US007842800B2

(12) United States Patent
Bentwich

(10) Patent No.: US 7,842,800 B2
(45) Date of Patent: Nov. 30, 2010

(54) BIOINFORMATICALLY DETECTABLE GROUP OF NOVEL REGULATORY BACTERIAL AND BACTERIAL ASSOCIATED OLIGONUCLEOTIDES AND USES THEREOF

(75) Inventor: Itzhak Bentwich, Kfar Daniel (IL)

(73) Assignee: Rosetta Genomics Ltd., Rehovot (IL)

( * ) Notice: Subject to any disclaimer, the term of this patent is extended or adjusted under 35 U.S.C. 154(b) by 379 days.

(21) Appl. No.: 10/708,951

(22) Filed: Apr. 2, 2004

(65) Prior Publication Data
US 2007/0042982 A1 Feb. 22, 2007

(51) Int. Cl.
*C07H 21/04* (2006.01)
(52) U.S. Cl. .................................. 536/24.5; 536/23.1
(58) Field of Classification Search ................ None
See application file for complete search history.

(56) References Cited

U.S. PATENT DOCUMENTS 5,541,308 A * 7/1996 Hogan et al. ............... 536/23.1
7,300,788 B2 * 11/2007 Matsuzaki et al. ......... 435/287.2
2005/0182005 A1 * 8/2005 Tuschl et al. ................ 514/44

OTHER PUBLICATIONS

Krutzfeldt et al. (2006) Nature Genetics 38:514-519.*
Bentwich et al. (2005) FEBS Lett. 579:5904-5910.*
Martin et al. (2007) J. Biosci. 32:1049-1052.*
Maziere et al. (2007) Drug Discovery Today 12:452-458.*
Smalheiser et al. (2006) Methods Mol. Biol. 342:115-127.*
Bahram et al. (1996) Immunogenetics 44:80-81.*
Buck et al (BioTechniques 27: 528-536, 1999).*
Kim et al. (1996) "Construction and characterization of a human bacterial artificial chromosome library" Genomics 34:213-218.*
GenBank Accession No. AC_011453 "*Homo sapiens* chromosome 19 clone CTC-339O9, complete sequence", as published online Jul. 14, 2002, retrieved from the Nation Center for Biotechnology Information [online] on Sep. 17, 2008 at ncbi.nlm.nih.gov/entrez.*
Online publication at [http://]genome.chop.edu/access/pages/repository/data/chr19/element_to_clone/element_to_clone.txt, retrieved Sep. 17, 2008.*
The International Human Genome Sequencing Consortium (2001) "Initial sequencing and analysis of the human genome" Nature 409:860-921.*
Scherr et al. (2003) Cell Cycle 2:3, pp. 251-257.*
Cullen (2004) "Derivation and function of small interfering RNAs and microRNAs" Viral Res. 102:3-9.*
Brown (1998) "In situ hybridization with riboprobes: An overview for veterinary pathologists" Vet. Pathol. 35:159-167.*
Bauer S, et al. Science, 1999;285:727-9.
Doench JG and Sharp PA. Genes Dev, 2004,18(5):504-11.
Lau NC, et al. Science, 2001;294:858-62.
Lagos-Quintana M, et al. Science, 2001;294:853-8.
Moss EG, et al. Cell, 1997;88:637-46.
Reinhart BJ, et al. Nature, 2000;43:901-6.
Slack FJ, et al. Mol Cell, 2000;5:659-69.
Wightman B, et al. Cell, 1993;75:855-62.
Lai EC, Micro RNAs are complimentary to 3' UTR sequence motifs that mediate negative post-transcriptional regulation. Nature Genetics 2002;30:363-4.
Enright AJ, MicoRNA targets in Drosophila, Genome Biology 2003;5:R1.
Lewis BP, Prediction of Mammalian MicroRNA Targets, Cell 2003;115:787-98.
Stark A, Identification of Drosophila MicroRNA Targets, PLoS Biology 2003;1(3):397-409.
Lai EC, Predicting and validating microRNA targets, Genome Biology 2004;5:115.
Vella MC, Architecture of a validated microRNA::target interaction, Chemistry & Biology 2004;11:1619-23.
Brennecke J, Principles of MicroRNA-target recognition, PLoS Biology 2005;3(3):e85.
Lim LP, Microarray analysis shows that some microRNAs downregulate large numbers of target mRNAs, Nature 2005;433(7027):769-73.
Busche A, Natural killer cell-mediated rejection of experimental human lung cancer by genetic overexpression of major histocompatibility complex class I chain-related gene A, Human Gene Therapy 2006;17:135-46.
Scherr et al. Lentivirus-mediated antagomir expression for specific inhibition of miRNA function. Nucleic Acids Res. 2007;35(22):e149.
Stern-Ginossar, N. et al. Human microRNAs regulate stress-induced immune responses mediated by the receptor NKG2D. Nature Immunology, 2008;9(9):1065-73.

* cited by examiner

*Primary Examiner*—Louis Wollenberger
(74) *Attorney, Agent, or Firm*—Polsinelli Shughart PC; Teddy C. Scott, Jr.; Paul A. Jenny

(57) ABSTRACT

The present invention relates to a first group of novel bacterial and human associated oligonucleotides, here identified as Genomic Address Messenger or GAM oligonucleotide, and a second group of novel operon-like bacterial and human polynucleotides, here identified as Genomic Record or GR polynucleotide. GAM oligonucleotides selectively inhibit translation of known 'target' genes, many of which are known to be involved in various bacterial diseases. Nucleic acid molecules are provided respectively encoding 6444 GAM precursors oligonucleotides, and 726 GR polynucleotides, as are vectors and probes both comprising the nucleic acid molecules, and methods and systems for detecting GAM oligonucleotides and GR polynucleotides and specific functions and utilities thereof, for detecting expression of GAM oligonucleotides and GR polynucleotides, and for selectively enhancing and selectively inhibiting translation of the respective target genes thereof.

6 Claims, 20 Drawing Sheets

FIG. 12B

| GAM Detection Group | Published Hairpins Detection | Background Hairpins Filtering | Lab Validation of Human GAMs ||| |
| --- | --- | --- | --- | --- | --- |
| | | | Sent | Positive | % Success |
| A | 382 | ~2850000 (95 %) | 101 | 37 | 37% |
| Overall | 440 | ~3000000 | 168 | 52 | 31% |

FIG. 13B

| NUMBER | NAME | SEQUENCE (5 TO 3) | SEQUENCED | Seq ID |
|---|---|---|---|---|
| 1 | hsa-miR-21 | TAGCTTATCAGACTGATGTTGA | + | 59825 |
| 2 | hsa-miR-27b | TTCACAGTGGCTAAGTTCTGCA | + | 59826 |
| 3 | hsa-miR-186 | AAAGAATTCTCCTTTTGGGCTT | + | 59827 |
| 4 | hsa-miR-93 | AAGTGCTGTTCGTGCAGGTAGT | + | 59828 |
| 5 | hsa-miR-26a | TCAAGTAATCCAGGATAGGCTG | + | 59829 |
| 6 | hsa-miR-191 | AACGGAATCCCAAAAGCAGCTG | + | 59830 |
| 7 | hsa-miR-31 | GGCAAGATGCTGGCATAGCTGT | + | 59831 |
| 8 | hsa-miR-92 | TATTGCACTTGTCCCGGCCTGT | + | 59832 |
| 9 | GAM3418-A | ATCACATTGCCAGGGATTACCA | + | 59833 |
| 10 | GAM4426-A | GAAGTTTGAAGCCTGTTGTTCA | + | 59834 |
| 11 | GAM281-A | CACTGCACTCCAGCCTGGGCAA |   | 59835 |
| 12 | GAM7553-A | TAGGTAGTTTCCTGTTGTTGGG | + | 59836 |
| 13 | GAM5385-A | TCACAGTGAACCGGTCTCTTTC | + | 59837 |
| 14 | GAM2608-A | TAAGGTGCATCTAGTGCAGTTA |   | 59838 |
| 15 | GAM1032-A | CTAGACTGAAGCTCCTTGAGGA | + | 59839 |
| 16 | GAM3431-A | TAATACTGCCGGGTAATGATGG |   | 59840 |
| 17 | GAM7933-A | TAGCAGCACATAATGGTTTGAA |   | 59841 |
| 18 | GAM3298-A | AAAGTGCTCATAGTGCAGGTAG | + | 59842 |
| 19 | GAM7080-A | TTTCCACAGCGGCCAATTCTTC | + | 59843 |
| 20 | GAM895-A | AGCTGCCAGTTGAAGAACATTT |   | 59844 |
| 21 | GAM3770-A | AAGTTAAGAGCTCCCAGGCCTG |   | 59845 |
| 22 | GAM337162-A | ACTGCACTCCAGCCTGGGCAAC | + | 59846 |
| 23 | GAM8678-A | GTGTTCCAGGAAGTCGTCTTGA |   | 59847 |
| 24 | GAM2033-A | TCAAGCTCATTCCTCTAACCTC |   | 59848 |
| 25 | GAM7776-A | CATTGCACTCCAGCCTGGGCAA | + | 59849 |
| 26 | GAM8145-A | ACATGATCTCCTCACTCTAGGA |   | 59850 |
| 27 | GAM25-A | AATTGCTTGAACCCAGGAAGTG | + | 59851 |
| 28 | GAM7352-A | TGTTTAAGTAGCTTATTTATCT |   | 59852 |
| 29 | GAM337624-A | TCTAAGAGAAAGGAAGTTCAGA | + | 59853 |
| 30 | GAM1479-A | GAAGGCAGTAGGTTGTATAGTT | + | 59854 |
| 31 | GAM2270-A | ATCACATTGCCAGTGATTACCC | + | 59855 |
| 32 | GAM7591-A | TTGGAGTAATTCAGTATAGGTT | + | 59856 |
| 33 | GAM8285-A | AGTAGACAGTGGCAACATAGTC |   | 59857 |
| 34 | GAM6773-A | CTAGCCTGTTTGTCCTCACCCC | + | 59858 |
| 35 | GAM336818-A | TGAGGTGGGATCCCGAGGCC | + | 59859 |
| 36 | GAM336487-A | TGGCTAGGTAAGGGAAG | + | 59860 |
| 37 | GAM337620-A | AATCATCATTATTTTGAAGTTTA | + | 59861 |
| 38 | GAM336809-A | T AAGGCATTTTT A TGGT | + | 59862 |
| 39 | GAM5346-A | GCTGTTGTTAAGGGCACTTGGG |   | 59863 |
| 40 | GAM8554-A | TTCATGGGAGCAGGTGGTACAG |   | 59864 |
| 41 | GAM2701-A | ACTGCACTCCAGTCTGGGTGAC |   | 59865 |
| 42 | GAM7957-A | TCACTGCAACCTCTGCCTCCCG |   | 59866 |
| 43 | GAM391-A | CAGATCACATCCATCCGTCACC |   | 59867 |
| 44 | GAM6633-A | GCACTCAAGCCTGGGTTACAGA |   | 59868 |
| 45 | GAM19 | AGAGAGTGGCAGGTCTGTTCCT |   | 59869 |
| 46 | GAM8358-A | GATGAGGCAGCACTTGGG |   | 59870 |
| 47 | GAM3229-A | TGAGGTGGGAGAATTGCTTGAA |   | 59871 |
| 48 | GAM7052-A | CATGTAATCCCAGCTACTCAGG |   | 59872 |
| 49 | GAM3027-A (mmu-MIR-29c) | TAGCACCATTTGAAATCGGTTA | + | 59873 |
| 50 | GAM21 (mmu-MIR-130b) | CAGTGCAATGATGAAAGGGCAT | + | 59874 |
| 51 | GAM oligonucleotide (mmu-MIR 30e) | TGTAAACATCCTTGACTGGAAG | + | 59875 |

FIG. 15A

EST72223 (705 nt.)

EST72223 sequence:

CCCTTATTAGAGGATTCTGCTCATGCCAGGG<u>TGAGGTAGTAAGTTGTATTG</u>
<u>TT</u>GTGGGGTAGGGATATTAGGCCCCAATTAGAAGATAACTATACAACT  MIR98
TACTACTTTCCCTGGTGTGTGGCATATTCACACTTAGTCTTAGCAGTGTTGCC
TCCATCAGACAAAGTTGTAGATGTTCCTTGGATAATTTGGACTGGAAGAAAAGA
GACATGGAAGGGGACAGATGGTGTTTAGGGTGAGGCAGATGTCATTATAAAGT
GACTTGTCTTTCATTAATTGGAGCATATAATTATTTTACCTTTGGGCATGAACTC
ATTTTGCTATTCTTCAACTGTGTAATGATTGCATTTTATTAGTAATAGAACAGGA
ATGTGTGCAAGGGAATGGAAAGCATACTTTAAGAATTTTGGGCCAGGCGCGGT
GGTTCATGCCTGTAATCCCAGCATTTTTGGGAGGCCGAGGCGGGTGGATCAC
CTGAGGTCAGGAGTTCGAGACCAACCTGGCCAACACGGCGAAACCCCGCCTC
TACTCAAATACAAAAATTAGCCAGGCTTGGTGACACTCGCCTGTGGTCCCAGC
TACTCAGGAGGCTGAGGCAGGAGAATTGCTTGAACCCAGGAAGTGGAG  GAM25
GCTTCAGTGAGCTGAGAACACGCCACTGCACTCCAGTCCTGGGCAAC
AGAGCAAGACTCTGTCTCAGGAAAAAAAAAG

FIG. 15B

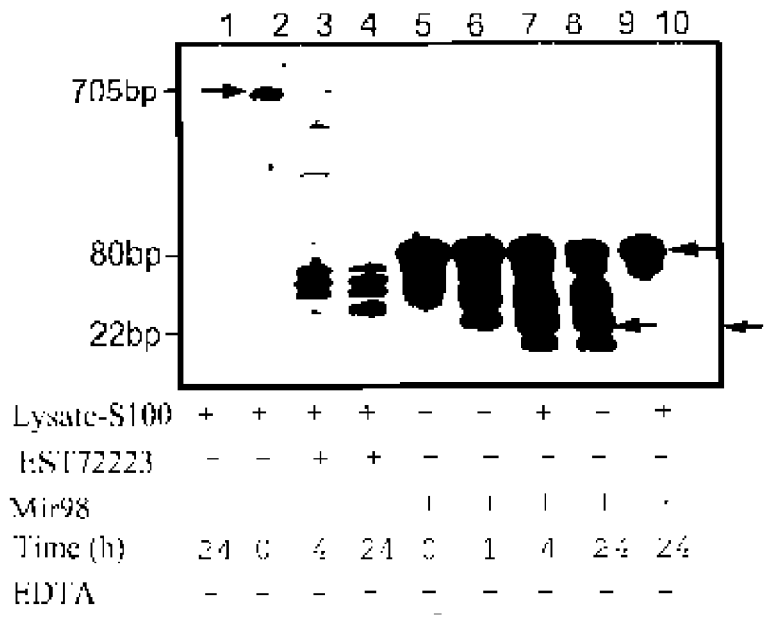

BIOINFORMATICALLY DETECTABLE GROUP OF NOVEL REGULATORY BACTERIAL AND BACTERIAL ASSOCIATED OLIGONUCLEOTIDES AND USES THEREOF

REFERENCES CITED

Altschul, S. F., Gish, W., Miller, W., Myers, E. W., and Lipman, D. J. (1990). Basic local alignment search tool. J. Mol. Biol. 215, 403-410.

Ambros, V., Lee, R. C., Lavanway, A., Williams, P. T., and Jewell, D. (2003). MicroRNAs and Other Tiny Endogenous RNAs in C. elegans 1. Curr. Biol. 13, 807-818.

Dan Gusfield, Algorithms on strings, trees, and sequences: computer science and computational biology, Cambridge University Press, 1997.

Elbashir, S. M., Lendeckel, W., and Tuschl, T. (2001). RNA interference is mediated by 21- and 22-nucleotide RNAs. Genes Dev. 15, 188-200.

Gibbs, W. W. (2003). The unseen genome: gems among the junk. Sci. Am. 289, 46-53.

Gussow, D. and Clackson, T. (1989). Direct clone characterization from plaques and colonies by the polymerase chain reaction. Nucleic Acids Res. 17, 4000.

Hamosh A, Scott A F, Amberger J, Bocchini C, Valle D and McKusick V A. (2002). Online Mendelian Inheritance in Man (OMIM), a knowledgebase of human genes and genetic disorders. Nucleic Acids Res. 30: 52-55.

Jenuth, J. P. (2000). The NCBI. Publicly available tools and resources on the Web. Methods Mol. Biol. 132, 301-312.

Kirkness, E. F. and Kerlavage, A. R. (1997). The TIGR human cDNA database. Methods Mol. Biol. 69, 261-268.

Lagos-Quintana, M., Rauhut, R., Lendeckel, W., and Tuschl, T. (2001). Identification of novel genes coding for small expressed RNAs. Science 294, 853-858.

Lau, N. C., Lim, L. P., Weinstein, E. G., and Bartel, D. P. (2001). An abundant class of tiny RNAs with probable regulatory roles in Caenorhabditis elegans. Science 294, 858-862.

Lau, N. C. and Bartel, D. P. (2003). Censors of the genome. Sci. Am. 289, 34-41.

Lim, L. P., Glasner, M. E., Yekta, S., Burge, C. B., and Bartel, D. P. (2003). Vertebrate microRNA genes. Science 299, 1540.

Mathews, D. H., Sabina, J., Zuker, M., and Turner, D. H. (1999). Expanded sequence dependence of thermodynamic parameters improves prediction of RNA secondary structure. J. Mol. Biol. 288, 911-940.

Reinhart, B. J., Slack, F. J., Basson, M., Pasquinelli, A. E., Bettinger, J. C., Rougvie, A. E., Horvitz, H. R., and Ruvkun, G. (2000). The 21-nucleotide let-7 RNA regulates developmental timing in Caenorhabditis elegans. Nature 403, 901-906.

Southern, E. M. (1992). Detection of specific sequences among DNA fragments separated by gel electrophoresis. 1975. Biotechnology 24, 122-139.

Tom M. Mitchell, Machine Learning, McGraw Hill, 1997.

Wightman, B., Ha, I., and Ruvkun, G. (1993). Posttranscriptional regulation of the heterochronic gene lin-14 by lin-4 mediates temporal pattern formation in C. elegans. Cell 75, 855-862.

Zhang, H., Kolb, F. A., Brondani, V., Billy, E., and Filipowicz, W. (2002). Human Dicer preferentially cleaves dsRNAs at their termini without a requirement for ATP. EMBO J. 21, 5875-5885.

Zuker, M. (2003). M fold web server for nucleic acid folding and hybridization prediction. Nucleic Acids Res. 31, 3406-3415.

BACKGROUND OF THE INVENTION

1. Field of the Invention

The present invention relates to a group of bioinformatically detectable novel bacterial oligonucleotides and to a group of bioinformatically detectable novel human oligonucleotides associated with bacterial infections, both are identified here as Genomic Address Messenger or GAM oligonucleotides.

All of which are believed to be related to the micro RNA (miRNA) group of oligonucleotides.

2. Description of Prior Art

Micro RNAs (miRNA), are short ~22 nt non-coding regulatory RNA oligonucleotides, found in a wide range of species, believed to function as specific gene translation repressors, sometimes involved in cell-differentiation.

The ability to detect novel miRNAs is limited by the methodologies used to detect such oligonucleotides. All miRNAs identified so far either present a visibly discernable whole body phenotype, as do Lin-4 and Let-7 (Wightman, B., Ha, I., and Ruvkun, G., Cell 75:855-862 (1993); Reinhart et al. Nature 403: 901-906 (2000)), or produce sufficient quantities of RNA so as to be detected by the standard molecular biological techniques.

Studies reporting miRNAs (Lau et al., Science 294:858-862 (2001), Lagos-Quintana et al., Science 294: 853-858 (2001)) discovered 93 miRNAs in several species, by sequencing a limited number of clones (300 by Lau and 100 by Lagos-Quintana) of small segments (i.e. size fractionated) RNA. miRNAs detected in these studies therefore, represent the more prevalent among the miRNA oligonucleotide family, and can not be much rarer than 1% of all small ~20 nt-long RNA oligonucleotides.

The aforesaid studies provide no basis for detection of miRNA oligonucleotides which either do not present a visually discernable whole body phenotype, or are rare (e.g. rarer than 0.1% of all size fractionated ~20 nt-long RNA segments expressed in the tissues examined), and therefore do not produce significant enough quantities of RNA so as to be detected by standard biological techniques. To date, miRNAs have not been detected in bacteria.

The following U.S. patents relate to bioinformatic detection of genes: U.S. Pat. No. 348,935, entitled "Statistical algorithms for folding and target accessibility prediction and design of nucleic acids", U.S. Pat. No. 6,369,195, entitled "Prostate-specific gene for diagnosis, prognosis and management of prostate cancer", and U.S. Pat. No. 6,291,666 entitled "Spike tissue-specific promoter", each of which is hereby incorporated by reference herein.

BRIEF DESCRIPTION OF SEQUENCE LISTING, LARGE TABLES AND COMPUTER PROGRAM LISTING

A sequence listing is attached to the present invention, comprising 59824 genomic sequences, is contained in a file named SEQ_LIST.txt (9477 KB, 01-Apr-04), and is hereby incorporated by reference herein.

Large tables relating to genomic sequences are attached to the present application, appear in 10 table files (size, creation date), incorporated herein: TABLE1.txt (1824 KB, 01-Apr-04); TABLE2.txt (70377 KB, 01-Apr-04); TABLE3.txt (733 KB, 01-Apr-04); TABLE4.txt (3621 KB, 01-Apr-04), TABLE5.txt (660 KB, 01-Apr-04), TABLE6.txt (3556 KB, 01-Apr-04) and TABLE7.txt (8434 KB, 01-Apr-04), TABLE8.txt (23003 KB, 01-Apr-04), TABLE9.txt (29018 KB, 01-Apr-04) and TABLE10.txt (5265 KB, 01-Apr-04), all of which are incorporated by reference herein.

LENGTHY TABLES

The patent contains a lengthy table section. A copy of the table is available in electronic form from the USPTO web site (http://seqdata.uspto.gov/?pageRequest=docDetail&DocID=US07842800B2). An electronic copy of the table will also be available from the USPTO upon request and payment of the fee set forth in 37 CFR 1.19(b)(3).

A computer program listing of a computer program constructed and operative in accordance with a preferred embodiment of the present invention is enclosed on an electronic medium in computer readable form, and is hereby incorporated by reference herein. The computer program listing is contained in 6 files, the name, sizes and creation date of which are as follows: AUXILARY_FILES.txt (117K, 14-Nov-03); EDIT_DISTANCE.txt (144K, 24-Nov-03); FIRST-K.txt (96K, 24-Nov-03); HAIRPIN_PREDICTION.txt (19K, 25-Mar-04); TWO_PHASED_SIDE_SELECTOR.txt (4K, 14-Nov-03); and TWO_PHASED_PREDICTOR.txt (74K, 14-Nov-03).

SUMMARY OF THE INVENTION

The present invention relates to an isolated nucleic acid selected from the group consisting of (a) SEQ ID NO: 55663, (b) a DNA encoding the nucleic acid of (a), wherein the DNA is identical in length to (a); and (c) the complement of (a) or (b), wherein the complement is identical in length to the nucleic acid of (a) or (b). Additionally, the present invention relates to vectors or probes comprising a human insert, wherein the human insert consists of the nucleic acid selected from the group consisting of (a) SEQ ID NO: 55663, (b) a DNA encoding the nucleic acid of (a), wherein the DNA is identical in length to (a); and (c) the complement of (a) or (b), wherein the complement is identical in length to the nucleic acid of (a) or (b), and wherein the vector or probe comprises no other insert but the nucleic acid as described above.

The present invention also relates to an isolated nucleic acid selected from the group consisting of (a) SEQ ID NO: 1485, (b) a DNA encoding the nucleic acid of (a), wherein the DNA is identical in length to (a); and (c) the complement of (a) or (b), wherein the complement is identical in length to the nucleic acid of (a) or (b). Additionally, the present invention relates to vectors or probes comprising a human insert, wherein the human insert consists of the nucleic acid selected from the group consisting of (a) SEQ ID NO: 1485, (b) a DNA encoding the nucleic acid of (a), wherein the DNA is identical in length to (a); and (c) the complement of (a) or (b), wherein the complement is identical in length to the nucleic acid of (a) or (b), and wherein the vector or probe comprises no other insert but the nucleic acid as described above.

BRIEF DESCRIPTION OF DRAWINGS

FIG. 12B is a table summarizing laboratory validation results which validate efficacy of a bioinformatic oligonucleotide detection system constructed and operative in accordance with a preferred embodiment of the present invention;

FIG. 13A and FIG. 13B are a picture and a summary table of laboratory results validating the expression of novel human oligonucleotides detected by a bioinformatic oligonucleotide detection engine constructed and operative in accordance with a preferred embodiment of the present invention, thereby validating the efficacy of the oligonucleotide detection engine of the present invention;

FIG. 15A is an annotated sequence of EST72223 (SEQ ID NO: 59887) comprising known human miRNA oligonucleotide MIR98 and novel human oligonucleotide GAM25 PRECURSOR detected by the oligonucleotide detection system of the present invention; and FIGS. 15B, 15C and 15D are pictures of laboratory results demonstrating laboratory confirmation of expression of known human oligonucleotide MIR98 and of novel bioinformatically detected human GAM25 RNA respectively, both of FIG. 15A, thus validating the bioinformatic oligonucleotide detection system of the present invention;

BRIEF DESCRIPTION OF SEQUENCES

Figure 1:
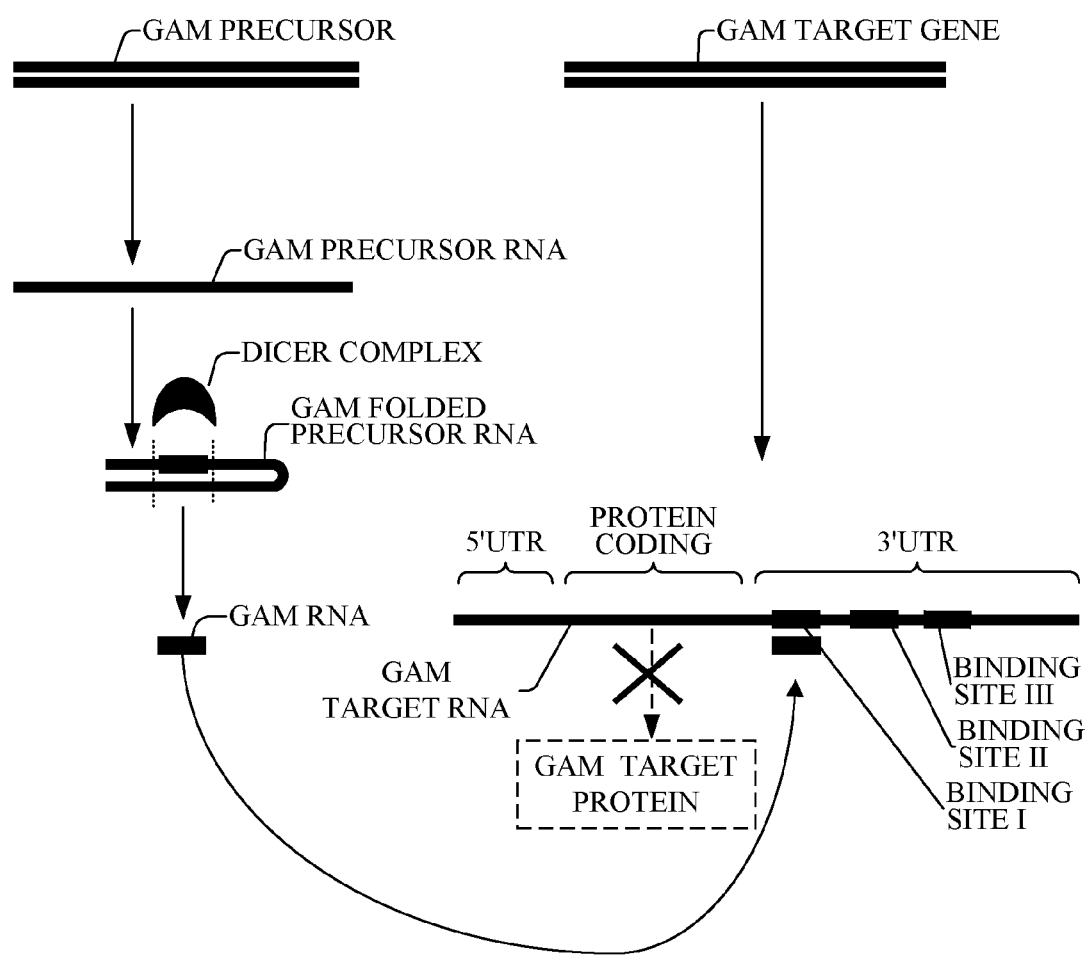
FIG. 1 is a simplified diagram illustrating a mode by which oligonucleotide of a novel group of oligonucleotides of the present invention modulates expression of known target genes.

A Sequence Listing of genomic sequences of the present invention designated SEQ ID NO:1 through SEQ ID: 59824 is attached to this application, and is hereby incorporated herein. The genomic listing comprises the following nucleotide sequences: nucleotide sequences of 6444 GAM precursors of respective novel oligonucleotides of the present invention; nucleotide sequences of 6456 GAM RNA oligonucleotides of respective novel oligonucleotides of the present invention; and nucleotide sequences of 13640 target gene binding sites of respective novel oligonucleotides of the present invention.

DETAILED DESCRIPTION

The present invention relates to a novel group of bioinformatically detectable bacterial regulatory RNA oligonucleotides, which repress expression of human target genes, by means of complementary hybridization to binding sites in untranslated regions of these target genes. It is believed that this novel group of bacterial oligonucleotides represents a pervasive bacterial mechanism of attacking a host, and therefore knowledge of this novel group of bacterial oligonucleotides may be useful in preventing and treating bacterial diseases.

Additionally, the present invention relates to a novel group of bioinformatically detectable human regulatory RNA oligonucleotides, which repress expression of human target genes associated with the bacterial infection, by means of complementary hybridization to binding sites in untranslated regions of these target genes. It is believed that this novel group of human oligonucleotides represents a pervasive novel host response mechanism, and therefore knowledge of this novel group of human oligonucleotides may be useful in preventing and treating bacterial diseases. In various preferred embodiments, the present invention seeks to provide improved method and system for detection and prevention of bacterial diseases, which are mediated by this group of novel oligonucleotides.

Accordingly, the invention provides several substantially pure nucleic acids (e.g., genomic DNA, cDNA or synthetic DNA) each comprising a novel GAM oligonucleotide, vectors comprising the DNAs, probes comprising the DNAs, a method and system for selectively modulating translation of known human target genes utilizing the vectors, and a method and system utilizing the CAM probes to modulate expression of human target genes.

The present invention represents a scientific breakthrough, disclosing novel miRNA-like oligonucleotides the number of which is dramatically larger than previously believed existed. Prior-art studies reporting miRNAs ((Lau et al., Science 294358-862 (2001), Lagos-Quintana et al., Science 294: 853-858 (2001)) discovered 93 miRNAs in several species, including 21 in human, using conventional molecular biology methods, such as cloning and sequencing.

Molecular biology methodologies employed by these studies are limited in their ability to detect rare miRNA oligonucleotides, since these studies relied on sequencing of a limited number of clones (300 clones by Lau and 100 clones by Lagos-Quintana) of small segments (i.e. size fractionated) of RNA. MicroRNAs detected in these studies therefore, represent the more prevalent among the miRNA oligonucleotide family, and are typically not be much rarer than 1% of all small -20 nt-long RNA oligonucleotides present in the tissue from the RNA was extracted. Recent studies state the number of miRNA oligonucleotides to be limited, and describe the limited sensitivity of available methods for detection of miRNA: The estimate of 255 human miRNA oligonucleotides is an upper bound implying that no more than 40 miRNA oligonucleotides remain to be identified in mammals (Lim et al., Science, 299:1540 (2003)); Estimates place the total number of vertebrate miRNA genes at about 200-250 (Ambros et al. Curr. Biol. 13307-818 (2003)); and Confirmation of very low abundance miRNAs awaits the application of detection methods more sensitive than Northern blots (Ambros et al. Curr. Biol. 13307-818 (2003)).

The oligonucleotides of the present invention represent a revolutionary new dimension of genomics and of biology: a dimension comprising a huge number of non-protein coding oligonucleotides which modulate expression of thousands of proteins and are associated with numerous major diseases. This new dimension disclosed by the present invention dismantles a central dogma that has dominated life-sciences during the past 50 years, a dogma which has emphasized the importance of protein coding regions of the genome, holding non-protein coding regions to be of little consequence, often dubbing them junk DNA.

Indeed, only in November, 2003 has this long held belief as to the low importance of non-protein coding regions been vocally challenged. As an example, an article titled The Unseen Genome -Gems in the Junk (Gibbs, W.W. Sci. Am. 289:46-53 (2003)) asserts that the failure to recognize the importance of non-protein- coding regions may well go down as one of the biggest mistakes in the history of molecular biology. Gibbs further asserts that what was considered junk because it was not understood, may in fact turn out to be the very basis of human complexity. The present invention provides a dramatic leap in understanding specific important roles of non-protein coding regions.

An additional scientific breakthrough of the present invention is a novel conceptual model disclosed by the present invention, which conceptual model is preferably used to encode in a genome the determination of cell differentiation, utilizing oligonucleotides and polynucleotides of the present invention.

In various preferred embodiments, the present invention seeks to provide an improved method and system for specific modulation of the expression of specific target genes involved in significant human diseases. It also provides an improved method and system for detection of the expression of novel oligonucleotides of the present invention, which modulate these target genes. In many cases the target genes may be known and fully characterized, however in alternative embodiments of the present invention, unknown or less well characterized genes may be targeted.

A Nucleic acid is defined as a ribonucleic acid (RNA) molecule, or a deoxyribonucleic acid (DNA) molecule, or complementary deoxyribonucleic acid (cDNA), comprising either naturally occurring nucleotides or non-naturally occurring nucleotides. Substantially pure nucleic acid, Isolated Nucleic Acid, Isolated Oligoucleotide and Isolated Polynucleotide are defined as a nucleic acid that is free of the genome of the organism from which the nucleic acid is derived, and include, for example, a recombinant nucleic acid which is incorporated into a vector, into an autonomously replicating plasmid or virus, or into the genomic nucleic acid of a prokaryote or eukaryote at a site other than its natural site; or which exists as a separate molecule (e.g., a cDNA or a genomic or cDNA fragment produced by PCR or restriction endonuclease digestion) independent of other nucleic acids. An Oligonucleotide is defined as a nucleic acid comprising 2-139 nucleotides, or preferably 16-120 nucleotides. A Polynucleotide is defined as a nucleic acid comprising 140-5000 nucleotides, or preferably 140-1000 nucleotides.

A Complementary sequence is defined as a first nucleotide sequence which reverses complementary of a second nucleotide sequence: the first nucleotide sequence is reversed relative to a second nucleotide sequence, and wherein each nucleotide in the first nucleotide sequence is complementary to a corresponding nucleotide in the second nucleotide sequence (e.g. ATGGC is the complementary sequence of GCCAT).

Hybridization, Binding and Annealing are defined as hybridization, under in-vivo physiologic conditions, of a first nucleic acid to a second nucleic acid, which second nucleic acid is at least partially complementary to the first nucleic acid. A Hairpin Structure is defined as an oligonucleotide having a nucleotide sequence that is 50-140 nucleotides in length, the first half of which nucleotide sequence is at least partially complementary to the second part thereof, thereby causing the nucleic acid to fold onto itself, forming a secondary hairpin structure.

A Hairpin Shaped Precursor is defined as a Hairpin Structure which is processed by a Dicer enzyme complex, yielding an oligonucleotide which is about 19 to about 24 nucleotides in length. "Inhibiting translation" is defined as the ability to prevent synthesis of a specific protein encoded by a respective gene by means of inhibiting the translation of the mRNA of this gene. For example, inhibiting translation may include the following steps: (1) a DNA segment encodes an RNA, the first half of whose sequence is partially complementary to the second half thereof; (2) the precursor folds onto itself forming a hairpin-shaped precursor; (3) a Dicer enzyme complex cuts the hairpin shaped precursor yielding an oligonucleotide that is approximately 22 nt in length; (4) the oligonucleotide binds complementarily to at least one binding site, having a nucleotide sequence that is at least partially complentary to the oligonucleotide, which binding site is located in the mRNA of a target gene, preferably in the untranslated region (UTR) of a target gene, such that the binding inhibits translation of the target protein.

A "Translation inhibitor site" is defined as the minimal nucleotide sequence sufficient to inhibit translation.

There is thus provided in accordance with a preferred embodiment of the present invention a bioinformatically detectable isolated oligonucleotide which is endogenously processed from a hairpin-shaped precursor, and anneals to a portion of a mRNA transcript of a target gene, wherein binding of the oligonucleotide to the mRNA transcript represses expression of the target gene, and wherein the oligonucleotide has at least 80% sequence identity with a nucleotide sequence selected from the group consisting of SEQ ID NOS: 1-6456.

There is further provided in accordance with another preferred embodiment of the present invention a bioinformatically detectable isolated oligonucleotide having a nucleotide sequence selected from the group consisting of SEQ ID NOS: 1-6456.

There is still further provided in accordance with another preferred embodiment of the present invention a bioinformatically detectable first oligonucleotide which is a portion of a mRNA transcript of a target gene, and anneals to a second oligonucleotide that is endogenously processed from a hairpin precursor, wherein binding of the first oligonucleotide to the second oligonucleotide represses expression of the target gene, and wherein nucleotide sequence of the second nucleotide is selected from the group consisting of SEQ ID NOS: 1-6456.

There is additionally provided in accordance with another preferred embodiment of the present invention a bioinformatically detectable oligonucleotide having a nucleotide sequence selected from the group consisting of SEQ ID NOS: 1-6456.

There is moreover provided in accordance with another preferred embodiment of the present invention a bioinformatically detectable isolated oligonucleotide which anneals to a portion of a mRNA transcript of a target gene associated with *Escherichia coli* CFT073 infection, wherein binding of the oligonucleotide to the mRNA transcript represses expression of the target gene, and wherein the oligonucleotide has at least 80% sequence identity with a nucleotide sequence selected from the group consisting of: (a) a sequence selected from the group consisting of SEQ ID NOS: 6 and 7044-8222, and (b) the complement of a sequence selected from the group consisting of SEQ ID NOS: 19991 and 18424-2 1435.

There is further provided in accordance with another preferred embodiment of the present invention a bioinformatically detectable first oligonucleotide which is a portion of a mRNA transcript of a target gene associated with Escherichia coli CFT073, and anneals to a second oligonucleotide that is endogenously processed from a hairpin precursor, wherein binding of the first oligonucleotide to the second oligonucleotide represses expression of the target gene, and wherein nucleotide sequence of the second nucleotide is selected from the group consisting of SEQ ID NOS: 6 and 7044-8222.

There is still further provided in accordance with another preferred embodiment of the present invention a bioinformatically detectable isolated oligonucleotide which anneals to a portion of a mRNA transcript of a target gene associated with Mycobacterium avium subsp. paratuberculosis infection, wherein binding of the oligonucleotide to the mRNA transcript represses expression of the target gene, and wherein the oligonucleotide has at least 80% sequence identity with a nucleotide sequence selected from the group consisting of: (a) a sequence selected from the group consisting of SEQ ID NOS: 1, 2, 3, 4, 5 and 8468-10252, and (b) the complement of a sequence selected from the group consisting of SEQ ID NOS: 24070, 24503, 24604, 24799, 24951 and 21948-25640.

There is additionally provided in accordance with another preferred embodiment of the present invention a bioinformatically detectable first oligonucleotide which is a portion of a mRNA transcript of a target gene associated with Mycobacterium avium subsp. paratuberculosis, and anneals to a second oligonucleotide that is endogenously processed from a hairpin precursor, wherein binding of the first oligonucleotide to the second oligonucleotide represses expression of the target gene, and wherein nucleotide sequence of the second nucleotide is selected from the group consisting of SEQ ID NOS: 1, 2, 3, 4, 5 and 8468-10252.

There is moreover provided in accordance with another preferred embodiment of the present invention a bioinformatically detectable isolated oligonucleotide which anneals to a portion of a mRNA transcript of a target gene associated with *Mycobacterium bovis* subsp *bovis* AF2122197 infection, wherein binding of the oligonucleotide to the mRNA transcript represses expression of the target gene, and wherein the oligonucleotide has at least 80% sequence identity with a nucleotide sequence selected from the group consisting of: (a) a sequence selected from the group consisting of SEQ ID NOS: 1, 2, 3, 4, 5 and 10253-11953, and (b) the complement of a sequence selected from the group consisting of SEQ ID NOS: 26741, 27115, 27315, 27443, 27664, 28350 and 25641-29147.

There is further provided in accordance with another preferred embodiment of the present invention a bioinformatically detectable first oligonucleotide which is a portion of a mRNA transcript of a target gene associated with *Mycobacterium bovis* subsp *bovis*AF2122197, and anneals to a second oligonucleotide that is endogenously processed from a hairpin precursor, wherein binding of the first oligonucleotide to the second oligonucleotide represses expression of the target gene, and wherein nucleotide sequence of the second nucleotide is selected from the group consisting of SEQ ID NOS: 1, 2, 3, 4, 5 and 10253-11953.

There is still further provided in accordance with another preferred embodiment of the present invention a bioinformatically detectable isolated oligonucleotide which anneals to a portion of a mRNA transcript of a target gene associated with *Mycobacterium tuberculosis* CDC15 5 1 infection, wherein binding of the oligonucleotide to the mRNA transcript represses expression of the target gene, and wherein the oligonucleotide has at least 80% sequence identity with a nucleotide sequence selected from the group consisting of: (a) a sequence selected from the group consisting of SEQ ID NOS:1, 2, 3, 4, 5 and 12752-14275, and (b) the complement of a sequence selected from the group consisting of SEQ ID NOS: 32492, 33020, 33133, 33366, 33675 and 30886-33928.

There is additionally provided in accordance with another preferred embodiment of the present invention a bioinformatically detectable first oligonucleotide which is a portion of a mRNA transcript of a target gene associated with *Mycobacterium tuberculosis* CDC15 51, and anneals to a second oligonucleotide that is endogenously processed from a hairpin precursor, wherein binding of the first oligonucleotide to the second oligonucleotide represses expression of the target gene, and wherein nucleotide sequence of the second nucleotide is selected from the group consisting of SEQ ID NOS: 1, 2, 3, 4, 5 and 12752-14275.

There is moreover provided in accordance with another preferred embodiment of the present invention a method for bioinformatic detection of microRNA oligonucleotides, the method including: bioinformatically detecting a hairpin shaped precursor oligonucleotide, bioinformatically detecting an oligonucleotide which is endogenously processed from the hairpin shaped precursor oligonucleotide, and bioinformatically detecting a target gene of the oligonucleotide wherein the oligonucleotide anneals to at least one portion of a mRNA transcript of the target gene, and wherein the binding represses expression of the target gene, and the target gene is associated with a disease.

Reference is now made to FIG. 1, which is a simplified diagram describing a plurality of novel bioinformatically detected oligonucleotide of the present invention referred to here as Genomic Address Messenger (GAM) oligonucleotide, which modulates expression of respective target genes whose function and utility is known in the art.

GAM is a novel bioinformatically detectable regulatory, non protein coding, microRNA (miRNA)-like oligonucleotide. The method by which GAM is detected is described with additional reference to FIGS. 1-8.

GAM PRECURSOR is preferably encoded by a bacterial genome. Alternatively or additionally GAM PRECURSOR is preferably encoded by the human genome. GAM TARGET GENE is a gene encoded by the human genome.

GAM PRECURSOR encodes a GAM PRECURSOR RNA. Similar to other miRNA oligonucleotides GAM PRECURSOR RNA does not encode a protein.

GAM PRECURSOR RNA folds onto itself, forming GAM FOLDED PRECURSOR RNA which has a two-dimensional 'hairpin structure'. As is well known in the art, this 'hairpin structure', is typical of RNA encoded by known miRNA oligonucleotides, and is due to the fact that the nucleotide sequence of the first half of the RNA encoded by a miRNA oligonucleotide is a fully or partially complementary sequence of the nucleotide sequence of the second half thereof. By complementary is meant a sequence which is reversed and wherein each nucleotide is replaced by a complementary nucleotide, as is well known in the art (e.g. ATGGC is the complementary sequence of GCCAT). An enzyme complex designated DICER COMPLEX, 'dices' the GAM FOLDED PRECURSOR RNA yielding a GAM RNA in the form of a single stranded ~22 nt long RNA segment. As is known in the art, 'dicing' of a hairpin structured RNA precursor product to yield a short ~22 nt RNA segment is catalyzed by an enzyme complex Dicer RNaseIII together with other necessary proteins.

GAM TARGET GENE encodes a corresponding messenger RNA, GAM TARGET RNA. Each of the GAM TARGET RNAs of the present invention comprises three regions, as is typical of mRNA of a protein coding gene: a 5 untranslated region, a protein coding region and a 3' untranslated region, designated 5'UTR, PROTEIN CODING and 3'UTR respectively.

GAM RNA binds complementarily to one or more target binding sites located in untranslated regions of each of the GAM TARGET RNAs of the present invention. This complementary binding is due to the fact that the nucleotide sequence of GAM RNA is a partial or fully complementary sequence of the nucleotide sequence of each of the target binding sites. As an illustration, FIG. 1 shows three such target binding sites, designated BINDING SITE I, BINDING SITE II and BINDING SITE III respectively. It is appreciated that the number of target binding sites shown in FIG. 1 is only illustrative and that any suitable number of target binding sites may be present. It is further appreciated that although FIG. 1 shows target binding sites only in the 3'UTR region these target binding sites may be located instead in the 5'UTR region or in both 3'UTR and 5'UTR regions.

The complementary binding of GAM RNA to target binding sites on GAM TARGET RNA, such as BINDING SITE I, BINDING SITE II and BINDING SITE III, inhibits translation of each of the GAM TARGET RNAs of the present invention into GAM TARGET PROTEIN, which is shown surrounded by a broken line.

It is appreciated that GAM TARGET GENE in fact represents a plurality of GAM target genes. The mRNA of each one of this plurality of GAM target genes comprises one or more target binding sites, each having a nucleotide sequence which is at least partly complementary to GAM RNA and which when bound by GAM RNA causes inhibition of translation of the GAM target mRNA into a corresponding GAM target protein.

The mechanism of the translational inhibition exerted by GAM RNA on one or more GAM TARGET GENEs may be similar or identical to the known mechanism of translational inhibition exerted by known miRNA oligonucleotides.

The nucleotide sequences of each of a plurality of GAM oligonucleotides described by FIG. 1 and their respective genomic sources and genomic locations are set forth in Tables 1-3, hereby incorporated herein. Specifically, in Table 1, line 3060, 20697, 24356 and 28626 describes GAM RNA (miRNA) as set forth in SEQ ID NOs:1485, 9423, 10931, 12760 respectively is shown as predicted from human.

| GAM SEQ-ID | GAM NAME | GAM RNA SEQUENCE | GAM ORGANISM | GAM POS |
|---|---|---|---|---|
| 1485 | GAM338499 | AAAGTGCTTCTCTTTGGTGGGT | Human | A |
| 9423 | GAM338499 | AAAGTGCTTCTCTTTGGTGGGT | Human | A |
| 10931 | GAM338499 | AAAGTGCTTCTCTTTGGTGGGT | Human | A |
| 12760 | GAM338499 | AAAGTGCTTCTCTTTGGTGGGT | Human | A |

In Table 2, lines 227057-227161, describes GAM PRECURSOR RNA (hairpin) as set forth in SEQ ID NO: 55663 and as it relates to FIGS. 1-8.

| GAM NAME | GAM ORGANISM | PRECUR SEQ-ID | PRECURSOR SEQUENCE | GAM DESCRIPTION |
|---|---|---|---|---|
| GAM 338499 | Human | 55663 | TCTCAAGCTG TGAGTCTACA AAGGGAAGCC CTTTCTGTTG CTTTCTGTTG TCTAAAAGAA AAGAAAGTGC TTCTCTTTGG TGGGTTACGG TTTGAGA | FIG. 1 further provides a conceptual description of another novel bioinformatically detected human oligonucleotide of the present invention referred to here as Genomic Address Messenger 338499 (GAM338499) oligonucleotide, which modulates expression of respective target genes whose function and utility is known in the art. GAM338499 is a novel bioinformatically detectable regulatory, non protein coding, microRNA (miRNA)-like oligonucleotide. The method by which GAM338499 is detected is described with additional reference to FIGS. 1-8. GAM338499 precursor, herein designated GAM PRECURSOR, is encoded by the Human genome. GAM338499 target gene, herein designated GAM TARGET GENE, is a target gene encoded by the human genome. GAM338499 precursor, herein designated GAM PRECURSOR, encodes a GAM338499 precursor RNA, herein designated GAM PRECURSOR RNA. Similar to other miRNA oligonucleotides GAM338499 precursor RNA does not encode a protein. GAM338499 precursor RNA Folds onto itself, forming GAM338499 folded precursor RNA, Herein designated GAM FOLDED PRECURSOR RNA, which has a two-dimensional 'hairpin structure'. As is well known in the art, this 'hairpin structure', is typical of RNA encoded by known miRNA oligonucleotides, and is due to the fact that the nucleotide sequence of first half of the RNA encodedby a miRNA oligonucleotide is a fully or partially complementary sequence of the nucleotide sequence of the second half thereof. A nucleotide sequence identical or highly similar to the nucleotide sequence of GAM338499 precursor RNA is designated SEQ ID NO: 55663, and is provided hereinbelow with reference to the sequence listing part. Nucleotide sequence SEQ ID NO: 55663 is located from position 58915162 to position 58915248 relative to chromosome 19 on the '+' strand. A schematic representation of a predicted secondary folding of GAM338499 folded precursor RNA, herein designated GAM FOLDED PRECURSOR RNA, is set forth in Table 4 incorporated herein. An enzyme complex designated DICER COMPLEX, 'dices' the GAM338499 |

| GAM NAME | GAM ORGANISM | PRECUR SEQ-ID | PRECURSOR SEQUENCE | GAM DESCRIPTION |
|---|---|---|---|---|
| | | | | folded precursor RNA yielding a GAM338499 RNA, herein designated GAM RNA, in the form of a single stranded ~22nt long RNA segment. As is known in the art, 'dicing' of a hairpin structured RNA precursor product to yield a short ~22nt RNA segment is catalyzed by an enzyme complex Dicer RNaseIII together with other necessary proteins. Table 5 provides a nucleotide sequence that is highly likely to be identical or highly similar to the nucleotide sequence of GAM338499 RNA, hereby incorporated herein. GAM338499 target gene, herein designated GAM TARGET GENE, encodes a corresponding messenger RNA, GAM338499 target RNA, herein designated TARGET RNA. GAM338499 target RNA comprises three regions, as is typical of mRNA of a protein coding gene: a 5' untranslated region, a protein coding region and a 3' untranslated region, designated 5'UTR, PROTEIN CODING and 3'UTR respectively. GAM338499 RNA, herein designated GAM RNA, binds complementarily to one or more target binding sites located in untranslated regions of GAM338499 target RNA. This complementary binding is due to the fact that the nucleotide sequence of GAM338499 RNA is a partial or fully complementary sequence of the nucleotide sequence of each of the target binding sites. As an illustration, FIG. 1 shows three such target binding sites, designated BINDING SITE I, BINDING SITE II and BINDING SITE III respectively. It is appreciated that the number of target binding sites shown in FIG. 1 is only illustrative and that any suitable number of target binding sites may be present. It is further appreciated that although FIG. 1 shows target binding sites only in the 3'UTR region these target binding sites may be located instead in the 5'UTR region or in both 3'UTR and 5'UTR regions The complementary binding of GAM338499 RNA, herein designated GAM RNA, to target binding sites on GAM338499 target RNA, herein designated GAM TARGET RNA, such as BINDING SITE I, BINDING SITE II and BINDING SITE III, inhibits translation of GAM338499 target RNA into GAM338499 target protein, herein designated GAM TARGET PROTEIN, which is shown surrounded by a broken line. It is appreciated that GAM338499 target gene, herein designated GAM TARGET GENE, in fact represents a plurality of GAM338499 target genes. The mRNA of each one of this plurality of GAM338499 target genes comprises one or more target binding sites, each having a nucleotide sequence which is at least partly complementary to GAM338499 RNA, herein designated GAM RNA, and which when bound by GAM338499 RNA causes inhibition of translation of the GAM338499 target mRNA into a corresponding GAM338499 target protein. The mechanism of the translational inhibition exerted by GAM338499 RNA, herein designated GAM RNA, on one or more GAM338499 target genes, herein collectively designated GAM TARGET GENE, may be similar or identical to the known mechanism of ranslational inhibition exerted by known miRNA oligonucleotides. Nucleotide sequence of GAM338499 precursor RNA, herein designated GAM PRECURSOR RNA, its respective genomic |

-continued

| GAM NAME | GAM ORGANISM | PRECUR SEQ-ID | PRECURSOR SEQUENCE | GAM DESCRIPTION |
|---|---|---|---|---|
| | | | | source and genomic location and a schematic representation of a predicted secondary folding of GAM338499 folded precursor RNA, herein designated GAM FOLDED PRECURSOR RNA, are set forth in Tables 3-4, incorporated herein. Nucleotide sequences of a 'diced' GAM338499 RNA, herein designated GAM RNA, of GAM338499 folded precursor RNA are set forth in Table 5, incorporated herein. Nucleotide sequences of target binding sites, such as BINDING SITE-I, BINDING SITE-II and BINDING SITE-III of FIG. 1, found on GAM338499 target RNA, herein designated GAM TARGET RNA, and a schematic representation of the complementarity of each of these target binding sites to GAM338499 RNA, herein designated GAM RNA, are set forth in Tables 6-7, incorporated herein. It is appreciated that specific functions and accordingly utilities of GAM338499 RNA are correlated with and may be deduced from the identity of the GAM338499 target gene inhibited thereby, and whose functions are set forth in Table 8, incorporated herein. |

Table 3, line 4432, shows data relating to the source and location of the GAM oligonucleotide, specifically the GAM PRECRSOR (hairpin) and its position in the genomic sequence of human.

| GAM NAME | PRECUR SEQ-ID | GAM ORGANISM | SOURCE | SRC-STR AND | SRC-START OFFSET | SRC-END OFFSET |
|---|---|---|---|---|---|---|
| GAM338499 | 55663 | Human | 19 | + | 58915162 | 58915248 |

The nucleotide sequences of GAM PRECURSOR RNAs, and a schematic representation of a predicted secondary folding of GAM FOLDED PRECURSOR RNAs, of each of a plurality of GAM oligonucleotides described by FIG. 1 are set forth in Table 4, hereby incorporated herein. Table 4 lines 11968-11972, shows a schematic representation of the GAM folder precursor as set forth in SEQ ID NO:55663, beginning at the 5' end (beginning of upper row) to the 3' end (beginning of lower row), where the hairpin loop is positioned at the right part of the drawing.

The nucleotide sequences of diced GAM RNAs of each of a plurality of GAM oligonucleotides described by FIG. 1 are set forth in Table 5, hereby incorporated herein. Table 5, line 4254 shows the mature GAM RNA as set forth in SEQ ID NO: 55663 as sliced by DICER from the GAM PRECURSOR sequence (hairpin) as set forth in SEQ ID NO: 55663.

| GAM NAME | GAM ORGANISM | GAM RNA SEQUENCE | PRECUR SEQ-ID | GAM POS |
|---|---|---|---|---|
| GAM338499 | Human | AAAGTGCTTCTCTTTGGTGGGT | 55663 | A |

The Nucleotide sequences of target binding sites, such as BINDING SITE I, BINDING SITE II and BINDING SITE III found on GAM TARGET RNAs of each of a plurality of GAM oligonucleotides described by FIG. 1, and a schematic representation of the complementarity of each of these target binding sites to each of a plurality of GAM RNAs described by FIG. 1 are set forth in Tables 6-7, hereby incorporated herein. Table 6 shows data relating to the SEQ ID NO: of the

| GAM NAME | PRECUR SEQ-ID | GAM ORGANISM | PRECURSOR-SEQUENCE | GAM FOLDED PRECURSOR RNA |
|---|---|---|---|---|
| GAM 338499 | 55663 | Human | TCTCAAGCTGTGAGTCTACA TAAAA AGGGAAGCCCTTTCTGTTG TCTAAAAGAAAAGAAAGTGC TTCTCTTTGGTGGGTTACGG - ----- TTTGAGA | G    TA        C      GTTG-<br>TCTCAAGCTGTGA TC  CAAAGGGAAGC CTTTCT  TC<br>AGAGTTTGGCATT GG  GTTTCTCTTCG GAAAGA  AG<br>G    TG        T      AA- |

GAM target binding site sequence of the target gene name as bound by the GAM RNA as set forth in SEQ ID NO:1485. Table 6, lines 11966 and 13602 related to target binding site SEQ ID NO: 23420 and 24238 respectively.

| TARGET BINDING SITE | TARGET SEQ-ID | TARGET ORGANISM | TARGET | TARGET BINDING SITE SEQUENCE |
|---|---|---|---|---|
| 23420 | | Human | MICA | CACAAGCACTTT:11966 |
| 24238 | | Human | MICA | AAAAGCACTTA:13602 |

Table 7, lines 26274-26282 shows data relating to target genes and binding site of GAM oligonucleotides.

| GAM NAME | GAM ORGANISM | GAM RNA SEQUENCE | TARGET BS-SEQ | TARGET | TARGET REF-ID | TARGET ORGANISM | UTR | BINDING-SITE DRAW (UPPER:GAM;LOWER:TARGET) | GAM POS |
|---|---|---|---|---|---|---|---|---|---|
| GAM 338499 | Human | AAAGTGCT TCTCTTTG GTGGGT | AAAAGCAC TTA | MICA | NM_000247 | Human | 3 | ---- -- -----         A<br>     A  AA     AGCACTT<br>     T  TT     TCGTGAA<br>TGGG  GG TCTCT A | A |
| GAM 338499 | Human | AAAGTGCT TCTCTTTG GTGGGT | CACAAGCA CTTT | MICA | NM_000247 | Human | 3 | -- - - ------    C AC A    AGCACTTT<br>   G TG T    TCGTGAAA | A |

It is appreciated that specific functions and accordingly utilities of each of a plurality of GAM oligonucleotides described by FIG.1 are correlated with, and may be deduced from the identity of the GAM TARGET GENEs inhibited thereby, and whose functions are set forth in Table 8, hereby incorporated herein. Table 8, lines 80406-80439 shows data relating to the function and utilities of GAM RNA as set forth in SEQ ID NO: 1485.

| GAM NAME | GAM RNA SEQUENCE | GAM ORGANISM | TARGET | TARGET ORGANISM | GAM FUNCTION | GAM POS |
|---|---|---|---|---|---|---|
| GAM 338 499 | AAAGTGCT TCTCTTTG GTGGGT | Human | MICA | Human | GAM338499 is a human miRNA-like oligonucleotide, which targets MHC class I polypeptide-related sequence A (MICA, Accession NM_000247), a human target gene, as part of a Host response mechanism associated with Mycobacterium avium subsp paratuberculosis, Mycobacterium bovis subsp bovis AF2122/and Mycobacterium tuberculosis CDC1551 infections. MICA BINDING SITE1 and MICA BINDING SITE2 are human target binding sites found in untranslated regions of mRNA encoded by MICA, corresponding to target binding sites such as BINDING SITE I, BINDING SITE II or BINDING SITE III of FIG.1. Nucleotide sequences of MICA BINDING SITE1 and MICA BINDING SITE2, and secondary structure complementarity to the nucleotide sequence of GAM338499 RNA are set forth in Tables 6-7, hereby incorporated herein. A function of GAM338499 is therefore inhibition of MICA, a GAM338499 human target gene which encodes for a protien that binds to the receptors on T-cells and NK cells, activating cytolytic responses, induced by oxidative stress and bacteria. MICA is associated with Mycobacterium avium subsp paratuberculosis, Mycobacterium bovis subsp bovis AF2122/97 and Mycobacterium tuberculosis CDC1551 infections, and therefore GAM338499 is ssociated with the abovementioned infections, as part of a host response mechanism. Accordingly, utilities of GAM338499 include diagnosis, prevention and treatment of Mycobacterium avium subsp. paratuberculosis, Mycobacterium bovis subsp bovis AF2122/97 and Mycobacterium tuberculosis CDC1551 | A |

-continued

| GAM NAME | GAM RNA SEQUENCE | GAM ORGANISM | TARGET ORGANISM | GAM TARGET FUNCTION | GAM POS |
|---|---|---|---|---|---|
| | | | | infections and associated clinical conditions. The function of MICA and its association with various diseases and clinical conditions, has been established by previous studies, as described hereinabove with reference to GAM336293. | |

Studies documenting well known correlations between each of a plurality of GAM TARGET GENEs of the GAM oligonucleotides of FIG. 1, and known functions and diseases are listed in Table 9, hereby incorporated herein.

The present invention discloses a novel group of bacterial and human oligonucleotides, belonging to the miRNA-like oligonucleotides group, here termed GAM oligonucleotides, for which a specific complementary binding has been determined bioinformatically.

Figure 2:
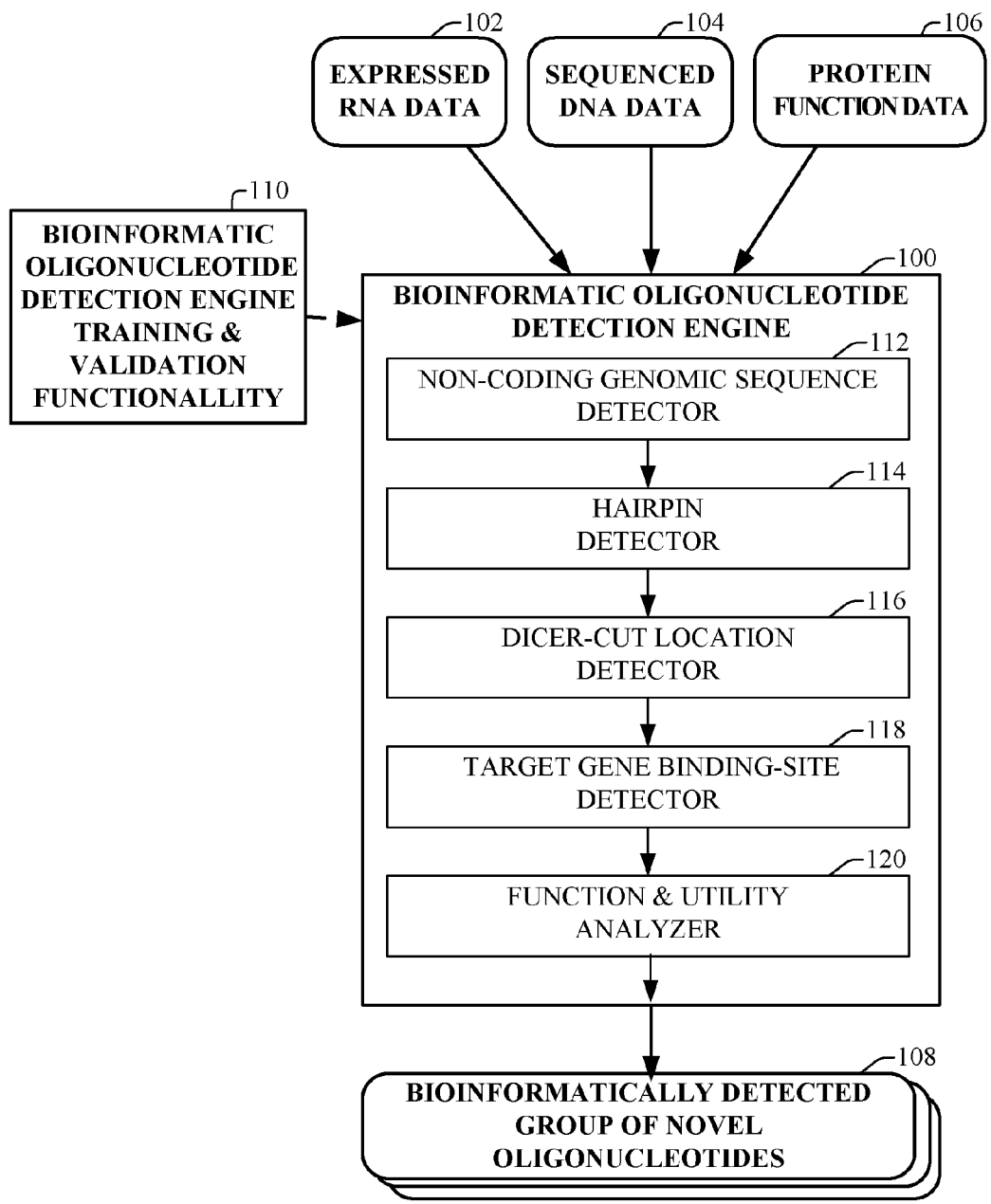
FIG. 2 is a simplified block diagram illustrating a bioinformatic oligonucleotide detection system capable of detecting oligonucleotides of the novel group of oligonucleotides of the present invention, which system is constructed and operative in accordance with a preferred embodiment of the present invention.

Reference is now made to FIG. 2 which is a simplified block diagram illustrating a bioinformatic oligonucleotide detection system and method constructed and operative in accordance with a preferred embodiment of the present invention.

An important feature of the present invention is a BIOINFORMATIC OLIGONUCLEOTIDE DETECTION ENGINE 100, which is capable of bioinformatically detecting oligonucleotides of the present invention.

The functionality of the BIOINFORMATIC OLIGONUCLEOTIDE DETECTION ENGINE 100 includes receiving EXPRESSED RNA DATA 102, SEQUENCED DNA DATA 104, and PROTEIN FUNCTION DATA 106; performing a complex process of analysis of this data as elaborated hereinbelow, and based on this analysis provides information, designated by reference numeral 108, identifying and describing features of novel oligonucleotides.

EXPRESSED RNA DATA 102 comprises published expressed sequence tags (EST) data, published mRNA data, as well as other published RNA data. SEQUENCED DNA DATA 104 comprises alphanumeric data representing genomic sequences and preferably including annotations such as information indicating the location of known protein coding regions relative to the genomic sequences.

PROTEIN FUNCTION DATA 106 comprises information from scientific publications e.g. physiological functions of known proteins and their connection, involvement and possible utility in treatment and diagnosis of various diseases.

EXPRESSED RNA DATA 102 and SEQUENCED DNA DATA 104 may preferably be obtained from data published by the National Center for Biotechnology Information (NCBI) at the National Institute of Health (NIH) (Jenuth, J. P. (2000). Methods Mol. Biol. 132:301-312 (2000), herein incorporated by reference) as well as from various other published data sources. PROTEIN FUNCTION DATA 106 may preferably be obtained from any one of numerous relevant published data sources, such as the Online Mendelian Inherited Disease In Man (OMIM™, Hamosh et al., Nucleic Acids Res. 30: 52-55 (2002)) database developed by John Hopkins University, and also published by NCBI (2000).

Prior to or during actual detection of BIOINFORMATICALLY DETECTED GROUP OF NOVEL OLIGONUCLEOTIDES 108 by the BIOINFORMATIC OLIGONUCLEOTIDE DETECTION ENGINE 100, BIOINFORMATIC OLIGONUCLEOTIDE DETECTION ENGINE TRAINING & VALIDATION FUNCTIONALITY 110 is operative. This functionality uses one or more known miRNA oligonucleotides as a training set to train the BIOINFORMATIC OLIGONUCLEOTIDE DETECTION ENGINE 100 to bioinformatically recognize miRNA-like oligonucleotides, and their respective potential target binding sites. BIOINFORMATIC OLIGONUCLEOTIDE DETECTION ENGINE TRAINING & VALIDATION FUNCTIONALITY 110 is further described hereinbelow with reference to FIG. 3.

The BIOINFORMATIC OLIGONUCLEOTIDE DETECTION ENGINE 100 preferably comprises several modules which are preferably activated sequentially, and are described as follows:

A NON-CODING GENOMIC SEQUENCE DETECTOR 112 operative to bioinformatically detect non-protein coding genomic sequences. The NON-CODING GENOMIC SEQUENCE DETECTOR 112 is further described herein below with reference to FIGS. 4A and 4B.

A HAIRPIN DETECTOR 114 operative to bioinformatically detect genomic 'hairpin-shaped' sequences, similar to GAM FOLDED PRECURSOR RNA (FIG. 1). The HAIRPIN DETECTOR 114 is further described herein below with reference to FIGS. 5A and 5B.

A DICER-CUT LOCATION DETECTOR 116 operative to bioinformatically detect the location on a GAM FOLDED PRECURSOR RNA which is enzymatically cut by DICER COMPLEX (FIG. 1), yielding diced GAM RNA. The DICER-CUT LOCATION DETECTOR 116 is further described herein below with reference to FIGS. 6A-6C.

A TARGET GENE BINDING-SITE DETECTOR 118 operative to bioinformatically detect target genes having binding sites, the nucleotide sequence of which is partially complementary to that of a given genomic sequence, such as a nucleotide sequence cut by DICER COMPLEX. The TARGET GENE BINDING-SITE DETECTOR 118 is further described hereinbelow with reference to FIGS. 7A and 7B.

A FUNCTION & UTILITY ANALYZER 120 operative to analyze the function and utility of target genes in order to identify target genes which have a significant clinical function and utility. The FUNCTION & UTILITY ANALYZER 120 is further described hereinbelow with reference to FIG. 8.

According to a preferred embodiment of the present invention the engine 100 may employ a cluster of 40 PCs (XEON®, 2.8 GHz, with 80 GB storage each), connected by Ethernet to 8 servers (2-CPU, XEON™ 1.2-2.2 GHz, with ~200 GB storage each), combined with an 8-processor server (8-CPU, Xeon 550 Mhz w/8 GB RAM) connected via 2 HBA fiber-channels to an EMC CLARIION™ 100-disks, 3.6 Terabyte storage device. A preferred embodiment of the present invention may also preferably comprise software which utilizes a commercial database software program, such as MICROSOFT™ SQL Server 2000. It is appreciated that the above mentioned hardware configuration is not meant to be limiting, and is given as an illustration only. The present invention may be implemented in a wide variety of hardware and software configurations.

The present invention discloses 6444 novel oligonucleotides of the GAM group of oligonucleotides, which have been detected bioinformatically and 726 novel polynucleotides of the GR group of polynucleotides, which have been detected bioinformatically. Laboratory confirmation of bioinformatically predicted oligonucleotides of the GAM group of oligonucleotides, and several bioinformatically predicted polynucleotides of the GR group of polynucleotides, is described hereinbelow with reference to FIGS. 12-15D.

Figure 3:
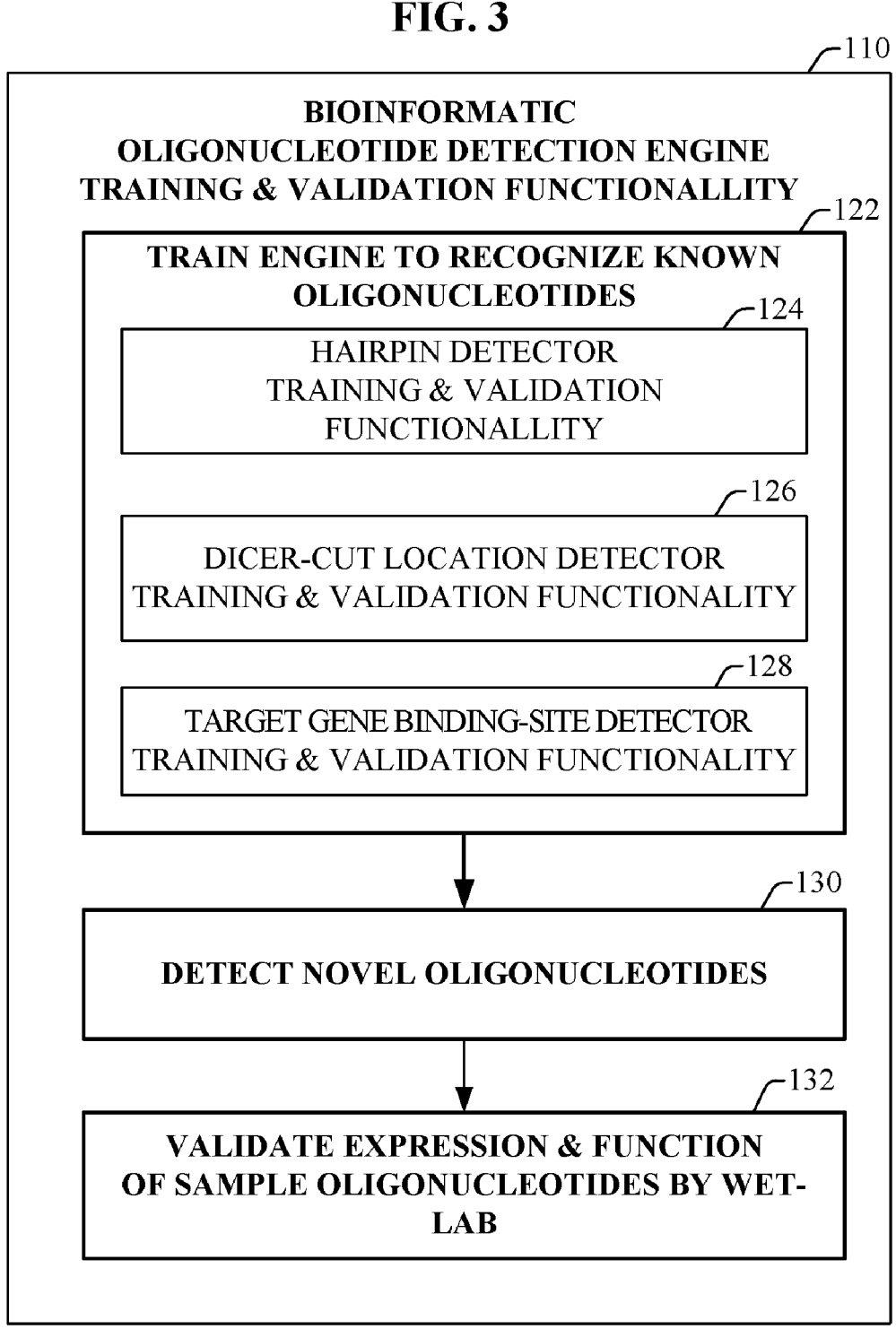
FIG. 3 is a simplified flowchart illustrating operation of a mechanism for training of a computer system to recognize the novel oligonucleotides of the present invention, which mechanism is constructed and operative in accordance with a preferred embodiment of the present invention.

Reference is now made to FIG. 3 which is a simplified flowchart illustrating operation of a preferred embodiment of the BIOINFORMATIC OLIGONUCLEOTIDE DETECTION ENGINE TRAINING & VALIDATION FUNCTIONALITY 110 described hereinabove with reference to FIG. 2.

BIOINFORMATIC OLIGONUCLEOTIDE DETECTION ENGINE TRAINING & VALIDATION FUNCTIONALITY 110 begins by training the BIOINFORMATIC OLIGONUCLEOTIDE DETECTION ENGINE 100 (FIG. 2) to recognize one or more known miRNA oligonucleotides, as designated by reference numeral 122. This training step comprises HAIRPIN DETECTOR TRAINING & VALIDATION FUNCTIONALITY 124, further described hereinbelow with reference to FIG. 5A, DICER-CUT LOCATION DETECTOR TRAINING & VALIDATION FUNCTIONALITY 126, further described hereinbelow with reference to FIGS. 6A and 6B, and TARGET GENE BINDING-SITE DETECTOR TRAINING & VALIDATION FUNCTIONALITY 128, further described hereinbelow with reference to FIG. 7A.

Next, the BIOINFORMATIC OLIGONUCLEOTIDE DETECTION ENGINE TRAINING & VALIDATION FUNCTIONALITY 110 is operative bioinformatically detect novel oligonucleotides, using BIOINFORMATIC OLIGONUCLEOTIDE DETECTION ENGINE 100 (FIG. 2), as designated by reference numeral 130. Wet lab experiments are preferably conducted in order to validate expression and preferably function of some samples of the novel oligonucleotides detected by the BIOINFORMATIC OLIGONUCLEOTIDE DETECTION ENGINE 100, as designated by reference numeral 132. FIGS. 13A-15D illustrate examples of wet-lab validation of sample novel human oligonucleotides bioinformatically detected in accordance with a preferred embodiment of the present invention.

Figure 4A:
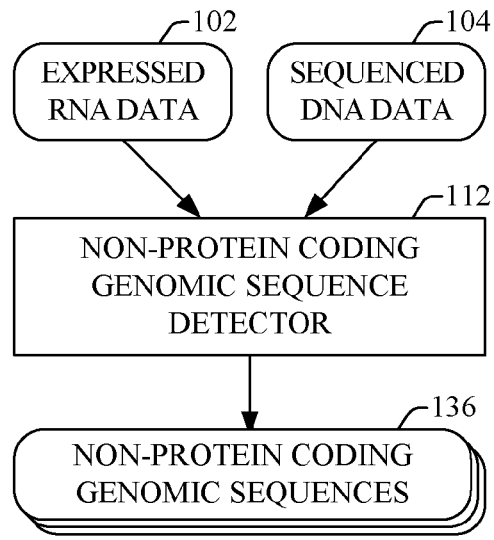
FIG. 4A is a simplified block diagram of a non-coding genomic sequence detector constructed and operative in accordance with a preferred embodiment of the present invention.

Reference is now made to FIG. 4A which is a simplified block diagram of a preferred implementation of the NON-CODING GENOMIC SEQUENCE DETECTOR 112 described hereinabove with reference to FIG. 2. The NON-PROTEIN CODING GENOMIC SEQUENCE DETECTOR 112 preferably receives at least two types of published genomic data: EXPRESSED RNA DATA 102 and SEQUENCED DNA DATA 104. The EXPRESSED RNA DATA 102 may include, inter alia, EST data, EST clusters data, EST genome alignment data and mRNA data. Sources for EXPRESSED RNA DATA 102 include NCBI dbEST, NCBI UniGene clusters and mapping data, and TIGR gene indices (Kirkness F. and Kerlavage, A. R., Methods Mol. Biol. 69:261-268 (1997)). SEQUENCED DNA DATA 104 may include sequence data (FASTA format files), and feature annotations (GenBank file format) mainly from NCBI databases. Based on the above mentioned input data, the NON-PROTEIN CODING GENOMIC SEQUENCE DETECTOR 112 produces a plurality of NON-PROTEIN CODING GENOMIC SEQUENCES 136. Preferred operation of the NON-PROTEIN CODING GENOMIC SEQUENCE DETECTOR 112 is described hereinbelow with reference to FIG. 4B.

Figure 4B:
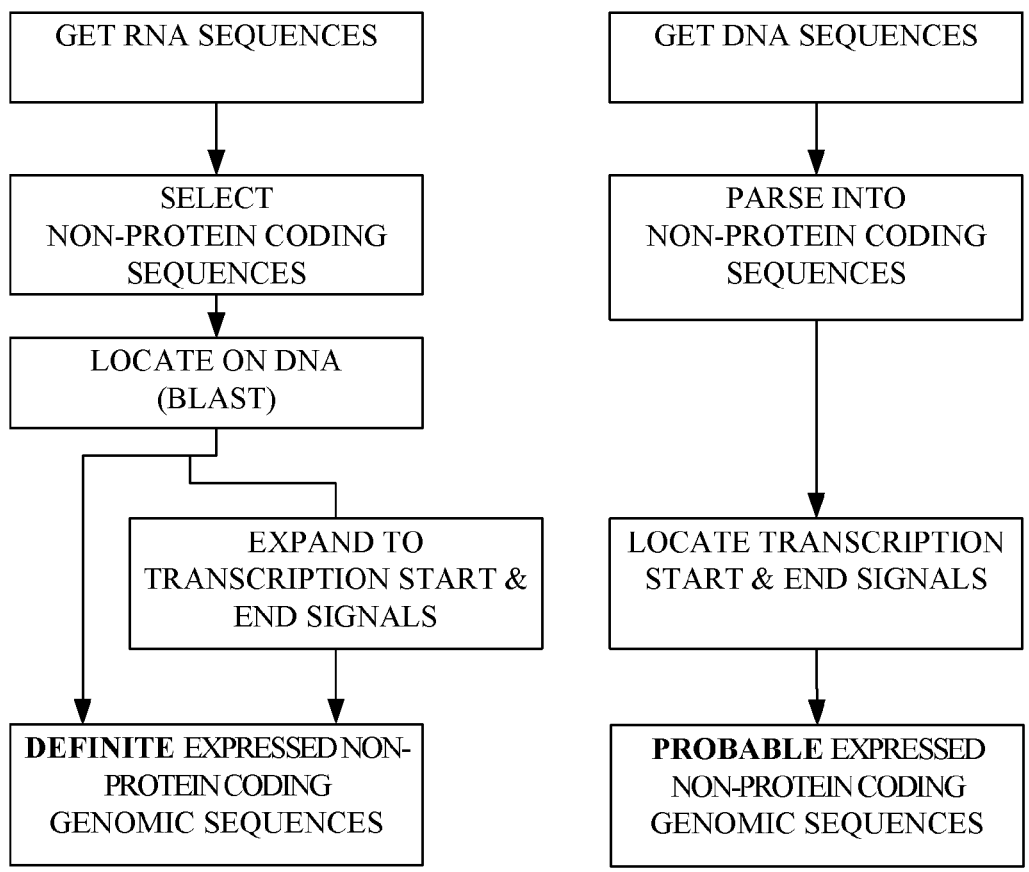
FIG. 4B is a simplified flowchart illustrating operation of a non-coding genomic sequence detector constructed and operative in accordance with a preferred embodiment of the present invention.

Reference is now made to FIG. 4B which is a simplified flowchart illustrating a preferred operation of the NON-CODING GENOMIC SEQUENCE DETECTOR 112 of FIG. 2. Detection of NON-PROTEIN CODING GENOMIC SEQUENCES 136, generally preferably progresses along one of the following two paths:

A first path for detecting NON-PROTEIN CODING GENOMIC SEQUENCES 136 (FIG. 4A) begins with receipt of a plurality of known RNA sequences, such as EST data. Each RNA sequence is first compared with known protein-coding DNA sequences, in order to select only those RNA sequences which are non-protein coding, i.e. intergenic or intronic sequences. This can preferably be performed by using one of many alignment algorithms known in the art, such as BLAST (Altschul et al., J. Mol. Biol. 215:403-410 (1990)). This sequence comparison preferably also provides localization of the RNA sequence on the DNA sequences.

Alternatively, selection of non-protein coding RNA sequences and their localization on the DNA sequences can be performed by using publicly available EST cluster data and genomic mapping databases, such as the UNIGENE database published by NCBI or the TIGR database. Such databases, map expressed RNA sequences to DNA sequences encoding them, find the correct orientation of EST sequences, and indicate mapping of ESTs to protein coding DNA regions, as is well known in the art. Public databases, such as TIGR, may also be used to map an EST to a cluster of ESTs, known in the art as Tentative Human Consensus and assumed to be expressed as one segment. Publicly available genome annotation databases, such as NCBIs GenBank, may also be used to deduce expressed intronic sequences.

Optionally, an attempt may be made to "expand" the non-protein RNA sequences thus found, by searching for transcription start and end signals, respectively upstream and downstream of the location of the RNA on the DNA, as is well known in the art.

A second path for detecting NON-PROTEIN CODING GENOMIC SEQUENCES 136 (FIG. 4A) begins with receipt of DNA sequences. The DNA sequences are parsed into non protein coding sequences, using published DNA annotation data, by extracting those DNA sequences which are between known protein coding sequences. Next, transcription start and end signals are sought. If such signals are found, and depending on their robustness, probable expressed non-protein coding genomic sequences are obtained. Such approach is especially useful for identifying novel GAM oligonucleotides which are found in proximity to other known miRNA oligonucleotides, or other wet-lab validated GAM oligonucleotides. Since, as described hereinbelow with reference to FIG. 9, GAM oligonucleotides are frequently found in clusters; sequences located near known miRNA oligonucleotides are more likely to contain novel GAM oligonucleotides. Optionally, sequence orthology, i.e. sequence conservation in an evolutionary related species, may be used to select genomic sequences having a relatively high probability of containing expressed novel GAM oligonucleotides. It is appreciated that in detecting non-human GAM oligonucleotides of the present invention the BIOINFORMATIC OLIGONUCLEOTIDE DETECTION ENGINE 100 utilizes the input genomic sequences, without filtering protein coding regions detected by the NON-CODING GENOMIC SEQUENCE DETECTOR 112, hence NON-PROTEIN CODING GENOMIC SEQUENCES 136 refers to GENOMIC SEQUENCES only.

Figure 5A:
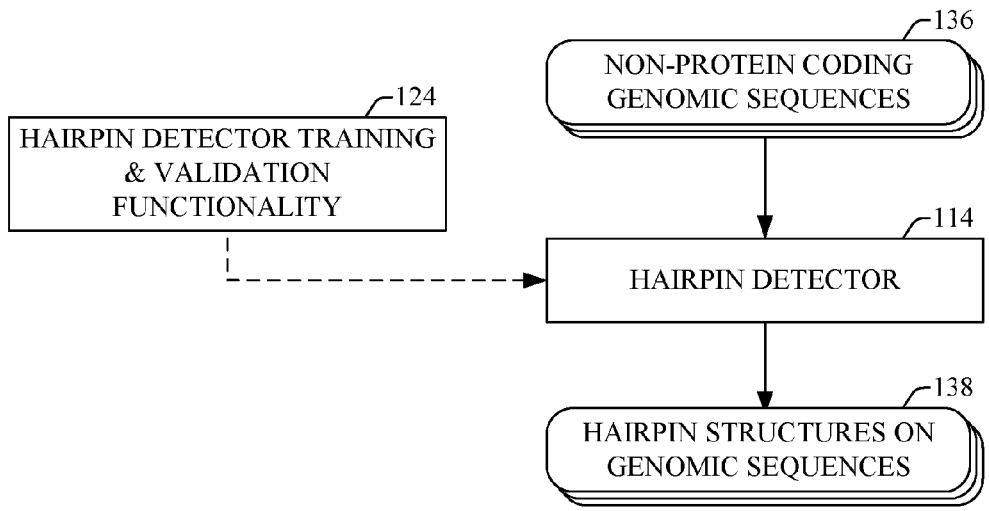
FIG. 5A is a simplified block diagram of a hairpin detector constructed and operative in accordance with a preferred embodiment of the present invention.

Reference is now made to FIG. 5A which is a simplified block diagram of a preferred implementation of the HAIRPIN DETECTOR 114 described hereinabove with reference to FIG. 2.

The goal of the HAIRPIN DETECTOR 114 is to detect hairpin-shaped genomic sequences, similar to those of known miRNA oligonucleotides. A hairpin-shaped genomic sequence is a genomic sequence, having a first half which is at least partially complementary to a second half thereof, which causes the halves to folds onto themselves, thereby forming a hairpin structure, as mentioned hereinabove with reference to FIG. 1.

The HAIRPIN DETECTOR 114 (FIG. 2) receives a plurality of NON-PROTEIN CODING GENOMIC SEQUENCES 136 (FIG. 4A). Following operation of HAIRPIN DETECTOR TRAINING & VALIDATION FUNCTIONALITY 124 (FIG. 3), the HAIRPIN DETECTOR 114 is operative to detect and output hairpin-shaped sequences, which are found in the NON-PROTEIN CODING GENOMIC SEQUENCES 136. The hairpin-shaped sequences detected by the HAIRPIN DETECTOR 114 are designated HAIRPINS STRUCTURES ON GENOMIC SEQUENCES 138. A preferred mode of operation of the HAIRPIN DETECTOR 114 is described hereinbelow with reference to FIG. 5B.

HAIRPIN DETECTOR TRAINING & VALIDATION FUNCTIONALITY 124 includes an iterative process of applying the HAIRPIN DETECTOR 114 to known hairpin shaped miRNA precursor sequences, calibrating the HAIRPIN DETECTOR 114 such that it identifies a training set of known hairpin-shaped miRNA precursor sequences, as well as other similarly hairpin-shaped sequences. In a preferred embodiment of the present invention, the HAIRPIN DETECTOR TRAINING & VALIDATION FUNCTIONALITY 124 trains the HAIRPIN DETECTOR 114 and validates each of the steps of operation thereof described hereinbelow with reference to FIG. 5B The HAIRPIN DETECTOR TRAINING & VALIDATION FUNCTIONALITY 124 preferably uses two sets of data: the aforesaid training set of known hairpin-shaped miRNA precursor sequences, such as hairpin-shaped miRNA precursor sequences of 440 miRNA oligonucleotides of *H. sapiens, M. musculus, C. elegans, C. Brigssae* and *D. Melanogaster*, annotated in the RFAM database (Griffiths-Jones 2003), and a background set of about 1000 hairpin-shaped sequences found in expressed non-protein coding human genomic sequences. The background set is expected to comprise some valid, previously undetected hairpin-shaped miRNA-like precursor sequences, and many hairpin-shaped sequences which are not hairpin-shaped miRNA-like precursors.

In a preferred embodiment of the present invention the efficacy of the HAIRPIN DETECTOR 114 (FIG. 2) is confirmed. For example, when a similarity threshold is chosen such that 87% of the known hairpin-shaped miRNA precursors are successfully predicted, only 21.8% of the 1000 background set of hairpin-shaped sequences are predicted to be hairpin-shaped miRNA-like precursors.

Figure 5B:
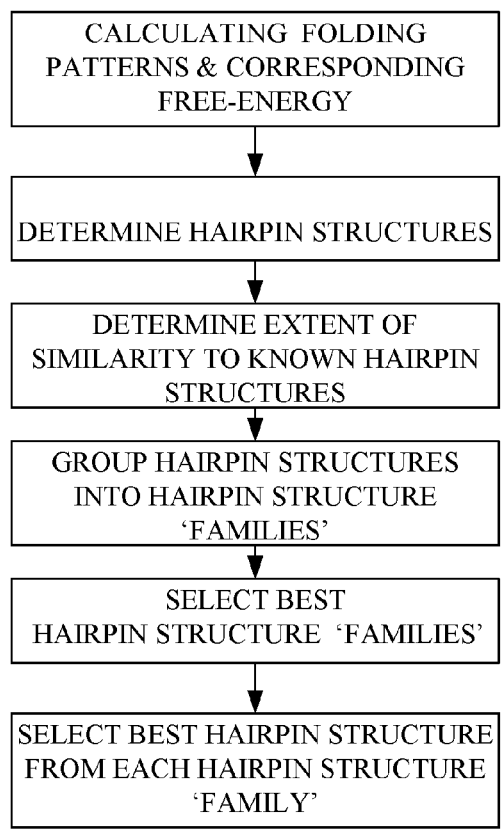
FIG. 5B is a simplified flowchart illustrating operation of a hairpin detector constructed and operative in accordance with a preferred embodiment of the present invention.

Reference is now made to FIG. 5B which is a simplified flowchart illustrating preferred operation of the HAIRPIN DETECTOR 114 of FIG. 2. The HAIRPIN DETECTOR 114 preferably initially uses a secondary structure folding algorithm based on free-energy minimization, such as the MFOLD algorithm, described in Mathews et al. J. Mol. Biol. 288:911-940 (1999) and Zuker, M. Nucleic Acids Res. 31: 3406-3415 (2003), the disclosure of which is hereby incorporated by reference. This algorithm is operative to calculate probable secondary structure folding patterns of the NON-PROTEIN CODING GENOMIC SEQUENCES 136 (FIG. 4A) as well as the free-energy of each of these probable secondary folding patterns. The secondary structure folding algorithm, such as the MFOLD algorithm (Mathews, 1997; Zuker 2003), typically provides a listing of the base-pairing of the folded shape, i.e. a listing of each pair of connected nucleotides in the sequence.

Next, the HAIRPIN DETECTOR 114 analyzes the results of the secondary structure folding patterns, in order to determine the presence and location of hairpin folding structures. The goal of this second step is to assess the base-pairing listing provided by the secondary structure folding algorithm, in order to determine whether the base-pairing listing describes one or more hairpin type bonding pattern. Preferably, sequence segment corresponding to a hairpin structure is then separately analyzed by the secondary structure folding algorithm in order to determine its exact folding pattern and free-energy.

The HAIRPIN DETECTOR 114 then assesses the hairpin structures found by the previous step, comparing them to hairpin structures of known miRNA precursors, using various characteristic hairpin structure features such as its free-energy and its thermodynamic stability, the amount and type of mismatched nucleotides and the existence of sequence repeat-elements, number of mismatched nucleotides in positions 18-22 counting from loop, and Percent of G nucleotide. Only hairpins that bear statistically significant resemblance to the training set of hairpin structures of known miRNA precursors, according to the abovementioned parameters, are accepted.

In a preferred embodiment of the present invention, similarity to the training set of hairpin structures of known miRNA precursors is determined using a "similarity score" which is calculated using a multiplicity of terms, where each term is a function of one of the abovementioned hairpin structure features. The parameters of each function are found heuristically from the set of hairpin structures of known miRNA precursors, as described hereinabove with reference to HAIRPIN DETECTOR TRAINING & VALIDATION FUNCTIONALITY 124 (FIG. 3). The selection of the features and their function parameters is optimized so as to achieve maximized separation between the distribution of similarity scores validated miRNA-precursor hairpin structures, and the distribution of similarity scores of hairpin structures detected in the background set mentioned hereinabove with reference to FIG. 5B.

In an alternative preferred embodiment of the present invention, the step described in the preceding paragraph may be split into two stages. A first stage implements a simplified scoring method, typically based on thresholding a subset of the hairpin structure features described hereinabove, and may employ a minimum threshold for hairpin structure length and a maximum threshold for free energy. A second stage is preferably more stringent, and preferably employs a full calculation of the weighted sum of terms described hereinabove. The second stage preferably is performed only on the subset of hairpin structures that survived the first stage.

The HAIRPIN DETECTOR 114 also attempts to select hairpin structures whose thermodynamic stability is similar to that of hairpin structures of known miRNA precursors. This may be achieved in various ways. A preferred embodiment of the present invention utilizes the following methodology, preferably comprising three logical steps:

First, the HAIRPIN DETECTOR 114 attempts to group hairpin structures into "families" of closely related hairpin structures. As is known in the art, a secondary structure folding algorithm typically provides multiple alternative folding patterns, for a given genomic sequence and indicates the free energy of each alternative folding pattern. It is a particular feature of the present invention that the HAIRPIN DETECTOR 114 preferably assesses the various hairpin structures appearing in the various alternative folding patterns and groups' hairpin structures which appear at identical or similar sequence locations in various alternative folding patterns into common sequence location based "families" of hairpins. For example, all hairpin structures whose center is within 7 nucleotides of each other may be grouped into a family". Hairpin structures may also be grouped into a family" if their nucleotide sequences are identical or overlap to a predetermined degree.

It is also a particular feature of the present invention that the hairpin structure "families" are assessed in order to select only those families which represent hairpin structures that are as thermodynamically stable as those of hairpin structures of known miRNA precursors. Preferably only families which are represented in at least a selected majority of the alternative secondary structure folding patterns, typically 65%, 80% or 100% are considered to be sufficiently stable. Our tests suggest that only about 50% of the hairpin structures, predicted by the MFOLD algorithm with default parameters, are members of sufficiently stable families, comparing to about 90% of the hairpin structures that contain known miRNAs. This percent depends on the size of the fraction that was fold. In an alternative embodiment of the present invention we use fractions of size 1000 nts as preferable size. Different embodiment uses other sizes of genomics sequences, more or less strict demand for representation in the alternative secondary structure folding patterns.

It is an additional particular feature of the present invention that the most suitable hairpin structure is selected from each selected family. For example, a hairpin structure which has the greatest similarity to the hairpin structures appearing in alternative folding patterns of the family may be preferred. Alternatively or additionally, the hairpin structures having relatively low free energy may be preferred.

Alternatively or additionally considerations of homology to hairpin structures of other organisms and the existence of clusters of thermodynamically stable hairpin structures located adjacent to each other along a sequence may be important in selection of hairpin structures. The tightness of the clusters in terms of their location and the occurrence of both homology and clusters may be of significance.

Figure 6A:
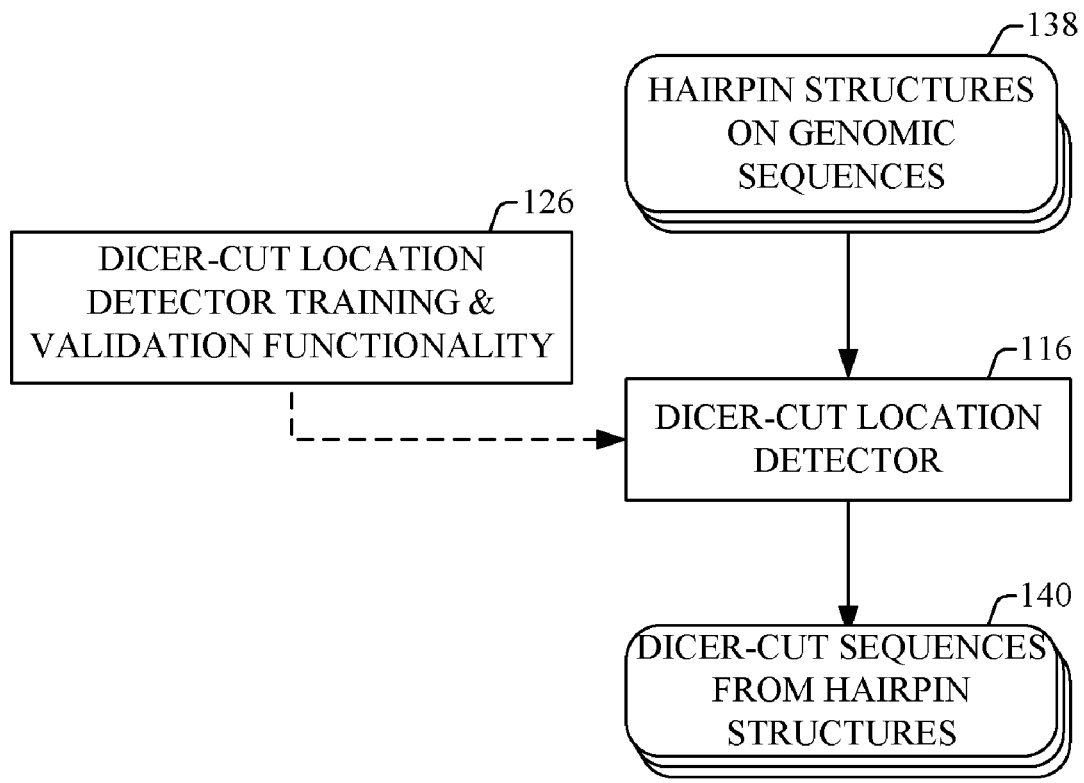
FIG. 6A is a simplified block diagram of a dicer-cut location detector constructed and operative in accordance with a preferred embodiment of the present invention.
Figure 6B:
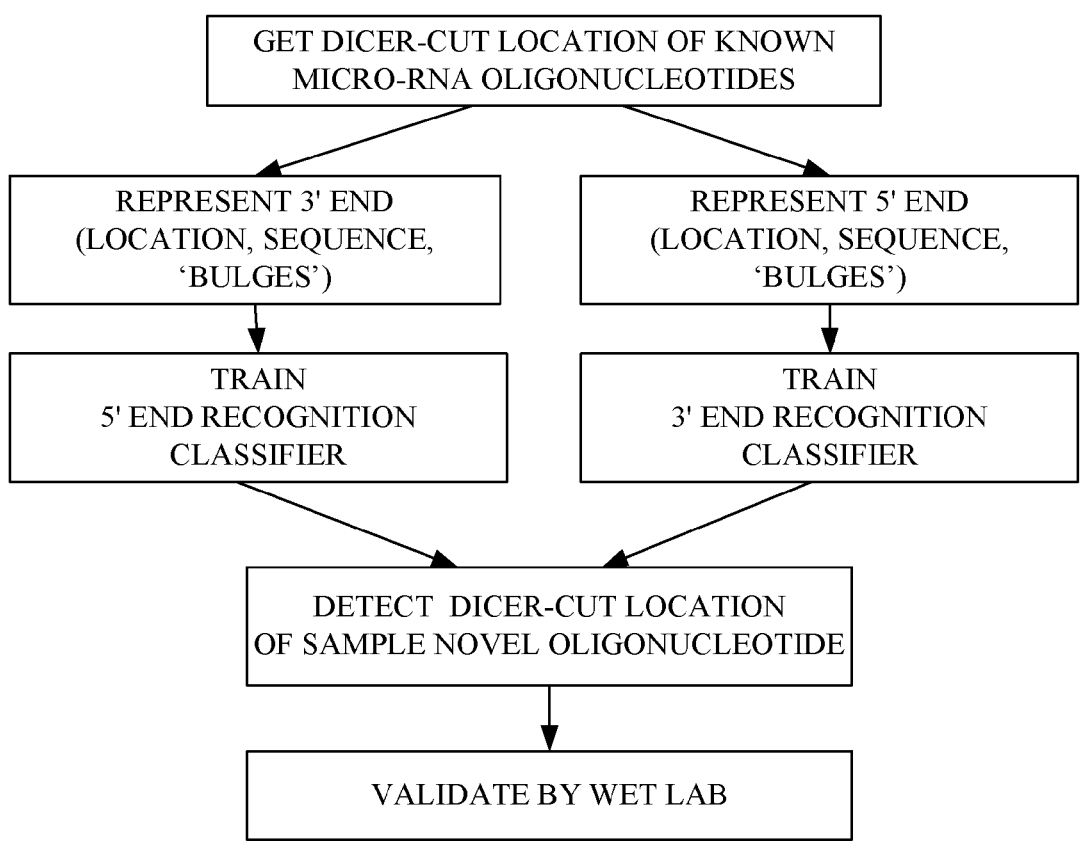
FIG. 6B is a simplified flowchart illustrating training of a dicer-cut location detector constructed and operative in accordance with a preferred embodiment of the present invention.
Figure 6C:
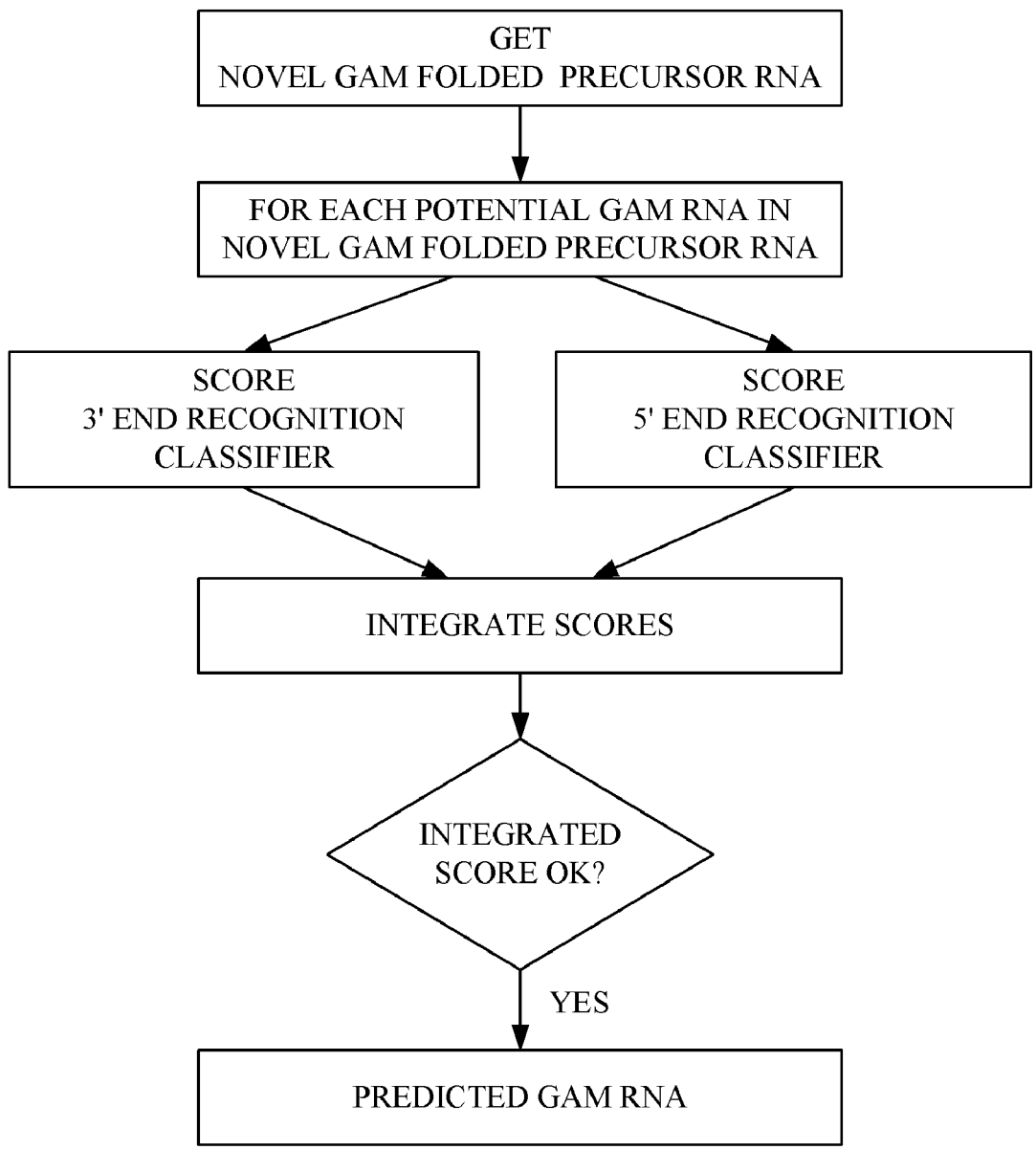
FIG. 6C is a simplified flowchart illustrating operation of a dicer-cut location detector constructed and operative in accordance with a preferred embodiment of the present invention.

Reference is now made to FIGS. 6A-6C which together describe the structure and operation of the DICER-CUT LOCATION DETECTOR 116, described hereinabove with FIG. 2.

FIG. 6A is a simplified block diagram of a preferred implementation of the DICER-CUT LOCATION DETECTOR 116. The goal of the DICER-CUT LOCATION DETECTOR 116 is to detect the location in which the DICER COMPLEX, described hereinabove with reference to FIG. 1, dices GAM FOLDED PRECURSOR RNA, yielding GAM RNA.

The DICER-CUT LOCATION DETECTOR 116 therefore receives a plurality of HAIRPIN STRUCTURES ON GENOMIC SEQUENCES 138 (FIG. 5A), and following operation of DICER-CUT LOCATION DETECTOR TRAINING & VALIDATION FUNCTIONALITY 126 (FIG. 3), is operative to detect a plurality of DICER-CUT SEQUENCES FROM HAIRPIN STRUCTURES 140.

Reference is now made to FIG. 6B which is a simplified flowchart illustrating a preferred implementation of DICER-CUT LOCATION DETECTOR TRAINING & VALIDATION FUNCTIONALITY 126.

A general goal of the DICER-CUT LOCATION DETECTOR TRAINING & VALIDATION FUNCTIONALITY 126 is to analyze the dicer-cut locations of known diced miRNA on respective hairpin shaped miRNA precursors in order to determine a common pattern in these locations, which can be used to predict dicer cut locations on GAM folded precursor RNAs.

The dicer-cut locations of known miRNA precursors are obtained and studied. Locations of the 5' and/or 3' ends of the known diced miRNAs are preferably represented by their respective distances from the 5' end of the corresponding hairpin shaped miRNA precursor. Additionally or alternatively, the 5' and/or 3' ends of the known diced miRNAs are preferably represented by the relationship between their locations and the locations of one or more nucleotides along the hairpin shaped miRNA precursor. Additionally or alternatively, the 5' and/or 3' ends of the known diced miRNAs are preferably represented by the relationship between their locations and the locations of one or more bound nucleotide pairs along the hairpin shaped miRNA precursor. Additionally or alternatively, the 5' and/or 3' ends of the known diced miRNAs are preferably represented by the relationship between their locations and the locations of one or more mismatched nucleotide pairs along the hairpin shaped miRNA precursor. Additionally or alternatively, the 5' and/or 3' ends of the known diced miRNAs are preferably represented by the relationship between their locations and the locations of one or more unmatched nucleotides along the hairpin shaped miRNA precursor. Additionally or alternatively, locations of the 5' and/or 3' ends of the known diced miRNAs are preferably represented by their respective distances from the loop located at the center of the corresponding hairpin shaped miRNA precursor.

One or more of the foregoing location metrics may be employed in the training and validation functionality. Additionally, metrics related to the nucleotide content of the diced miRNA and/or of the hairpin shaped miRNA precursor may be employed.

In a preferred embodiment of the present invention, DICER-CUT LOCATION DETECTOR TRAINING & VALIDATION FUNCTIONALITY 126 preferably employs standard machine learning techniques known in the art of machine learning for analysis of existing patterns in a given "training set" of examples. These techniques are capable, to a certain degree, of detecting similar patterns in other, previously unseen examples. Such machine learning techniques include, but are not limited to neural networks, Bayesian networks, Support Vector Machines (SVM), Genetic Algorithms, Markovian modeling, Maximum Likelihood modeling, Nearest Neighbor algorithms, Decision trees and other techniques, as is well known in the art.

In accordance with one embodiment of the present invention, machine learning predictors, such as a Support Vector Machine (SVM) predictor, are applied to the aforementioned training set and are operative, for example to test every possible nucleotide on a hairpin as a candidate for being the 5' end or the 3' end of a diced GAM RNA. More preferred machine learning predictors include predictors based on Nearest Neighbor, Bayesian modeling, and K-nearest-neighbor algorithms. A training set of the known miRNA precursor sequences is preferably used for training multiple separate classifiers or predictors, each of which produces a model for the 5' and/or 3' end locations of a diced miRNA with respect to its hairpin precursor. The models take into account one or more of the various miRNA location metrics described above.

Performance of the resulting predictors, evaluated on the abovementioned validation set of 440 published miRNAs using k-fold cross validation (Mitchell, 1997) with k=3, is found to be as follows: in 70% of known miRNAs 5'-end location is correctly determined by an SVM predictor within up to 2 nucleotides; a Nearest Neighbor (EDIT DISTANCE) predictor achieves 56% accuracy (247/440); a Two-Phased predictor that uses Bayesian modeling (TWO PHASED) achieves 80% accuracy (352/440), when only the first phase is used. When the second phase (strand choice) is implemented by a nave Bayesian model the accuracy is 55% (244/440), and when the K-nearest-neighbor modeling is used for the second phase, 374/440 decision are made and the accuracy is 65% (242/374). A K-nearest-neighbor predictor (FIRST-K) achieves 61% accuracy (268/440). The accuracies of all predictors are considerably higher on top scoring subsets of published miRNA.

Finally, in order to validate the efficacy and accuracy of the DICER-CUT LOCATION DETECTOR 116, a sample of novel oligonucleotides detected thereby is preferably selected, and validated by wet lab. Laboratory results validating the efficacy of the DICER-CUT LOCATION DETECTOR 116 are described hereinbelow with reference to FIGS. 12-15D.

Reference is now made to FIG. 6C which is a simplified flowchart illustrating operation of DICER-CUT LOCATION DETECTOR 116 (FIG. 2), constructed and operative in accordance with a preferred embodiment of the present invention. The DICER CUT LOCATION DETECTOR 116 preferably comprises a machine learning computer program module, which is trained to recognize dicer-cut locations on known hairpin-shaped miRNA precursors, and based on this training, is operable to detect dicer-cut locations of novel GAM RNAs (FIG. 1) on GAM FOLDED PRECURSOR RNAs (FIG. 1). In a preferred embodiment of the present invention, the dicer-cut location module preferably utilizes machine learning algorithms, such as known Support Vector Machine (SVM) and more preferably: known Bayesian modeling, Nearest Neighbors, and K-nearest-neighbor algorithms.

When initially assessing a novel GAM FOLDED PRECURSOR RNA, all 19-24 nucleotide long segments thereof are initially considered as "potential GAM RNAs", since the dicer-cut location is initially unknown.

For each such potential GAM RNA, the location of its 5' end or the locations of its 5' and 3' ends are scored by at least one recognition classifier or predictor.

In a preferred embodiment of the present invention, the DICER-CUT LOCATION DETECTOR 116 (FIG. 2) may use a Support Vector Machine predictor trained on and operating on features such as the following:

Locations of the 5' and/or 3' ends of the known diced miRNAs, which are preferably represented by their respective distances from the 5 end of the corresponding hairpin shaped miRNA precursor. Additionally or alternatively, the 5' and/or 3' ends of the known diced miRNAs are preferably represented by the relationship between their locations and the locations of one or more nucleotides along the hairpin shaped miRNA precursor. Additionally or alternatively, the 5' and/or 3' ends of the known diced miRNAs are preferably represented by the relationship between their locations and the locations of one or more bound nucleotide pairs along the hairpin shaped miRNA precursor. Additionally or alternatively, the 5' and/or 3' ends of the known diced miRNAs are preferably represented by the relationship between their locations and the locations of one or more mismatched nucleotide pairs along the hairpin shaped miRNA precursor. Additionally or alternatively, the 5' and/or 3' ends of the known diced miRNAs are preferably represented by the relationship between their locations and the locations of one or more unmatched nucleotides along the hairpin shaped miRNA precursor. Additionally or alternatively, locations of the 5' and/or 3' ends of the known diced miRNAs are preferably represented by their respective distances from the loop located at the center of the corresponding hairpin shaped miRNA precursor; and secondarily Metrics related to the nucleotide content of the diced miRNA and/or of the hairpin shaped miRNA precursor.

In another preferred embodiment of the present invention, the DICER-CUT LOCATION DETECTOR 116 (FIG. 2) preferably employs an "EDIT DISTANCE" predictor, which seeks sequences that are similar to those of known miRNAs, utilizing a Nearest Neighbor algorithm, where a similarity metric between two sequences is a variant of the Edit Distance algorithm (Gusfield, 1997). The EDIT DISTANCE predictor is based on an observation that miRNA oligonucleotides tend to form clusters, the members of which show marked sequence similarity.

In yet another preferred embodiment of the present invention, the DICER-CUT LOCATION DETECTOR 116 (FIG. 2) preferably uses a "TWO PHASE" predictor, which predicts the dicer-cut location in two distinct phases: (a) selecting a double-stranded segment of the GAM FOLDED PRECURSOR RNA (FIG. 1) comprising the GAM RNA by nave Bayesian modeling and (b) detecting which strand of the double-stranded segment contains GAM RNA (FIG. 1) by employing either nave or by K-nearest-neighbor modeling. K-nearest-neighbor modeling is a variant of the 'FIRST-K' predictor described hereinbelow, with parameters optimized for this specific task. The 'TWO PHASE' predictor may be operated in two modes: either utilizing only the first phase and thereby producing two alternative dicer-cut location predictions, or utilizing both phases and thereby producing only one final dicer-cut location.

In still another preferred embodiment of the present invention, the DICER-CUT LOCATION DETECTOR 116 preferably uses a "FIRST-K" predictor, which utilizes a K-nearest-neighbor algorithm. The similarity metric between any two sequences is 1−E/L, where L is a parameter, preferably 8-10 and E is the edit distance between the two sequences, taking into account only the first L nucleotides of each sequence. If the K-nearest-neighbor scores of two or more locations on the GAM FOLDED PRECURSOR RNA (FIG. 1) are not significantly different, these locations are further ranked by a Bayesian model, similar to the one described hereinabove.

The TWO PHASE and FIRST-K predictors preferably are trained on and operate on features such as the following:

Locations of the 5' and/or 3' ends of the known diced miRNAs, which are preferably represented by their respective distances from the 5' end of the corresponding hairpin shaped miRNA precursor. Additionally or alternatively, the 5' and/or 3' ends of the known diced miRNAs are preferably represented by the relationship between their locations and the locations of one or more nucleotides along the hairpin shaped miRNA precursor. Additionally or alternatively, the 5' and/or 3' ends of the known diced miRNAs are preferably represented by the relationship between their locations and the locations of one or more bound nucleotide pairs along the hairpin shaped miRNA precursor. Additionally or alternatively, the 5' and/or 3' ends of the known diced miRNAs are preferably represented by the relationship between their locations and the locations of one or more mismatched nucleotide pairs along the hairpin shaped miRNA precursor. Additionally or alternatively, the 5' and/or 3' ends of the known diced miRNAs are preferably represented by the relationship between their locations and the locations of one or more unmatched nucleotides along the hairpin shaped miRNA precursor. Additionally or alternatively, locations of the 5' and/or 3' ends of the known diced miRNAs are preferably represented by their respective distances from the loop located at the center of the corresponding hairpin shaped miRNA precursor; and secondarily Metrics related to the nucleotide content of the diced miRNA and/or of the hairpin shaped miRNA precursor.

In accordance with an embodiment of the present invention scores of two or more of the abovementioned classifiers or predictors are integrated, yielding an integrated score for each "potential GAM RNA". As an example, FIG. 6C illustrates integration of scores from two classifiers, a 3' end recognition classifier and a 5' end recognition classifier, the scores of which are integrated to yield an integrated score. Most preferably, the INTEGRATED SCORE of FIG. 6C preferably implements a "best-of-breed" approach employing a pair of classifiers and accepting only "potential GAM RNAs" that score highly on one of the above mentioned "EDIT DISTANCE", or "TWO-PHASE" predictors. In this context, "high scores" means scores which have been demonstrated to have low false positive value when scoring known miRNA oligonucleotides. Alternatively, the INTEGRATED SCORE may be derived from operation of more or less than two classifiers.

The INTEGRATED SCORE is evaluated as follows: (a) the "potential GAM RNA" having the highest score is preferably taken to be the most probable GAM RNA, and (b) if the integrated score of this most probable GAM RNA is higher than a pre-defined threshold, then the most probable GAM RNA is accepted as a PREDICTED GAM RNA. Preferably, this evaluation technique is not limited to the highest scoring potential GAM RNA.

As a final optional stage we may filter PREDICTED GAM RNAs with low complexity, which have high probability to be part of repeated element in the DNA (for example ATATATA sequences). For each PREDICTED GAM RNA sequence we count the number of occurrences of each 2 nucleotides combination (AA, AT, AC), we filter out sequences where the sum of the most 2 probable combination is higher then 9. Using this criteria we filter 2% of the known miRNA and around 30% of the PREDICTED GAM RNAs.

Figure 7A:
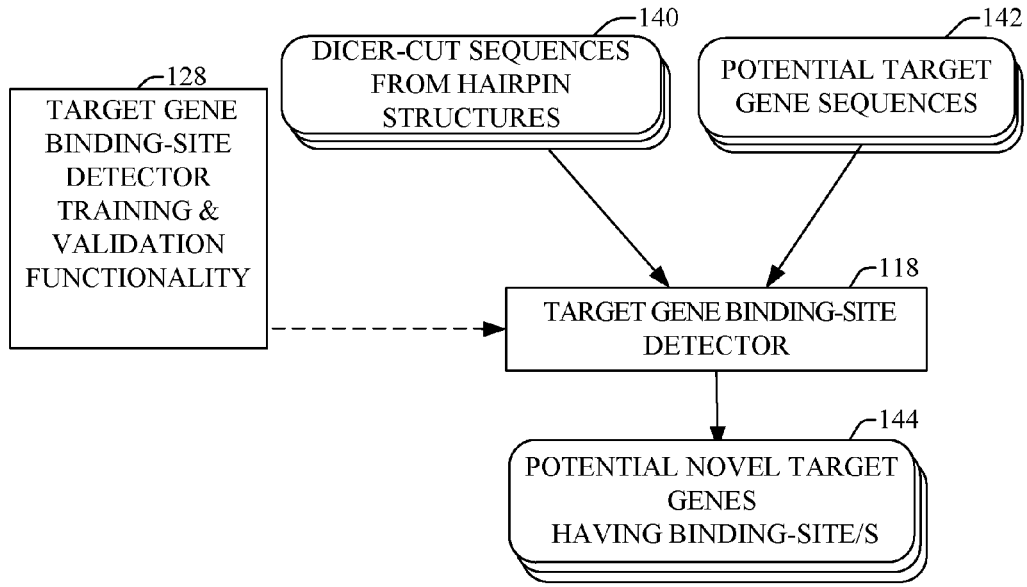
FIG. 7A is a simplified block diagram of a target gene binding-site detector constructed and operative in accordance with a preferred embodiment of the present invention.

Reference is now made to FIG. 7A which is a simplified block diagram of a preferred implementation of the TARGET GENE BINDING-SITE DETECTOR 118 described hereinabove with reference to FIG. 2. The goal of the TARGET GENE BINDING-SITE DETECTOR 118 is to detect one or more binding sites such as BINDING SITE I, BINDING SITE II and BINDING SITE III (FIG. 1) located in 3' untranslated regions of the mRNA of a known gene, the nucleotide sequence of which binding sites is partially or fully complementary to a GAM RNA, thereby determining that the above mentioned known gene is a target gene thereof.

The TARGET GENE BINDING-SITE DETECTOR 118 (FIG. 2) receives a plurality of DICER-CUT SEQUENCES FROM HAIRPIN STRUCTURES 140 (FIG. 6A), and a plurality of POTENTIAL TARGET GENE SEQUENCES 142 which are derived from SEQUENCED DNA DATA 104 (FIG. 2).

TARGET GENE BINDING-SITE DETECTOR TRAINING & VALIDATION FUNCTIONALITY 128 (FIG. 3) is operative to train the TARGET GENE BINDING-SITE DETECTOR 118 on known miRNAs and their respective target genes and to build a background model for evaluation of a P value for the TARGET GENE BINDING-SITE DETECTOR 118 results It Construct the model by analyzing both heuristically and computationally the results of the TARGET GENE BINDING-SITE DETECTOR 118.

Following operation of TARGET GENE BINDING-SITE DETECTOR TRAINING & VALIDATION FUNCTIONALITY 128 (FIG. 3), the TARGET GENE BINDING-SITE DETECTOR 118 is operative to detect a plurality of POTENTIAL NOVEL TARGET GENES HAVING BINDING-SITE/S 144 the nucleotide sequence of which is partially or fully complementary to that of each of the plurality of DICER-CUT SEQUENCES FROM HAIRPIN STRUCTURES 140. Preferred operation of the TARGET GENE BINDING-SITE DETECTOR 118 is further described hereinbelow with reference to FIG. 7B.

Figure 7B:
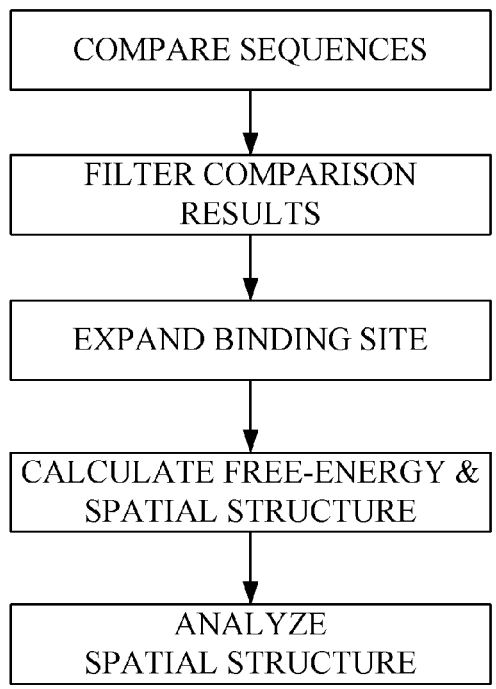
FIG. 7B is a simplified flowchart illustrating operation of a target gene binding-site detector constructed and operative in accordance with a preferred embodiment of the present invention.

Reference is now made to FIG. 7B which is a simplified flowchart illustrating a preferred operation of the TARGET GENE BINDING-SITE DETECTOR 118 of FIG. 2. In a preferred embodiment of the present invention, the TARGET GENE BINDING-SITE DETECTOR 118 employs a match search tool, described hereinbelow, in order to compare the nucleotide sequence of each of the plurality of DICER-CUT SEQUENCES FROM HAIRPIN STRUCTURES 140 (FIG. 6A), to the POTENTIAL TARGET GENE SEQUENCES 142 (FIG. 7A), such as 3 untranslated regions of known mRNAs, in order to find crude potential matches. Alternatively, a sequence comparison algorithm such as BLAST can be used.

The match search tool compare the DICER-CUT SEQUENCES FROM HAIRPIN STRUCTURES 140 (FIG. 7A) to POTENTIAL TARGET GENE SEQUENCES 142 (FIG. 7A). the methodology of the match search tool is to match Nucleotides 1:8 of DICER-CUT SEQUENCES FROM HAIRPIN STRUCTURES 140 (FIG. 7A) to POTENTIAL TARGET GENE SEQUENCES 142 (FIG. 7A). The results are preferably filtered to allow at most 1 edit distance between the DICER-CUT SEQUENCES FROM HAIRPIN STRUCTURES 140 (FIG. 7A) complementary sequence and POTENTIAL TARGET GENE SEQUENCES 142 (FIG. 7A).

In a preferred implementation of the match search tool, it first calculates two preprocess data structures: the first, store for every 9 nts sequences all its appearances in the POTENTIAL TARGET GENE SEQUENCES 142 (FIG. 7A).

The second is a map of all the 8 nts sequence to 9 nts sequences that can be accepted by adding one nucleotide and performing one or less editing actions to the 8 nts complementary sequence. This two data structures help to improve performance and to perform the binding site filtering stage as an integral part of the search. The match search tool in this implementation returns for every DICER-CUT SEQUENCES FROM HAIRPIN STRUCTURES 140 (FIG. 7A all the appearances of the 9 nts sequence in the POTENTIAL TARGET GENE SEQUENCES 142 (FIG. 7A) that are calculated using the second, describe hereinabove, data structure from its first 8 nts. The 9 nts sequences appearances are the potentially 3 of the POTENTIAL TARGET GENE SEQUENCES 142 (FIG. 7A) binding site of each DICER-CUT SEQUENCES FROM HAIRPIN STRUCTURES 140 (FIG. 7A Next the binding sites are expanded, and determinations are made whether if nucleotide sequences immediately upstream to the binding sites 3 part matches with the 3' end of the DICER-CUT SEQUENCES FROM HAIRPIN STRUCTURES. The alignment of the binding site 5 part is made by the alignment algorithm with specific weighting parameters describes hereinbelow with reference to FIG. 5). Alternatively the alignment can include also the 3 part of the binding site.

The alignment algorithm (implemented here) with specific weighting parameters. The weighting parameters are based on analyze of known miRNA binding sites (references: Wightman et al. Cell 1993, Moss Cell 1997, Reinhart Nature 2000, Abrahante Developmental Cell 2003 and Lin Developmental Cell 2003, Brennecke Cell 2003, Stark PLOS 2003, lewis et al. Cell 2003). It was heuristically found to best distinguish between known miRNA binding sites and sequences which are known not to be miRNA binding sites.

According to a preferred embodiment of the present invention a good matching at 5' end of the miRNA (nucleotides 1-8), and at 3' end of the miRNA, (the last 9 nucleotides) is required. The matching at 5' end is crucial for the binding while the 3' end binding is less important but can compensate on few mismatches at the 5'. The nucleotides at the middle of the miRNA have no punishment for any editing operation (reference: Doench et al. Gene and Development 2004). In this preferred embodiment the alignment of the 5 end of the miRNA (3 of the binding site) is a result of the match search tool, while the middle and 3 miRNA (5 of the binding site) is done by the alignment algorithm. The alignment is a combination of both. Alternatively, the alignment is done for all the miRNA and all the binding site sequence. The alignment algorithm finds the lowest free-energy spatial structure and heuristic constrain that were found to distinct the known binding sites in the best way. The alignment yields 2 scores for 5' end and 3' end. Each score represents the inverse of its probability to obtain such or higher score by running random sequences, with 22 nucleotides length and same base composition as known miRNA, with randomly chosen 3 un translated region sequences. The final score is the multiplicity of the two scores.

The binding site detector, then analyze the spatial structure of the miRNA with all its potential target gene 3 un translated region. It assesses the list of binding sites of each miRNA—Target gene pair with their positions and respective scores. The TARGET GENE BINDING-SITE DETECTOR 118 (FIG. 7A) then uses the fact that Many of the known binding sites are clustered, to evaluate the P value of obtaining cluster of few binding sites on the same target gene 3 un translated region in the following way: It scans different scores threshold, and calculate for each threshold the number and positions of possible binding sites with score above the threshold. It then gets from a preprocess calculated background matrixes, describe hereinbelow, a P value for each threshold and number and positions of binding sites combination. The output score for each miRNA and target gene pair is the minimal P value, normalized with the number of thresholds trying using Bernoulli distribution. A preference of low P value pairs is made.

As mentioned hereinabove, for each target gene a preprocess calculated background matrixes were build. The matrixes includes rows for each number of miRNA binding site (In the preferred embodiment the matrix include 7 rows for 0 to 6 binding site.), and columns for each different score threshold (In the preferred embodiment the matrix include 5 columns for 5 different threshold). Each matrix cell, corresponding to specific number of binding site and threshold, was set to be the probability to get equal or more binding sites with equal or more score by random sequences with 22 nucleotides length with the same letter distribution as known miRNAs (29.5% T, 24.5% A, 25% G and 21% C). Those probabilities are calculated by running the above procedure for 10000 random sequences. The P value can be estimated as the number of random sequences obeys the matrix cell requirement divided by the total number of random sequences (10000). In the preferred embodiment 2 matrixes are calculated. The P values are of the second matrix are calculated under constrain that at least two of the binding site position are under a heuristically determine constant value. The second matrix values are calculated without this constrain. The TARGET GENE BINDING-SITE DETECTOR uses the second matrix if the binding sites position agree with the constrain, else it uses the first. In an alternative embodiment only one matrix is calculated without any constrain on the binding sites positions.

Test preformed using the TARGET GENE BINDING-SITE DETECTOR showed that all of the known miRNA target genes are found using this algorithm with a P value of less than 0.5%. Running known miRNA against 3400 potential 3' UTR of target genes sequences yield on average 32 target genes for each miRNA with P value less than 0.5%, while background sequences, as well as inverse or complement sequence of known miRNA (which preserve their high order sequence statistics) found, as excepted, on average 17 target genes. This reflects the algorithm performance to detect real target genes with 47% accuracy.

Scoring of all potential binding sites are calculated and P value for obtaining such binding sites list for DICER-CUT SEQUENCE FROM HAIRPIN STRUCTURE and POTENTIAL TARGET GENE SEQUENCE pair is evaluate using the background matrix. In accordance with another preferred embodiment of the present invention, binding sites are searched by a reversed process. Sequences of K (preferably 22) nucleotides of a untranslated regions of a target gene are assessed as potential binding sites. A sequence comparison algorithm, such as BLAST or EDIT DISTANCE varinet, is then used to search elsewhere in the genome for partially or fully complementary sequences which are found in known miRNA oligonucleotides or computationally predicted GAM oligonucleotides. Only complementary sequences, which meet predetermined spatial structure and free energy criteria as described hereinabove, are accepted. Clustered binding sites are strongly preferred and potential binding sites and potential GAM oligonucleotides which occur in evolutionarily conserved genomic sequences are also preferred. Scoring of candidate binding sites takes into account free energy and spatial structure of the binding site complexes, as well as the aforesaid preferences.

Figure 8:
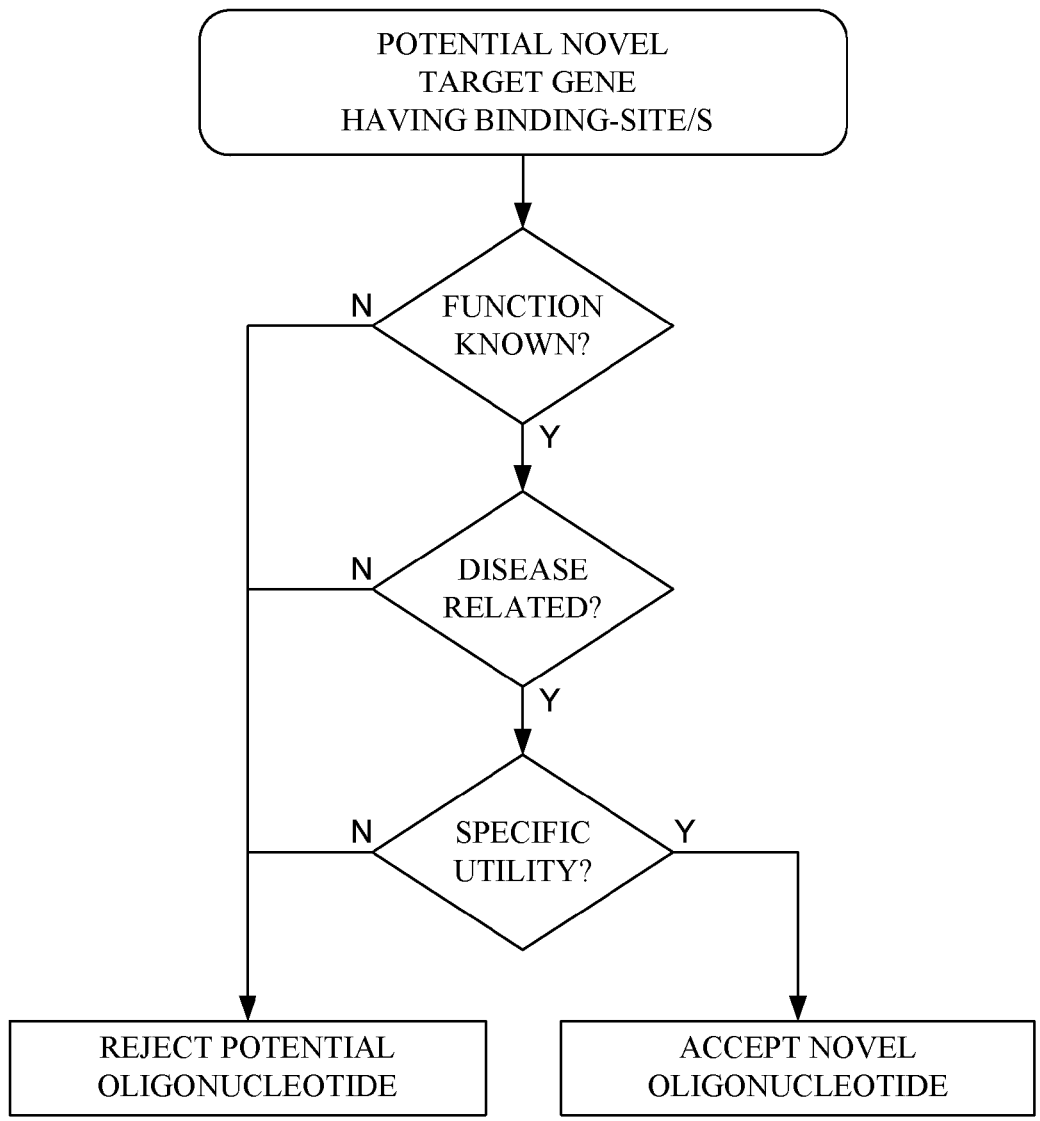
FIG. 8 is a simplified flowchart illustrating operation of a function & utility analyzer constructed and operative in accordance with a preferred embodiment of the present invention.

Reference is now made to FIG. 8 which is a simplified flowchart illustrating a preferred operation of the FUNCTION & UTILITY ANALYZER 120 described hereinabove with reference to FIG. 2. The goal of the FUNCTION & UTILITY ANALYZER 120 is to determine if a potential target gene is in fact a valid clinically useful target gene. Since a potential novel GAM oligonucleotide binding a binding site in the UTR of a target gene is understood to inhibit expression of that target gene, and if that target gene is shown to have a valid clinical utility, then in such a case it follows that the potential novel oligonucleotide itself also has a valid useful function which is the opposite of that of the target gene.

The FUNCTION & UTILITY ANALYZER 120 preferably receives as input a plurality of POTENTIAL NOVEL TARGET GENES HAVING BINDING-SITE/S 144 (FIG. 7A), generated by the TARGET GENE BINDING-SITE DETECTOR 118 (FIG. 2). Each potential oligonucleotide is evaluated as follows: First, the system checks to see if the function of the potential target gene is scientifically well established. Preferably, this can be achieved bioinformatically by searching various published data sources presenting information on known function of proteins. Many such data sources exist and are published as is well known in the art. Next, for those target genes the function of which is scientifically known and is well documented, the system then checks if scientific research data exists which links them to known diseases. For example, a preferred embodiment of the present invention utilizes the OMIM™ (Hamosh et al, 2002) database published by NCBI, which summarizes research publications relating to genes which have been shown to be associated with diseases. Finally, the specific possible utility of the target gene is evaluated. While this process too may be facilitated by bioinformatic means, it might require manual evaluation of published scientific research regarding the target gene, in order to determine the utility of the target gene to the diagnosis and or treatment of specific disease. Only potential novel oligonucleotides, the target genes of which have passed all three examinations, are accepted as novel oligonucleotide.

Figure 9:
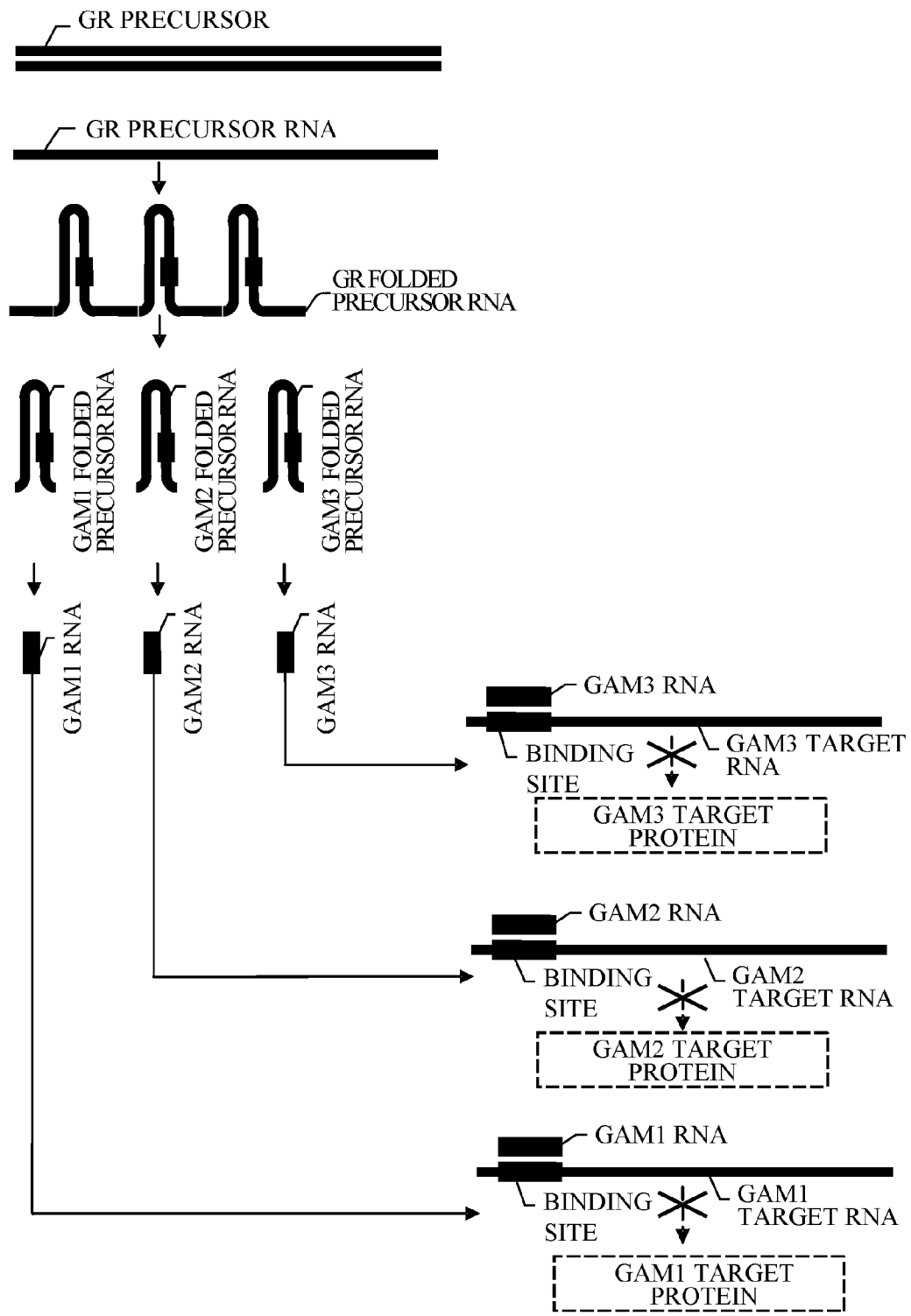
FIG. 9 is a simplified diagram describing a novel bioinformatically detected group of regulatory polynucleotides, referred to here as Genomic Record (GR) polynucleotides, each of which encodes an 'operon-like' cluster of novel miRNA-like oligonucleotides, which in turn modulate expression of one or more target genes.

Reference is now made to FIG. 9, which is a simplified diagram describing each of a plurality of novel bioinformatically detected regulatory polynucleotide referred to here as Genomic Record (GR) polynucleotide, which encodes an 'operon-like' cluster of novel microRNA-like oligonucleotides, each of which in turn modulates expression of at least one target gene; the function and utility of which at least one target gene is known in the art.

GR PRECURSOR is a novel bioinformatically detected regulatory, non protein coding polynucleotide. The method by which GR PRECURSOR is detected is described hereinabove with additional reference to FIGS. 1-9.

GR PRECURSOR is preferably encoded by the bacterial genome and contains cluster of novel bacterial oligonucleotides, which preferably binds to a human target genes or to the bacterium self-genes. Alternatively or additionally, GR PRECURSOR is encoded by the human genome and contains cluster of novel human oligonucleotides, which preferably binds to bacterial target genes or to human self-genes.

GR PRECURSOR encodes GR PRECURSOR RNA, an RNA molecule, typically several hundred to several thousand nucleotides long. GR PRECURSOR RNA folds spatially, forming GR FOLDED PRECURSOR RNA. It is appreciated that GR FOLDED PRECURSOR RNA comprises a plurality of what is known in the art as 'hairpin' structures. These 'hairpin' structures are due to the fact that the nucleotide sequence of GR PRECURSOR RNA comprises a plurality of segments, the first half of each such segment having a nucleotide sequence which is at least a partial or accurate reverse-complement sequence of the second half thereof, as is well known in the art.

GR FOLDED PRECURSOR RNA is naturally processed by cellular enzymatic activity into a plurality of separate GAM precursor RNAs, herein schematically represented by GAM1 FOLDED PRECURSOR RNA through GAM3 FOLDED PRECURSOR RNA, each of which GAM folded precursor RNAs being a hairpin shaped RNA segment, corresponding to GAM FOLDED PRECURSOR RNA of FIG. 1.

The above mentioned GAM folded precursor RNAs are diced by DICER COMPLEX of FIG. 1, yielding respective short RNA segments of about 22 nucleotides in length, schematically represented by GAM1 RNA through GAM3 RNA, each of which GAM RNAs corresponding to GAM RNA of FIG. 1. GAM1 RNA, GAM2 RNA and GAM3 RNA, each bind complementarily to binding sites located in untranslated regions of respective target genes, designated GAM1 TARGET RNA, GAM2 TARGET RNA and GAM3 TARGET RNA, respectively, which target binding site corresponds to a target binding site such as BINDING SITE I, BINDING SITE II or BINDING SITE III of FIG. 1. This binding inhibits translation of the respective target proteins designated GAM1 TARGET PROTEIN, GAM2 TARGET PROTEIN and GAM3 TARGET PROTEIN respectively.

It is appreciated that specific functions, and accordingly utilities of GR polynucleotide are correlated with and may be deduced from the identity of the target genes, which are inhibited by GAM RNAs comprised in the 'operon-like' cluster of GR polynucleotide, schematically represented by GAM1 TARGET PROTEIN through GAM3 TARGET PROTEIN. The function of these target genes is elaborated in Table 8, hereby incorporated herein.

Figure 10:
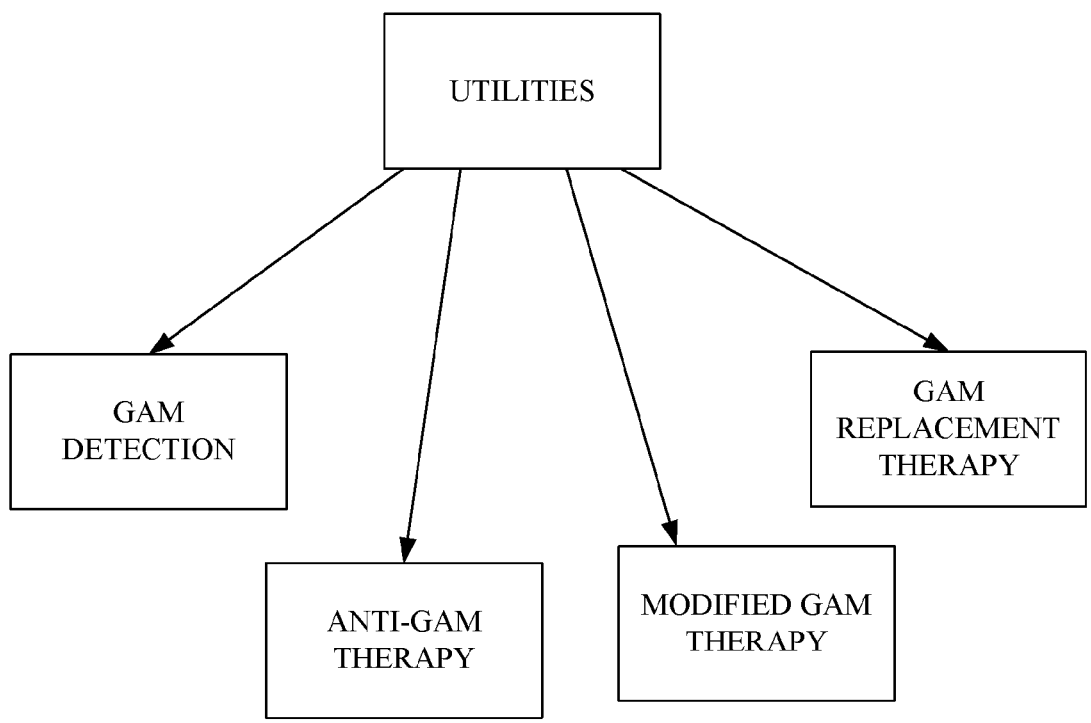
FIG. 10 is a block diagram illustrating different utilities of novel oligonucleotides and novel operon-like polynucleotides, both of the present invention.

Reference is now made to FIG. 10 which is a block diagram illustrating different utilities of oligonucleotide of the novel group of oligonucleotides of the present invention referred to here as GAM oligonucleotides and GR polynucleotides. The present invention discloses a first plurality of novel oligonucleotides referred to here as GAM oligonucleotides and a second plurality of operon-like polynucleotides referred to here as GR polynucleotides, each of the GR polynucleotide encoding a plurality of GAM oligonucleotides. The present invention further discloses a very large number of known target genes, which are bound by, and the expression of which is modulated by each of the novel oligonucleotides of the present invention. Published scientific data referenced by the present invention provides specific, substantial, and credible evidence that the above mentioned target genes modulated by novel oligonucleotides of the present invention, are associated with various diseases. Specific novel oligonucleotides of the present invention, target genes thereof and diseases associated therewith, are described hereinbelow with reference to Tables 1 through 10. It is therefore appreciated that a function of GAM oligonucleotides and GR polynucleotides of the present invention is modulation of expression of target genes related to known bacterial diseases, and that therefore utilities of novel oligonucleotides of the present invention include diagnosis and treatment of the above mentioned diseases.

FIG. 10 describes various types of diagnostic and therapeutic utilities of novel oligonucleotides of the present invention. A utility of novel oligonucleotide of the present invention is detection of GAM oligonucleotides and of GR polynucleotides. It is appreciated that since GAM oligonucleotides and GR polynucleotides modulate expression of disease related target genes, that detection of expression of GAM oligonucleotides in clinical scenarios associated with said bacterial diseases is a specific, substantial and credible utility. Diagnosis of novel oligonucleotides of the present invention may preferably be implemented by RNA expression detection techniques, including but not limited to biochips, as is well known in the art. Diagnosis of expression of oligonucleotides of the present invention may be useful for research purposes, in order to further understand the connection between the novel oligonucleotides of the present invention and the above mentioned related bacterial diseases, for disease diagnosis and prevention purposes, and for monitoring disease progress.

Another utility of novel oligonucleotides of the present invention is anti-GAM therapy, a mode of therapy which allows up regulation of a bacterial disease-related target gene of a novel GAM oligonucleotide of the present invention, by lowering levels of the novel GAM oligonucleotide which naturally inhibits expression of that target gene. This mode of therapy is particularly useful with respect to target genes which have been shown to be under-expressed in association with a specific bacterial disease. Anti-GAM therapy is further discussed hereinbelow with reference to FIGS. 11A and 11B.

A further utility of novel oligonucleotides of the present invention is GAM replacement therapy, a mode of therapy which achieves down regulation of a bacterial disease related target gene of a novel GAM oligonucleotide of the present invention, by raising levels of the GAM which naturally inhibits expression of that target gene. This mode of therapy is particularly useful with respect to target genes which have been shown to be over-expressed in association with a specific bacterial disease. GAM replacement therapy involves introduction of supplementary GAM products into a cell, or stimulation of a cell to produce excess GAM products. GAM replacement therapy may preferably be achieved by transfecting cells with an artificial DNA molecule encoding a GAM which causes the cells to produce the GAM product, as is well known in the art.

Yet a further utility of novel oligonucleotides of the present invention is modified GAM therapy. Disease conditions are likely to exist, in which a mutation in a binding site of a GAM RNA prevents natural GAM RNA to effectively bind inhibit a bacterial disease related target gene, causing up regulation of that target gene, and thereby contributing to the disease pathology. In such conditions, a modified GAM oligonucleotides is designed which effectively binds the mutated GAM binding site, i.e. is an effective anti-sense of the mutated GAM binding site, and is introduced in disease effected cells. Modified GAM therapy is preferably achieved by transfecting cells with an artificial DNA molecule encoding the modified GAM which causes the cells to produce the modified GAM product, as is well known in the art.

Figure 11A:
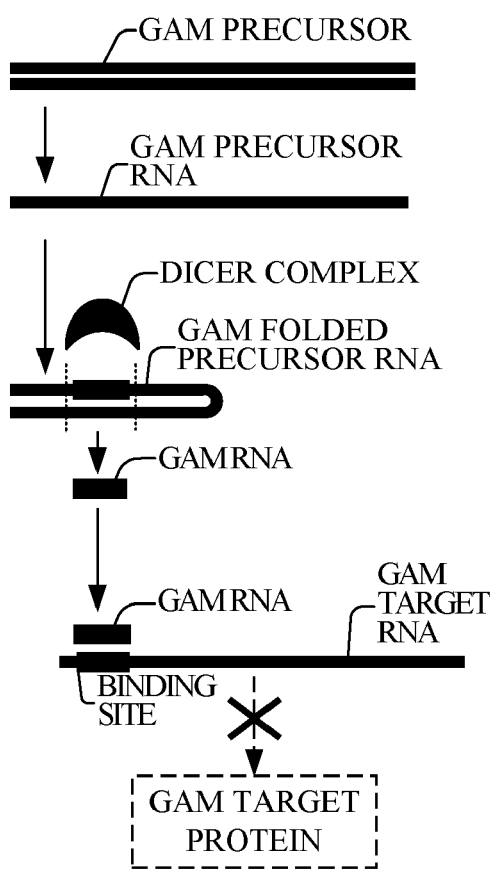
FIGS. 11A and 11B are simplified diagrams, which when taken together illustrate a mode of oligonucleotide therapy applicable to novel oligonucleotides of the present invention.
Figure 11B:
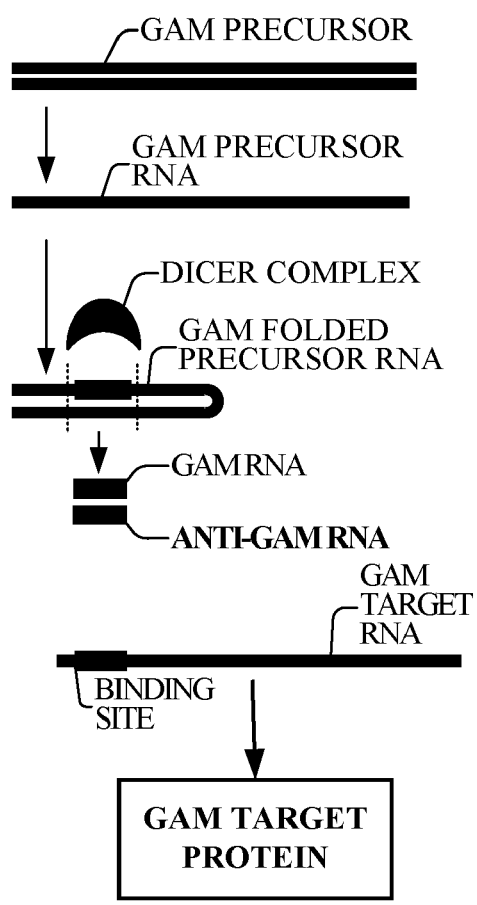

Reference is now made to FIGS. 11A and 11B, simplified diagrams which when taken together illustrate anti-GAM therapy mentioned hereinabove with reference to FIG. 10. A utility of novel GAMs of the present invention is anti-GAM therapy, a mode of therapy which allows up regulation of a bacterial disease-related target gene of a novel GAM of the present invention, by lowering levels of the novel GAM which naturally inhibits expression of that target gene. FIG. 11A shows a normal GAM inhibiting translation of a target gene by binding of GAM RNA to a BINDING SITE found in an untranslated region of GAM TARGET RNA, as described hereinabove with reference to FIG. 1.

FIG. 11B shows an example of anti-GAM therapy. ANTI-GAM RNA is short artificial RNA molecule the sequence of which is an anti-sense of GAM RNA. Anti-GAM treatment comprises transfecting diseased cells with ANTI-GAM RNA, or with a DNA encoding thereof. The ANTI-GAM RNA binds the natural GAM RNA, thereby preventing binding of natural GAM RNA to its BINDING SITE. This prevents natural translation inhibition of GAM TARGET RNA by GAM RNA, thereby up regulating expression of GAM TARGET PROTEIN.

It is appreciated that anti-GAM therapy is particularly useful with respect to target genes which have been shown to be under-expressed in association with a specific bacterial disease.

Furthermore, anti-GAM therapy is particularly useful, since it may be used in situations in which technologies known in the art as RNAi and siRNA can not be utilized. As in known in the art, RNAi and siRNA are technologies which offer means for artificially inhibiting expression of a target protein, by artificially designed short RNA segments which bind complementarily to mRNA of said target protein. However, RNAi and siRNA can not be used to directly up regulate translation of target proteins.

Figure 12A:
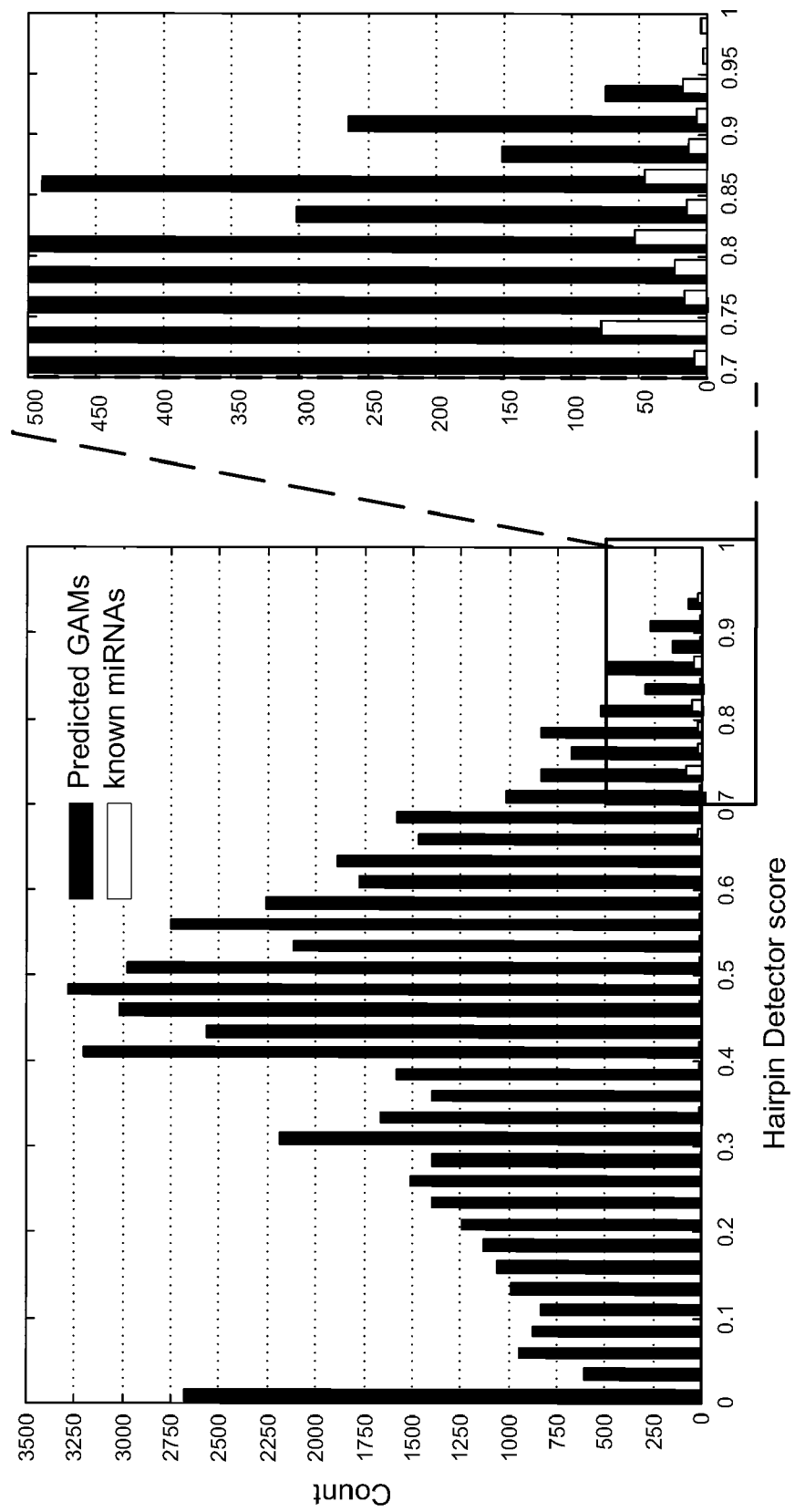
FIG. 12A is a histogram representing the distribution of known miRNA oligonucleotides and that of predicted miRNA-like hairpin structures extracted from expressed genome sequences with respect to their hairpin detector score.

Reference is now made to FIG. 12A, which is a histogram representing the distribution of known miRNA oligonucleotides and that of hairpin structures extracted from expressed human genome sequences with respect to their HAIRPIN DETECTOR score (this analysis preferably uses the previous version of the Hairpin Detector program). The known miRNA oligonucleotides set is taken from RFAM database, Release 2.1 and includes 440 miRNA oligonucleotides from H. sapienas, M. musculus, C. elegans, C. brigassae and D. melanogaster. Folding of expressed genome sequences taken from public databases of ESTs (Unigene-NCBI and TIGR) identified 342,882 hairpin structures. ~154,000 out of the 342,882 hairpin structures did not pass the filter of being identified as hairpins in several secondary structure folding versions of the given genomic sequence, as described hereinabove with reference to FIG. 5B, and hence did not receive a Hairpin detector score. Furthermore, ~133,000 hairpin structures did not pass the filter of minimum score of the DICER-CUT LOCATION DETECTOR 116 (FIG. 2) (those ~287,000 hairpin structures are not represented in the histogram). Hairpin structures are considered as miRNA-like precursor oligonucleotides here referred to as GAM precursor, if their Hairpin detector score is above 0.3. Thus, the GAM precursor set is comprised of ~40,000 hairpin structures, of those ~5100 received a high Hairpin detector score (>=0.7). These are much higher numbers than those of the known miRNA oligonucleotides and of the upper bound of ~255 human miRNA oligonucleotides, estimated by Bartel et al. (Science, 299, 1540, March 2003). Of the reference set that pass the above filter (408/440), 284 (69%) received a high Hairpin detector score (>=0.7).

Reference is now made to FIG. 12B, which is a table summarizing laboratory validation results that validate efficacy of the BIOINFORMATIC OLIGONUCLEOTIDE DETECTION ENGINE 100 (FIG. 2). In order to assess efficacy of the BIOINFORMATIC OLIGONUCLEOTIDE DETECTION ENGINE 100, novel oligonucleotides predicted thereby are preferably filtered using the scores of HAIRPIN DETECTOR 114 (FIG. 2) and DICER-CUT LOCATION DETECTOR 116 (FIG. 2) as follows: covering 85% (second column) of published hairpin our algorithm enable to filter 95% of background (third column), leaving only dozens of predicted hairpins with relatively high probability of being a real hairpin carrying a 'diced' miRNA for lab validation.

Group A (selected for the present invention, first column): The score of the HAIRPIN-DETECTOR is above 0, the overall score of the two-phased predictor is above 0.55, and the score of the second phase of the two-phased predictor is above 0.75, or the score of the EDIT-DISTANCE predictor is equal or above 17. In this group, one Dicer cut location is predicted for each hairpin.

Sample of novel bioinformatically predicted human GAMs are sent to the laboratory for validation (fourth column), and the number (fifth column) and percent (sixth column) of successful validation of predicted human GAM is noted for each of the groups, as well as overall (bottom line). The information about the above lab validation is based on previous patents group selections, there is a high correlation between the old group A predicted hairpin and the present one indicate that the update results should be approximately the same or better, due to improvement in the predictions.

It is appreciated that the present invention comprises 6444 novel GAM oligonucleotides, which fall into group A, and that the BIOINFORMATIC OLIGONUCLEOTIDE DETECTION ENGINE 100 (FIG. 2) is substantiated by a group of 37 novel human GAM oligonucleotides validated by laboratory means, out of 101 human GAM oligonucleotides which were tested in the lab, resulting in validation of an overall 31% accuracy. The selected group demonstrated 37% accuracy. Pictures of test-results of specific human GAM oligonucleotides as well as the methodology used for validating the expression of predicted oligonucleotides are elaborated hereinbelow with reference to FIG. 13.

It is further appreciated that failure to detect a predicted oligonucleotide in the lab does not necessarily indicate a mistaken bioinformatic prediction. Rather, it may be due to technical sensitivity limitation of the lab test, or because the predicted oligonucleotides are not expressed in the tissue examined, or at the development phase tested.

It is still further appreciated that in general these findings are in agreement with the expected bioinformatic accuracy, as describe hereinabove with reference to FIG. 6B: assuming 80% accuracy of the HAIRPIN DETECTOR 114 and 80% accuracy of the DICER-CUT LOCATION DETECTOR 116 and 80% accuracy of the lab validation, this would result in 50% overall accuracy of the predicted oligonucleotide validated in the lab.

Figure 13A:
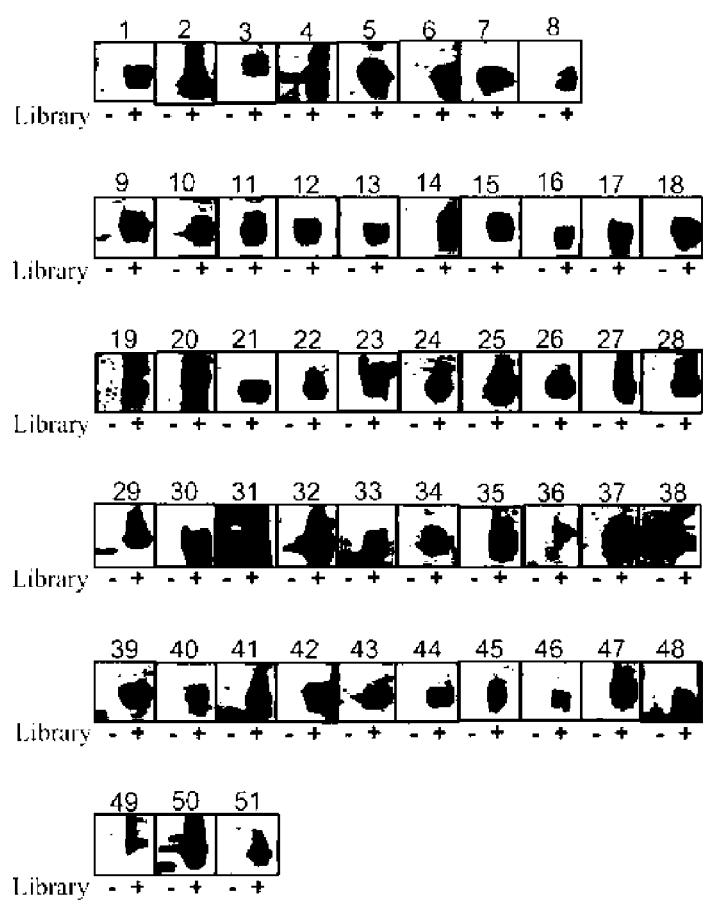

Reference is now made to FIG. 13A which is a picture of laboratory results validating the expression of 43 novel human GAM oligonucleotides detected by the BIOINFORMATIC OLIGONUCLEOTIDE DETECTION ENGINE 100 (FIG. 2).

Reference is now made to FIG. 13A and FIG. 13B which are pictures and a summary table of laboratory results validating the expression of 43 novel human GAM oligonucleotides detected by the BIOINFORMATIC OLIGONUCLEOTIDE DETECTION ENGINE 100. In each row in FIG. 13A, pictures of several oligonucleotides validated by hybridization of Polymerase Chain Reaction (PCR)-product southern-blots, are provided, each corresponding to a specific GAM oligonucleotide, as elaborated hereinbelow. To test our validation method, we used a reference set of 8 known human miRNA oligonucleotides, as a blind test to our laboratory. These PCR-product hybridization pictures are designated 1 through 8 for the reference set known miRNA oligonucleotides; and 9 through 51 for predicted GAM oligonucleotides.

In each PCR hybridization picture, 2 lanes are seen: the test lane, designated "+" and the control lane, designated "−". The control reaction contained all the components of the test reaction except library template. For convenience of viewing the results, all PCR-product hybridization pictures of FIG. 22A have been shrunk ×4 vertically. It is appreciated that for each of the tested GAM oligonucleotides a clear hybridization band appears in the test ("+") lane, but not in the control ("−") lane.

Specifically, FIG. 13A shows pictures of PCR-product hybridization validation by southern-blot, the methodology of which is described hereinbelow, to the following novel human GAM oligonucleotides (RosettaGenomics Ltd. Nomenclature, 'A' and 'B' referred to the Dicer Cut Location as described hereinbelow with reference to the description of large tables:

(1) hsa-MIR-21; (2) hsa-MIR-27b; (3) hsa-MIR-186; (4) hsa-MIR-93; (5) hsa-MIR-26a; (6) hsa-MIR-191; (7) hsa-MIR-31; (8) hsa-MIR-92; (9) GAM3418-A (later published by other researchers as hsa-MIR23); (10) GAM4426-A; (11) GAM281-A; (12) GAM7553-A; (13) GAM5385-A; (14) GAM2608-A; (15) GAM1032-A; (16) GAM3431-A; (17) GAM7933-A; (18) GAM3298-A; (19) GAM7080-A; (20) GAM895-A; (21) GAM3770.1; (22) GAM337162-A; (23) GAM 8678-A; (24) GAM2033-A; (25) GAM7776-A; (26) GAM8145-A; (27) GAM25-A; (28) GAM7352.1; (29) GAM337624-A; (30) GAM1479-A; (31) GAM2270-A; (32) GAM7591-A; (33) GAM8285-A; (34) GAM6773-A; (35) GAM336818-A; (36) GAM336487-A; (37) GAM337620-A; (38) GAM336809-A; (39) GAM5346-A; (40) GAM8554-A; (41) GAM2071-A; (42) GAM7957-A; (43) GAM391-A; (44) GAM6633-A; (45) GAM19; (46) GAM8358-A; (47) GAM3229-A; an) GAM 7052-A; (49) GAM3027-A; (50) GAM21 and (51) GAM oligonucleotide similar to mmu-MIR-30e.

The next validated GAM oligonucleotides are highly similar or identical to known mouse-miRNA oligonucleotides: GAM3027-A, similar to mmu-MIR-29c; GAM21, similar to mmu-MIR-130b; and GAM oligonucleotide which is highly similar to mmu-MIR-30e (picture number 51). In addition to the PCR—product hybridization detection, the following GAMs were also cloned and sequenced: GAM3418-A, GAM5385-A, GAM1032-A, GAM3298-A, GAM7080-A, GAM1338-A, GAM7776-A, GAM25-A, GAM337624-A, GAM1479-A, GAM6773-A, GAM336818-A, GAM336487-A, GAM337620-A, GAM336809-A, GAM3027-A, GAM21, and GAM oligonucleotide similar to mmu-MIR-30e (picture number 51). Furthermore, the following GAM oligonucleotides were sequenced directly from the ligation reaction by the method described hereinbelow under LIGATION-PCR DIAGNOSTIC METHOD: GAM4426-A, GAM7553-A, GAM2270-A, and GAM7591-A.

In order to validate the expression of predicted novel GAMs and assuming that these novel GAM oligonucleotides are probably expressed at low concentrations, a PCR product cloning approach was set up through the following strategy: two types of cDNA libraries designated "One tailed" and "Ligation" were prepared from frozen HeLa S100 extract (4c Biotech, Belgium) size fractionated RNA. Essentially, Total S100 RNA was prepared through an SDS-Proteinase K incubation followed by an acid Phenol-Chloroform purification and Isopropanol precipitation. Alternatively, total HeLa RNA was also used as starting material for these libraries.

Fractionation was done by loading up to 500 g per YM100 Amicon Microcon column (Millipore) followed by a 500 g centrifugation for 40 minutes at 4° C. Flow through "YM100" RNA consisting of about of the total RNA was used for library preparation or fractionated further by loading onto a YM30 Amicon Microcon column (Millipore) followed by a 13,500 g centrifugation for 25 minutes at 4° C. Flowthrough "YM30" was used for library preparation as is and consists of less than 0.5% of total RNA. For the both the "ligation" and the "One-tailed" libraries, RNA was dephosphorylated and ligated to an RNA (lowercase)-DNA (UPPERCASE) hybrid 5-phosphorylated, 3 idT blocked 3-adapter (5-P-uuuAACCGCATC-CTTCTC-idT-3 (SEQ ID No: 59888) Dharmacon #P-002045-01-05) (as elaborated in Elbashir et al., Genes Dev. 15:188-200 (2001)) resulting in ligation only of RNase III type cleavage products. 3-Ligated RNA was excised and purified from a half 6%, half 13% polyacrylamide gel to remove excess adapter with a Nanosep 0.2M centrifugal device (Pall) according to instructions, and precipitated with glycogen and 3 volumes of Ethanol. Pellet was resuspended in a minimal volume of water.

For the "ligation" library a DNA (UPPERCASE)-RNA (lowercase) hybrid 5-adapter (5-TACTAATACGACTCAC-Taaa-3 (SEQ ID No: 59889) Dharmacon #P-002046-01-05) was ligated to the 3-adapted RNA, reverse transcribed with "EcoRI-RT": (5-GACTAGCTGGAATTCAAGGATGCG-GTTAAA-3)SEQ ID No: 59890, PCR amplified with two external primers essentially as in Elbashir et al 2001 except that primers were "EcoRI-RT" and "PstI Fwd" (5-CAGC-CAACGCTGCAGATACGACTCAC TAAA-3). (SEQ ID No: 59891). This PCR product was used as a template for a second round of PCR with one hemispecific and one external primer or with two hemispecific primers.

For the "One tailed" library the 3-Adapted RNA was annealed to 20 pmol primer "EcoRI RT" by heating to 70° C.

and cooling 0.1° C./sec to 30° C. and then reverse transcribed with Superscript II RT (According to instructions, Invitrogen) in a 20l volume for 10 alternating 5 minute cycles of 37° C. and 45° C. Subsequently, RNA was digested with 1l 2M NaOH, 2 mM EDTA at 65° C. for 10 minutes. cDNA was loaded on a polyacrylamide gel, excised and gel-purified from excess primer as above (invisible, judged by primer run alongside) and resuspended in 13l of water. Purified cDNA was then oligo-dC tailed with 400 U of recombinant terminal transferase (Roche molecular biochemicals), 1l 100M dCTP, 1l 15 mM CoCl2, and 4l reaction buffer, to a final volume of 20l for 15 minutes at 37 C. Reaction was stopped with 2l 0.2M EDTA and 15l 3M NaOAc pH 5.2. Volume was adjusted to 150l with water, Phenol: Bromochloropropane 10:1 extracted and subsequently precipitated with glycogen and 3 volumes of Ethanol. C-tailed cDNA was used as a template for PCR with the external primers "T3-PstBsg(G/I)18" (5-AATTAACCCTCACTAA AGGCTGCAGGTGCAG-GIGGGIIGGGIIGGGIIGN-3 (SEQ ID No: 59892 where I stands for Inosine and N for any of the 4 possible deoxynucleotides), and with "EcoRI Nested" (5-GGAATTCAAGGAT-GCGGTTA-3) (SEQ ID No: 59893). This PCR product was used as a template for a second round of PCR with one hemispecific and one external primer or with two hemispecific primers.

Hemispecific primers were constructed for each predicted GAM RNA oligonucleotide by an in-house program designed to choose about half of the 5 or 3 sequence of the GAM RNA corresponding to a TM of about 30-34° C. constrained by an optimized 3 clamp, appended to the cloning adapter sequence (for "One-tailed" libraries 5-GGN-NGGGNNG (SEQ ID No: 59894on the 5 end of the GAM RNA, or TTTAACCGCATC-3 (SEQ ID No: 59895 on the 3 end of the GAM RNA. For "Ligation" libraries the same 3 adapter and 5- CGACTCACTAAA (SEQ ID No: 59896 ) on the 5 end). Consequently, a fully complementary primer of a TM higher than 60 C was created covering only one half of the GAM RNA sequence permitting the unbiased elucidation by sequencing of the other half.

CONFIRMATION OF GAM OLIGONUCLEOTIDE SEQUENCE AUTHENTICITY OF PCR PRODUCTS:

SOUTHERN BLOT: PCR-product sequences were confirmed by southern blot (Southern E. M., Biotechnology, 1992, 24:122-39 (1975)) and hybridization with DNA oligonucleotide probes synthesized as complimentary (antisense) to predicted GAM RNA oligonucleotides. Gels were transferred onto a Biodyne PLUS 0.45m, (Pall) positively charged nylon membrane and UV cross-linked. Hybridization was performed overnight with DIG-labeled probes at 420 C in DIG Easy-Hyb buffer (Roche). Membranes were washed twice with 2×SSC and 0.1% SDS for 10 minutes at 420 C and then washed twice with 0.5×SSC and 0.1% SDS for 5 min at 420 C. The membrane was then developed by using a DIG luminescent detection kit (Roche) using anti-DIG and CSPD reaction, according to the manufacturer's protocol. All probes were prepared according to the manufacturers (Roche Molecular Biochemicals) protocols: Digoxigenin (DIG) labeled antisense transcripts was prepared from purified PCR products using a DIG RNA labeling kit with T3 RNA polymerase. DIG labeled PCR was prepared by using a DIG PCR labeling kit. 3-DIG-tailed oligo ssDNA antisense probes, containing DIG-dUTP and dATP at an average tail length of 50 nucleotides were prepared from 100 pmole oligonucleotides with the DIG Oligonucleotide Labeling Kit.

CLONE-SEQUENCING: PCR products were inserted into pGEM-T (Promega) or pTZ57/T (MBI Fermentas), heat-shock transformed into competent JM109 E. coli (Promega) and sown on LB-Ampiccilin plates with IPTG and Xgal. White and light-blue colonies were transferred to duplicate gridded plates, one of which was blotted onto a membrane (Biodyne Plus, Pall) for hybridization with DIG tailed oligo probes (according to instructions, Roche) complimentary to the expected GAM. Plasmid DNA from positive colonies was sequenced.

LIGATION-PCR DIAGNOSTIC METHOD: To further validate predicted GAM PCR product sequence derived from hemi-primers, a PCR based diagnostic technique was devised to amplify only those products containing also at least two additional nucleotides of the non hemi-primer defined part of the predicted GAM RNA oligonucleotide. In essence, a diagnostic primer was designed so that its 3 end, which is the specificity determining side, was identical to the desired GAM RNA oligonucleotide, 2-10 nucleotides (typically 4-7, chosen for maximum specificity) further into its 3 end than the nucleotide stretch primed by the hemi-primer. The hemi-primer PCR product was first ligated into a T-cloning vector (pTZ57/T or pGEM-T) as described hereinabove. The ligation reaction mixture was used as template for the diagnostic PCR under strict annealing conditions with the new diagnostic primer in conjunction with a general plasmid-homologous primer, resulting in a distinct ~200 base-pair product. This PCR product can be directly sequenced, permitting the elucidation of the remaining nucleotides up to the 3 of the mature GAM RNA oligonucleotide adjacent to the 3 adapter. Alternatively, following analysis of the diagnostic PCR reaction on an agarose gel, positive ligation reactions (containing a band of the expected size) were transformed into E. coli. Using this same diagnostic technique and as an alternative to screening by Southern-blot colonyhybridization, transformed bacterial colonies were screened by colony-PCR (Gussow, D. and Clackson, T, Nucleic Acids Res. 17: 4000 (1989)) prior to plasmid purification and sequencing.

Reference is now made to FIG. 13B which is a table summarizing laboratory results which validate the expression of 8 known human miRNA oligonucleotides and 43 novel GAM oligonucleotides detected by the BIOINFORMATIC OLIGONUCLEOTIDE DETECTION ENGINE 100. The table gives additional information on the above GAM oligonucleotides and contains the following fields: NUMBER: refers to the hybridization picture number of FIG. 13A; NAME: indicates the known MIR name for the reference set, or the GAM's name as given by RosettaGenomics nomenclature method; SEQUENCE: 5' to 3' sequence of the mature, 'diced' oligonucleotide; SEQUENCED: '+' indicates the additional validation of the GAM RNA sequence by sequencing procedure as described hereinabove with reference to FIG. 13A.

Figures 14A, 14B, 14C:
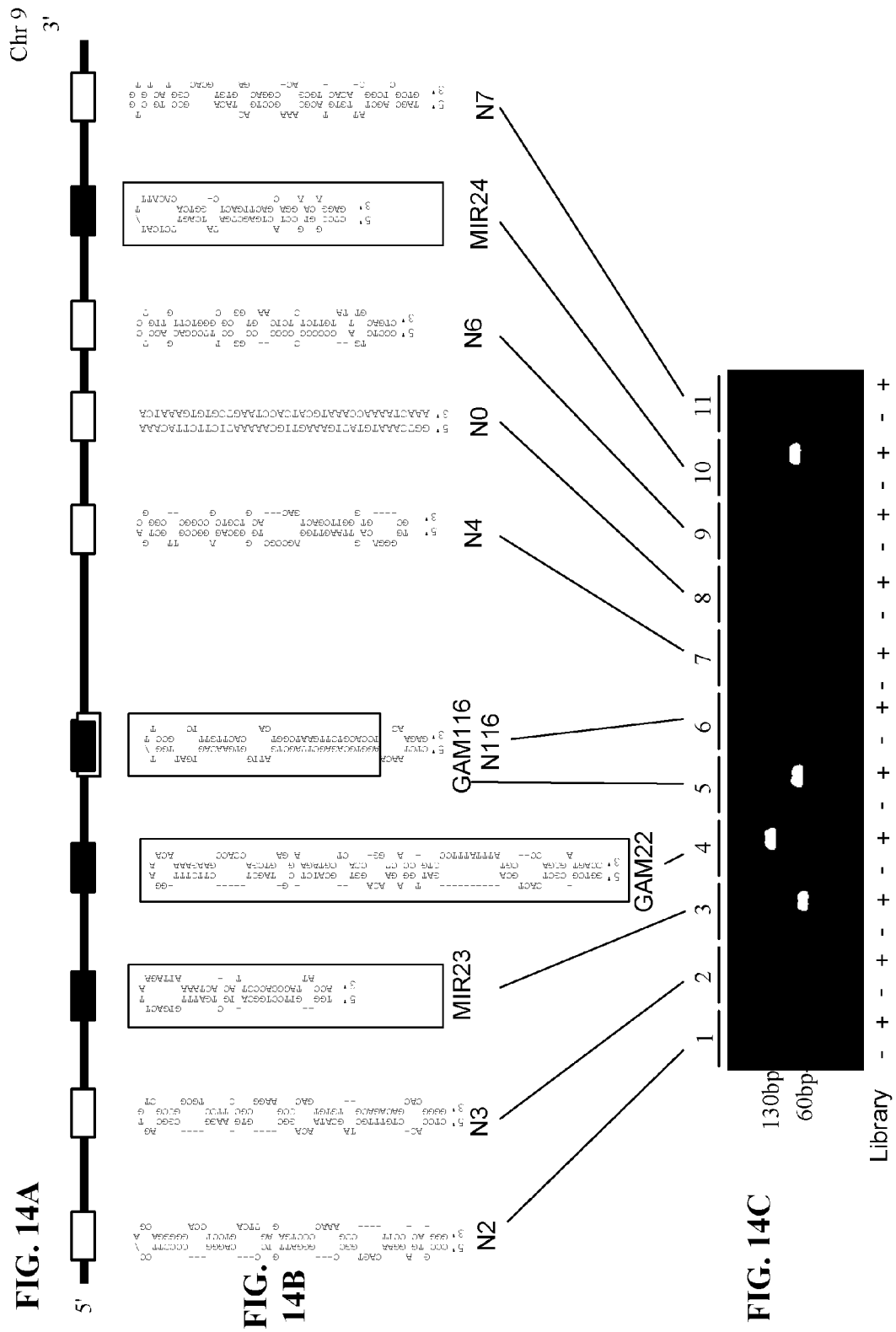
FIG. 14A is a schematic representation of an "operon-like" cluster of novel human hairpin sequences detected bioinformatically by a bioinformatic oligonucleotide detection engine constructed and operative in accordance with a preferred embodiment of the present invention, and non-GAM hairpin useful as negative controls thereto.
FIG. 14B is a schematic representation of secondary folding of hairpins of the operon-like cluster of FIG. 14A. The following hairpins are shown in FIG. 14B: MIR24 (SEQ ID NO: 59885), MIR23 (SEQ ID NO: 59878), GA22 (SEQ ID NO: 59879) and GA116 (SEQ ID NO: 59881), N2 (SEQ ID NO: 59876), 3 (SEQ ID NO: 59877), N116 (SEQ ID NO: 59880), N4 (SEQ ID NO: 59882), N6 (SEQ ID NO: 59884), N7 (SEQ ID NO: 59886), and N0 (SEQ ID NO: 59883)
FIG. 14C is a picture of laboratory results demonstrating expression of novel oligonucleotides of FIGS. 14A and 14B, and lack of expression of the negative controls, thereby validating efficacy of bioinformatic detection of GAM oligonucleotides and GR polynycleotides detected by a bioinformatic oligonucleotide detection engine, constructed and operative in accordance with a preferred embodiment of the present invention.

Reference is now made to FIG. 14A, which is a schematic representation of a novel human GR polynucleotide herein designated GR12731 (RosettaGenomics Ltd. nomenclature), located on chromosome 9, comprising 2 known human MIR oligonucleotides—MIR24 and MIR23, and 2 novel GAM oligonucleotides, herein designated GAM22 and GAM116, all marked by solid black boxes. FIG. 14A also schematically illustrates 6 non-GAM hairpin sequences, and one non-hairpin sequence, all marked by white boxes, and serving as negative controls. By "non-GAM hairpin sequences" is meant sequences of a similar length to known MIR PRECURSOR sequences, which form hairpin secondary folding pattern similar to MIR PRECURSOR hairpins, and yet which are assessed by the BIOINFORMATIC OLIGONUCLEOTIDE DETECTION ENGINE 100 not to be valid GAM PRECURSOR hairpins. It is appreciated that FIG. 14A is a simplified schematic representation, reflecting only the order in which the segments of interest appear relative to one another, and not a proportional distance between the segments.

Reference is now made to FIG. 14B, which is a schematic representation of secondary folding of each of the MIRs and GAMS of GR GR12731 MIR24 (SEQ ID NO: 59885), MIR23 (SEQ ID NO: 59878), GAM22 (SEQ ID NO:59879) and GAM116 (SEQ ID NO: 59881), and of the negative control non-GAM hairpins, herein designated N2 (SEQ ID NO: 59876), N3 (SEQ ID NO: 59877), N116 (SEQ ID NO: 59880), N4 (SEQ ID NO: 59882), N6 (SEQ ID NO: 59884) and N7 (SEQ ID NO: 59886). N0 (SEQ ID NO: 59883) is a non-hairpin control, of a similar length to that of known MIR PRECURSOR hairpins. It is appreciated that the negative controls are situated adjacent to and in between real MIR genes and GAM predicted oligonucleotide and demonstrates similar secondary folding patterns to that of known MIRs and GAMS.

Reference is now made to FIG. 14C, which is a picture of laboratory results of a PCR test upon a YM100 size-fractionated "ligation"-library, utilizing a set of specific primer pairs located directly inside the boundaries of the hairpins. Due to the nature of the library the only PCR amplifiable products can result from RNaseIII type enzyme cleaved RNA, as expected for legitimate hairpin precursors presumed to be produced by DROSHA (Lee et al, Nature 425 415-419, 2003). FIG. 14C demonstrates expression of hairpin precursors of known MIR oligonucleotides MIRhsa-23 and MIRhsa-24, and of novel bioinformatically detected GAM22 and GAM116 hairpins predicted bioinformatically by a system constructed and operative in accordance with a preferred embodiment of the present invention. FIG. 14C also shows that none of the 7 controls (6 hairpins designated N2, N3, N23, N4, N6 and N7 and 1 non-hairpin sequence designated N0) were expressed. N116 is a negative control sequence partially overlapping GAM116.

In the picture, test lanes including template are designated "+" and the control lane is designated "−". The control reaction contained all the components of the test reaction except library template. It is appreciated that for each of the tested hairpins, a clear PCR band appears in the test ("+") lane, but not in the control ("−") lane.

FIGS. 14A through 14C, when taken together validate the efficacy of the bioinformatic oligonucleotide detection engine in: (a) detecting known MIR oligonucleotides; (b) detecting novel GAM PRECURSOR hairpins which are found adjacent to these MIR oligonucleotides, and which despite exhaustive prior biological efforts and bioinformatic detection efforts, went undetected; (c) discerning between GAM (or MIR) PRECURSOR hairpins, and non-GAM hairpins.

It is appreciated that the ability to discern GAM-hairpins from non-GAM-hairpins is very significant in detecting GAM oligonucleotides since hairpins are highly abundant in the genome. Other MIR prediction programs have not been able to address this challenge successfully.

Reference is now made to FIG. 15A which is an annotated sequence of an EST comprising a novel GAM oligonucleotides detected by the oligonucleotide detection system of the present invention. FIG. 15A shows the nucleotide sequence of a known human non-protein coding EST (Expressed Sequence Tag), identified as EST72223. The EST72223 clone obtained from TIGR database (Kirkness and Kerlavage, 1997) was sequenced to yield the above 705 bp transcript with a polyadenyl tail. It is appreciated that the sequence of this EST comprises sequences of one known miRNA oligonucleotide, identified as hsa-MIR98, and of one novel GAM oligonucleotide referred to here as GAM25, detected by the BIOINFORMATIC OLIGONUCLEOTIDE DETECTION ENGINE 100 (FIG. 2) of the present invention.

The whole sequence presented FIG. 15A is part of EST72223 (SEQ ID No. 59887). This sequence includes, among others, the four marked sequences: The sequence of the miRNA-98 hairpin in bold, the sequence of the mature miRNA-98 in bold and underlined, the sequence of the GAM25 hairpin in bold and the sequence of the mature miRNA of GAM25 in bold and underlined.

The sequences of the precursors of the known MIR98 and of the predicted GAM25 precursors are marked in bold, the sequences of the established miRNA 98 and of the predicted miRNA-like oligonucleotide GAM25 are underlined.

Figure 15C:
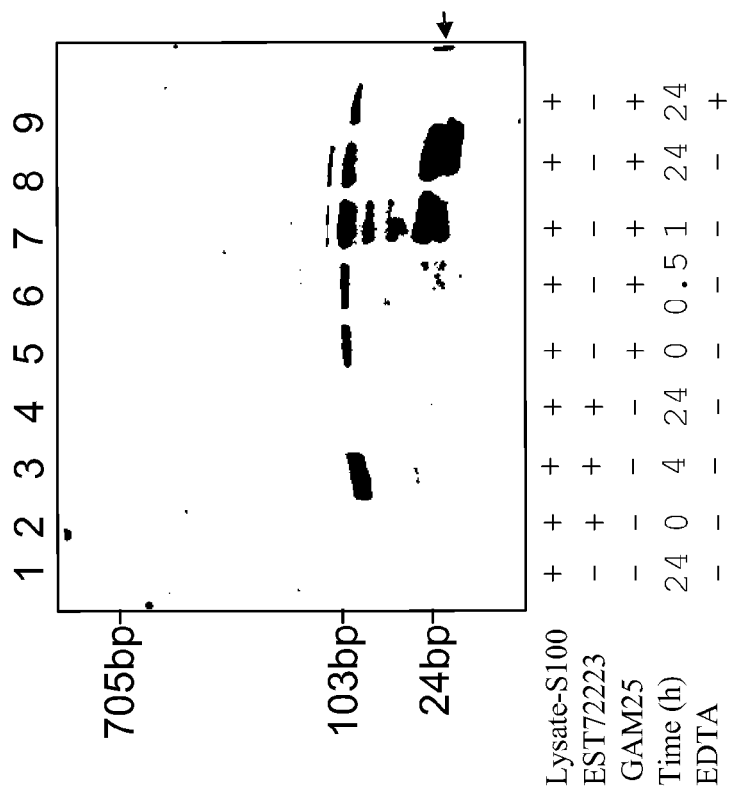
Figure 15D:
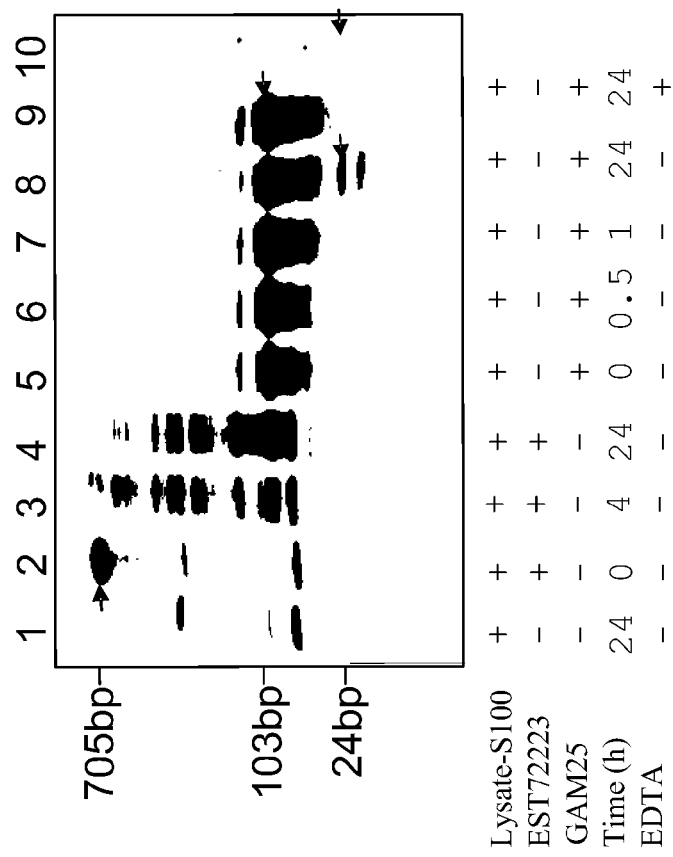

Reference is now made to FIGS. 15B, 15C and 15D that are pictures of laboratory results, which when taken together demonstrate laboratory confirmation of expression of the bioinformatically detected novel oligonucleotide of FIG. 15A. In two parallel experiments, an enzymatically synthesized capped, EST72223 RNA transcript, was incubated with Hela S100 lysate for 0 minutes, 4 hours and 24 hours. RNA was subsequently harvested, run on a denaturing polyacrylamide gel, and reacted with either a 102 nt antisense MIR98 probe or a 145 nt antisenseGAM25 precursor transcript probe respectively. The Northern blot results of these experiments demonstrated processing of EST72223 RNA by Hela lysate (lanes 2-4, in 15B and 15C), into ~80 bp and ~22 bp segments, which reacted with the MIR98 precursor probe (15B), and into ~100 bp and ~24 bp segments, which reacted with the GAM25 precursor probe (15C). These results demonstrate the processing of EST72223 by Hela lysate into MIR98 precursor and GAM25 precursor. It is also appreciated from FIG. 15C (lane 1) that Hela lysate itself reacted with the GAM25 precursor probe, in a number of bands, including a ~100 bp band, indicating that GAM25-precursor is endogenously expressed in Hela cells. The presence of additional bands, higher than 100 bp in lanes 5-9 probably corresponds to the presence of nucleotide sequences in Hela lysate, which contain the GAM25 sequence.

In addition, in order to demonstrate the kinetics and specificity of the processing of MIR98 and GAM25 precursors into their respective mature, 'diced' segments, transcripts of MIR98 and of the bioinformatically predicted GAM25 precursors were similarly incubated with Hela S100 lysate, for 0 minutes, 30 minutes, 1 hour and 24 hours, and for 24 hours with the addition of EDTA, added to inhibit Dicer activity, following which RNA was harvested, run on a polyacrylamide gel and reacted with MIR98 and GAM25 precursor probes. Capped transcripts were prepared for in-vitro RNA cleavage assays with T7 RNA polymerase, including a m7G (5')ppp(5')G-capping reaction using the T7-mMessage mMachine kit (Ambion). Purified PCR products were used as template for the reaction. These were amplified for each assay with specific primers containing a T7 promoter at the 5 end and a T3 RNA polymerase promoter at the 3 end. Capped RNA transcripts were incubated at 30 C in supplemented, dialysis concentrated, Hela S100 cytoplasmic extract (4C Biotech, Seneffe, Belgium). The Hela S100 was supplemented by dialysis to a final concentration of 20 mM Hepes, 100 mM KCl, 2.5 mM MgCl2, 0.5 mM DTT, 20% glycerol and protease inhibitor cocktail tablets (Complete mini Roche Molecular Biochemicals). After addition of all components, final concentrations were 100 mM capped target RNA, 2 mM ATP, 0.2 mM GTP, 500 U/ml RNasin, 25 g/ml creatine kinase, 25 mM creatine phosphate, 2.5 mM DTT and 50% S100 extract. Proteinase K, used to enhance Dicer activity (Zhang et al., EMBO J. 21, 5875-5885 (2002)) was dissolved in 50 mM Tris-HCl pH 8, 5 mM CaCl2, and 50% glycerol, was added to a final concentration of 0.6 mg/ml. Cleavage reactions were stopped by the addition of 8 volumes of proteinase K buffer (200 Mm Tris-Hcl, pH 7.5, 25 mM EDTA, 300 mM NaCl, and 2% SDS) and incubated at 65 C for 15 min at different time points (0, 0.5, 1, 4, 24 h) and subjected to phenol/chloroform extraction. Pellets were dissolved in water and kept frozen. Samples were analyzed on a segmented half 6%, half 13% polyacrylamide 1×TBE-7M Urea gel.

The Northern blot results of these experiments demonstrated an accumulation of a ~22 bp segment which reacted with the MIR98 precursor probe, and of a ~24 bp segment which reacted with the GAM25 precursor probe, over time (lanes 5-8). Absence of these segments when incubated with EDTA (lane 9), which is known to inhibit Dicer enzyme (Zhang et al., 2002), supports the notion that the processing of MIR98 and GAM25 precursors into their 'diced' segments is mediated by Dicer enzyme, found in Hela lysate. Other RNases do not utilize divalent cations and are thus not inhibited by EDTA. The molecular sizes of EST72223, MIR-98 and GAM25 and their corresponding precursors are indicated by arrows.

FIG. 15D present Northern blot results of same above experiments with GAM25 probe (24 nt). The results clearly demonstrated the accumulation of mature GAM25 oligonucleotide after 24 h.

To validate the identity of the band shown by the lower arrow in FIGS. 15C and 15D, a RNA band parallel to a marker of 24 base was excised from the gel and cloned as in Elbashir et al (2001) and sequenced. 90 clones corresponded to the sequence of mature GAM25 oligonucleotide, three corresponded to GAM25* (the opposite arm of the hairpin with a 1-3 nucleotide 3 overhang) and two to the hairpin-loop.

GAM25 was also validated endogenously by sequencing from both sides from a HeLa YM100 total-RNA "ligation" libraries, utilizing hemispecific primers as described in FIG. 13.

Taken together, these results validate the presence and processing of a novel MIR-like oligonucleotide, GAM25, which was predicted bioinformatically. The processing of this novel GAM oligonucleotide product, by Hela lysate from EST72223, through its precursor, to its final form was similar to that observed for known miRNA oligonucleotide, MIR98.

Transcript products were 705nt (EST72223), 102nt (MIR98precursor), 125nt (GAM25 precursor) long. EST72223 was PCR amplified with T7-EST 72223 forward primer: 5"-TAATACGACTCACTATAGGCCCTTATTA-GAGGATTCTGCT-3" (SEQ ID NO: 59897) and T3-EST72223 reverse primer: "-AATTAACCCTCAC-TAAAGGTTTTTTTTTCCTGAGACAGAG T-3" (SEQ ID NO: 59898).MIR98 was PCR amplified using EST72223 as a template with T7MIR98 forward primer: 5-"TAATACGACT-CACTATAGGGTGAGGTAGTAAGTTGTATT GTT-3" (SEQ ID NO: 59899) and T3MIR98 reverse primer: 5"-AAT-TAACCCTCACTAAAGGGAAAGTAGTAAGTTGTATAG TT-3" (SEQ ID NO: 59900).GAM25 was PCR amplified using EST72223 as a template with GAM25 forward primer: 5"-GAGGCAGGAGAATTGCTTGA-3" (SEQ ID NO: 59901) and T3-EST72223 reverse primer:5" -AATTAAC-CCTCACTAAAGG CCTGAGACAGAGTCTTGCTC-3" (SEQ ID NO: 59902).

It is appreciated that the data presented in FIGS. 15A, 15B, 15C and 15D when taken together validate the function of the bioinformatic oligonucleotide detection engine 100 of FIG. 2. FIG. 15A shows a novel GAM oligonucleotide bioinformatically detected by the BIOINFORMATIC OLIGONUCLE-OTIDE DETECTION ENGINE 100, and FIGS. 15C and 15D show laboratory confirmation of the expression of this novel oligonucleotide. This is in accord with the engine training and validation methodology described hereinabove with reference to FIG. 3.

DETAILED DESCRIPTION OF LARGE TABLES

Table 1 comprises data relating the SEQ ID NO of oligonucleotides of the present invention to their corresponding GAM NAME, and contains the following fields: GAM SEQ-ID: GAM SEQ ID NO, as in the Sequence Listing; GAM NAME: Rosetta Genomics Ltd. nomenclature (see below); GAM RNA SEQUENCE: Sequence (5' to 3') of the mature, 'diced' GAM RNA; GAM ORGANISM: identity of the organism encoding the GAM oligonucleotide; GAM POS: Dicer cut location (see below); and Table 2 comprises detailed textual description according to the description of FIG. 1 of each of a plurality of novel GAM oligonucleotides of the present invention, and contains the following fields: GAM NAME: Rosetta Genomics Ltd. nomenclature (see below); GAM ORGANISM: identity of the organism encoding the GAM oligonucleotide; PRECUR SEQ-ID: GAM precursor Seq-ID, as in the Sequence Listing; PRECURSOR SEQUENCE: Sequence (5' to 3') of the GAM precursor; GAM DESCRIPTION: Detailed description of GAM oligonucleotide with reference to FIG. 1; and Table 3 comprises data relating to the source and location of novel GAM oligonucleotides of the present invention, and contains the following fields: GAM NAME: Rosetta Genomics Ltd. nomenclature (see below); PRECUR SEQ-ID: GAM precursor SEQ ID NO, as in the Sequence Listing; GAM ORGANISM: identity of the organism encodes the GAM oligonucleotide; SOURCE: For human GAM-chromosome encoding the human GAM oligonucleotide, otherwise—accession ID (GenBank, NCBI); STRAND: Orientation of the strand, '+' for the plus strand, '–' for the minus strand; SRC-START OFFSET: Start offset of GAM precursor sequence relative to the SOURCE; SRC-END OFFSET: End offset of GAM precursor sequence relative to the SOURCE; and Table 4 comprises data relating to GAM precursors of novel GAM oligonucleotides of the present invention, and contains the following fields: GAM NAME: Rosetta Genomics Ltd. nomenclature (see below); PRECUR SEQ-ID: GAM precursor Seq-ID, as in the Sequence Listing; GAM ORGANISM: identity of the organism encoding the GAM oligonucleotide; PRECURSOR-SEQUENCE: GAM precursor nucleotide sequence (5' to 3'); GAM FOLDED PRECUR-SOR RNA: Schematic representation of the GAM folded precursor, beginning 5' end (beginning of upper row) to 3' end (beginning of lower row), where the hairpin loop is positioned at the right part of the draw; and Table 5 comprises data relating to GAM oligonucleotides of the present invention, and contains the following fields: GAM NAME: Rosetta Genomics Ltd. nomenclature (see below); GAM ORGANISM: identity of the organism encoding the GAM oligonucleotide; GAM RNA SEQUENCE: Sequence (5' to 3') of the mature, 'diced' GAM RNA; PRE-CUR SEQ-ID: GAM precursor Seq-ID, as in the Sequence Listing; GAM POS: Dicer cut location (see below); and Table 6 comprises data relating SEQ ID NO of the GAM target gene binding site sequence to TARGET gene name and target binding site sequence, and contains the following fields: TARGET BINDING SITE SEQ-ID: Target binding site SEQ ID NO, as in the Sequence Listing; TARGET ORGANISM: identity of organism encode the TARGET gene; TARGET: GAM target gene name; TARGET BIND-ING SITE SEQUENCE: Nucleotide sequence (5' to 3') of the target binding site; and Table 7 comprises data relating to target-genes and binding sites of GAM oligonucleotides of the present invention, and contains the following fields: GAM NAME: Rosetta Genomics Ltd. nomenclature (see below); GAM ORGANISM: identity of the organism encoding the GAM oligonucleotides; GAM RNA SEQUENCE: Sequence (5' to 3') of the mature, 'diced' GAM RNA; TARGET: GAM target gene name; TARGET REF-ID: Target accession number (GenBank); TARGET ORGANISM: identity of organism encode the TARGET gene; UTR: Untranslated region of binding site/s (3" or 5"); TARGET BS-SEQ: Nucleotide sequence (5' to 3') of the target binding site; BINDING-SITE-DRAW: Schematic representation of the binding site, upper row represent 5' to 3' sequence of the target, Lower row represent 3' to 5' Sequence of the GAM; GAM POS: Dicer cut location (see below); and Table 8 comprises data relating to functions and utilities of novel GAM oligonucleotides of the present invention, and contains the following fields: GAM NAME: Rosetta Genomics Ltd. nomenclature (see below); GAM RNA SEQUENCE: Sequence (5' to 3') of the mature, 'diced' GAM RNA; GAM ORGANISM: identity of the organism encoding the GAM oligonucleotide; TARGET: GAM target gene name; TARGET ORGANISM: identity of organism encode the TARGET gene; GAM FUNCTION: Description of the GAM functions and utilities; GAM POS: Dicer cut location (see below); and Table 9 comprises data of gene function references—Bibliography and contains the following fields: GAM NAME: Rosetta Genomics Ltd. nomenclature (see below); GAM RNA SEQUENCE: Sequence (5' to 3') of the mature, 'diced' GAM RNA gene; GAM ORGANISM: identity of the organism encoding the GAM oligonucleotide; TARGET: GAM target gene name; TARGET ORGANISM: identity of organism encode the TARGET gene; REFERENCES: list of references relating to the target gene; GAM POS: Dicer cut location (see below); and Table 10 comprises data relating to novel GR (Genomic Record) polynucleotides of the present invention, and contains the following fields: GR NAME: Rosetta Genomics Ltd. nomenclature (see below); GR ORGANISM: identity of the organism encoding the GR polynucleotide; GR DESCRIPTION: Detailed description of a GR gene cluster, with reference to FIG. 9; and The following conventions and abbreviations are used in the tables: The nucleotide 'U' is represented as 'T' in the tables, and GAM NAME or GR NAME are names for nucleotide sequences of the present invention given by RosettaGenomics Ltd. nomenclature method. All GAMs/GRs are designated by GAMx/GRx where x is a unique ID.

GAM POS is a position of the GAM RNA on the GAM PRECURSOR RNA sequence. This position is the Dicer cut location: A indicates a probable Dicer cut location; B indicates an alternative Dicer cut location.

All human nucleotide sequences of the present invention as well as their chromosomal location and strand orientation are derived from sequence records of UCSC-hg16 version, which is based on NCBI, Build34 database (April, 2003).

All bacteria sequences of the present invention as well as their genomic location are derived from NCBI, RefSeq database.

SEQUENCE LISTING (59902 sequences)

SEQ ID NO: 1 - RNA, 22 nt, Homo sapiens
aauugcuugaacccaggaagug

SEQ ID NO: 2 - RNA, 22 nt, Homo sapiens
acugcacuccagccugggcaac

SEQ ID NO: 3 - RNA, 22 nt, Homo sapiens
cacugcaaccuccaccuccugg

SEQ ID NO: 4 - RNA, 22 nt, Homo sapiens
cacugcacuccagccugggcaa

SEQ ID NO: 5 - RNA, 22 nt, Homo sapiens
cauugcacuccagccugggcaa

SEQ ID NO: 6 - RNA, 22 nt, Homo sapiens
gaaguuugaagccuguuguuca

SEQ ID NO: 7 - RNA, 22 nt, Bordetella pertussis
aagaacaagggcgucaacaggg

SEQ ID NO: 8 - RNA, 22 nt, Bordetella pertussis
aagcaggggguugccgacgggg

SEQ ID NO: 9 - RNA, 22 nt, Bordetella pertussis
aagccgugaaggcaaucgcgcc

SEQ ID NO: 10 - RNA, 22 nt, Bordetella pertussis
aaggcagcgccucgaucaccuc

SEQ ID NO: 11 - RNA, 22 nt, Bordetella pertussis
aagggcagcgugcuggccauca

SEQ ID NO: 12 - RNA, 22 nt, Bordetella pertussis
acagcaggaugucggcggccau

SEQ ID NO: 13 - RNA, 19 nt, Bordetella pertussis
acaucucgugcaccagccc

SEQ ID NO: 14 - RNA, 22 nt, Bordetella pertussis
accgugggcagcuggucguagu

SEQ ID NO: 15 - RNA, 22 nt, Bordetella pertussis
acgaccaggaagaggcgcuguc

SEQ ID NO: 16 - RNA, 22 nt, Bordetella pertussis
acgaucuggccgccgagcuggc

SEQ ID NO: 17 - RNA, 22 nt, Bordetella pertussis
acuguaaaccuuuuagaagugc

SEQ ID NO: 18 - RNA, 22 nt, Bordetella pertussis
acuuucaugcccggccaguuau

SEQ ID NO: 19 - RNA, 22 nt, Bordetella pertussis
agccagcaguugcagcggcugg

SEQ ID NO: 20 - RNA, 22 nt, Bordetella pertussis
aggaugaggucggcgcgcucga

SEQ ID NO: 21 - RNA, 22 nt, Bordetella pertussis
agggccugcguuucgcuggcau

SEQ ID NO: 22 - RNA, 19 nt, Bordetella pertussis
agggccuggggcccgagca

SEQ ID NO: 23 - RNA, 22 nt, Bordetella pertussis
aggugcaggccgcccucggcgc

SEQ ID NO: 24 - RNA, 22 nt, Bordetella pertussis
agguugaucgcccaugugccau

SEQ ID NO: 25 - RNA, 23 nt, Bordetella pertussis
agugggcagggugcaugcgcgcc

SEQ ID NO: 26 - RNA, 22 nt, Bordetella pertussis
aguuccagcccuucgauggugu

SEQ ID NO: 27 - RNA, 22 nt, Bordetella pertussis
auagacuuuggcgcuugauucc

SEQ ID NO: 28 - RNA, 22 nt, Bordetella pertussis
aucaacuuccagaucaugggca

SEQ ID NO: 29 - RNA, 22 nt, Bordetella pertussis
auccagcccggcggccuggcgc

SEQ ID NO: 30 - RNA, 22 nt, Bordetella pertussis
auccagccguucgguucgcaag

SEQ ID NO: 31 - RNA, 22 nt, Bordetella pertussis
auggggccgagcgcccagucgc

SEQ ID NO: 32 - RNA, 22 nt, Bordetella pertussis
auguagcucgccagcagcguca

SEQ ID NO: 33 - RNA, 22 nt, Bordetella pertussis
augugcagcgccaccaggcugg

SEQ ID NO: 34 - RNA, 22 nt, Bordetella pertussis
caccagauacugcgccuggccc

SEQ ID NO: 35 - RNA, 22 nt, Bordetella pertussis
cagcagggccagcaccgagcca

SEQ ID NO: 36 - RNA, 22 nt, Bordetella pertussis
cagcaggguggguuugauguug

SEQ ID NO: 37 - RNA, 22 nt, Bordetella pertussis
caggaacucguggcugacgccu

SEQ ID NO: 38 - RNA, 22 nt, Bordetella pertussis
cagggcagcgcgcaggaccuga

SEQ ID NO: 39 - RNA, 22 nt, Bordetella pertussis
caggugaaccuggacuggcugg

SEQ ID NO: 40 - RNA, 22 nt, Bordetella pertussis
ccagcaggcgcuugcgcgucag

SEQ ID NO: 41 - RNA, 22 nt, Bordetella pertussis
ccagcaggugcggcgucagguu

SEQ ID NO: 42 - RNA, 22 nt, Bordetella pertussis
ccagcaggugcgugucggcaaa

SEQ ID NO: 43 - RNA, 22 nt, Bordetella pertussis
ccagcagguccagcgccugcug

SEQ ID NO: 44 - RNA, 22 nt, Bordetella pertussis
ccagggacgggagggugccgaa

SEQ ID NO: 45 - RNA, 22 nt, Bordetella pertussis
ccaguuggucaccucguagccc

SEQ ID NO: 46 - RNA, 22 nt, Bordetella pertussis
ccgccgugagccacagaaugcc

SEQ ID NO: 47 - RNA, 22 nt, Bordetella pertussis
ccggcacaggaagcgccagcaa

SEQ ID NO: 48 - RNA, 20 nt, Bordetella pertussis
ccgugggcacgcugaccuug

SEQ ID NO: 49 - RNA, 22 nt, Bordetella pertussis
ccgugggcagcgucgugcuggg

SEQ ID NO: 50 - RNA, 21 nt, Bordetella pertussis
ccgugggcgaguaccuugugc

SEQ ID NO: 51 - RNA, 22 nt, Bordetella pertussis
ccugaaugauggcgguuccgug

SEQ ID NO: 52 - RNA, 22 nt, Bordetella pertussis
ccugauggaccacuggcagccg

SEQ ID NO: 53 - RNA, 22 nt, Bordetella pertussis
ccuguauggcgcugauggccgg

SEQ ID NO: 54 - RNA, 21 nt, Bordetella pertussis
cgaagaauacgcugacgucgu

SEQ ID NO: 55 - RNA, 22 nt, Bordetella pertussis
cgaagggcgcguuggugaugua

SEQ ID NO: 56 - RNA, 22 nt, Bordetella pertussis
cgaccagaucaugcgcuugggu

SEQ ID NO: 57 - RNA, 22 nt, Bordetella pertussis
cgacggcaccgacagcaaggag

SEQ ID NO: 58 - RNA, 22 nt, Bordetella pertussis
cgagggcaggccguggcagguu

SEQ ID NO: 59 - RNA, 20 nt, Bordetella pertussis
cgaucugcugccaugccggu

SEQ ID NO: 60 - RNA, 22 nt, Bordetella pertussis
cgcagcaagcggcugagcugaa

SEQ ID NO: 61 - RNA, 22 nt, Bordetella pertussis
cgcagcucgugcgagacguugg

SEQ ID NO: 62 - RNA, 22 nt, Bordetella pertussis
cgccgugguggcggccgacaua

SEQ ID NO: 63 - RNA, 22 nt, Bordetella pertussis
cgcuccaguagaacgccucgag

SEQ ID NO: 64 - RNA, 22 nt, Bordetella pertussis
cggcagcaggaacagcgacacg

SEQ ID NO: 65 - RNA, 22 nt, Bordetella pertussis
cggcagcaucgucagcggcgug

SEQ ID NO: 66 - RNA, 22 nt, Bordetella pertussis
cggcaucagcgccugcaggcgc

SEQ ID NO: 67 - RNA, 22 nt, Bordetella pertussis
cggcauccccguggucagcgac

SEQ ID NO: 68 - RNA, 22 nt, Bordetella pertussis
cggccuguccagcgagaacgug

SEQ ID NO: 69 - RNA, 22 nt, Bordetella pertussis
cggccuguccaucaugugcuuc

SEQ ID NO: 70 - RNA, 22 nt, Bordetella pertussis
cgggacggcccugcaggaacuc

SEQ ID NO: 71 - RNA, 22 nt, Bordetella pertussis
cgggccuggcccgccauccgcg

SEQ ID NO: 72 - RNA, 16 nt, Bordetella pertussis
cgggccuguucgccag

SEQ ID NO: 73 - RNA, 22 nt, Bordetella pertussis
cguggaugauggccucggcgcg

SEQ ID NO: 74 - RNA, 22 nt, Bordetella pertussis
cgugugggccguggccgguacg

SEQ ID NO: 75 - RNA, 22 nt, Bordetella pertussis
cuacaacaugaagcugccgcca

SEQ ID NO: 76 - RNA, 22 nt, Bordetella pertussis
cuggaugacgcgaugcguggaa

SEQ ID NO: 77 - RNA, 22 nt, Bordetella pertussis
gaacagauuguccgggccgggg

SEQ ID NO: 78 - RNA, 22 nt, Bordetella pertussis
gaacucuuccgcaaagcggucg

SEQ ID NO: 79 - RNA, 22 nt, Bordetella pertussis
gacagcacgcgccgcaagggca

SEQ ID NO: 80 - RNA, 22 nt, Bordetella pertussis
gacggcacggcacaggucgacg

SEQ ID NO: 81 - RNA, 22 nt, Bordetella pertussis
gagaaauaugcugcuaugaagc

SEQ ID NO: 82 - RNA, 22 nt, Bordetella pertussis
gcagcaggcacccggccagcgu

SEQ ID NO: 83 - RNA, 17 nt, Bordetella pertussis
gcaggugcgccugaagg

SEQ ID NO: 84 - RNA, 22 nt, Bordetella pertussis
gccagccgcugggggguaccca

SEQ ID NO: 85 - RNA, 22 nt, Bordetella pertussis
gccagccggcccacgaaggcga

SEQ ID NO: 86 - RNA, 22 nt, Bordetella pertussis
gccagccggugccggccgacca

SEQ ID NO: 87 - RNA, 22 nt, Bordetella pertussis
gccgugugcuugaugaauggag

SEQ ID NO: 88 - RNA, 22 nt, Bordetella pertussis
gcgccagccugcgcaaccugcu

SEQ ID NO: 89 - RNA, 22 nt, Bordetella pertussis
gcgugggcacgcaaucgcuuuc

SEQ ID NO: 90 - RNA, 22 nt, Bordetella pertussis
gcgugggcauuuugcugcgccc

SEQ ID NO: 91 - RNA, 22 nt, Bordetella pertussis
gcgugggccgggcccggcacug

SEQ ID NO: 92 - RNA, 22 nt, Bordetella pertussis
gcuagcuccugucgugggucgc

SEQ ID NO: 93 - RNA, 22 nt, Bordetella pertussis
gcucugggcggagucgauaugc

SEQ ID NO: 94 - RNA, 23 nt, Bordetella pertussis
gcucuggguggccgaggucuggc

SEQ ID NO: 95 - RNA, 22 nt, Bordetella pertussis
gcugcugguggucgacggucag

SEQ ID NO: 96 - RNA, 22 nt, Bordetella pertussis
gcuguagcugaagccgucggcc

SEQ ID NO: 97 - RNA, 22 nt, Bordetella pertussis
ggauggaguucagcagcucgca

SEQ ID NO: 98 - RNA, 22 nt, Bordetella pertussis
ggcagcacgccgaagccgucga

SEQ ID NO: 99 - RNA, 23 nt, Bordetella pertussis
ggcagcaggaacaccgccggcgg

SEQ ID NO: 100 - RNA, 22 nt, Bordetella pertussis
ggcagcaggauguugcggcgaa

SEQ ID NO: 101 - RNA, 22 nt, Bordetella pertussis
ggcagccucgccgagaccguca

SEQ ID NO: 102 - RNA, 22 nt, Bordetella pertussis
ggcagcucggccucgggcgcca

SEQ ID NO: 103 - RNA, 22 nt, Bordetella pertussis
ggcauccugcacaguccggacg

SEQ ID NO: 104 - RNA, 22 nt, Bordetella pertussis
ggccgugggcgccgacgugcgu

SEQ ID NO: 105 - RNA, 22 nt, Bordetella pertussis
gggcaaggucgccguggcagcg

SEQ ID NO: 106 - RNA, 22 nt, Bordetella pertussis
gggccugaccgugcugggcgcu

SEQ ID NO: 107 - RNA, 22 nt, Bordetella pertussis
gggcgaagucaccgucagcauc

SEQ ID NO: 108 - RNA, 22 nt, Bordetella pertussis
guccagccauucgagcagggcc

SEQ ID NO: 109 - RNA, 22 nt, Bordetella pertussis
gugcagcgcuugcagccggcgu

SEQ ID NO: 110 - RNA, 22 nt, Bordetella pertussis
gugcaggccaugaacgaccgcu

SEQ ID NO: 111 - RNA, 22 nt, Bordetella pertussis
gugccuguccccgcauggggga

SEQ ID NO: 112 - RNA, 22 nt, Bordetella pertussis
gugcgagccgcucaggcccgcg

SEQ ID NO: 113 - RNA, 22 nt, Bordetella pertussis
uauuacgugcggcugcuggccg

SEQ ID NO: 114 - RNA, 22 nt, Bordetella pertussis
ucagauggucgagcacauuguc

SEQ ID NO: 115 - RNA, 22 nt, Bordetella pertussis
ugaaaauuccuugagcgcccgg

SEQ ID NO: 116 - RNA, 22 nt, Bordetella pertussis
ugaaugccagcgcgaccucgca

SEQ ID NO: 117 - RNA, 22 nt, Bordetella pertussis
ugcacagggucgcccuggcgcc

SEQ ID NO: 118 - RNA, 22 nt, Bordetella pertussis
ugcagcagcgcggcaucgaccg

SEQ ID NO: 119 - RNA, 19 nt, Bordetella pertussis
ugcagcaggaucugcuggu

SEQ ID NO: 120 - RNA, 22 nt, Bordetella pertussis
ugcaggaacacgagauccggcc

SEQ ID NO: 121 - RNA, 23 nt, Bordetella pertussis
uggacaaggcgcgcgagguggug

SEQ ID NO: 122 - RNA, 22 nt, Bordetella pertussis
uggaccagcucgcgggcgcgau

SEQ ID NO: 123 - RNA, 22 nt, Bordetella pertussis
uggcagcagaucgacuacggcu

SEQ ID NO: 124 - RNA, 23 nt, Bordetella pertussis
uggcauccgacgccgugcucgcg

SEQ ID NO: 125 - RNA, 22 nt, Bordetella pertussis
ugggcagcgaauucuggcacgg

SEQ ID NO: 126 - RNA, 22 nt, Bordetella pertussis
ugggccugaacgguggcggcca

SEQ ID NO: 127 - RNA, 22 nt, Bordetella pertussis
ugggccugcugggcaaccuggu

SEQ ID NO: 128 - RNA, 22 nt, Bordetella pertussis
ugggccuggauggcgccgcauu

SEQ ID NO: 129 - RNA, 22 nt, Bordetella pertussis
uggugcagcucgucguugucgg

SEQ ID NO: 130 - RNA, 22 nt, Bordetella pertussis
uggugcaggagcgccugcuguu

SEQ ID NO: 131 - RNA, 22 nt, Bordetella pertussis
uguggauguucucccugguggu

SEQ ID NO: 132 - RNA, 22 nt, Bordetella pertussis
uguuccauugccuucugaaccg

SEQ ID NO: 133 - RNA, 22 nt, Bordetella pertussis
uugcagcacgugccguaucgag

SEQ ID NO: 134 - RNA, 22 nt, Bordetella pertussis
uuggggccguggccggcgcugu

SEQ ID NO: 135 - RNA, 22 nt, Chlamydia trachomatis
uugauuaucccgaagauauaac

SEQ ID NO: 136 - RNA, 22 nt, Chlamydia trachomatis
uggaaguaucgaggaucucugg

SEQ ID NO: 137 - RNA, 22 nt, Chlamydia trachomatis
uagaagaagacccuucguuugu

SEQ ID NO: 138 - RNA, 22 nt, Chlamydia trachomatis
guauauuuauauugcccuucuu

SEQ ID NO: 139 - RNA, 22 nt, Chlamydia trachomatis
gauucucugguauuaacugguu

SEQ ID NO: 140 - RNA, 22 nt, Chlamydophila pneumoniae AR39
cuuuauauacccucgcucuuaa

SEQ ID NO: 141 - RNA, 22 nt, Chlamydophila pneumoniae AR39
uagaaguauuaagccaagauuu

SEQ ID NO: 142 - RNA, 22 nt, Chlamydophila pneumoniae AR39
aucuauaaaacaucaguugcuu

SEQ ID NO: 143 - RNA, 21 nt, Chlamydophila pneumoniae AR39
auaguaaguucaugcuuguua

SEQ ID NO: 144 - RNA, 22 nt, Chlamydophila pneumoniae AR39
auauauuuagccucuccugauu

SEQ ID NO: 145 - RNA, 22 nt, Chlamydophila pneumoniae AR39
agcuuuuggauauccuuccuua

SEQ ID NO: 146 - RNA, 22 nt, Chlamydophila pneumoniae AR39
aagaagaagaauccguggauga

SEQ ID NO: 147 - RNA, 22 nt, Chlamydophila pneumoniae CWL029
ucuuuaauuuucugaaagauua

SEQ ID NO: 148 - RNA, 22 nt, Chlamydophila pneumoniae CWL029
uguaugaguuucucuucaucca

SEQ ID NO: 149 - RNA, 22 nt, Chlamydophila pneumoniae J138
uuuguuauuacuaguugucuga

SEQ ID NO: 150 - RNA, 22 nt, Chlamydophila pneumoniae J138
gcagaacuuagagcuucaauau

SEQ ID NO: 151 - RNA, 22 nt, Escherichia coli CFT073
gcacgggcgacauuuggcaggc

SEQ ID NO: 152 - RNA, 22 nt, Escherichia coli CFT073
gcagaauuuuguccgauagugg

SEQ ID NO: 153 - RNA, 22 nt, Escherichia coli CFT073
gcagcagcgccuguucaagcgc

SEQ ID NO: 154 - RNA, 22 nt, Escherichia coli CFT073
gcagggcauugauugggcgcac

SEQ ID NO: 155 - RNA, 21 nt, Escherichia coli CFT073
gcaggcagcgaccggaguagg

SEQ ID NO: 156 - RNA, 22 nt, Escherichia coli CFT073
gccagccauaacccgauggauu

SEQ ID NO: 157 - RNA, 22 nt, Escherichia coli CFT073
gccaguuugcuggacucugcca

SEQ ID NO: 158 - RNA, 22 nt, Escherichia coli CFT073
gccaugucggaucgaugcgcuc

SEQ ID NO: 159 - RNA, 22 nt, Escherichia coli CFT073
gcauggcaugcagggaacgccg

SEQ ID NO: 160 - RNA, 21 nt, Escherichia coli CFT073
gcauggcuguuaucaucuucc

SEQ ID NO: 161 - RNA, 22 nt, Escherichia coli CFT073
gcauguacaugcagcugauaau

SEQ ID NO: 162 - RNA, 22 nt, Escherichia coli CFT073
gccaagucgagcaacguuuuac

SEQ ID NO: 163 - RNA, 22 nt, Escherichia coli CFT073
gcaaaaauggcccggaagagau

SEQ ID NO: 164 - RNA, 22 nt, Escherichia coli CFT073
gauguacagcgcguuacuccug

SEQ ID NO: 165 - RNA, 23 nt, Escherichia coli CFT073
gaugcgcagauggcauacagcgg

SEQ ID NO: 166 - RNA, 22 nt, Escherichia coli CFT073
gauauuuauacaucccaauaaa

SEQ ID NO: 167 - RNA, 22 nt, Escherichia coli CFT073
gauauuuuacgcgcaauaacug

SEQ ID NO: 168 - RNA, 22 nt, Escherichia coli CFT073
gaucauuuucgcuauuuugccu

SEQ ID NO: 169 - RNA, 22 nt, Escherichia coli CFT073
gaugauuauguuguugauaucc

SEQ ID NO: 170 - RNA, 21 nt, Escherichia coli CFT073
gagauucagcaucucuuucug

SEQ ID NO: 171 - RNA, 22 nt, Escherichia coli CFT073
gaggaagaaucccgguguauuc

SEQ ID NO: 172 - RNA, 23 nt, Escherichia coli CFT073
cuucagaguuccggcugcgucag

SEQ ID NO: 173 - RNA, 22 nt, Escherichia coli CFT073
cuucucuucaaucgggauuauc

SEQ ID NO: 174 - RNA, 22 nt, Escherichia coli CFT073
cugggaggccaguggcaagaaa

SEQ ID NO: 175 - RNA, 22 nt, Escherichia coli CFT073
cugggauacugguugcucauug

SEQ ID NO: 176 - RNA, 22 nt, Escherichia coli CFT073
cugggauguauggauauguugu

SEQ ID NO: 177 - RNA, 22 nt, Escherichia coli CFT073
cuggugaaaaugcucggccucg

SEQ ID NO: 178 - RNA, 19 nt, Escherichia coli CFT073
cuguuuauucuguuugccc

SEQ ID NO: 179 - RNA, 22 nt, Escherichia coli CFT073
cuggagaguaauacccagucug

SEQ ID NO: 180 - RNA, 22 nt, Escherichia coli CFT073
cugagaggcucuuugcuaagug

SEQ ID NO: 181 - RNA, 22 nt, Escherichia coli CFT073
cugcaacuggcugauggcagca

SEQ ID NO: 182 - RNA, 22 nt, Escherichia coli CFT073
cugccagcuacuuugugucagu

SEQ ID NO: 183 - RNA, 22 nt, Escherichia coli CFT073
gacuucauggagucgaguugca

SEQ ID NO: 184 - RNA, 22 nt, Escherichia coli CFT073
gacuuuauuaaacugcuggagg

SEQ ID NO: 185 - RNA, 22 nt, Escherichia coli CFT073
gacacauuucuucccggcuccg

SEQ ID NO: 186 - RNA, 22 nt, Escherichia coli CFT073
gacauugaggaacacuuccaga

SEQ ID NO: 187 - RNA, 19 nt, Escherichia coli CFT073
gacauugauggucccacug

SEQ ID NO: 188 - RNA, 22 nt, Escherichia coli CFT073
gacccagugcuaacaaauguuc

SEQ ID NO: 189 - RNA, 23 nt, Escherichia coli CFT073
gaacugaauaccaaugaggagac

SEQ ID NO: 190 - RNA, 22 nt, Escherichia coli CFT073
gaaguaaggggacaucauguca

SEQ ID NO: 191 - RNA, 22 nt, Escherichia coli CFT073
gaaguggcagcgcagcagguuu

SEQ ID NO: 192 - RNA, 22 nt, Escherichia coli CFT073
gaagugggcucgccaggaagga

SEQ ID NO: 193 - RNA, 22 nt, Escherichia coli CFT073
gaaaccuggauggugcauauuu

SEQ ID NO: 194 - RNA, 22 nt, Escherichia coli CFT073
gaaacgcucgaaaaacuggcag

SEQ ID NO: 195 - RNA, 22 nt, Escherichia coli CFT073
gaaacuuugucgcguggaccca

SEQ ID NO: 196 - RNA, 22 nt, Escherichia coli CFT073
gaaagugacggauuuaacgcgg

SEQ ID NO: 197 - RNA, 18 nt, Escherichia coli CFT073
gaaauugaugccucuggc

SEQ ID NO: 198 - RNA, 19 nt, Escherichia coli CFT073
ggcagcugucaggugugcg

SEQ ID NO: 199 - RNA, 22 nt, Escherichia coli CFT073
ggcauccucaauauucaccagc

SEQ ID NO: 200 - RNA, 23 nt, Escherichia coli CFT073
ggcagaagccgguugcagugccg

SEQ ID NO: 201 - RNA, 22 nt, Escherichia coli CFT073
gcugguuaagcguauuagccaa

SEQ ID NO: 202 - RNA, 22 nt, Escherichia coli CFT073
gcugguuaucggaagagaugaa

SEQ ID NO: 203 - RNA, 22 nt, Escherichia coli CFT073
gcugguauuuucaaucgguacg

SEQ ID NO: 204 - RNA, 22 nt, Escherichia coli CFT073
gcuuaaaagcgacgcaaucaca

SEQ ID NO: 205 - RNA, 22 nt, Escherichia coli CFT073
ggaauagaaagcaggcagcuaa

SEQ ID NO: 206 - RNA, 22 nt, Escherichia coli CFT073
ggagaugcugcgugaagccgug

SEQ ID NO: 207 - RNA, 22 nt, Escherichia coli CFT073
gcuggcgagaucuuccggugua

SEQ ID NO: 208 - RNA, 22 nt, Escherichia coli CFT073
gcugccauccuccgguaccacg

SEQ ID NO: 209 - RNA, 22 nt, Escherichia coli CFT073
gcugauggcgcagguagcgccu

SEQ ID NO: 210 - RNA, 22 nt, Escherichia coli CFT073
gcguaaggcgugggaugugcuc

SEQ ID NO: 211 - RNA, 22 nt, Escherichia coli CFT073
gcgcaggcaggguaaucgggga

SEQ ID NO: 212 - RNA, 22 nt, Escherichia coli CFT073
gcccuuuuuuacuuaguagaga

SEQ ID NO: 213 - RNA, 22 nt, Escherichia coli CFT073
uagcaugugauucaauguaagc

SEQ ID NO: 214 - RNA, 22 nt, Escherichia coli CFT073
uagcggacgucgacuacuggaa

SEQ ID NO: 215 - RNA, 22 nt, Escherichia coli CFT073
uagggcugguggaggcgggacu

SEQ ID NO: 216 - RNA, 22 nt, Escherichia coli CFT073
uaguaucacuuuaucagccaag

SEQ ID NO: 217 - RNA, 22 nt, Escherichia coli CFT073
uaaguaaagggaguuugauaug

SEQ ID NO: 218 - RNA, 18 nt, Escherichia coli CFT073
uaagugaagggaguguga

SEQ ID NO: 219 - RNA, 22 nt, Escherichia coli CFT073
uacaaucuuagugcuaaauggc

SEQ ID NO: 220 - RNA, 22 nt, Escherichia coli CFT073
uacagaaaaaguuuggcaucuu

SEQ ID NO: 221 - RNA, 22 nt, Escherichia coli CFT073
uauggcaaucaucgacaaacgu

SEQ ID NO: 222 - RNA, 22 nt, Escherichia coli CFT073
uauuaaauaugaaaaguuauga

SEQ ID NO: 223 - RNA, 22 nt, Escherichia coli CFT073
uauuauguguuggguauacguc

SEQ ID NO: 224 - RNA, 22 nt, Escherichia coli CFT073
uauucccauaaacucagaucua

SEQ ID NO: 225 - RNA, 19 nt, Escherichia coli CFT073
uauuucuccggauuuuuga

SEQ ID NO: 226 - RNA, 22 nt, Escherichia coli CFT073
uauuucugccccgcaggucugg

SEQ ID NO: 227 - RNA, 22 nt, Escherichia coli CFT073
uaucaauuuaucgaccugcagc

SEQ ID NO: 228 - RNA, 23 nt, Escherichia coli CFT073
uauccacaccggacgugagaguc

SEQ ID NO: 229 - RNA, 22 nt, Escherichia coli CFT073
uaucugggaagugccuggcggu

SEQ ID NO: 230 - RNA, 22 nt, Escherichia coli CFT073
uaucuugugcuuguggcugauc

SEQ ID NO: 231 - RNA, 22 nt, Escherichia coli CFT073
uaugcaaaacugcggcgcauua

SEQ ID NO: 232 - RNA, 22 nt, Escherichia coli CFT073
uaugcauaaaaagcagcggcug

SEQ ID NO: 233 - RNA, 22 nt, Escherichia coli CFT073
uauguacaauaauaagcgaaau

SEQ ID NO: 234 - RNA, 22 nt, Escherichia coli CFT073
ucagccacugaccgcugagcaa

SEQ ID NO: 235 - RNA, 21 nt, Escherichia coli CFT073
ucaaugauggugccucgcugu

SEQ ID NO: 236 - RNA, 22 nt, Escherichia coli CFT073
ucaccagucccugaaugucucc

SEQ ID NO: 237 - RNA, 22 nt, Escherichia coli CFT073
ucaggaugccgaaguggaugau

SEQ ID NO: 238 - RNA, 22 nt, Escherichia coli CFT073
ucaggucacgcucuggaacagc

SEQ ID NO: 239 - RNA, 22 nt, Escherichia coli CFT073
ucaugaaaucgacauguacgca

SEQ ID NO: 240 - RNA, 22 nt, Escherichia coli CFT073
ucaguugggcugcgaaguuuuc

SEQ ID NO: 241 - RNA, 23 nt, Escherichia coli CFT073
ucauuuucauugguuaacucggc

SEQ ID NO: 242 - RNA, 22 nt, Escherichia coli CFT073
uccaggcaaacgccaguaaaaa

SEQ ID NO: 243 - RNA, 22 nt, Escherichia coli CFT073
ucccacaaugccaauacacuug

SEQ ID NO: 244 - RNA, 22 nt, Escherichia coli CFT073
uccggccuacaaaaucgugcaa

SEQ ID NO: 245 - RNA, 22 nt, Escherichia coli CFT073
uccuccuuucagagugcuccgc

SEQ ID NO: 246 - RNA, 16 nt, Escherichia coli CFT073
uccugggaggcagagc

SEQ ID NO: 247 - RNA, 19 nt, Escherichia coli CFT073
uccuguuccagcagucggc

SEQ ID NO: 248 - RNA, 21 nt, Escherichia coli CFT073
ucggcaauuccacgcuccagc

SEQ ID NO: 249 - RNA, 22 nt, Escherichia coli CFT073
ucggccucucuugcggucuggu

SEQ ID NO: 250 - RNA, 22 nt, Escherichia coli CFT073
guauuuccguacgucauaaccc

SEQ ID NO: 251 - RNA, 22 nt, Escherichia coli CFT073
guauuauuucugcggcagguuu

SEQ ID NO: 252 - RNA, 22 nt, Escherichia coli CFT073
gucaguuuuucacgagagauac

SEQ ID NO: 253 - RNA, 22 nt, Escherichia coli CFT073
guaaauaguccggaagaugcgc

SEQ ID NO: 254 - RNA, 22 nt, Escherichia coli CFT073
gguaaaggaguucgagaaaaau

SEQ ID NO: 255 - RNA, 22 nt, Escherichia coli CFT073
ggucagauugucuauaugaacu

SEQ ID NO: 256 - RNA, 23 nt, Escherichia coli CFT073
ggucuuccagcucaaucacuucc

SEQ ID NO: 257 - RNA, 22 nt, Escherichia coli CFT073
ggugagaaugugguggccauca

SEQ ID NO: 258 - RNA, 22 nt, Escherichia coli CFT073
gggaaucaauaucggauugauu

SEQ ID NO: 259 - RNA, 22 nt, Escherichia coli CFT073
gggacguagaagcugacgacgu

SEQ ID NO: 260 - RNA, 22 nt, Escherichia coli CFT073
ggcucagccacugacgccaggc

SEQ ID NO: 261 - RNA, 22 nt, Escherichia coli CFT073
ggcuggagcuggcgguaaucuc

SEQ ID NO: 262 - RNA, 22 nt, Escherichia coli CFT073
ggcuggcaguucaccauugccc

SEQ ID NO: 263 - RNA, 22 nt, Escherichia coli CFT073
gugaaagccugcgcgcuggcga

SEQ ID NO: 264 - RNA, 22 nt, Escherichia coli CFT073
gugaaagguuuuggucucgaug

SEQ ID NO: 265 - RNA, 22 nt, Escherichia coli CFT073
gugauuauggaugaaccgacuu

SEQ ID NO: 266 - RNA, 19 nt, Escherichia coli CFT073
gucugguggugcgcggauc

SEQ ID NO: 267 - RNA, 22 nt, Escherichia coli CFT073
gugcuggucaggaugccggacc

SEQ ID NO: 268 - RNA, 22 nt, Escherichia coli CFT073
guggcaggaucugucuccucau

SEQ ID NO: 269 - RNA, 22 nt, Escherichia coli CFT073
guugauauuguggucaagcgcg

SEQ ID NO: 270 - RNA, 22 nt, Escherichia coli CFT073
guuuuguuagcguuaaaaacac

SEQ ID NO: 271 - RNA, 22 nt, Escherichia coli CFT073
uaaacacugcacuguguauuca

SEQ ID NO: 272 - RNA, 22 nt, Escherichia coli CFT073
uaaagugaucuucuaagcccgc

SEQ ID NO: 273 - RNA, 22 nt, Escherichia coli CFT073
uaaaguuccgcguauugcguuc

SEQ ID NO: 274 - RNA, 22 nt, Escherichia coli CFT073
uaaaucaugcuguaauaaaugg

SEQ ID NO: 275 - RNA, 22 nt, Escherichia coli CFT073
uaaaucugcgcuuuguugauau

SEQ ID NO: 276 - RNA, 22 nt, Escherichia coli CFT073
aagaauuagcugacccagcguu

SEQ ID NO: 277 - RNA, 22 nt, Escherichia coli CFT073
aagagaugucauuacugaugcu

SEQ ID NO: 278 - RNA, 22 nt, Escherichia coli CFT073
aagcaguuccuuuuggcucugu

SEQ ID NO: 279 - RNA, 18 nt, Escherichia coli CFT073
aacauuuuuaaagcccgg

SEQ ID NO: 280 - RNA, 22 nt, Escherichia coli CFT073
aacgcugcgguuuugugcuggu

SEQ ID NO: 281 - RNA, 22 nt, Escherichia coli CFT073
aacagcauggggaaugaucaga

SEQ ID NO: 282 - RNA, 22 nt, Escherichia coli CFT073
aaaaaguggcggagaucccgga

SEQ ID NO: 283 - RNA, 22 nt, Escherichia coli CFT073
aaaaaucuccuugacaauuuau

SEQ ID NO: 284 - RNA, 20 nt, Escherichia coli CFT073
aaaacgugauuuuuacuggc

SEQ ID NO: 285 - RNA, 22 nt, Escherichia coli CFT073
aaaacugucugaaguggauuuu

SEQ ID NO: 286 - RNA, 22 nt, Escherichia coli CFT073
aaaagugauauuacggucucgu

SEQ ID NO: 287 - RNA, 22 nt, Escherichia coli CFT073
aaaaguggaaacagguuauccc

SEQ ID NO: 288 - RNA, 22 nt, Escherichia coli CFT073
aaaauaccgaagacagguguuc

SEQ ID NO: 289 - RNA, 22 nt, Escherichia coli CFT073
aaaaugcauuauacgguucugg

SEQ ID NO: 290 - RNA, 20 nt, Escherichia coli CFT073
aaaaugucaaugacacugua

SEQ ID NO: 291 - RNA, 22 nt, Escherichia coli CFT073
aaaauuuuggucgcagcgccau

SEQ ID NO: 292 - RNA, 22 nt, Escherichia coli CFT073
aaacugaggcugaugccagcgu

SEQ ID NO: 293 - RNA, 22 nt, Escherichia coli CFT073
aaagaaauggcgcaaauuaguu

SEQ ID NO: 294 - RNA, 22 nt, Escherichia coli CFT073
aaauaugcgacuggaaagagug

SEQ ID NO: 295 - RNA, 21 nt, Escherichia coli CFT073
aaauuuaacuacugaugauug

SEQ ID NO: 296 - RNA, 18 nt, Escherichia coli CFT073
aagggcagggcaaguacc

SEQ ID NO: 297 - RNA, 22 nt, Escherichia coli CFT073
aaguuacaucaacaaacucagg

SEQ ID NO: 298 - RNA, 22 nt, Escherichia coli CFT073
aaguuugccguggcaguggcga

SEQ ID NO: 299 - RNA, 22 nt, Escherichia coli CFT073
aauaacagacagugccaguuca

SEQ ID NO: 300 - RNA, 22 nt, Escherichia coli CFT073
aauagcauucgcuuuuggacga

SEQ ID NO: 301 - RNA, 20 nt, Escherichia coli CFT073
aagcugcaucagggcgauau

SEQ ID NO: 302 - RNA, 22 nt, Escherichia coli CFT073
aauauuugugguuuaccuucug

SEQ ID NO: 303 - RNA, 22 nt, Escherichia coli CFT073
aaucaugagcaucgaaacguuc

SEQ ID NO: 304 - RNA, 19 nt, Escherichia coli CFT073
aaucuggguuaagcguguc

SEQ ID NO: 305 - RNA, 22 nt, Escherichia coli CFT073
aauguacaaucaaaccaguuga

SEQ ID NO: 306 - RNA, 20 nt, Escherichia coli CFT073
aaugugcaggaugcguucgg

SEQ ID NO: 307 - RNA, 22 nt, Escherichia coli CFT073
aauguugucggucgccauauaa

SEQ ID NO: 308 - RNA, 22 nt, Escherichia coli CFT073
aauuaagaaagccgugcaggca

SEQ ID NO: 309 - RNA, 22 nt, Escherichia coli CFT073
aauuucaaucgcgucgcccagc

SEQ ID NO: 310 - RNA, 22 nt, Escherichia coli CFT073
aauuuuauccaguaacgccugg

SEQ ID NO: 311 - RNA, 19 nt, Escherichia coli CFT073
acaauagccaugugcaaua

SEQ ID NO: 312 - RNA, 22 nt, Escherichia coli CFT073
acuuaacagcccguuaacuuug

SEQ ID NO: 313 - RNA, 22 nt, Escherichia coli CFT073
acugucaucaaucaucuugaca

SEQ ID NO: 314 - RNA, 22 nt, Escherichia coli CFT073
agaaauaccaucaaaaucguga

SEQ ID NO: 315 - RNA, 22 nt, Escherichia coli CFT073
agaaauauuugcccggcgcguu

SEQ ID NO: 316 - RNA, 15 nt, Escherichia coli CFT073
agaagcagccaguuu

SEQ ID NO: 317 - RNA, 22 nt, Escherichia coli CFT073
acugcgaaucgggaauuaucuu

SEQ ID NO: 318 - RNA, 22 nt, Escherichia coli CFT073
agacaacaguuggaugcucauu

SEQ ID NO: 319 - RNA, 22 nt, Escherichia coli CFT073
agagcaugaucgcgugggccga

SEQ ID NO: 320 - RNA, 22 nt, Escherichia coli CFT073
agauccuucacuuaauuucauu

SEQ ID NO: 321 - RNA, 22 nt, Escherichia coli CFT073
agaucucuucgccaaagugcag

SEQ ID NO: 322 - RNA, 23 nt, Escherichia coli CFT073
agcaaacagcacgacugcucacc

SEQ ID NO: 323 - RNA, 22 nt, Escherichia coli CFT073
agcagacaaacagcgucgaggu

SEQ ID NO: 324 - RNA, 22 nt, Escherichia coli CFT073
acuaauuagccaucgauaaaaa

SEQ ID NO: 325 - RNA, 22 nt, Escherichia coli CFT073
acuacuucauuaugagcaaacu

SEQ ID NO: 326 - RNA, 22 nt, Escherichia coli CFT073
acccagguggagacguucucca

SEQ ID NO: 327 - RNA, 22 nt, Escherichia coli CFT073
acagagauguuuaauccuggcg

SEQ ID NO: 328 - RNA, 22 nt, Escherichia coli CFT073
acagggcuguagcaugcgucga

SEQ ID NO: 329 - RNA, 22 nt, Escherichia coli CFT073
acagggcuugcuaaugcugaug

SEQ ID NO: 330 - RNA, 22 nt, Escherichia coli CFT073
aggaaauugugucagcgaauug

SEQ ID NO: 331 - RNA, 22 nt, Escherichia coli CFT073
aggaagaugccucucaguugcg

SEQ ID NO: 332 - RNA, 22 nt, Escherichia coli CFT073
agcagcaacgcuggcuggagca

SEQ ID NO: 333 - RNA, 22 nt, Escherichia coli CFT073
agcaggccaucacgaccuugcu

SEQ ID NO: 334 - RNA, 22 nt, Escherichia coli CFT073
aguuccuuauaauauucaauga

SEQ ID NO: 335 - RNA, 22 nt, Escherichia coli CFT073
aguuccuuauaguauucaauga

SEQ ID NO: 336 - RNA, 22 nt, Escherichia coli CFT073
aguuuacaacgcauuguuaaag

SEQ ID NO: 337 - RNA, 20 nt, Escherichia coli CFT073
agugaaauccaacaguagcc

SEQ ID NO: 338 - RNA, 22 nt, Escherichia coli CFT073
auacagaaagcuuauaaugcga

SEQ ID NO: 339 - RNA, 19 nt, Escherichia coli CFT073
aggugauugaaaccgaucu

SEQ ID NO: 340 - RNA, 22 nt, Escherichia coli CFT073
aguaaaagugcgcaguuauggc

SEQ ID NO: 341 - RNA, 22 nt, Escherichia coli CFT073
agguggcaaaauuugggacaaa

SEQ ID NO: 342 - RNA, 22 nt, Escherichia coli CFT073
aguaacugcuugguaucuuucg

SEQ ID NO: 343 - RNA, 22 nt, Escherichia coli CFT073
aguaucaauagugauaucgcca

SEQ ID NO: 344 - RNA, 22 nt, Escherichia coli CFT073
aggcucaguacgcagcugaaga

SEQ ID NO: 345 - RNA, 22 nt, Escherichia coli CFT073
aggcacauaacagcuaaguauu

SEQ ID NO: 346 - RNA, 22 nt, Escherichia coli CFT073
agggcugcuugcuguucuccau

SEQ ID NO: 347 - RNA, 22 nt, Escherichia coli CFT073
aggucaaucaucuguucacuau

SEQ ID NO: 348 - RNA, 22 nt, Escherichia coli CFT073
auaucguugcuaauaauucuaa

SEQ ID NO: 349 - RNA, 22 nt, Escherichia coli CFT073
auagcaccgagaacaguaccgc

SEQ ID NO: 350 - RNA, 22 nt, Escherichia coli CFT073
auagcagcgugcuugucccugu

SEQ ID NO: 351 - RNA, 20 nt, Escherichia coli CFT073
aucaaaaggcagauaacguc

SEQ ID NO: 352 - RNA, 22 nt, Escherichia coli CFT073
aucaaacaggugcuggaguggu

SEQ ID NO: 353 - RNA, 22 nt, Escherichia coli CFT073
auauugaaggggcgagcaaaca

SEQ ID NO: 354 - RNA, 22 nt, Escherichia coli CFT073
auccuuaaccaugccgauaacg

SEQ ID NO: 355 - RNA, 22 nt, Escherichia coli CFT073
auccuucccgaaaaauauguau

SEQ ID NO: 356 - RNA, 21 nt, Escherichia coli CFT073
aucauucaccuguuguaacuc

SEQ ID NO: 357 - RNA, 22 nt, Escherichia coli CFT073
aucauaaugguacacuuuauag

SEQ ID NO: 358 - RNA, 22 nt, Escherichia coli CFT073
auggcgauauagucuuucacgc

SEQ ID NO: 359 - RNA, 22 nt, Escherichia coli CFT073
auggcgaucaggugcuggcuca

SEQ ID NO: 360 - RNA, 22 nt, Escherichia coli CFT073
auggaaggaucuggauucugga

SEQ ID NO: 361 - RNA, 22 nt, Escherichia coli CFT073
auggaagggauugaagagccgc

SEQ ID NO: 362 - RNA, 22 nt, Escherichia coli CFT073
auggcaauugccgguucgcugg

SEQ ID NO: 363 - RNA, 22 nt, Escherichia coli CFT073
aucuugaagugccaugggcgca

SEQ ID NO: 364 - RNA, 22 nt, Escherichia coli CFT073
aucuucucugcuuuuggcuggg

SEQ ID NO: 365 - RNA, 22 nt, Escherichia coli CFT073
augaaaacucugcggcauggcg

SEQ ID NO: 366 - RNA, 22 nt, Escherichia coli CFT073
augaauauuuagacuaaagagu

SEQ ID NO: 367 - RNA, 20 nt, Escherichia coli CFT073
augaaucagagaaaaaguga

SEQ ID NO: 368 - RNA, 22 nt, Escherichia coli CFT073
augacaaucgacggcuuuagau

SEQ ID NO: 369 - RNA, 22 nt, Escherichia coli CFT073
augauaaaacucacuaaacugu

SEQ ID NO: 370 - RNA, 22 nt, Escherichia coli CFT073
cguuuuauccggccuacaauga

SEQ ID NO: 371 - RNA, 22 nt, Escherichia coli CFT073
cugagaagugaugcugucagca

SEQ ID NO: 372 - RNA, 22 nt, Escherichia coli CFT073
cggcccagcuuuucccucucuc

SEQ ID NO: 373 - RNA, 22 nt, Escherichia coli CFT073
cggagagcgaguccagccugau

SEQ ID NO: 374 - RNA, 22 nt, Escherichia coli CFT073
cggaggacagccgugcauggug

SEQ ID NO: 375 - RNA, 22 nt, Escherichia coli CFT073
cgcacaggauuauuacggugug

SEQ ID NO: 376 - RNA, 22 nt, Escherichia coli CFT073
cgagcuggaaaccuuccugcug

SEQ ID NO: 377 - RNA, 22 nt, Escherichia coli CFT073
ccugggaagauguaagccgcca

SEQ ID NO: 378 - RNA, 21 nt, Escherichia coli CFT073
ccucgcuggucguuauccugc

SEQ ID NO: 379 - RNA, 22 nt, Escherichia coli CFT073
ccguaaaacgcaaucaaaauga

SEQ ID NO: 380 - RNA, 22 nt, Escherichia coli CFT073
ccaguuucuccugcaaugacaa

SEQ ID NO: 381 - RNA, 22 nt, Escherichia coli CFT073
cccaguccaacaccagcgggcg

SEQ ID NO: 382 - RNA, 22 nt, Escherichia coli CFT073
ccccccuauaguauauugcaug

SEQ ID NO: 383 - RNA, 21 nt, Escherichia coli CFT073
caguaaaacgcaccauacugu

SEQ ID NO: 384 - RNA, 22 nt, Escherichia coli CFT073
caguaacacuuccgcacugacc

SEQ ID NO: 385 - RNA, 20 nt, Escherichia coli CFT073
caguuugcuucugcauccac

SEQ ID NO: 386 - RNA, 22 nt, Escherichia coli CFT073
caucccccgugguccgccagua

SEQ ID NO: 387 - RNA, 22 nt, Escherichia coli CFT073
caucgugucuucauagcccugc

SEQ ID NO: 388 - RNA, 22 nt, Escherichia coli CFT073
caugaaaacaguguuauguugu

SEQ ID NO: 389 - RNA, 22 nt, Escherichia coli CFT073
caugaugggcaugaaugucaua

SEQ ID NO: 390 - RNA, 22 nt, Escherichia coli CFT073
cauguguaguaucgcaaacaua

SEQ ID NO: 391 - RNA, 22 nt, Escherichia coli CFT073
cauugaaaauaaauauccuccg

SEQ ID NO: 392 - RNA, 20 nt, Escherichia coli CFT073
cauuggcugguuguuggggc

SEQ ID NO: 393 - RNA, 22 nt, Escherichia coli CFT073
ccagaauucagguugcauccgu

SEQ ID NO: 394 - RNA, 22 nt, Escherichia coli CFT073
cagggcgcgaaugacagcagug

SEQ ID NO: 395 - RNA, 22 nt, Escherichia coli CFT073
cagccaguuaacgcuggcgcag

SEQ ID NO: 396 - RNA, 22 nt, Escherichia coli CFT073
cagcagcaguaugcagacgcug

SEQ ID NO: 397 - RNA, 22 nt, Escherichia coli CFT073
cagagcuggcccgacagauggc

SEQ ID NO: 398 - RNA, 22 nt, Escherichia coli CFT073
cagaaacguuguuaacccggca

SEQ ID NO: 399 - RNA, 22 nt, Escherichia coli CFT073
caccaaaaugacgcacuuugcc

SEQ ID NO: 400 - RNA, 22 nt, Escherichia coli CFT073
cacacgauccgcucgguuccga

SEQ ID NO: 401 - RNA, 22 nt, Escherichia coli CFT073
auguguucugggaucugcagga

SEQ ID NO: 402 - RNA, 22 nt, Escherichia coli CFT073
auguuuuaagcucugugagcga

SEQ ID NO: 403 - RNA, 22 nt, Escherichia coli CFT073
auuaauuugcuggaaauauuua

SEQ ID NO: 404 - RNA, 22 nt, Escherichia coli CFT073
auuaucaacggcgaagugcccg

SEQ ID NO: 405 - RNA, 22 nt, Escherichia coli CFT073
auugagcauaacuuuaaugcgc

SEQ ID NO: 406 - RNA, 22 nt, Escherichia coli CFT073
auuguaucccugauuauucaga

SEQ ID NO: 407 - RNA, 17 nt, Escherichia coli CFT073
auuucugcucauccagc

SEQ ID NO: 408 - RNA, 22 nt, Escherichia coli CFT073
caaaacugaugcagaaugcaga

SEQ ID NO: 409 - RNA, 22 nt, Escherichia coli CFT073
caaauuuuaccucguugguauc

SEQ ID NO: 410 - RNA, 22 nt, Escherichia coli CFT073
caauucugaacuacagccguag

SEQ ID NO: 411 - RNA, 22 nt, Escherichia coli CFT073
cacacagggcugaugauguucc

SEQ ID NO: 412 - RNA, 22 nt, Escherichia coli CFT073
uuuuacuggcgaugaaguacac

SEQ ID NO: 413 - RNA, 22 nt, Escherichia coli CFT073
uuuuauacucuaagaaaucagg

SEQ ID NO: 414 - RNA, 22 nt, Escherichia coli CFT073
uuuuauauuagccaggaacuuu

SEQ ID NO: 415 - RNA, 22 nt, Escherichia coli CFT073
uuuguaacguugcaggaugucg

SEQ ID NO: 416 - RNA, 22 nt, Escherichia coli CFT073
uuugcaggccugauaagcguag

SEQ ID NO: 417 - RNA, 22 nt, Escherichia coli CFT073
uuuggcuucagcguuuugcagg

SEQ ID NO: 418 - RNA, 20 nt, Escherichia coli CFT073
uuuugaccaacagugcuggc

SEQ ID NO: 419 - RNA, 22 nt, Escherichia coli CFT073
uuuugguguugcagccguggca

SEQ ID NO: 420 - RNA, 21 nt, Escherichia coli CFT073
uuuauagagcgaggccaguga

SEQ ID NO: 421 - RNA, 22 nt, Escherichia coli CFT073
uuuaugaugugugaaaaguuag

SEQ ID NO: 422 - RNA, 22 nt, Escherichia coli CFT073
uuuaugcucauuuguaggucgg

SEQ ID NO: 423 - RNA, 22 nt, Escherichia coli CFT073
uuucaaaaugauaacuucgcaa

SEQ ID NO: 424 - RNA, 22 nt, Escherichia coli CFT073
uuucaauacuuaucgauuccuu

SEQ ID NO: 425 - RNA, 22 nt, Escherichia coli CFT073
uuucacggucggccaguauuug

SEQ ID NO: 426 - RNA, 22 nt, Escherichia coli CFT073
uguggcauauguucgcgcaugg

SEQ ID NO: 427 - RNA, 22 nt, Escherichia coli CFT073
uguaauuaaaaccuggcucaua

SEQ ID NO: 428 - RNA, 22 nt, Escherichia coli CFT073
uguagcagcugccagcgaagcg

SEQ ID NO: 429 - RNA, 17 nt, Escherichia coli CFT073
uggugaacuggaaagcc

SEQ ID NO: 430 - RNA, 23 nt, Escherichia coli CFT073
ugguggcagagauugccgaucgg

SEQ ID NO: 431 - RNA, 22 nt, Escherichia coli CFT073
ugguuuggcgcugacgucauua

SEQ ID NO: 432 - RNA, 22 nt, Escherichia coli CFT073
uggggauguuaagcuggaguug

SEQ ID NO: 433 - RNA, 22 nt, Escherichia coli CFT073
uggucugucauacuuuguuacc

SEQ ID NO: 434 - RNA, 22 nt, Escherichia coli CFT073
ugugguguaagcacaguaguag

SEQ ID NO: 435 - RNA, 21 nt, Escherichia coli CFT073
uuaaaaaccggaggcaacaug

SEQ ID NO: 436 - RNA, 22 nt, Escherichia coli CFT073
uuaaauaucacccuguuugcca

SEQ ID NO: 437 - RNA, 22 nt, Escherichia coli CFT073
uuaaauuguuuaaugguauuga

SEQ ID NO: 438 - RNA, 22 nt, Escherichia coli CFT073
uuaagcuuugcacuccauuuau

SEQ ID NO: 439 - RNA, 22 nt, Escherichia coli CFT073
uuaccauaaugauuuucaugug

SEQ ID NO: 440 - RNA, 22 nt, Escherichia coli CFT073
uuauauguauuccagagguuua

SEQ ID NO: 441 - RNA, 22 nt, Escherichia coli CFT073
uuauuucugccgcguugcaaac

SEQ ID NO: 442 - RNA, 22 nt, Escherichia coli CFT073
uucaaaaccggcuuuuugcaau

SEQ ID NO: 443 - RNA, 22 nt, Escherichia coli CFT073
uucaaaauggugcggaauuuua

SEQ ID NO: 444 - RNA, 22 nt, Escherichia coli CFT073
uucagaauuuggcgaucugaaa

SEQ ID NO: 445 - RNA, 20 nt, Escherichia coli CFT073
uugaugaauuugcuguaaga

SEQ ID NO: 446 - RNA, 21 nt, Escherichia coli CFT073
uugaccugguugcagcacagc

SEQ ID NO: 447 - RNA, 20 nt, Escherichia coli CFT073
uucuggauuuugccaucaau

SEQ ID NO: 448 - RNA, 22 nt, Escherichia coli CFT073
uucuucaaucugacgcaucagg

SEQ ID NO: 449 - RNA, 22 nt, Escherichia coli CFT073
uucuucauuuuguaaggcgaac

SEQ ID NO: 450 - RNA, 22 nt, Escherichia coli CFT073
uucuucugguuauuaugccugc

SEQ ID NO: 451 - RNA, 22 nt, Escherichia coli CFT073
uucccugugacaaugauacagu

SEQ ID NO: 452 - RNA, 22 nt, Escherichia coli CFT073
uuccggguccaggagcaucauu

SEQ ID NO: 453 - RNA, 22 nt, Escherichia coli CFT073
uuccuguucgcgcugcucuuca

SEQ ID NO: 454 - RNA, 22 nt, Escherichia coli CFT073
uuccuguuuauaaaaggagagg

SEQ ID NO: 455 - RNA, 22 nt, Escherichia coli CFT073
uucucucugccugccgaggcca

SEQ ID NO: 456 - RNA, 22 nt, Escherichia coli CFT073
uugguaucguugggcugguguu

SEQ ID NO: 457 - RNA, 22 nt, Escherichia coli CFT073
uuguaaauuuccucuuugcuaa

SEQ ID NO: 458 - RNA, 22 nt, Escherichia coli CFT073
uuguuguucauguaugcauguu

SEQ ID NO: 459 - RNA, 22 nt, Escherichia coli CFT073
uuuaaguuaaucgaccauacug

SEQ ID NO: 460 - RNA, 22 nt, Escherichia coli CFT073
ucugguggcgaugucccugugg

SEQ ID NO: 461 - RNA, 22 nt, Escherichia coli CFT073
ucuuauuucaucgguucaugug

SEQ ID NO: 462 - RNA, 22 nt, Escherichia coli CFT073
ucuucuuuagccgcuucaauau

SEQ ID NO: 463 - RNA, 22 nt, Escherichia coli CFT073
ucuccugcggccacagcaguaa

SEQ ID NO: 464 - RNA, 22 nt, Escherichia coli CFT073
ucugacauaagggcacugcuga

SEQ ID NO: 465 - RNA, 18 nt, Escherichia coli CFT073
ucugaaagcugacaaugc

SEQ ID NO: 466 - RNA, 22 nt, Escherichia coli CFT073
ucuggcggcacucucugucccu

SEQ ID NO: 467 - RNA, 22 nt, Escherichia coli CFT073
ucuggcggcgguagaccgagag

SEQ ID NO: 468 - RNA, 22 nt, Escherichia coli CFT073
ugaagcagguauggcccaucac

SEQ ID NO: 469 - RNA, 22 nt, Escherichia coli CFT073
ugaauaaaccaucaugauuuuu

SEQ ID NO: 470 - RNA, 22 nt, Escherichia coli CFT073
ugaauacacagugcaguguuua

SEQ ID NO: 471 - RNA, 22 nt, Escherichia coli CFT073
ugaauauggcguggagucgcug

SEQ ID NO: 472 - RNA, 22 nt, Escherichia coli CFT073
ugaaaaacggcugcggaauuag

SEQ ID NO: 473 - RNA, 22 nt, Escherichia coli CFT073
ugaaaaguaaaguguuagauga

SEQ ID NO: 474 - RNA, 22 nt, Escherichia coli CFT073
ugaaagagcuggggaugcauuc

SEQ ID NO: 475 - RNA, 19 nt, Escherichia coli CFT073
ugaaaggcgcuggaugacg

SEQ ID NO: 476 - RNA, 22 nt, Escherichia coli CFT073
ugaaaggguuagcaguauauga

SEQ ID NO: 477 - RNA, 23 nt, Escherichia coli CFT073
ugaaauccuuaugaaacaaagua

SEQ ID NO: 478 - RNA, 22 nt, Escherichia coli CFT073
ugaagagcguucaagcgccguu

SEQ ID NO: 479 - RNA, 22 nt, Escherichia coli CFT073
ugcagcaugucaucugcauuuu

SEQ ID NO: 480 - RNA, 22 nt, Escherichia coli CFT073
ugcaacuggaguuaauuucguu

SEQ ID NO: 481 - RNA, 22 nt, Escherichia coli CFT073
ugauuaucgcuggucugcugcc

SEQ ID NO: 482 - RNA, 22 nt, Escherichia coli CFT073
ugaggcugccgggaaaguuuug

SEQ ID NO: 483 - RNA, 22 nt, Escherichia coli CFT073
ugaggcugcgcagcagucgcca

SEQ ID NO: 484 - RNA, 22 nt, Escherichia coli CFT073
ugaucacaguauuaucaaugac

SEQ ID NO: 485 - RNA, 22 nt, Escherichia coli CFT073
ugaugccuggcagccacuucaa

SEQ ID NO: 486 - RNA, 22 nt, Escherichia coli CFT073
ugaaugacagcgccgggcaugc

SEQ ID NO: 487 - RNA, 20 nt, Escherichia coli CFT073
ugcugcagcaagguaaaggc

SEQ ID NO: 488 - RNA, 22 nt, Escherichia coli CFT073
ugcugggauuaaccuucuuuuc

SEQ ID NO: 489 - RNA, 22 nt, Escherichia coli CFT073
ugcuggggaaaacauggucgau

SEQ ID NO: 490 - RNA, 22 nt, Escherichia coli CFT073
ugcuaucuggugagagugucgg

SEQ ID NO: 491 - RNA, 22 nt, Escherichia coli CFT073
ugcugaaacagaaacaguaugc

SEQ ID NO: 492 - RNA, 22 nt, Escherichia coli CFT073
ugcuggagucugccggacugga

SEQ ID NO: 493 - RNA, 18 nt, Escherichia coli CFT073
ugcauaauccuucugagc

SEQ ID NO: 494 - RNA, 22 nt, Escherichia coli CFT073
ugcaucacaaaccugaaaagaa

SEQ ID NO: 495 - RNA, 22 nt, Escherichia coli CFT073
ugccaucacgucgauuaucgcc

SEQ ID NO: 496 - RNA, 20 nt, Escherichia coli CFT073
uggccuguggcuguaugcgc

SEQ ID NO: 497 - RNA, 22 nt, Escherichia coli CFT073
uggccuuggaacgauguauccu

SEQ ID NO: 498 - RNA, 22 nt, Escherichia coli CFT073
uggcgauaagucucuuccuggu

SEQ ID NO: 499 - RNA, 20 nt, Escherichia coli CFT073
uggcaugguaagcgaagcgc

SEQ ID NO: 500 - RNA, 22 nt, Escherichia coli CFT073
uggcaggccauuggguugagaa

SEQ ID NO: 501 - RNA, 22 nt, Escherichia coli CFT073
uggauagccaggcaggguugua

SEQ ID NO: 502 - RNA, 22 nt, Escherichia coli CFT073
uggaauaucucggcagcuucug

SEQ ID NO: 503 - RNA, 21 nt, Escherichia coli CFT073
uggaggacgagguauugacca

SEQ ID NO: 504 - RNA, 19 nt, Haemophilus influenzae Rd
ugccggcguggcgauugca

SEQ ID NO: 505 - RNA, 22 nt, Haemophilus influenzae Rd
ugcgguaaaaaauucgaggguu

SEQ ID NO: 506 - RNA, 22 nt, Haemophilus influenzae Rd
ucuuccuuaaaacaacagcuuu

SEQ ID NO: 507 - RNA, 22 nt, Haemophilus influenzae Rd
uugcggaaaacagucguuuauu

SEQ ID NO: 508 - RNA, 21 nt, Haemophilus influenzae Rd
uucuuucguuuguccaggcaa

SEQ ID NO: 509 - RNA, 22 nt, Haemophilus influenzae Rd
uugacaauggguuuugaugaug

SEQ ID NO: 510 - RNA, 22 nt, Haemophilus influenzae Rd
uuauaaauaucaguauagcaac

SEQ ID NO: 511 - RNA, 22 nt, Haemophilus influenzae Rd
uuaauaaagguggugcgaccgu

SEQ ID NO: 512 - RNA, 18 nt, Haemophilus influenzae Rd
uuagaacuuuaucaugcu

SEQ ID NO: 513 - RNA, 22 nt, Haemophilus influenzae Rd
uuaaugcacgaccacgguuugu

SEQ ID NO: 514 - RNA, 21 nt, Haemophilus influenzae Rd
uuuccagugcuuuauauuaag

SEQ ID NO: 515 - RNA, 22 nt, Haemophilus influenzae Rd
caaaugaucggcuucuuuuucu

SEQ ID NO: 516 - RNA, 19 nt, Haemophilus influenzae Rd
auuuucuaccaacauugca

SEQ ID NO: 517 - RNA, 22 nt, Haemophilus influenzae Rd
auuacuuauaugaucauagccu

SEQ ID NO: 518 - RNA, 22 nt, Haemophilus influenzae Rd
auuuaaaauggcaucggcuugu

SEQ ID NO: 519 - RNA, 22 nt, Haemophilus influenzae Rd
auuaaugaauuacgauuucacc

SEQ ID NO: 520 - RNA, 22 nt, Haemophilus influenzae Rd
auguuggaucgggcgcaauaag

SEQ ID NO: 521 - RNA, 22 nt, Haemophilus influenzae Rd
auguggaaaaugugagcaagcu

SEQ ID NO: 522 - RNA, 22 nt, Haemophilus influenzae Rd
cacuagaacaguuuuagaaugc

SEQ ID NO: 523 - RNA, 22 nt, Haemophilus influenzae Rd
caucuuguuuuuaugccugaaa

SEQ ID NO: 524 - RNA, 22 nt, Haemophilus influenzae Rd
ccccuucaaauauaacgacguu

SEQ ID NO: 525 - RNA, 22 nt, Haemophilus influenzae Rd
ccccuuccgcccuucgggcacc

SEQ ID NO: 526 - RNA, 22 nt, Haemophilus influenzae Rd
cggaagcguuagcagcagcaaa

SEQ ID NO: 527 - RNA, 22 nt, Haemophilus influenzae Rd
auguauuccguucaagaacaaa

SEQ ID NO: 528 - RNA, 22 nt, Haemophilus influenzae Rd
auauucuuauugcaacuuaugc

SEQ ID NO: 529 - RNA, 23 nt, Haemophilus influenzae Rd
auauuguggcucaauuggcuugg

SEQ ID NO: 530 - RNA, 22 nt, Haemophilus influenzae Rd
aucaacuugcuaaagauuuagu

SEQ ID NO: 531 - RNA, 22 nt, Haemophilus influenzae Rd
auauuucacaaugucagaagau

SEQ ID NO: 532 - RNA, 22 nt, Haemophilus influenzae Rd
auaggauggguuucugcccacc

SEQ ID NO: 533 - RNA, 22 nt, Haemophilus influenzae Rd
auacaauauuggcuaugaugca

SEQ ID NO: 534 - RNA, 22 nt, Haemophilus influenzae Rd
agcagcugauuguauuggaaga

SEQ ID NO: 535 - RNA, 22 nt, Haemophilus influenzae Rd
aauuuauccucugauguagggc

SEQ ID NO: 536 - RNA, 22 nt, Haemophilus influenzae Rd
accauuuacuaauaagcgauug

SEQ ID NO: 537 - RNA, 22 nt, Haemophilus influenzae Rd
acgagcgugguaucaacguuug

SEQ ID NO: 538 - RNA, 22 nt, Haemophilus influenzae Rd
agcaacuuuuacuuuaaugagu

SEQ ID NO: 539 - RNA, 20 nt, Haemophilus influenzae Rd
agauuguuguggcaaauuuc

SEQ ID NO: 540 - RNA, 18 nt, Haemophilus influenzae Rd
acuuuuaacacuuaguca

SEQ ID NO: 541 - RNA, 22 nt, Haemophilus influenzae Rd
aauuaaaacaucagguuuauua

SEQ ID NO: 542 - RNA, 22 nt, Haemophilus influenzae Rd
aauaaauugaagcaauugguug

SEQ ID NO: 543 - RNA, 22 nt, Haemophilus influenzae Rd
aauaacaugguacgagaugcgu

SEQ ID NO: 544 - RNA, 22 nt, Haemophilus influenzae Rd
aaauauugugacaaaugauauu

SEQ ID NO: 545 - RNA, 22 nt, Haemophilus influenzae Rd
aaacaucacaucagaaagauca

SEQ ID NO: 546 - RNA, 22 nt, Haemophilus influenzae Rd
aaaaaaagaggcgugauuauag

SEQ ID NO: 547 - RNA, 22 nt, Haemophilus influenzae Rd
aacaaugccacugccauaacga

SEQ ID NO: 548 - RNA, 22 nt, Haemophilus influenzae Rd
aacuaggauuagcaagcauauu

SEQ ID NO: 549 - RNA, 22 nt, Haemophilus influenzae Rd
uaaauauuacguaacugaaaug

SEQ ID NO: 550 - RNA, 22 nt, Haemophilus influenzae Rd
guugggaacccuggauguggug

SEQ ID NO: 551 - RNA, 22 nt, Haemophilus influenzae Rd
gugggaugcucguuuaacugca

SEQ ID NO: 552 - RNA, 22 nt, Haemophilus influenzae Rd
guauuucaucacgucuuacuuu

SEQ ID NO: 553 - RNA, 22 nt, Haemophilus influenzae Rd
ucgcuagaaugaggcguuuaau

SEQ ID NO: 554 - RNA, 22 nt, Haemophilus influenzae Rd
ucaucuuuuacgaagugcaucg

SEQ ID NO: 555 - RNA, 22 nt, Haemophilus influenzae Rd
ucccaauuuagcugccgugauu

SEQ ID NO: 556 - RNA, 22 nt, Haemophilus influenzae Rd
uauuuuaacggugaugacaauc

SEQ ID NO: 557 - RNA, 22 nt, Haemophilus influenzae Rd
uaugaacucgcgaacgaagaga

SEQ ID NO: 558 - RNA, 22 nt, Haemophilus influenzae Rd
uauuguuaaagugaaaaauggu

SEQ ID NO: 559 - RNA, 22 nt, Haemophilus influenzae Rd
uaaugauuuacaaagcauacau

SEQ ID NO: 560 - RNA, 22 nt, Haemophilus influenzae Rd
uaauuauuggcaucguuuuagg

SEQ ID NO: 561 - RNA, 22 nt, Haemophilus influenzae Rd
uacaaaauuaccgcacuuuagg

SEQ ID NO: 562 - RNA, 22 nt, Haemophilus influenzae Rd
uaauauaacggacguagaugac

SEQ ID NO: 563 - RNA, 22 nt, Haemophilus influenzae Rd
gaaaaugugcggugcaaaacau

SEQ ID NO: 564 - RNA, 22 nt, Haemophilus influenzae Rd
gcauaacagaacccaguuaaac

SEQ ID NO: 565 - RNA, 21 nt, Haemophilus influenzae Rd
gcaaaugugauuugccccuac

SEQ ID NO: 566 - RNA, 22 nt, Homo sapiens
gcaagacaugucuaagguuuaa

SEQ ID NO: 567 - RNA, 22 nt, Homo sapiens
gcacauauguaaauagcugccu

SEQ ID NO: 568 - RNA, 22 nt, Homo sapiens
gcaccacugcacucucagcuug

SEQ ID NO: 569 - RNA, 22 nt, Homo sapiens
gcaccaugguagaauaauggua

SEQ ID NO: 570 - RNA, 22 nt, Homo sapiens
gcaaugcugucugugcacagau

SEQ ID NO: 571 - RNA, 22 nt, Homo sapiens
gcagcacauggcagaacauauu

SEQ ID NO: 572 - RNA, 22 nt, Homo sapiens
gcagaauugguuucuucuaagg

SEQ ID NO: 573 - RNA, 22 nt, Homo sapiens
gcagagaaacaggucuaaggag

SEQ ID NO: 574 - RNA, 22 nt, Homo sapiens
gcaggcaugacauuucacucuu

SEQ ID NO: 575 - RNA, 22 nt, Homo sapiens
gcagucacagggagauggugac

SEQ ID NO: 576 - RNA, 22 nt, Homo sapiens
gcaguggugugugccagccuag

SEQ ID NO: 577 - RNA, 22 nt, Homo sapiens
gcaguguggguagagggcaaga

SEQ ID NO: 578 - RNA, 22 nt, Homo sapiens
gcagcaucaaaucacacaagau

SEQ ID NO: 579 - RNA, 20 nt, Homo sapiens
gcauaugucuuuauagcaga

SEQ ID NO: 580 - RNA, 22 nt, Homo sapiens
gcauggagaaggggacugauuc

SEQ ID NO: 581 - RNA, 22 nt, Homo sapiens
gccaagaagugucuaagcagga

SEQ ID NO: 582 - RNA, 22 nt, Homo sapiens
gcauggccuuuaaaugucacag

SEQ ID NO: 583 - RNA, 22 nt, Homo sapiens
gaggaguagggcacaaagccuu

SEQ ID NO: 584 - RNA, 22 nt, Homo sapiens
gaggagucagacugugcaaggu

SEQ ID NO: 585 - RNA, 22 nt, Homo sapiens
gaggcuagauggggaugugucc

SEQ ID NO: 586 - RNA, 22 nt, Homo sapiens
gagcacugauuuauuuuugucu

SEQ ID NO: 587 - RNA, 22 nt, Homo sapiens
gagcaucaguggccucaucuca

SEQ ID NO: 588 - RNA, 22 nt, Homo sapiens
gagcuagguuuugaauccagac

SEQ ID NO: 589 - RNA, 22 nt, Homo sapiens
gagcugaucuuuucugauucca

SEQ ID NO: 590 - RNA, 22 nt, Homo sapiens
gagcuggacuucuuaccuuuuc

SEQ ID NO: 591 - RNA, 22 nt, Homo sapiens
gagauugucaugauuacauugu

SEQ ID NO: 592 - RNA, 22 nt, Homo sapiens
gagagcuaggccacuggggcuu

SEQ ID NO: 593 - RNA, 22 nt, Homo sapiens
gagagguaguuuuuuggucguc

SEQ ID NO: 594 - RNA, 22 nt, Homo sapiens
gagagugcuuggcaucugcuga

SEQ ID NO: 595 - RNA, 22 nt, Homo sapiens
gagauacacccagugcagaggc

SEQ ID NO: 596 - RNA, 22 nt, Homo sapiens
gagauacuugguuucuguuucu

SEQ ID NO: 597 - RNA, 22 nt, Homo sapiens
gagauauuauuucccuuucaca

SEQ ID NO: 598 - RNA, 22 nt, Homo sapiens
gagauauucugguuuacuaaau

SEQ ID NO: 599 - RNA, 22 nt, Homo sapiens
gagauauuuagaaauguguucu

SEQ ID NO: 600 - RNA, 22 nt, Homo sapiens
gagaucauguacuagaacaccu

SEQ ID NO: 601 - RNA, 23 nt, Homo sapiens
gagaucauucuggaauuagagug

SEQ ID NO: 602 - RNA, 22 nt, Homo sapiens
gagaaccauuuggagaaaaagu

SEQ ID NO: 603 - RNA, 22 nt, Homo sapiens
gagauggugugcuguuggaagu

SEQ ID NO: 604 - RNA, 22 nt, Homo sapiens
gagauguuuuguuaucaaagga

SEQ ID NO: 605 - RNA, 22 nt, Homo sapiens
gaugcagcuaggauuugugaca

SEQ ID NO: 606 - RNA, 22 nt, Homo sapiens
gaugaggcuagagacaugugua

SEQ ID NO: 607 - RNA, 22 nt, Homo sapiens
gaugagguagaagacucagcaa

SEQ ID NO: 608 - RNA, 22 nt, Homo sapiens
gaucacauuguuucauacauau

SEQ ID NO: 609 - RNA, 22 nt, Homo sapiens
gaggugauaucucauugugguu

SEQ ID NO: 610 - RNA, 22 nt, Homo sapiens
gaucugugugauuggaugcauu

SEQ ID NO: 611 - RNA, 19 nt, Homo sapiens
gaucuguugaucaaugugu

SEQ ID NO: 612 - RNA, 22 nt, Homo sapiens
gaucuguuuuccuauuguuugu

SEQ ID NO: 613 - RNA, 22 nt, Homo sapiens
gagguaaguggauuaugagguc

SEQ ID NO: 614 - RNA, 21 nt, Homo sapiens
gagguaccucauguaagugga

SEQ ID NO: 615 - RNA, 22 nt, Homo sapiens
gagguauagaacaccuuucaag

SEQ ID NO: 616 - RNA, 22 nt, Homo sapiens
gagguaucauuauguugcccag

SEQ ID NO: 617 - RNA, 22 nt, Homo sapiens
gagguauggauaucuggagagg

SEQ ID NO: 618 - RNA, 22 nt, Homo sapiens
gaggugaaggucucaauaaaua

SEQ ID NO: 619 - RNA, 22 nt, Homo sapiens
gaguaacagcauaaauuuguga

SEQ ID NO: 620 - RNA, 22 nt, Homo sapiens
gaguuagguugucaaugucuua

SEQ ID NO: 621 - RNA, 22 nt, Homo sapiens
gauaaagauagcaauagggaca

SEQ ID NO: 622 - RNA, 22 nt, Homo sapiens
gauaaaguauuggguacuaugc

SEQ ID NO: 623 - RNA, 22 nt, Homo sapiens
gauaacagauaaugucaguuau

SEQ ID NO: 624 - RNA, 18 nt, Homo sapiens
gauaacaguggacuaugc

SEQ ID NO: 625 - RNA, 22 nt, Homo sapiens
gauagcagccauucuuuuuauu

SEQ ID NO: 626 - RNA, 22 nt, Homo sapiens
gauagguucuaagcagguguug

SEQ ID NO: 627 - RNA, 21 nt, Homo sapiens
gauaucuuuauucccaagagc

SEQ ID NO: 628 - RNA, 22 nt, Homo sapiens
gauaucuuuuguauggugagcu

SEQ ID NO: 629 - RNA, 22 nt, Homo sapiens
gauauguaguaguugaaaaaga

SEQ ID NO: 630 - RNA, 19 nt, Homo sapiens
gauauguugagcacccuuu

SEQ ID NO: 631 - RNA, 22 nt, Homo sapiens
gaugccuuuuuguccucaguua

SEQ ID NO: 632 - RNA, 22 nt, Homo sapiens
gauggaguaauguaaucuugag

SEQ ID NO: 633 - RNA, 22 nt, Homo sapiens
gauggaguugucgccugggcug

SEQ ID NO: 634 - RNA, 22 nt, Homo sapiens
gauggcacuaagccauguagga

SEQ ID NO: 635 - RNA, 22 nt, Homo sapiens
gauggcacuuaagagcaagagc

SEQ ID NO: 636 - RNA, 22 nt, Homo sapiens
gaugugaaaucauaguuucuag

SEQ ID NO: 637 - RNA, 22 nt, Homo sapiens
gauguguugggaagauuucaag

SEQ ID NO: 638 - RNA, 22 nt, Homo sapiens
gauguguuuccaggauuuguuu

SEQ ID NO: 639 - RNA, 22 nt, Homo sapiens
gauguguuuuaggaucucagca

SEQ ID NO: 640 - RNA, 20 nt, Homo sapiens
gauuagagagaggcugugca

SEQ ID NO: 641 - RNA, 22 nt, Homo sapiens
gauuccauugcgaauuuucaga

SEQ ID NO: 642 - RNA, 22 nt, Homo sapiens
gauuuuccaguggcccugauca

SEQ ID NO: 643 - RNA, 22 nt, Homo sapiens
gcaaagaaugcagauuugccuc

SEQ ID NO: 644 - RNA, 22 nt, Homo sapiens
gcaaaugcuacaccauuuugua

SEQ ID NO: 645 - RNA, 22 nt, Homo sapiens
gcaaaugcuaugccauuuuaua

SEQ ID NO: 646 - RNA, 20 nt, Homo sapiens
gcaaauggaucccacaagcc

SEQ ID NO: 647 - RNA, 21 nt, Homo sapiens
gaaauacugccuuaggagcug

SEQ ID NO: 648 - RNA, 22 nt, Homo sapiens
gaaauggaucagagcaagcuuu

SEQ ID NO: 649 - RNA, 22 nt, Homo sapiens
gaaagacuuucugcuguggaua

SEQ ID NO: 650 - RNA, 22 nt, Homo sapiens
gaaagauuuccugagcuagaaa

SEQ ID NO: 651 - RNA, 22 nt, Homo sapiens
gaaagauuuuaacugggagacu

SEQ ID NO: 652 - RNA, 22 nt, Homo sapiens
gaaagguaggaacagggugcag

SEQ ID NO: 653 - RNA, 22 nt, Homo sapiens
cuuucucagugagacccgagau

SEQ ID NO: 654 - RNA, 22 nt, Homo sapiens
cuuucugaggagaauagagaac

SEQ ID NO: 655 - RNA, 22 nt, Homo sapiens
gaaaacugcuucucuggguuuc

SEQ ID NO: 656 - RNA, 22 nt, Homo sapiens
cuuugauuauaaaaggguguuu

SEQ ID NO: 657 - RNA, 18 nt, Homo sapiens
cuuugcagcuuccagagg

SEQ ID NO: 658 - RNA, 22 nt, Homo sapiens
cuuuggagaaaaguucuugggc

SEQ ID NO: 659 - RNA, 20 nt, Homo sapiens
cuuuggcaaugagaacaggg

SEQ ID NO: 660 - RNA, 22 nt, Homo sapiens
cuuuggcaaugucauuuucaau

SEQ ID NO: 661 - RNA, 22 nt, Homo sapiens
cuuuggcauuagccuguauaga

SEQ ID NO: 662 - RNA, 22 nt, Homo sapiens
cuuuggccauagcuaaaugauu

SEQ ID NO: 663 - RNA, 22 nt, Homo sapiens
cuuugguguauuuucagagacc

SEQ ID NO: 664 - RNA, 22 nt, Homo sapiens
cuuuguaugucaugacaacugu

SEQ ID NO: 665 - RNA, 23 nt, Homo sapiens
cuuuguccccacccaaaucucau

SEQ ID NO: 666 - RNA, 22 nt, Homo sapiens
cuuuuggcuuaagauugucuug

SEQ ID NO: 667 - RNA, 22 nt, Homo sapiens
cuuuuggcuuagaauugucuug

SEQ ID NO: 668 - RNA, 22 nt, Homo sapiens
gaauaaacuagagaggacugag

SEQ ID NO: 669 - RNA, 22 nt, Homo sapiens
gaaucaauugaucuaugugucu

SEQ ID NO: 670 - RNA, 22 nt, Homo sapiens
gaaucacagauuaugaguaucu

SEQ ID NO: 671 - RNA, 22 nt, Homo sapiens
gaaucacaguuauuagagcagc

SEQ ID NO: 672 - RNA, 22 nt, Homo sapiens
gaaucacugugguaucccaugc

SEQ ID NO: 673 - RNA, 22 nt, Homo sapiens
gaaucauuguuucuaaguuugu

SEQ ID NO: 674 - RNA, 22 nt, Homo sapiens
gaaugaauguuuauccuuagau

SEQ ID NO: 675 - RNA, 22 nt, Homo sapiens
gaaugauacuguuaacgaaaga

SEQ ID NO: 676 - RNA, 22 nt, Homo sapiens
gaaugcuaagcaugugggaauu

SEQ ID NO: 677 - RNA, 22 nt, Homo sapiens
gaaugcuaccagcaucuagugg

SEQ ID NO: 678 - RNA, 22 nt, Homo sapiens
gaauggaacugacuauagcuga

SEQ ID NO: 679 - RNA, 22 nt, Homo sapiens
gaauucugucgcuuacuagaug

SEQ ID NO: 680 - RNA, 22 nt, Homo sapiens
gaauuguacugcaaucagggga

SEQ ID NO: 681 - RNA, 22 nt, Homo sapiens
gaagugcuuuuggacuaacagu

SEQ ID NO: 682 - RNA, 22 nt, Homo sapiens
gaagauucaaccaaaccagaac

SEQ ID NO: 683 - RNA, 22 nt, Homo sapiens
gaagcauugauccacaggcgug

SEQ ID NO: 684 - RNA, 22 nt, Homo sapiens
gaagcgaggugauuagcagaca

SEQ ID NO: 685 - RNA, 22 nt, Homo sapiens
gaacuguuucuggugaaagagu

SEQ ID NO: 686 - RNA, 22 nt, Homo sapiens
gaacccuggaggcggagguugc

SEQ ID NO: 687 - RNA, 21 nt, Homo sapiens
gaccacagcagggaaugucag

SEQ ID NO: 688 - RNA, 22 nt, Homo sapiens
gacaccugguguggaacuggag

SEQ ID NO: 689 - RNA, 22 nt, Homo sapiens
gacacugucuucugcucuuaaa

SEQ ID NO: 690 - RNA, 21 nt, Homo sapiens
gacauggcgauacuccgucuc

SEQ ID NO: 691 - RNA, 22 nt, Homo sapiens
gacauguaaggcucucucuguu

SEQ ID NO: 692 - RNA, 22 nt, Homo sapiens
gacagugagaugucaugugaaa

SEQ ID NO: 693 - RNA, 18 nt, Homo sapiens
gacagugugaagauuccu

SEQ ID NO: 694 - RNA, 22 nt, Homo sapiens
gacagugugauacuuagucuca

SEQ ID NO: 695 - RNA, 18 nt, Homo sapiens
gacaguguggcaauuccu

SEQ ID NO: 696 - RNA, 18 nt, Homo sapiens
gacaguguggcgauuccu

SEQ ID NO: 697 - RNA, 22 nt, Homo sapiens
gacaguguggcgauuccucaag

SEQ ID NO: 698 - RNA, 18 nt, Homo sapiens
gacaguguggugauuccu

SEQ ID NO: 699 - RNA, 20 nt, Homo sapiens
gacauagagacucucaaaaa

SEQ ID NO: 700 - RNA, 22 nt, Homo sapiens
gacuagaaauuauuuagugagc

SEQ ID NO: 701 - RNA, 22 nt, Homo sapiens
gacuaggagagcagcugcccau

SEQ ID NO: 702 - RNA, 22 nt, Homo sapiens
gacuaggagauauguuuucuuc

SEQ ID NO: 703 - RNA, 19 nt, Homo sapiens
gacuccagaguugugugcu

SEQ ID NO: 704 - RNA, 22 nt, Homo sapiens
gagaacauacggcauuugguuu

SEQ ID NO: 705 - RNA, 22 nt, Homo sapiens
gagaacauuaauaguuaauuuu

SEQ ID NO: 706 - RNA, 22 nt, Homo sapiens
gagaacauuuaagccacucagg

SEQ ID NO: 707 - RNA, 22 nt, Homo sapiens
gagaacugagauaagugauauu

SEQ ID NO: 708 - RNA, 22 nt, Homo sapiens
gagaaugaugauuuccaauuuc

SEQ ID NO: 709 - RNA, 22 nt, Homo sapiens
gagaaugcaugaaagacuuaca

SEQ ID NO: 710 - RNA, 23 nt, Homo sapiens
gagaccagcuucagaaagcacga

SEQ ID NO: 711 - RNA, 22 nt, Homo sapiens
gagacggagucucgcucuguca

SEQ ID NO: 712 - RNA, 22 nt, Homo sapiens
gagacggagucucgcucugucg

SEQ ID NO: 713 - RNA, 22 nt, Homo sapiens
gagacggagucuugcucuguug

SEQ ID NO: 714 - RNA, 22 nt, Homo sapiens
gagacugagucucacucuguca

SEQ ID NO: 715 - RNA, 22 nt, Homo sapiens
gagacugagucuugcucuguca

SEQ ID NO: 716 - RNA, 22 nt, Homo sapiens
gagacugagucuugcucugucg

SEQ ID NO: 717 - RNA, 22 nt, Homo sapiens
gagacugagucuugcuuuguca

SEQ ID NO: 718 - RNA, 22 nt, Homo sapiens
gagacugaguuuugcucuuguu

SEQ ID NO: 719 - RNA, 22 nt, Homo sapiens
gagagcauuaagccaucaucau

SEQ ID NO: 720 - RNA, 18 nt, Homo sapiens
cugccagugugcucuccg

SEQ ID NO: 721 - RNA, 22 nt, Homo sapiens
cugcaguaaccacuguaggugu

SEQ ID NO: 722 - RNA, 22 nt, Homo sapiens
cugccacugacaccucaaggac

SEQ ID NO: 723 - RNA, 20 nt, Homo sapiens
cugcacauccacucuacuuc

SEQ ID NO: 724 - RNA, 22 nt, Homo sapiens
cugagauggagucucgcauugu

SEQ ID NO: 725 - RNA, 22 nt, Homo sapiens
cugaggacaucagggaagcauc

SEQ ID NO: 726 - RNA, 22 nt, Homo sapiens
cugauacugagaccuuggguua

SEQ ID NO: 727 - RNA, 22 nt, Homo sapiens
cugauugucaucaauauuauua

SEQ ID NO: 728 - RNA, 22 nt, Homo sapiens
cuggaggccugaacauaaaugg

SEQ ID NO: 729 - RNA, 22 nt, Homo sapiens
cuggaguaugaaccauguauca

SEQ ID NO: 730 - RNA, 22 nt, Homo sapiens
cuggauauguugcaacauuucc

SEQ ID NO: 731 - RNA, 20 nt, Homo sapiens
cuggaugucgaggcagaggu

SEQ ID NO: 732 - RNA, 18 nt, Homo sapiens
cuggaugucgaguguguu

SEQ ID NO: 733 - RNA, 22 nt, Homo sapiens
cuggaagaaaaucacgccaucu

SEQ ID NO: 734 - RNA, 22 nt, Homo sapiens
cuggaauguuccuaaagauuca

SEQ ID NO: 735 - RNA, 22 nt, Homo sapiens
cuggcagucugccucuucacug

SEQ ID NO: 736 - RNA, 22 nt, Homo sapiens
cuggccagagacauucauuaaa

SEQ ID NO: 737 - RNA, 22 nt, Homo sapiens
cuggcaagaggauaaaguccua

SEQ ID NO: 738 - RNA, 22 nt, Homo sapiens
cuggcaauaaauuuuuguguug

SEQ ID NO: 739 - RNA, 22 nt, Homo sapiens
cuggcaauaggcagugucccaa

SEQ ID NO: 740 - RNA, 22 nt, Homo sapiens
cuguuugaggguuugcuuucag

SEQ ID NO: 741 - RNA, 22 nt, Homo sapiens
cuuaaagcgaauauugguggua

SEQ ID NO: 742 - RNA, 22 nt, Homo sapiens
cuuaacagugguauugaugacc

SEQ ID NO: 743 - RNA, 18 nt, Homo sapiens
cuuaacauugggaugaua

SEQ ID NO: 744 - RNA, 22 nt, Homo sapiens
cugguuuguaaaguuccugaga

SEQ ID NO: 745 - RNA, 22 nt, Homo sapiens
cuguaauguaaugagacuacau

SEQ ID NO: 746 - RNA, 22 nt, Homo sapiens
cuguagcuuuuauaugcuuagc

SEQ ID NO: 747 - RNA, 22 nt, Homo sapiens
cuguaugugagaaauaauaagu

SEQ ID NO: 748 - RNA, 22 nt, Homo sapiens
cugucucagccucuccaguagc

SEQ ID NO: 749 - RNA, 22 nt, Homo sapiens
cugugcaaagcgcucucggggu

SEQ ID NO: 750 - RNA, 22 nt, Homo sapiens
cugugcauggauuuuaagauug

SEQ ID NO: 751 - RNA, 19 nt, Homo sapiens
cugugcauuucuguggaag

SEQ ID NO: 752 - RNA, 22 nt, Homo sapiens
cugugcuugagagaugacacag

SEQ ID NO: 753 - RNA, 22 nt, Homo sapiens
cugugcuugauuauaugagugu

SEQ ID NO: 754 - RNA, 22 nt, Homo sapiens
cuggugauugguuucauucagu

SEQ ID NO: 755 - RNA, 22 nt, Homo sapiens
cugggaugugacuguugccccc

SEQ ID NO: 756 - RNA, 22 nt, Homo sapiens
cuggcugagugguaaguagagg

SEQ ID NO: 757 - RNA, 22 nt, Homo sapiens
cuucuugagacuuaggcuuugg

SEQ ID NO: 758 - RNA, 22 nt, Homo sapiens
cuucaugucuucaauggggggg

SEQ ID NO: 759 - RNA, 21 nt, Homo sapiens
cugguccccuuuauguaugug

SEQ ID NO: 760 - RNA, 22 nt, Homo sapiens
cuucaaaguuggcuaggagaca

SEQ ID NO: 761 - RNA, 17 nt, Homo sapiens
cuucaaauaauuucccc

SEQ ID NO: 762 - RNA, 22 nt, Homo sapiens
cuucaaguguggccaccugacc

SEQ ID NO: 763 - RNA, 20 nt, Homo sapiens
cuucacagaaguggaaucau

SEQ ID NO: 764 - RNA, 22 nt, Homo sapiens
cuuuaugagguuggauggaucu

SEQ ID NO: 765 - RNA, 22 nt, Homo sapiens
cuuuaguugucuccucaagggu

SEQ ID NO: 766 - RNA, 18 nt, Homo sapiens
cuugucaaaucuuuccuc

SEQ ID NO: 767 - RNA, 22 nt, Homo sapiens
cuuguggugcuuuuacgugggc

SEQ ID NO: 768 - RNA, 22 nt, Homo sapiens
cuuguuguggaggggagugcag

SEQ ID NO: 769 - RNA, 22 nt, Homo sapiens
cuuuacaguuggacucacgagg

SEQ ID NO: 770 - RNA, 22 nt, Homo sapiens
cuugaucaaugugguacuugau

SEQ ID NO: 771 - RNA, 22 nt, Homo sapiens
cuugcacucagaagauucaguu

SEQ ID NO: 772 - RNA, 22 nt, Homo sapiens
cuugcacuccacuguucuccug

SEQ ID NO: 773 - RNA, 22 nt, Homo sapiens
cuugcacuugaaauuccaguuu

SEQ ID NO: 774 - RNA, 20 nt, Homo sapiens
cuugccuagcccuuugccuc

SEQ ID NO: 775 - RNA, 22 nt, Homo sapiens
cuguucaaauuguuugugaagu

SEQ ID NO: 776 - RNA, 22 nt, Homo sapiens
cuucucagugcucaucuuauuu

SEQ ID NO: 777 - RNA, 20 nt, Homo sapiens
cuuggcuuucuugguguuaa

SEQ ID NO: 778 - RNA, 22 nt, Homo sapiens
gccccgggugaugcagccguca

SEQ ID NO: 779 - RNA, 22 nt, Homo sapiens
gccuagagaaguaaauauuauc

SEQ ID NO: 780 - RNA, 22 nt, Homo sapiens
gccugagaggauaugauccccu

SEQ ID NO: 781 - RNA, 22 nt, Homo sapiens
gccuguagaagaguagaugacc

SEQ ID NO: 782 - RNA, 22 nt, Homo sapiens
gcuaggagauccacugcucucu

SEQ ID NO: 783 - RNA, 22 nt, Homo sapiens
gcuaggagaucugcugcucucu

SEQ ID NO: 784 - RNA, 22 nt, Homo sapiens
gcgguagcauagacugcaggac

SEQ ID NO: 785 - RNA, 22 nt, Homo sapiens
gcugauguugaccuugaucacc

SEQ ID NO: 786 - RNA, 22 nt, Homo sapiens
gcugcacuuuaaggcauccccu

SEQ ID NO: 787 - RNA, 22 nt, Homo sapiens
gcgugguguuagaaugagaagu

SEQ ID NO: 788 - RNA, 22 nt, Homo sapiens
gcugagaucucuugccugaacu

SEQ ID NO: 789 - RNA, 22 nt, Homo sapiens
gcuggaauuaacauagaugugc

SEQ ID NO: 790 - RNA, 22 nt, Homo sapiens
gcuggcuuucuccugaucucag

SEQ ID NO: 791 - RNA, 22 nt, Homo sapiens
gcuggguucagagugggcugcg

SEQ ID NO: 792 - RNA, 22 nt, Homo sapiens
gcugcuguuucucuuucagcau

SEQ ID NO: 793 - RNA, 22 nt, Homo sapiens
ggacagugaaugccacuccucc

SEQ ID NO: 794 - RNA, 22 nt, Homo sapiens
ggacuaggagcuaggaagaucu

SEQ ID NO: 795 - RNA, 22 nt, Homo sapiens
ggacuagggacauggggagcug

SEQ ID NO: 796 - RNA, 22 nt, Homo sapiens
ggacuguacuccuggccagugu

SEQ ID NO: 797 - RNA, 22 nt, Homo sapiens
ggagaauguaauugguauuuug

SEQ ID NO: 798 - RNA, 22 nt, Homo sapiens
ggagaugauuaugaaucacuua

SEQ ID NO: 799 - RNA, 20 nt, Homo sapiens
ggaauagucuacacucugac

SEQ ID NO: 800 - RNA, 22 nt, Homo sapiens
ggaaucugaaccaugggaaugg

SEQ ID NO: 801 - RNA, 23 nt, Homo sapiens
ggaaugaaaccugguuaugauau

SEQ ID NO: 802 - RNA, 22 nt, Homo sapiens
ggaaauguuuagcauccacuuu

SEQ ID NO: 803 - RNA, 22 nt, Homo sapiens
ggaagaauaaugggccuuagag

SEQ ID NO: 804 - RNA, 22 nt, Homo sapiens
ggaagaauauuaggggauuucg

SEQ ID NO: 805 - RNA, 22 nt, Homo sapiens
ggaagguaauugucagcucaua

SEQ ID NO: 806 - RNA, 22 nt, Homo sapiens
ggaaggucaaagggaaagcaga

SEQ ID NO: 807 - RNA, 18 nt, Homo sapiens
gcuguugucagagcacau

SEQ ID NO: 808 - RNA, 22 nt, Homo sapiens
gcugugauucuguguagauagu

SEQ ID NO: 809 - RNA, 20 nt, Homo sapiens
gcugugcuuaauacacuuuc

SEQ ID NO: 810 - RNA, 22 nt, Homo sapiens
gcuguguugugcccagcaucau

SEQ ID NO: 811 - RNA, 22 nt, Homo sapiens
gcuggugacuuuaaguugaagc

SEQ ID NO: 812 - RNA, 22 nt, Homo sapiens
gcuuguguuuacuguaguuacu

SEQ ID NO: 813 - RNA, 18 nt, Homo sapiens
ggaaaacuuuucuaagua

SEQ ID NO: 814 - RNA, 23 nt, Homo sapiens
ggaaacauccagucuuucaccau

SEQ ID NO: 815 - RNA, 22 nt, Homo sapiens
ggaaagacaccuuacuauguua

SEQ ID NO: 816 - RNA, 22 nt, Homo sapiens
ggaaagauguaauauuaucuaa

SEQ ID NO: 817 - RNA, 22 nt, Homo sapiens
ggaaagcuagguguggguguac

SEQ ID NO: 818 - RNA, 22 nt, Homo sapiens
gcuuuguugauggugagucugu

SEQ ID NO: 819 - RNA, 22 nt, Homo sapiens
ggcagacuguggaguucuuucu

SEQ ID NO: 820 - RNA, 23 nt, Homo sapiens
ggcaagaucucagcucacugcaa

SEQ ID NO: 821 - RNA, 22 nt, Homo sapiens
ggcaagaucuuggcucacugaa

SEQ ID NO: 822 - RNA, 19 nt, Homo sapiens
ggcaauacuuucuuguugg

SEQ ID NO: 823 - RNA, 22 nt, Homo sapiens
ggcaaugaggcggaccagcagg

SEQ ID NO: 824 - RNA, 22 nt, Homo sapiens
ggcacaaugucagcucacugca

SEQ ID NO: 825 - RNA, 22 nt, Homo sapiens
ggagcugugauuugaguccaga

SEQ ID NO: 826 - RNA, 22 nt, Homo sapiens
ggagcucaucuagcauagaggu

SEQ ID NO: 827 - RNA, 22 nt, Homo sapiens
ggagucugauuuuuauguugcu

SEQ ID NO: 828 - RNA, 23 nt, Homo sapiens
ggaguguaaugacucgaucucgg

SEQ ID NO: 829 - RNA, 23 nt, Homo sapiens
ggaguguauuggcacgaucucag

SEQ ID NO: 830 - RNA, 22 nt, Homo sapiens
ggaguguguaggagaaagguaa

SEQ ID NO: 831 - RNA, 22 nt, Homo sapiens
ggaucacuugagaccaggaguu

SEQ ID NO: 832 - RNA, 22 nt, Homo sapiens
ggaucauaugauagcucaauuu

SEQ ID NO: 833 - RNA, 22 nt, Homo sapiens
ggcaguuuguuugugaggucca

SEQ ID NO: 834 - RNA, 22 nt, Homo sapiens
ggcagcucaggccccgcgcuga

SEQ ID NO: 835 - RNA, 22 nt, Homo sapiens
ggcagcuguguccuucguaagg

SEQ ID NO: 836 - RNA, 22 nt, Homo sapiens
ggcagcaugggugccuuuguga

SEQ ID NO: 837 - RNA, 22 nt, Homo sapiens
ggcagcauugccuuugcaguga

SEQ ID NO: 838 - RNA, 23 nt, Homo sapiens
ggauggaaaguuuugagggccac

SEQ ID NO: 839 - RNA, 22 nt, Homo sapiens
ggcacuguggcucaagccugua

SEQ ID NO: 840 - RNA, 22 nt, Homo sapiens
ggccggguggccauggcugccc

SEQ ID NO: 841 - RNA, 22 nt, Homo sapiens
ggccuguaaacuagagacccug

SEQ ID NO: 842 - RNA, 22 nt, Homo sapiens
ggccuguaggguauugguaggg

SEQ ID NO: 843 - RNA, 22 nt, Homo sapiens
uaauauguuuugaaaucaggaa

SEQ ID NO: 844 - RNA, 22 nt, Homo sapiens
uaaucacagagguuuggccuca

SEQ ID NO: 845 - RNA, 22 nt, Homo sapiens
uaauccuagcacuuuggaagac

SEQ ID NO: 846 - RNA, 22 nt, Homo sapiens
uaagugaauauggacaguuagc

SEQ ID NO: 847 - RNA, 22 nt, Homo sapiens
uaaguucauucaugaaacuuag

SEQ ID NO: 848 - RNA, 22 nt, Homo sapiens
uaauacuguaauggugguuccg

SEQ ID NO: 849 - RNA, 22 nt, Homo sapiens
uaauagcaguguuacuaggacu

SEQ ID NO: 850 - RNA, 22 nt, Homo sapiens
uaagugaauguuggcuacugaa

SEQ ID NO: 851 - RNA, 22 nt, Homo sapiens
uaagugaauuucacuacugagu

SEQ ID NO: 852 - RNA, 22 nt, Homo sapiens
uaagugaauuugacagguaaug

SEQ ID NO: 853 - RNA, 20 nt, Homo sapiens
uaagugcauaggauauuucu

SEQ ID NO: 854 - RNA, 22 nt, Homo sapiens
uaagugcaugauuacaugcaua

SEQ ID NO: 855 - RNA, 22 nt, Homo sapiens
uaagugcuguguuguuaccuaa

SEQ ID NO: 856 - RNA, 22 nt, Homo sapiens
uaagugcuugacuuugauguuu

SEQ ID NO: 857 - RNA, 20 nt, Homo sapiens
uaagugcuugagacuucuga

SEQ ID NO: 858 - RNA, 20 nt, Homo sapiens
uaagugcuugaugaaugaac

SEQ ID NO: 859 - RNA, 18 nt, Homo sapiens
uaagugcuuuaaacacau

SEQ ID NO: 860 - RNA, 20 nt, Homo sapiens
uaagugcuuuauauugauua

SEQ ID NO: 861 - RNA, 22 nt, Homo sapiens
uaaguaaaugaaagguugauuu

SEQ ID NO: 862 - RNA, 22 nt, Homo sapiens
uaaguagaggaaucauuuugug

SEQ ID NO: 863 - RNA, 22 nt, Homo sapiens
uaaguaguauaagguuuuuuga

SEQ ID NO: 864 - RNA, 22 nt, Homo sapiens
uaaguagugugcauguauguau

SEQ ID NO: 865 - RNA, 22 nt, Homo sapiens
uaaguauuaugugcugcauuuu

SEQ ID NO: 866 - RNA, 23 nt, Homo sapiens
uaagucacacagauuaauuuauu

SEQ ID NO: 867 - RNA, 22 nt, Homo sapiens
uaagucacuccagguuaaagug

SEQ ID NO: 868 - RNA, 22 nt, Homo sapiens
uaacuaaagagaagucaauguc

SEQ ID NO: 869 - RNA, 22 nt, Homo sapiens
uaacuagaaaggagacaguugc

SEQ ID NO: 870 - RNA, 22 nt, Homo sapiens
uaagacacuuaaaauguuacau

SEQ ID NO: 871 - RNA, 22 nt, Homo sapiens
uaagcagugcaagaauggaaua

SEQ ID NO: 872 - RNA, 21 nt, Homo sapiens
uaagcuaaacauucaguuaac

SEQ ID NO: 873 - RNA, 22 nt, Homo sapiens
uaagcuauagugaauaaauugc

SEQ ID NO: 874 - RNA, 22 nt, Homo sapiens
uaaggaacucugauaucuggaa

SEQ ID NO: 875 - RNA, 22 nt, Homo sapiens
uaagguccuuaaauguguaacc

SEQ ID NO: 876 - RNA, 22 nt, Homo sapiens
uaagugaaggaaguguguuuac

SEQ ID NO: 877 - RNA, 22 nt, Homo sapiens
uacaaagcuuucugcaaaucau

SEQ ID NO: 878 - RNA, 22 nt, Homo sapiens
uacaaagugggaaacgaagguu

SEQ ID NO: 879 - RNA, 22 nt, Homo sapiens
uacaagcacaggcagcaggcug

SEQ ID NO: 880 - RNA, 22 nt, Homo sapiens
uacaagcaggaaaugguauaug

SEQ ID NO: 881 - RNA, 22 nt, Homo sapiens
uacaaguggguuugugcaggag

SEQ ID NO: 882 - RNA, 22 nt, Homo sapiens
uacaauagugacaaaucagcau

SEQ ID NO: 883 - RNA, 22 nt, Homo sapiens
uaauucacauaaagcacuuaga

SEQ ID NO: 884 - RNA, 22 nt, Homo sapiens
uaaugcacauuuauuuuaccuu

SEQ ID NO: 885 - RNA, 22 nt, Homo sapiens
uaaugcacucgaaucauggaau

SEQ ID NO: 886 - RNA, 22 nt, Homo sapiens
uaaugcacuuuccuccaaggcu

SEQ ID NO: 887 - RNA, 22 nt, Homo sapiens
uaaugcuaucugggccaggggu

SEQ ID NO: 888 - RNA, 22 nt, Homo sapiens
uaaugugaauagugcuguaaug

SEQ ID NO: 889 - RNA, 21 nt, Homo sapiens
uacaaugcacaggagagccuc

SEQ ID NO: 890 - RNA, 22 nt, Homo sapiens
uacacagucaaaaauuuccagg

SEQ ID NO: 891 - RNA, 22 nt, Homo sapiens
uaccaaguauuuucacaugaac

SEQ ID NO: 892 - RNA, 22 nt, Homo sapiens
uaccacccuuuuuccagaagcc

SEQ ID NO: 893 - RNA, 22 nt, Homo sapiens
uaccacugccgagaaaacagau

SEQ ID NO: 894 - RNA, 22 nt, Homo sapiens
uaccagcauuucucuuuaagua

SEQ ID NO: 895 - RNA, 19 nt, Homo sapiens
uacccagaagcagcauugu

SEQ ID NO: 896 - RNA, 22 nt, Homo sapiens
uacagccacauaauguaugauu

SEQ ID NO: 897 - RNA, 22 nt, Homo sapiens
uacaguagaaugucuuucaaaa

SEQ ID NO: 898 - RNA, 22 nt, Homo sapiens
uacagucacauuccugaccaua

SEQ ID NO: 899 - RNA, 22 nt, Homo sapiens
uacagucauaaugccuagugac

SEQ ID NO: 900 - RNA, 22 nt, Homo sapiens
uacauacuucacagacuuuaaa

SEQ ID NO: 901 - RNA, 19 nt, Homo sapiens
uacauaguauuuaguggca

SEQ ID NO: 902 - RNA, 22 nt, Homo sapiens
uacaugcaugggcaugugugca

SEQ ID NO: 903 - RNA, 22 nt, Homo sapiens
uacauugucauauucucucucu

SEQ ID NO: 904 - RNA, 16 nt, Homo sapiens
uacauuuguuacaugg

SEQ ID NO: 905 - RNA, 22 nt, Homo sapiens
uaguauguuuauagcauugagu

SEQ ID NO: 906 - RNA, 22 nt, Homo sapiens
uagucacacacucaacuuuuca

SEQ ID NO: 907 - RNA, 22 nt, Homo sapiens
uagugaauguuggcuauuaaua

SEQ ID NO: 908 - RNA, 22 nt, Homo sapiens
uaggucaguuuuggcuuggcuu

SEQ ID NO: 909 - RNA, 22 nt, Homo sapiens
uaggugaaugcuggaagaaaug

SEQ ID NO: 910 - RNA, 22 nt, Homo sapiens
uaguaaacauaguucuuuugcu

SEQ ID NO: 911 - RNA, 22 nt, Homo sapiens
uaguaguuuuguguauaauaau

SEQ ID NO: 912 - RNA, 22 nt, Homo sapiens
uagcugagacuacaguaggugc

SEQ ID NO: 913 - RNA, 22 nt, Homo sapiens
uagcuggaauuacuugcaccug

SEQ ID NO: 914 - RNA, 22 nt, Homo sapiens
uagcuggaguuuuuguuauagg

SEQ ID NO: 915 - RNA, 22 nt, Homo sapiens
uaggaaguuucuugauuacuua

SEQ ID NO: 916 - RNA, 22 nt, Homo sapiens
uaggcagccagcuguggauuga

SEQ ID NO: 917 - RNA, 19 nt, Homo sapiens
uagggcacgaggcagaguc

SEQ ID NO: 918 - RNA, 22 nt, Homo sapiens
uagccucacaaagugcuuaaga

SEQ ID NO: 919 - RNA, 22 nt, Homo sapiens
uagaaagcaugaccuucagaua

SEQ ID NO: 920 - RNA, 22 nt, Homo sapiens
uagaacauuccaggugauguug

SEQ ID NO: 921 - RNA, 22 nt, Homo sapiens
uacgccuguaauaucagcauuu

SEQ ID NO: 922 - RNA, 22 nt, Homo sapiens
uacuagaaccuuauucagagug

SEQ ID NO: 923 - RNA, 22 nt, Homo sapiens
uacucaauugcagucaccuggc

SEQ ID NO: 924 - RNA, 22 nt, Homo sapiens
uacucuuuagcuccuuaaggaa

SEQ ID NO: 925 - RNA, 22 nt, Homo sapiens
uacugagagaggaauauugaaa

SEQ ID NO: 926 - RNA, 19 nt, Homo sapiens
uacuggcucgggaauuuuc

SEQ ID NO: 927 - RNA, 22 nt, Homo sapiens
uacugguuuuauauauuucucc

SEQ ID NO: 928 - RNA, 22 nt, Homo sapiens
uacuguacugcaguucugcaaa

SEQ ID NO: 929 - RNA, 18 nt, Homo sapiens
uagaauauaggucauucu

SEQ ID NO: 930 - RNA, 22 nt, Homo sapiens
uagaauggaaggcauguuugcc

SEQ ID NO: 931 - RNA, 22 nt, Homo sapiens
uagaauggaagguugagaagaa

SEQ ID NO: 932 - RNA, 22 nt, Homo sapiens
uagaauguaaauuccaagggca

SEQ ID NO: 933 - RNA, 22 nt, Homo sapiens
uagaaugucagcuucuugaggg

SEQ ID NO: 934 - RNA, 22 nt, Homo sapiens
uagacaacugaaacacugugca

SEQ ID NO: 935 - RNA, 22 nt, Homo sapiens
uagacacuagauaugugacuga

SEQ ID NO: 936 - RNA, 22 nt, Homo sapiens
uagacacugcauauuuuuuuaa

SEQ ID NO: 937 - RNA, 21 nt, Homo sapiens
uagagagcaauaccuccagag

SEQ ID NO: 938 - RNA, 22 nt, Homo sapiens
uagagcacauuaucauuuccaa

SEQ ID NO: 939 - RNA, 22 nt, Homo sapiens
uagagcucaucuucuuuaaacu

SEQ ID NO: 940 - RNA, 22 nt, Homo sapiens
uagagguagagugacuucccca

SEQ ID NO: 941 - RNA, 22 nt, Homo sapiens
uagagguaggucuucgagucuc

SEQ ID NO: 942 - RNA, 22 nt, Homo sapiens
uagagguagguguaugaacuag

SEQ ID NO: 943 - RNA, 22 nt, Homo sapiens
uagagguauaccaaaaaggcau

SEQ ID NO: 944 - RNA, 22 nt, Homo sapiens
uagagguauguauaguauucuu

SEQ ID NO: 945 - RNA, 22 nt, Homo sapiens
uagagguauuaacaguagaaga

SEQ ID NO: 946 - RNA, 22 nt, Homo sapiens
uagaucauauacuugccaugac

SEQ ID NO: 947 - RNA, 22 nt, Homo sapiens
uagauuauuggcugauuugauc

SEQ ID NO: 948 - RNA, 21 nt, Homo sapiens
uagcaaauugcuauuaaggca

SEQ ID NO: 949 - RNA, 22 nt, Homo sapiens
uagcaacauucagcucagguac

SEQ ID NO: 950 - RNA, 22 nt, Homo sapiens
uagcaagaugaauuugugcaaa

SEQ ID NO: 951 - RNA, 22 nt, Homo sapiens
uagcacaucuucuuggccugca

SEQ ID NO: 952 - RNA, 22 nt, Homo sapiens
uagcaccaaacauauacucagu

SEQ ID NO: 953 - RNA, 22 nt, Homo sapiens
uagcaccucuuuggccuuucgu

SEQ ID NO: 954 - RNA, 22 nt, Homo sapiens
uagcaccugugcacaccaggca

SEQ ID NO: 955 - RNA, 22 nt, Homo sapiens
uagcaccuuagcauuucuagug

SEQ ID NO: 956 - RNA, 22 nt, Homo sapiens
uagcagaauauaccucuuacuu

SEQ ID NO: 957 - RNA, 22 nt, Homo sapiens
uagcagcaccccacucuacugg

SEQ ID NO: 958 - RNA, 22 nt, Homo sapiens
uagcagcauaaauggacuaaga

SEQ ID NO: 959 - RNA, 22 nt, Homo sapiens
uagcagguguuccacaaauauu

SEQ ID NO: 960 - RNA, 22 nt, Homo sapiens
uagcaguaaagaaugugauguu

SEQ ID NO: 961 - RNA, 22 nt, Homo sapiens
uagcaguaagaaacugacauug

SEQ ID NO: 962 - RNA, 22 nt, Homo sapiens
uagcaguaccccaguauccugg

SEQ ID NO: 963 - RNA, 22 nt, Homo sapiens
uagcaguagacagacuuuggcu

SEQ ID NO: 964 - RNA, 22 nt, Homo sapiens
uagcaguauacguacugggucc

SEQ ID NO: 965 - RNA, 22 nt, Homo sapiens
uagcaguauaugagagcuauug

SEQ ID NO: 966 - RNA, 22 nt, Homo sapiens
uagcaguaucccaccaucuggu

SEQ ID NO: 967 - RNA, 22 nt, Homo sapiens
uagcaguauggagcgaggccca

SEQ ID NO: 968 - RNA, 22 nt, Homo sapiens
uagcaguauugaaagaugaggg

SEQ ID NO: 969 - RNA, 22 nt, Homo sapiens
uagcaucagauuccauauucua

SEQ ID NO: 970 - RNA, 22 nt, Homo sapiens
uauuucaguugcguuucccgag

SEQ ID NO: 971 - RNA, 22 nt, Homo sapiens
uauuucaguugugcagguaguu

SEQ ID NO: 972 - RNA, 22 nt, Homo sapiens
uauuugauugacuuuagcagga

SEQ ID NO: 973 - RNA, 22 nt, Homo sapiens
uauuuguccccuccaaaaguca

SEQ ID NO: 974 - RNA, 22 nt, Homo sapiens
uauugauuaauugugauuaggc

SEQ ID NO: 975 - RNA, 22 nt, Homo sapiens
uauugcacaugaggagacauug

SEQ ID NO: 976 - RNA, 22 nt, Homo sapiens
uauugcacgccagccugagcaa

SEQ ID NO: 977 - RNA, 23 nt, Homo sapiens
uauugcacuaugguaacccuuuu

SEQ ID NO: 978 - RNA, 22 nt, Homo sapiens
uauugcacuccagccuuggcaa

SEQ ID NO: 979 - RNA, 20 nt, Homo sapiens
uauugcacuccagucugggc

SEQ ID NO: 980 - RNA, 22 nt, Homo sapiens
uauugcacuccucaugcauuug

SEQ ID NO: 981 - RNA, 22 nt, Homo sapiens
uauugcacuuuuccauaggagu

SEQ ID NO: 982 - RNA, 22 nt, Homo sapiens
uauugcagaaugugaguuggca

SEQ ID NO: 983 - RNA, 22 nt, Homo sapiens
uauugcagauacccaggaaguu

SEQ ID NO: 984 - RNA, 22 nt, Homo sapiens
uauugcagugagauccaucugg

SEQ ID NO: 985 - RNA, 22 nt, Homo sapiens
uauugccuugccuacuuuucca

SEQ ID NO: 986 - RNA, 22 nt, Homo sapiens
uauugcucaugcauuuaauuuc

SEQ ID NO: 987 - RNA, 22 nt, Homo sapiens
uauugcuugaggaaaugguaau

SEQ ID NO: 988 - RNA, 22 nt, Homo sapiens
uauuguacauguuauagauuuu

SEQ ID NO: 989 - RNA, 18 nt, Homo sapiens
uauuccucuuccucuauc

SEQ ID NO: 990 - RNA, 22 nt, Homo sapiens
uauuccuuuugcauuuccacau

SEQ ID NO: 991 - RNA, 22 nt, Homo sapiens
uauugaacgugggauauugaag

SEQ ID NO: 992 - RNA, 22 nt, Homo sapiens
uauugaauuugagcugucucuu

SEQ ID NO: 993 - RNA, 20 nt, Homo sapiens
uauucacucuccagucuugc

SEQ ID NO: 994 - RNA, 22 nt, Homo sapiens
uauuccacaauaugauuuuuaa

SEQ ID NO: 995 - RNA, 22 nt, Homo sapiens
uauuccauuugugaaaggaagu

SEQ ID NO: 996 - RNA, 22 nt, Homo sapiens
uauuacauccauaggcucugcu

SEQ ID NO: 997 - RNA, 22 nt, Homo sapiens
uauggcaaugcauaggaaggaa

SEQ ID NO: 998 - RNA, 22 nt, Homo sapiens
uauggcacuaguacuggaaagc

SEQ ID NO: 999 - RNA, 22 nt, Homo sapiens
uauuacuugucugugucucaau

SEQ ID NO: 1000 - RNA, 22 nt, Homo sapiens
uauuagugccuaagucuuaggg

SEQ ID NO: 1001 - RNA, 22 nt, Homo sapiens
uauuaguuuucuguggauuaca

SEQ ID NO: 1002 - RNA, 22 nt, Homo sapiens
ucaaaguaaagccucaggaugg

SEQ ID NO: 1003 - RNA, 22 nt, Homo sapiens
ucaaagugacaaaguugcagca

SEQ ID NO: 1004 - RNA, 22 nt, Homo sapiens
ucaaagugagcuccuucucacu

SEQ ID NO: 1005 - RNA, 22 nt, Homo sapiens
ucaaaugcacguagagaaaaua

SEQ ID NO: 1006 - RNA, 17 nt, Homo sapiens
ucaaaugcucccaguga

SEQ ID NO: 1007 - RNA, 22 nt, Homo sapiens
ucaaaugcucuuugcagagagg

SEQ ID NO: 1008 - RNA, 22 nt, Homo sapiens
ucaaaugcuguauuguaguaau

SEQ ID NO: 1009 - RNA, 22 nt, Homo sapiens
ucaaaugguccacgugaacauu

SEQ ID NO: 1010 - RNA, 22 nt, Homo sapiens
ucaaauuccaagucuagguagg

SEQ ID NO: 1011 - RNA, 20 nt, Homo sapiens
ucaaauucuuggccuccagc

SEQ ID NO: 1012 - RNA, 22 nt, Homo sapiens
ucaacaggucaauugcauagaa

SEQ ID NO: 1013 - RNA, 22 nt, Homo sapiens
ucaacagugggcacuguaaaug

SEQ ID NO: 1014 - RNA, 22 nt, Homo sapiens
ucaacauugcugucaggcaucu

SEQ ID NO: 1015 - RNA, 22 nt, Homo sapiens
ucaagcaauucuccucucagcc

SEQ ID NO: 1016 - RNA, 22 nt, Homo sapiens
ucaagcaauucuccugccucag

SEQ ID NO: 1017 - RNA, 22 nt, Homo sapiens
ucaagcaauucugcugccucag

SEQ ID NO: 1018 - RNA, 20 nt, Homo sapiens
ucaaggcacgaauaaaaguu

SEQ ID NO: 1019 - RNA, 18 nt, Homo sapiens
ucacaaccacagugcugu

SEQ ID NO: 1020 - RNA, 20 nt, Homo sapiens
ucacaagccaagaucacguc

SEQ ID NO: 1021 - RNA, 22 nt, Homo sapiens
ucacaaguguauagacaugucc

SEQ ID NO: 1022 - RNA, 21 nt, Homo sapiens
ucacaaugaacagcagcagaa

SEQ ID NO: 1023 - RNA, 22 nt, Homo sapiens
ucacacgugaacucaucacaga

SEQ ID NO: 1024 - RNA, 22 nt, Homo sapiens
ucacacugaauuugaagcaaug

SEQ ID NO: 1025 - RNA, 19 nt, Homo sapiens
ucacacuguggcuucuuua

SEQ ID NO: 1026 - RNA, 22 nt, Homo sapiens
ucacacuguuuugauuauuaua

SEQ ID NO: 1027 - RNA, 22 nt, Homo sapiens
ucacaggguguuauuagaauua

SEQ ID NO: 1028 - RNA, 18 nt, Homo sapiens
ucacagguaaaguugaca

SEQ ID NO: 1029 - RNA, 22 nt, Homo sapiens
ucacaguccuguuuaggagagg

SEQ ID NO: 1030 - RNA, 22 nt, Homo sapiens
ucacagugcaggaucaguuaau

SEQ ID NO: 1031 - RNA, 23 nt, Homo sapiens
ucacaguggcugcuuaauuguga

SEQ ID NO: 1032 - RNA, 22 nt, Homo sapiens
ucacaguucagcauggcugagg

SEQ ID NO: 1033 - RNA, 22 nt, Homo sapiens
ucacaugaagauuuuaguauac

SEQ ID NO: 1034 - RNA, 22 nt, Homo sapiens
ucacaugggugcaauauaauca

SEQ ID NO: 1035 - RNA, 22 nt, Homo sapiens
ucacaugugcguuuuggcaugu

SEQ ID NO: 1036 - RNA, 22 nt, Homo sapiens
ucacauuguacaaacagguaag

SEQ ID NO: 1037 - RNA, 22 nt, Homo sapiens
ucacauuguuauguaaauguuu

SEQ ID NO: 1038 - RNA, 22 nt, Homo sapiens
uaugacauaguccuuaacccuc

SEQ ID NO: 1039 - RNA, 22 nt, Homo sapiens
uaugaaagcuacuucucacaau

SEQ ID NO: 1040 - RNA, 22 nt, Homo sapiens
uaugcacacacguguuuaugug

SEQ ID NO: 1041 - RNA, 22 nt, Homo sapiens
uaugcacacguguccaugugca

SEQ ID NO: 1042 - RNA, 22 nt, Homo sapiens
uaugcacacucucccaggaggg

SEQ ID NO: 1043 - RNA, 22 nt, Homo sapiens
uaugcacaugcaugcuugaaua

SEQ ID NO: 1044 - RNA, 22 nt, Homo sapiens
uaugcacaugugccugggugug

SEQ ID NO: 1045 - RNA, 22 nt, Homo sapiens
uaugcagacauuguuccaacca

SEQ ID NO: 1046 - RNA, 22 nt, Homo sapiens
uaucccaauguaauaucacaaa

SEQ ID NO: 1047 - RNA, 23 nt, Homo sapiens
uaucucaaugcacagagaggaaa

SEQ ID NO: 1048 - RNA, 22 nt, Homo sapiens
uaucucauccuccuugauccca

SEQ ID NO: 1049 - RNA, 22 nt, Homo sapiens
uaucaacaggguggccagugua

SEQ ID NO: 1050 - RNA, 22 nt, Homo sapiens
uaucaagaugacaaacuuugcu

SEQ ID NO: 1051 - RNA, 22 nt, Homo sapiens
uaucucuguggguagugcugaa

SEQ ID NO: 1052 - RNA, 19 nt, Homo sapiens
uauguaguuuucucaauau

SEQ ID NO: 1053 - RNA, 22 nt, Homo sapiens
uaugucaugggguuuuugagau

SEQ ID NO: 1054 - RNA, 22 nt, Homo sapiens
uaugucuauuauguagcaggaa

SEQ ID NO: 1055 - RNA, 23 nt, Homo sapiens
uaugucuauucuaaugccagcac

SEQ ID NO: 1056 - RNA, 22 nt, Homo sapiens
uaugucuggaguuacugagcug

SEQ ID NO: 1057 - RNA, 22 nt, Homo sapiens
uaugucuucuuuagagaaaugu

SEQ ID NO: 1058 - RNA, 22 nt, Homo sapiens
uaugucuuuugcuugcaaauag

SEQ ID NO: 1059 - RNA, 22 nt, Homo sapiens
uaugugcaaauuaauugcuaga

SEQ ID NO: 1060 - RNA, 22 nt, Homo sapiens
uaugugcacaugcccuggugac

SEQ ID NO: 1061 - RNA, 22 nt, Homo sapiens
uaugccuuuuggcucaagaaac

SEQ ID NO: 1062 - RNA, 19 nt, Homo sapiens
uaugcuauuuauuagaagu

SEQ ID NO: 1063 - RNA, 22 nt, Homo sapiens
uaugcuuauaaacauuugucag

SEQ ID NO: 1064 - RNA, 22 nt, Homo sapiens
uaugcuuauugucucauccacu

SEQ ID NO: 1065 - RNA, 22 nt, Homo sapiens
uauggauuugccuauucuguau

SEQ ID NO: 1066 - RNA, 22 nt, Homo sapiens
uauggauuuucagauucuuauc

SEQ ID NO: 1067 - RNA, 22 nt, Homo sapiens
uauggauuuuuuugacaagagc

SEQ ID NO: 1068 - RNA, 22 nt, Homo sapiens
uaucacaaacuuagcaguuuaa

SEQ ID NO: 1069 - RNA, 22 nt, Homo sapiens
uaucacagaggguauccuagag

SEQ ID NO: 1070 - RNA, 22 nt, Homo sapiens
uaucacagcauugucuauaaua

SEQ ID NO: 1071 - RNA, 22 nt, Homo sapiens
uaucacaggucaggaaccuugu

SEQ ID NO: 1072 - RNA, 22 nt, Homo sapiens
uaucacaggucaggaaucuugc

SEQ ID NO: 1073 - RNA, 22 nt, Homo sapiens
uaucacagguggacugcacacc

SEQ ID NO: 1074 - RNA, 21 nt, Homo sapiens
uaucacaguagaauaggaucu

SEQ ID NO: 1075 - RNA, 22 nt, Homo sapiens
uaucacagugcuggaguauucc

SEQ ID NO: 1076 - RNA, 20 nt, Homo sapiens
uaucacaguucaggaacucu

SEQ ID NO: 1077 - RNA, 22 nt, Homo sapiens
uaucacaguugcauauuuaagg

SEQ ID NO: 1078 - RNA, 22 nt, Homo sapiens
uaucacuguuguuuguuuaagg

SEQ ID NO: 1079 - RNA, 22 nt, Homo sapiens
uaucacuuugauaguuuaaaug

SEQ ID NO: 1080 - RNA, 21 nt, Homo sapiens
uaucagagacauugagaggca

SEQ ID NO: 1081 - RNA, 22 nt, Homo sapiens
uaucagagcugucagccuaccu

SEQ ID NO: 1082 - RNA, 22 nt, Homo sapiens
uaucagcagagucauacuucaa

SEQ ID NO: 1083 - RNA, 22 nt, Homo sapiens
uaucaguauggauucauggauu

SEQ ID NO: 1084 - RNA, 22 nt, Homo sapiens
uaucauggggacugcagccuag

SEQ ID NO: 1085 - RNA, 22 nt, Homo sapiens
uaucaugucuguguguaccuag

SEQ ID NO: 1086 - RNA, 22 nt, Homo sapiens
uaucauugccucaaucuguauu

SEQ ID NO: 1087 - RNA, 22 nt, Homo sapiens
uauacagcaaguuacugugcug

SEQ ID NO: 1088 - RNA, 22 nt, Homo sapiens
uauacugucuuuguaugccuag

SEQ ID NO: 1089 - RNA, 21 nt, Homo sapiens
uauagcagcacgauuuauaau

SEQ ID NO: 1090 - RNA, 21 nt, Homo sapiens
uauagcagcacgauuuauagu

SEQ ID NO: 1091 - RNA, 22 nt, Homo sapiens
uauagcagccugaacaaaguaa

SEQ ID NO: 1092 - RNA, 22 nt, Homo sapiens
uauagcagugaguauugacuaa

SEQ ID NO: 1093 - RNA, 22 nt, Homo sapiens
uauagcaguguaagaaucgagu

SEQ ID NO: 1094 - RNA, 22 nt, Homo sapiens
uauagcuaugggauguauuugc

SEQ ID NO: 1095 - RNA, 22 nt, Homo sapiens
uauaacaaugcaagaauggccu

SEQ ID NO: 1096 - RNA, 20 nt, Homo sapiens
uauaacaguuuggacccagu

SEQ ID NO: 1097 - RNA, 22 nt, Homo sapiens
uauaagacgagcaaaaagcuug

SEQ ID NO: 1098 - RNA, 22 nt, Homo sapiens
uaguuauggaguaauuuuaagc

SEQ ID NO: 1099 - RNA, 22 nt, Homo sapiens
uaguucauuuuucuugcuuaga

SEQ ID NO: 1100 - RNA, 22 nt, Homo sapiens
uauauguuuucauaaggcuaga

SEQ ID NO: 1101 - RNA, 22 nt, Homo sapiens
ucacugugagaguuuauccugu

SEQ ID NO: 1102 - RNA, 22 nt, Homo sapiens
ucacugugguuuugaugugcau

SEQ ID NO: 1103 - RNA, 22 nt, Homo sapiens
ucacuguguauguauaugcagg

SEQ ID NO: 1104 - RNA, 22 nt, Homo sapiens
ucacugugugucucuguaucug

SEQ ID NO: 1105 - RNA, 18 nt, Homo sapiens
ucacugugugucuugggu

SEQ ID NO: 1106 - RNA, 22 nt, Homo sapiens
ucacuguugaugggcaugcagg

SEQ ID NO: 1107 - RNA, 22 nt, Homo sapiens
ucacuuugacggccaacuucua

SEQ ID NO: 1108 - RNA, 22 nt, Homo sapiens
ucagaaccuccuagcaguguuc

SEQ ID NO: 1109 - RNA, 22 nt, Homo sapiens
ucagaaccucugauuuauacuu

SEQ ID NO: 1110 - RNA, 22 nt, Homo sapiens
ucagaacugauacuagaacuuu

SEQ ID NO: 1111 - RNA, 22 nt, Homo sapiens
ucagacacugagcaaacgacua

SEQ ID NO: 1112 - RNA, 22 nt, Homo sapiens
ucagacacugcccuccaccugu

SEQ ID NO: 1113 - RNA, 22 nt, Homo sapiens
ucagacacuguggccuuuggac

SEQ ID NO: 1114 - RNA, 22 nt, Homo sapiens
ucagaccauuucauuacagacu

SEQ ID NO: 1115 - RNA, 22 nt, Homo sapiens
ucagaguagaaacacuuccaua

SEQ ID NO: 1116 - RNA, 22 nt, Homo sapiens
ucagaguagagcgacuucuccu

SEQ ID NO: 1117 - RNA, 22 nt, Homo sapiens
ucagaguagcugucugaggugc

SEQ ID NO: 1118 - RNA, 22 nt, Homo sapiens
ucagauacuggugacaugaaug

SEQ ID NO: 1119 - RNA, 22 nt, Homo sapiens
ucagcagugugaaaacaaacua

SEQ ID NO: 1120 - RNA, 22 nt, Homo sapiens
ucagcagugugaaaauggacua

SEQ ID NO: 1121 - RNA, 20 nt, Homo sapiens
ucacuggagcucauuugauu

SEQ ID NO: 1122 - RNA, 20 nt, Homo sapiens
ucacugugaacuucuugagg

SEQ ID NO: 1123 - RNA, 18 nt, Homo sapiens
ucacggggagcagcagcc

SEQ ID NO: 1124 - RNA, 22 nt, Homo sapiens
ucacuaaagaaaauggcaugga

SEQ ID NO: 1125 - RNA, 18 nt, Homo sapiens
ucacuagacacugaaucu

SEQ ID NO: 1126 - RNA, 23 nt, Homo sapiens
ucacuagaguccuggaguuugag

SEQ ID NO: 1127 - RNA, 22 nt, Homo sapiens
ucacuagaucaagggagagaaa

SEQ ID NO: 1128 - RNA, 22 nt, Homo sapiens
ucacuagggagaaacugaggcu

SEQ ID NO: 1129 - RNA, 22 nt, Homo sapiens
ucacucagaccuggugauaugc

SEQ ID NO: 1130 - RNA, 22 nt, Homo sapiens
ucacugaaaccacugccuccug

SEQ ID NO: 1131 - RNA, 22 nt, Homo sapiens
ucacugagaaugauguuucuga

SEQ ID NO: 1132 - RNA, 21 nt, Homo sapiens
ucacugagcaucaugguuuca

SEQ ID NO: 1133 - RNA, 22 nt, Homo sapiens
ucacugaggucugagcuuuaug

SEQ ID NO: 1134 - RNA, 22 nt, Homo sapiens
ucacugcgaccucugccucccg

SEQ ID NO: 1135 - RNA, 22 nt, Homo sapiens
uccaguuguuauuuuuauaaag

SEQ ID NO: 1136 - RNA, 22 nt, Homo sapiens
uccaguuuggaggcuugaugug

SEQ ID NO: 1137 - RNA, 18 nt, Homo sapiens
uccaguuuucccagcauc

SEQ ID NO: 1138 - RNA, 20 nt, Homo sapiens
uccaguuuuggagacauucu

SEQ ID NO: 1139 - RNA, 22 nt, Homo sapiens
uccaguuuuguuaacauauggu

SEQ ID NO: 1140 - RNA, 22 nt, Homo sapiens
ucauugcaaucucugccucccg

SEQ ID NO: 1141 - RNA, 22 nt, Homo sapiens
ucauugcauguuaauuaaacag

SEQ ID NO: 1142 - RNA, 22 nt, Homo sapiens
ucauuggaugucugaaaugauu

SEQ ID NO: 1143 - RNA, 19 nt, Homo sapiens
uccaccgcgugcaccucua

SEQ ID NO: 1144 - RNA, 22 nt, Homo sapiens
ucauucauucauccagcuugag

SEQ ID NO: 1145 - RNA, 22 nt, Homo sapiens
ucauucauuugcucacuccaca

SEQ ID NO: 1146 - RNA, 22 nt, Homo sapiens
ucaugucuuguuguauuuauuu

SEQ ID NO: 1147 - RNA, 22 nt, Homo sapiens
ucaugugaggauaacaauagug

SEQ ID NO: 1148 - RNA, 22 nt, Homo sapiens
ucauguguugcacugaggaccu

SEQ ID NO: 1149 - RNA, 23 nt, Homo sapiens
ucaugaggccauucaaauccauu

SEQ ID NO: 1150 - RNA, 22 nt, Homo sapiens
ucauggcacugaugagaguuuc

SEQ ID NO: 1151 - RNA, 22 nt, Homo sapiens
ucauggcauuguuaaggguuuu

SEQ ID NO: 1152 - RNA, 22 nt, Homo sapiens
ucauaucauuagaucuacugua

SEQ ID NO: 1153 - RNA, 22 nt, Homo sapiens
ucaucagaguuuacaagcucag

SEQ ID NO: 1154 - RNA, 22 nt, Homo sapiens
ucaucaggcucauucaagcuga

SEQ ID NO: 1155 - RNA, 21 nt, Homo sapiens
ucaucagucaaagacaauggu

SEQ ID NO: 1156 - RNA, 22 nt, Homo sapiens
ucaucagugcuugcaaauuauu

SEQ ID NO: 1157 - RNA, 20 nt, Homo sapiens
ucaucaguuggugcucgcug

SEQ ID NO: 1158 - RNA, 22 nt, Homo sapiens
ucaucuggcgaaugugaagagu

SEQ ID NO: 1159 - RNA, 22 nt, Homo sapiens
ucagguccuuacugugcucccu

SEQ ID NO: 1160 - RNA, 22 nt, Homo sapiens
ucaggcuuuucccagagugaug

SEQ ID NO: 1161 - RNA, 22 nt, Homo sapiens
ucagggacgcuugacacaagcc

SEQ ID NO: 1162 - RNA, 22 nt, Homo sapiens
ucagggacuuacaaaccagaag

SEQ ID NO: 1163 - RNA, 22 nt, Homo sapiens
ucaggguacuuguggccaaagu

SEQ ID NO: 1164 - RNA, 22 nt, Homo sapiens
ucaggcaccuuccucuuaucug

SEQ ID NO: 1165 - RNA, 22 nt, Homo sapiens
ucaggcacuaguaagaaaaagg

SEQ ID NO: 1166 - RNA, 22 nt, Homo sapiens
ucaggcaugcagcaaugcagug

SEQ ID NO: 1167 - RNA, 18 nt, Homo sapiens
ucagucacugccuggcuu

SEQ ID NO: 1168 - RNA, 22 nt, Homo sapiens
ucagucuuuuuuuggcaagcau

SEQ ID NO: 1169 - RNA, 23 nt, Homo sapiens
ucagugaaggaacaacuaaauag

SEQ ID NO: 1170 - RNA, 22 nt, Homo sapiens
ucagugccucaguuuuuaaaga

SEQ ID NO: 1171 - RNA, 22 nt, Homo sapiens
ucagugcuuuuuguugucauca

SEQ ID NO: 1172 - RNA, 22 nt, Homo sapiens
ucagugucugugauggagaggu

SEQ ID NO: 1173 - RNA, 22 nt, Homo sapiens
ucaguguuuggaaucucaauuu

SEQ ID NO: 1174 - RNA, 21 nt, Homo sapiens
ucaguuacugagagagaagug

SEQ ID NO: 1175 - RNA, 22 nt, Homo sapiens
ucaguaaaugcuguucucuuuu

SEQ ID NO: 1176 - RNA, 23 nt, Homo sapiens
ucaguacuccacuuucaauagug

SEQ ID NO: 1177 - RNA, 22 nt, Homo sapiens
ucaguagcauugcuuauacagu

SEQ ID NO: 1178 - RNA, 22 nt, Homo sapiens
ucauacaguaguccucacuugu

SEQ ID NO: 1179 - RNA, 22 nt, Homo sapiens
ucauaggucacuguaaccucgu

SEQ ID NO: 1180 - RNA, 22 nt, Homo sapiens
ucauaggucugagaagaaaaua

SEQ ID NO: 1181 - RNA, 22 nt, Homo sapiens
ucauaguagucacuuaauaaau

SEQ ID NO: 1182 - RNA, 19 nt, Homo sapiens
ucauagucuaagaugagaa

SEQ ID NO: 1183 - RNA, 22 nt, Homo sapiens
ucauagucuaagguucuuuugc

SEQ ID NO: 1184 - RNA, 22 nt, Homo sapiens
uccauugucuagauguaacaca

SEQ ID NO: 1185 - RNA, 18 nt, Homo sapiens
uccauuuguaugggaugg

SEQ ID NO: 1186 - RNA, 22 nt, Homo sapiens
uccaugugaaaaggucgugaua

SEQ ID NO: 1187 - RNA, 22 nt, Homo sapiens
uccaugugaaaucuaugaggac

SEQ ID NO: 1188 - RNA, 22 nt, Homo sapiens
ucccaguuuuucugaauaguca

SEQ ID NO: 1189 - RNA, 22 nt, Homo sapiens
ucccauguagcuaggauuacag

SEQ ID NO: 1190 - RNA, 17 nt, Homo sapiens
ucccauguuucuucuac

SEQ ID NO: 1191 - RNA, 22 nt, Homo sapiens
uccccgagcccaggcugugacu

SEQ ID NO: 1192 - RNA, 23 nt, Homo sapiens
uccccgggagcaccagcuuguug

SEQ ID NO: 1193 - RNA, 19 nt, Homo sapiens
uccccgggucuagugcagc

SEQ ID NO: 1194 - RNA, 18 nt, Homo sapiens
ucccucagaauuauagaa

SEQ ID NO: 1195 - RNA, 22 nt, Homo sapiens
ucccugaguaucuaauguguuu

SEQ ID NO: 1196 - RNA, 22 nt, Homo sapiens
uccuucaguccaguggguuuug

SEQ ID NO: 1197 - RNA, 22 nt, Homo sapiens
uccugagaauagaguugcaugu

SEQ ID NO: 1198 - RNA, 22 nt, Homo sapiens
uccugagacucacaggcucccc

SEQ ID NO: 1199 - RNA, 22 nt, Homo sapiens
uccugagacugaggagcuuugg

SEQ ID NO: 1200 - RNA, 21 nt, Homo sapiens
uccugagagaggaguaacucu

SEQ ID NO: 1201 - RNA, 22 nt, Homo sapiens
uccugagagcagacccucuaua

SEQ ID NO: 1202 - RNA, 20 nt, Homo sapiens
uccugagauucccaguucuc

SEQ ID NO: 1203 - RNA, 22 nt, Homo sapiens
ucgcugcgaccuccaccucccg

SEQ ID NO: 1204 - RNA, 23 nt, Homo sapiens
ucgcagcauucaauaccaggcag

SEQ ID NO: 1205 - RNA, 19 nt, Homo sapiens
ucgcgccauucuccugccu

SEQ ID NO: 1206 - RNA, 22 nt, Homo sapiens
ucgcgccauucuccugccucag

SEQ ID NO: 1207 - RNA, 22 nt, Homo sapiens
ucggcucagugcaagcucugcc

SEQ ID NO: 1208 - RNA, 23 nt, Homo sapiens
ucgguccccuuggcugcccucgg

SEQ ID NO: 1209 - RNA, 19 nt, Homo sapiens
ucuaaaucucuugauagac

SEQ ID NO: 1210 - RNA, 17 nt, Homo sapiens
ucuaauaauaugcauuu

SEQ ID NO: 1211 - RNA, 22 nt, Homo sapiens
ucuaauguaaccugcaaauauu

SEQ ID NO: 1212 - RNA, 22 nt, Homo sapiens
ucuacagccaguucaggaagaa

SEQ ID NO: 1213 - RNA, 22 nt, Homo sapiens
ucuagccuaugaagcuugucca

SEQ ID NO: 1214 - RNA, 22 nt, Homo sapiens
ucucaaccucccaaguagcugg

SEQ ID NO: 1215 - RNA, 22 nt, Homo sapiens
ucucaaguggucgcaguuagau

SEQ ID NO: 1216 - RNA, 22 nt, Homo sapiens
ucucacaccccucucauauacc

SEQ ID NO: 1217 - RNA, 22 nt, Homo sapiens
ucucacagaguugaacuuucuu

SEQ ID NO: 1218 - RNA, 22 nt, Homo sapiens
ucucacagaguugaauguuucu

SEQ ID NO: 1219 - RNA, 22 nt, Homo sapiens
ucucagugaauguggaaaaagc

SEQ ID NO: 1220 - RNA, 22 nt, Homo sapiens
ucucaguggcuuccucacuuuu

SEQ ID NO: 1221 - RNA, 22 nt, Homo sapiens
ucucaguguuaucuaucugccu

SEQ ID NO: 1222 - RNA, 20 nt, Homo sapiens
ucucauggagggaaagagca

SEQ ID NO: 1223 - RNA, 22 nt, Homo sapiens
ucucauggagucaggagcagaa

SEQ ID NO: 1224 - RNA, 20 nt, Homo sapiens
guccauuugcugccauugcu

SEQ ID NO: 1225 - RNA, 22 nt, Homo sapiens
gucauugcuuaaggguucaugc

SEQ ID NO: 1226 - RNA, 22 nt, Homo sapiens
gucauugguucuguuuauguga

SEQ ID NO: 1227 - RNA, 22 nt, Homo sapiens
guccaaauccaugggauguaca

SEQ ID NO: 1228 - RNA, 22 nt, Homo sapiens
guccuggagaagcguggaccgg

SEQ ID NO: 1229 - RNA, 20 nt, Homo sapiens
gucugucuccgaguagaauu

SEQ ID NO: 1230 - RNA, 22 nt, Homo sapiens
gucuggcuuaucucacuuacca

SEQ ID NO: 1231 - RNA, 22 nt, Homo sapiens
gucuuuguuuggucuguaucag

SEQ ID NO: 1232 - RNA, 22 nt, Homo sapiens
gugaaaagaugagcaccauaca

SEQ ID NO: 1233 - RNA, 22 nt, Homo sapiens
gucucacagcuagcugcuuuau

SEQ ID NO: 1234 - RNA, 18 nt, Homo sapiens
gucucacaugguggaagc

SEQ ID NO: 1235 - RNA, 22 nt, Homo sapiens
gucuggcacagggaaaguacaa

SEQ ID NO: 1236 - RNA, 22 nt, Homo sapiens
gugaaguuuuugugaggccuaa

SEQ ID NO: 1237 - RNA, 22 nt, Homo sapiens
gugaaguuuuuugcugagaguc

SEQ ID NO: 1238 - RNA, 22 nt, Homo sapiens
gugacagucaaagacaugacuu

SEQ ID NO: 1239 - RNA, 22 nt, Homo sapiens
gugacaguggagacuuacuuca

SEQ ID NO: 1240 - RNA, 22 nt, Homo sapiens
gugacauuauuucagcuacaug

SEQ ID NO: 1241 - RNA, 22 nt, Homo sapiens
gugacauuuuuacugaugagag

SEQ ID NO: 1242 - RNA, 22 nt, Homo sapiens
gugacugcauccauccaggcuu

SEQ ID NO: 1243 - RNA, 22 nt, Homo sapiens
gugacugggaguggugaagaua

SEQ ID NO: 1244 - RNA, 22 nt, Homo sapiens
gugagaacugugucuuauaaac

SEQ ID NO: 1245 - RNA, 22 nt, Homo sapiens
gugagaagaaaaauauggcugu

SEQ ID NO: 1246 - RNA, 18 nt, Homo sapiens
gugagaaugacuguucug

SEQ ID NO: 1247 - RNA, 16 nt, Homo sapiens
gugagagaugacaaac

SEQ ID NO: 1248 - RNA, 22 nt, Homo sapiens
gugagauacuagagauauagug

SEQ ID NO: 1249 - RNA, 22 nt, Homo sapiens
gugagauaucuagacuagggaa

SEQ ID NO: 1250 - RNA, 22 nt, Homo sapiens
gugauuauuaugcacugcaugc

SEQ ID NO: 1251 - RNA, 22 nt, Homo sapiens
gugcaaaucucugaguaucuuu

SEQ ID NO: 1252 - RNA, 22 nt, Homo sapiens
gugcaaauuccagcucaacucc

SEQ ID NO: 1253 - RNA, 22 nt, Homo sapiens
gugcaaugagaaggggcucugg

SEQ ID NO: 1254 - RNA, 22 nt, Homo sapiens
gugcacaaaucuuaaauguaca

SEQ ID NO: 1255 - RNA, 22 nt, Homo sapiens
gugcacaacaugcagguuuguu

SEQ ID NO: 1256 - RNA, 22 nt, Homo sapiens
gugcacaacaugcaguuuuguu

SEQ ID NO: 1257 - RNA, 22 nt, Homo sapiens
gugcacaacgugcaaguuuguu

SEQ ID NO: 1258 - RNA, 22 nt, Homo sapiens
gugcacaacgugcaggcuuguu

SEQ ID NO: 1259 - RNA, 22 nt, Homo sapiens
gugcacaacgugcagguuaguu

SEQ ID NO: 1260 - RNA, 22 nt, Homo sapiens
gugcacaacgugcagguuuguu

SEQ ID NO: 1261 - RNA, 22 nt, Homo sapiens
gugcacaacguguagguuuguu

SEQ ID NO: 1262 - RNA, 22 nt, Homo sapiens
gugcacaaucgugcauuccuug

SEQ ID NO: 1263 - RNA, 22 nt, Homo sapiens
gugcacaaugugcagguuuguu

SEQ ID NO: 1264 - RNA, 22 nt, Homo sapiens
gugcacauauggugcauaagug

SEQ ID NO: 1265 - RNA, 22 nt, Homo sapiens
gugaaagacagcauuaauggcu

SEQ ID NO: 1266 - RNA, 22 nt, Homo sapiens
gugaaagacauauaugguuuga

SEQ ID NO: 1267 - RNA, 22 nt, Homo sapiens
gugaaagauuaaaccagugugu

SEQ ID NO: 1268 - RNA, 22 nt, Homo sapiens
gugaacagaaccugggaucgaa

SEQ ID NO: 1269 - RNA, 22 nt, Homo sapiens
gugaggaaggaaaccugcuagc

SEQ ID NO: 1270 - RNA, 22 nt, Homo sapiens
gugaggcacugcugcuuuccag

SEQ ID NO: 1271 - RNA, 22 nt, Homo sapiens
gugagguacgugucaagaacca

SEQ ID NO: 1272 - RNA, 20 nt, Homo sapiens
gugagguagaggguuaccug

SEQ ID NO: 1273 - RNA, 17 nt, Homo sapiens
gugagguauccucaaaa

SEQ ID NO: 1274 - RNA, 22 nt, Homo sapiens
gugaggucguagucauaggcaa

SEQ ID NO: 1275 - RNA, 17 nt, Homo sapiens
gugagguggguaguauc

SEQ ID NO: 1276 - RNA, 22 nt, Homo sapiens
gugauagaucugggauucagaa

SEQ ID NO: 1277 - RNA, 22 nt, Homo sapiens
gugauauguuaggaucuaaguc

SEQ ID NO: 1278 - RNA, 22 nt, Homo sapiens
gugaucuguccuucauagccug

SEQ ID NO: 1279 - RNA, 22 nt, Homo sapiens
gugcuaggugcuaggaagauag

SEQ ID NO: 1280 - RNA, 22 nt, Homo sapiens
guggaaaacauaugcuuguuga

SEQ ID NO: 1281 - RNA, 22 nt, Homo sapiens
guggaaaaguaguugcgguuuu

SEQ ID NO: 1282 - RNA, 22 nt, Homo sapiens
guggaaaauuauugcuguuuuu

SEQ ID NO: 1283 - RNA, 22 nt, Homo sapiens
guggaagaaaucagguuauuug

SEQ ID NO: 1284 - RNA, 22 nt, Homo sapiens
guggaagaccagacuuuccaac

SEQ ID NO: 1285 - RNA, 20 nt, Homo sapiens
guggaagauaaguagccuga

SEQ ID NO: 1286 - RNA, 22 nt, Homo sapiens
guggaagauaguguguuaaugu

SEQ ID NO: 1287 - RNA, 22 nt, Homo sapiens
guggaagucuuugguauuggua

SEQ ID NO: 1288 - RNA, 22 nt, Homo sapiens
gugccuuuucugagcaaugagc

SEQ ID NO: 1289 - RNA, 22 nt, Homo sapiens
gugcacaucuguguuccagcua

SEQ ID NO: 1290 - RNA, 22 nt, Homo sapiens
gugcacaugguagguauugagu

SEQ ID NO: 1291 - RNA, 22 nt, Homo sapiens
gugcacauuguuuaugucuguu

SEQ ID NO: 1292 - RNA, 22 nt, Homo sapiens
gugcauaugcaugugcaugcac

SEQ ID NO: 1293 - RNA, 22 nt, Homo sapiens
gugccacugcaccuggccuaag

SEQ ID NO: 1294 - RNA, 22 nt, Homo sapiens
gugccacugcacuccggccugg

SEQ ID NO: 1295 - RNA, 22 nt, Homo sapiens
gugggcucguucguguuagaca

SEQ ID NO: 1296 - RNA, 22 nt, Homo sapiens
guggcaguuuuaaauaugaaaa

SEQ ID NO: 1297 - RNA, 22 nt, Homo sapiens
guggcgagaucauagcucauug

SEQ ID NO: 1298 - RNA, 22 nt, Homo sapiens
gugauuauccacgucuuuguga

SEQ ID NO: 1299 - RNA, 16 nt, Homo sapiens
gugcuguguuguuagg

SEQ ID NO: 1300 - RNA, 22 nt, Homo sapiens
guggaagugucuggggccaggg

SEQ ID NO: 1301 - RNA, 22 nt, Homo sapiens
guggaaugaaaacucucucaca

SEQ ID NO: 1302 - RNA, 22 nt, Homo sapiens
guggaaugauaucucauugugg

SEQ ID NO: 1303 - RNA, 22 nt, Homo sapiens
guggaaugcaguguugauucaa

SEQ ID NO: 1304 - RNA, 22 nt, Homo sapiens
guggaauggaaugauuguguau

SEQ ID NO: 1305 - RNA, 22 nt, Homo sapiens
guggacaugaauuuuggaggca

SEQ ID NO: 1306 - RNA, 22 nt, Homo sapiens
gugguguuugagcugccaggga

SEQ ID NO: 1307 - RNA, 22 nt, Homo sapiens
gugguuuucaacuccaccugca

SEQ ID NO: 1308 - RNA, 22 nt, Homo sapiens
gugguuuuuaaaguaccugugg

SEQ ID NO: 1309 - RNA, 22 nt, Homo sapiens
gugguuuuuuucugccuuauag

SEQ ID NO: 1310 - RNA, 22 nt, Homo sapiens
guguaaaacaauuagaggauuu

SEQ ID NO: 1311 - RNA, 22 nt, Homo sapiens
guguauauccuauuaguucugu

SEQ ID NO: 1312 - RNA, 22 nt, Homo sapiens
guguauguuucucccugucccu

SEQ ID NO: 1313 - RNA, 21 nt, Homo sapiens
gugucacagacaugacagaug

SEQ ID NO: 1314 - RNA, 22 nt, Homo sapiens
gugucaugagggggacaggaag

SEQ ID NO: 1315 - RNA, 22 nt, Homo sapiens
gugucccagugugcauacaggu

SEQ ID NO: 1316 - RNA, 22 nt, Homo sapiens
guguccucgaguacacaucagg

SEQ ID NO: 1317 - RNA, 22 nt, Homo sapiens
gugucucagcccagaccuauuu

SEQ ID NO: 1318 - RNA, 22 nt, Homo sapiens
gugucuccugccuucaugcagc

SEQ ID NO: 1319 - RNA, 22 nt, Homo sapiens
gugggaagcuggaacucccucc

SEQ ID NO: 1320 - RNA, 22 nt, Homo sapiens
gugugauuauuucaauugaugc

SEQ ID NO: 1321 - RNA, 22 nt, Homo sapiens
gugugauuguuaauuuuaggug

SEQ ID NO: 1322 - RNA, 22 nt, Homo sapiens
gugugcucaucacaugcaauag

SEQ ID NO: 1323 - RNA, 22 nt, Homo sapiens
guuauguaucuugauugggugg

SEQ ID NO: 1324 - RNA, 22 nt, Homo sapiens
guucaagugauagcugggauua

SEQ ID NO: 1325 - RNA, 21 nt, Homo sapiens
guucaagugauccuccugucu

SEQ ID NO: 1326 - RNA, 22 nt, Homo sapiens
guucaagugauucuacugccuc

SEQ ID NO: 1327 - RNA, 22 nt, Homo sapiens
guucaaguuuucucuugugggu

SEQ ID NO: 1328 - RNA, 20 nt, Homo sapiens
guucacaggcuuccuuucag

SEQ ID NO: 1329 - RNA, 22 nt, Homo sapiens
guucacagugguugccuuccag

SEQ ID NO: 1330 - RNA, 20 nt, Homo sapiens
guucauguaauuaguucagg

SEQ ID NO: 1331 - RNA, 22 nt, Homo sapiens
guuugccuuuuagauaggaaug

SEQ ID NO: 1332 - RNA, 17 nt, Homo sapiens
guuuggguacuggguaa

SEQ ID NO: 1333 - RNA, 22 nt, Homo sapiens
guugcucaggccggagugcagu

SEQ ID NO: 1334 - RNA, 22 nt, Homo sapiens
guugcucaggcuggagugcagu

SEQ ID NO: 1335 - RNA, 22 nt, Homo sapiens
guuggaauguauugcuacuucu

SEQ ID NO: 1336 - RNA, 22 nt, Homo sapiens
guuggcaaguggcugagcuggg

SEQ ID NO: 1337 - RNA, 22 nt, Homo sapiens
guucuggagauaaagccaaggu

SEQ ID NO: 1338 - RNA, 22 nt, Homo sapiens
guguucaaacccaggucugucu

SEQ ID NO: 1339 - RNA, 22 nt, Homo sapiens
guguucaaagcugauugagauu

SEQ ID NO: 1340 - RNA, 22 nt, Homo sapiens
guguucaaauucugacagagag

SEQ ID NO: 1341 - RNA, 22 nt, Homo sapiens
guuaagaaguguaacuuaaguu

SEQ ID NO: 1342 - RNA, 22 nt, Homo sapiens
uaaacugucuugcaguuacaug

SEQ ID NO: 1343 - RNA, 22 nt, Homo sapiens
uaaagccauugucaaguuugua

SEQ ID NO: 1344 - RNA, 22 nt, Homo sapiens
uaaagcgaggucuccuacaaga

SEQ ID NO: 1345 - RNA, 22 nt, Homo sapiens
uaaagcuaucacauuggugauu

SEQ ID NO: 1346 - RNA, 22 nt, Homo sapiens
uaaagcuuagauccaugguggc

SEQ ID NO: 1347 - RNA, 21 nt, Homo sapiens
uaaagcuuagcuauaguggcu

SEQ ID NO: 1348 - RNA, 22 nt, Homo sapiens
uaaagcuuggauuuaggcuaau

SEQ ID NO: 1349 - RNA, 22 nt, Homo sapiens
uaaagugaggauggcaguaggu

SEQ ID NO: 1350 - RNA, 22 nt, Homo sapiens
guuuuuggggucacuauuaccg

SEQ ID NO: 1351 - RNA, 21 nt, Homo sapiens
uaaaacuguaacuuuguccug

SEQ ID NO: 1352 - RNA, 22 nt, Homo sapiens
uaaaagucaucacaacuggagu

SEQ ID NO: 1353 - RNA, 22 nt, Homo sapiens
uaaaugcucuuuaaaagugcuu

SEQ ID NO: 1354 - RNA, 22 nt, Homo sapiens
uaaaugcuuaauugaaugugga

SEQ ID NO: 1355 - RNA, 22 nt, Homo sapiens
uaaauggauaaaugaauaccua

SEQ ID NO: 1356 - RNA, 22 nt, Homo sapiens
uaaauggauauugccaucuccu

SEQ ID NO: 1357 - RNA, 22 nt, Homo sapiens
uaaauugcauaaguacaaauga

SEQ ID NO: 1358 - RNA, 18 nt, Homo sapiens
uaaauugcuucaccugag

SEQ ID NO: 1359 - RNA, 21 nt, Homo sapiens
uaacagcuccacuccauucuc

SEQ ID NO: 1360 - RNA, 22 nt, Homo sapiens
uaacagcucuacagcugcucuu

SEQ ID NO: 1361 - RNA, 22 nt, Homo sapiens
uaacaggcaaggucacaccuug

SEQ ID NO: 1362 - RNA, 22 nt, Homo sapiens
uaacaguguauuccuuuggaca

SEQ ID NO: 1363 - RNA, 22 nt, Homo sapiens
uaacauagucauauacuugcuu

SEQ ID NO: 1364 - RNA, 22 nt, Homo sapiens
uaacauucacaugcugcaaaaa

SEQ ID NO: 1365 - RNA, 22 nt, Homo sapiens
uaacauuguugauuauacuaag

SEQ ID NO: 1366 - RNA, 22 nt, Homo sapiens
ggcucguguuuucuguccaguu

SEQ ID NO: 1367 - RNA, 22 nt, Homo sapiens
gggaagugugcagaguucucuu

SEQ ID NO: 1368 - RNA, 22 nt, Homo sapiens
gggaucaacuuauacuaaaauu

SEQ ID NO: 1369 - RNA, 22 nt, Homo sapiens
gggaauguagcaaaucugcaau

SEQ ID NO: 1370 - RNA, 22 nt, Homo sapiens
ggcuuggaggaaugugagggcu

SEQ ID NO: 1371 - RNA, 22 nt, Homo sapiens
gggaggucauuguucaaugcug

SEQ ID NO: 1372 - RNA, 22 nt, Homo sapiens
ggugagguaggaaaaguuagga

SEQ ID NO: 1373 - RNA, 22 nt, Homo sapiens
ggugcagcacaccaacauggca

SEQ ID NO: 1374 - RNA, 22 nt, Homo sapiens
gguggugguauuucagaaaaug

SEQ ID NO: 1375 - RNA, 19 nt, Homo sapiens
ggucacagggguuacaagg

SEQ ID NO: 1376 - RNA, 22 nt, Homo sapiens
ggucacauuggacuaucaaguu

SEQ ID NO: 1377 - RNA, 22 nt, Homo sapiens
ggguucaaaucuuggcucuuac

SEQ ID NO: 1378 - RNA, 22 nt, Homo sapiens
guaaaucucuguuuucauggac

SEQ ID NO: 1379 - RNA, 18 nt, Homo sapiens
guaaauguaucuauugcc

SEQ ID NO: 1380 - RNA, 22 nt, Homo sapiens
guaacacaugcugcucucuggu

SEQ ID NO: 1381 - RNA, 22 nt, Homo sapiens
guaacacucuaaagggaugcac

SEQ ID NO: 1382 - RNA, 20 nt, Homo sapiens
guaacagcacuuucccaaag

SEQ ID NO: 1383 - RNA, 22 nt, Homo sapiens
guaauaacuguggaaaaagguu

SEQ ID NO: 1384 - RNA, 22 nt, Homo sapiens
guaaucucaccuacuugggagg

SEQ ID NO: 1385 - RNA, 22 nt, Homo sapiens
guaaucucagcuacucaggagg

SEQ ID NO: 1386 - RNA, 22 nt, Homo sapiens
guaaucucagcuacucgggaga

SEQ ID NO: 1387 - RNA, 22 nt, Homo sapiens
guaaucucagcuacucgggagg

SEQ ID NO: 1388 - RNA, 22 nt, Homo sapiens
guaaucucagcuacuugggagc

SEQ ID NO: 1389 - RNA, 22 nt, Homo sapiens
guaaucucagcuacuugggagg

SEQ ID NO: 1390 - RNA, 22 nt, Homo sapiens
guaaucucagcuacuugggagu

SEQ ID NO: 1391 - RNA, 22 nt, Homo sapiens
guaaucucagcuucuugggagg

SEQ ID NO: 1392 - RNA, 22 nt, Homo sapiens
guacaagugcaguuucguuaca

SEQ ID NO: 1393 - RNA, 22 nt, Homo sapiens
guacacauacauauaugugugu

SEQ ID NO: 1394 - RNA, 22 nt, Homo sapiens
guacaguacugaaugaauguau

SEQ ID NO: 1395 - RNA, 22 nt, Homo sapiens
guacaguaguaaaagugaauga

SEQ ID NO: 1396 - RNA, 22 nt, Homo sapiens
guacaguauaguaauaggauuu

SEQ ID NO: 1397 - RNA, 22 nt, Homo sapiens
guacaguuuucaguguucacug

SEQ ID NO: 1398 - RNA, 22 nt, Homo sapiens
guaaacuuccccucaugaauga

SEQ ID NO: 1399 - RNA, 22 nt, Homo sapiens
guaaaguaaagcacaucaaggu

SEQ ID NO: 1400 - RNA, 22 nt, Homo sapiens
guaaauaccaguuucuggaaca

SEQ ID NO: 1401 - RNA, 22 nt, Homo sapiens
guagagguagacuuccuugucu

SEQ ID NO: 1402 - RNA, 22 nt, Homo sapiens
guagcagaacauguuccuugua

SEQ ID NO: 1403 - RNA, 22 nt, Homo sapiens
guagcagaauaucagauaauuu

SEQ ID NO: 1404 - RNA, 22 nt, Homo sapiens
guacaugcaugcaugggugugc

SEQ ID NO: 1405 - RNA, 22 nt, Homo sapiens
gucagucugucccugccuggcg

SEQ ID NO: 1406 - RNA, 22 nt, Homo sapiens
gucagugugauaucugcagggg

SEQ ID NO: 1407 - RNA, 22 nt, Homo sapiens
gucaucaggacgggucaucugc

SEQ ID NO: 1408 - RNA, 22 nt, Homo sapiens
gucaugucugcacauaguaaaa

SEQ ID NO: 1409 - RNA, 22 nt, Homo sapiens
gucauguuuaacuucuugagga

SEQ ID NO: 1410 - RNA, 18 nt, Homo sapiens
guauuccagccugaguga

SEQ ID NO: 1411 - RNA, 22 nt, Homo sapiens
gucacuggcugucuuguaugau

SEQ ID NO: 1412 - RNA, 22 nt, Homo sapiens
gucacugucuacuguaauagcc

SEQ ID NO: 1413 - RNA, 22 nt, Homo sapiens
gucacuguggagaagaaagugg

SEQ ID NO: 1414 - RNA, 22 nt, Homo sapiens
gucacuguuuccuauuauauuu

SEQ ID NO: 1415 - RNA, 22 nt, Homo sapiens
gucaggcaccgauacaguuuuu

SEQ ID NO: 1416 - RNA, 22 nt, Homo sapiens
guauuugauuauagcaugcuua

SEQ ID NO: 1417 - RNA, 22 nt, Homo sapiens
guauuuguugcagcagcacuau

SEQ ID NO: 1418 - RNA, 22 nt, Homo sapiens
gucacauugaugcccauggugg

SEQ ID NO: 1419 - RNA, 22 nt, Homo sapiens
guagugcaguuugagaaucagu

SEQ ID NO: 1420 - RNA, 22 nt, Homo sapiens
guauaguaguacaaaaguuuuu

SEQ ID NO: 1421 - RNA, 22 nt, Homo sapiens
guaucacacuuauugaccugca

SEQ ID NO: 1422 - RNA, 22 nt, Homo sapiens
guaugauacuguaacagugggu

SEQ ID NO: 1423 - RNA, 22 nt, Homo sapiens
guaugcacauauguguauguau

SEQ ID NO: 1424 - RNA, 22 nt, Homo sapiens
guauggaagucaguuuguuggc

SEQ ID NO: 1425 - RNA, 22 nt, Homo sapiens
guauggguuuuguuucuucugg

SEQ ID NO: 1426 - RNA, 22 nt, Homo sapiens
guaugucuugucuauggcugcu

SEQ ID NO: 1427 - RNA, 22 nt, Homo sapiens
guaugucuuuauagcagugugg

SEQ ID NO: 1428 - RNA, 22 nt, Homo sapiens
aaccuguaaccauaugaucagu

SEQ ID NO: 1429 - RNA, 22 nt, Homo sapiens
aacugguauuucccaugaauuu

SEQ ID NO: 1430 - RNA, 22 nt, Homo sapiens
aaauaguagcugaaugagggaa

SEQ ID NO: 1431 - RNA, 22 nt, Homo sapiens
aacugcuguuuggguacuggug

SEQ ID NO: 1432 - RNA, 22 nt, Homo sapiens
aacacuguuuccagucaugauc

SEQ ID NO: 1433 - RNA, 22 nt, Homo sapiens
aacagaauccucuuuuccuggg

SEQ ID NO: 1434 - RNA, 22 nt, Homo sapiens
aacaccauucucuguaacaaga

SEQ ID NO: 1435 - RNA, 22 nt, Homo sapiens
aacacggcccgcagagcaagcu

SEQ ID NO: 1436 - RNA, 22 nt, Homo sapiens
aacacuaucugccuuacaggga

SEQ ID NO: 1437 - RNA, 22 nt, Homo sapiens
aacagucaauugcugaugaccu

SEQ ID NO: 1438 - RNA, 22 nt, Homo sapiens
aacagugcauuccuguccauau

SEQ ID NO: 1439 - RNA, 22 nt, Homo sapiens
aacagugcuguuauaaauguac

SEQ ID NO: 1440 - RNA, 21 nt, Homo sapiens
aacagugcuuaguagauguuc

SEQ ID NO: 1441 - RNA, 20 nt, Homo sapiens
aacaguguguaaguuuccuu

SEQ ID NO: 1442 - RNA, 22 nt, Homo sapiens
aacauuaaaccacccgauucac

SEQ ID NO: 1443 - RNA, 21 nt, Homo sapiens
aagcaugguguaucuuuccau

SEQ ID NO: 1444 - RNA, 22 nt, Homo sapiens
aagccagugugacaggaaacuu

SEQ ID NO: 1445 - RNA, 22 nt, Homo sapiens
aagcaggugucugugucuguaa

SEQ ID NO: 1446 - RNA, 21 nt, Homo sapiens
aagcacauugaguguguguga

SEQ ID NO: 1447 - RNA, 22 nt, Homo sapiens
aagcacccuuugucuggacaug

SEQ ID NO: 1448 - RNA, 22 nt, Homo sapiens
aagaguuaguaaaauuuccucu

SEQ ID NO: 1449 - RNA, 22 nt, Homo sapiens
aagauauguuaguuauaaacuc

SEQ ID NO: 1450 - RNA, 22 nt, Homo sapiens
aagaucaucauagagggcauga

SEQ ID NO: 1451 - RNA, 22 nt, Homo sapiens
aagaugauguucuuuuucuuag

SEQ ID NO: 1452 - RNA, 22 nt, Homo sapiens
aagaugauguuguguuuucacu

SEQ ID NO: 1453 - RNA, 22 nt, Homo sapiens
aagagguaauaacaaagcuucu

SEQ ID NO: 1454 - RNA, 22 nt, Homo sapiens
aagagguagaagcuugccuucu

SEQ ID NO: 1455 - RNA, 22 nt, Homo sapiens
aagagguagcagucacaaaaga

SEQ ID NO: 1456 - RNA, 22 nt, Homo sapiens
aagagguaggaaauggucauuu

SEQ ID NO: 1457 - RNA, 22 nt, Homo sapiens
aagagguagucugucccuuagc

SEQ ID NO: 1458 - RNA, 23 nt, Homo sapiens
aagagguaugacuaugaagugga

SEQ ID NO: 1459 - RNA, 20 nt, Homo sapiens
aagacacuguccccacugga

SEQ ID NO: 1460 - RNA, 22 nt, Homo sapiens
aagaccuaugcaggaagaaaug

SEQ ID NO: 1461 - RNA, 22 nt, Homo sapiens
aagacuguaauccaucuugagu

SEQ ID NO: 1462 - RNA, 22 nt, Homo sapiens
aagagaugaagguccugacugu

SEQ ID NO: 1463 - RNA, 18 nt, Homo sapiens
aaaaagugcucaggccua

SEQ ID NO: 1464 - RNA, 22 nt, Homo sapiens
aaaaguucuuugagccuugaca

SEQ ID NO: 1465 - RNA, 22 nt, Homo sapiens
aaaagucuguagugaaagguga

SEQ ID NO: 1466 - RNA, 22 nt, Homo sapiens
aaaggcuucggaucagaaggua

SEQ ID NO: 1467 - RNA, 22 nt, Homo sapiens
aaagguaguacuucuagaaggg

SEQ ID NO: 1468 - RNA, 22 nt, Homo sapiens
aaagucuagaggaucaugugug

SEQ ID NO: 1469 - RNA, 22 nt, Homo sapiens
aaagucuguuacagcuauuucu

SEQ ID NO: 1470 - RNA, 22 nt, Homo sapiens
aaagugaauguaucccguaagu

SEQ ID NO: 1471 - RNA, 22 nt, Homo sapiens
aaagugauguccaggcuuucag

SEQ ID NO: 1472 - RNA, 22 nt, Homo sapiens
aaagugcuaggauuaccugggg

SEQ ID NO: 1473 - RNA, 22 nt, Homo sapiens
aaagugcugagacagacuggga

SEQ ID NO: 1474 - RNA, 22 nt, Homo sapiens
aaagugcugagaguucuaacuu

SEQ ID NO: 1475 - RNA, 22 nt, Homo sapiens
aaagugcugagauuguaggcau

SEQ ID NO: 1476 - RNA, 22 nt, Homo sapiens
aaagugcugagucuaggcgggg

SEQ ID NO: 1477 - RNA, 22 nt, Homo sapiens
aaagugcugggaucacacugaa

SEQ ID NO: 1478 - RNA, 22 nt, Homo sapiens
aaagugcugggauuaggccagg

SEQ ID NO: 1479 - RNA, 22 nt, Homo sapiens
aaagugcugggauuggccgggc

SEQ ID NO: 1480 - RNA, 22 nt, Homo sapiens
aaagugcugggauuggcugggc

SEQ ID NO: 1481 - RNA, 22 nt, Homo sapiens
aaagugcugggauuuuaggcau

SEQ ID NO: 1482 - RNA, 22 nt, Homo sapiens
aaagugcuguagacugggcgca

SEQ ID NO: 1483 - RNA, 22 nt, Homo sapiens
aaagugcuuacuaaguugccaa

SEQ ID NO: 1484 - RNA, 22 nt, Homo sapiens
aaagugcuuccuuuuugagggu

SEQ ID NO: 1485 - RNA, 22 nt, Homo sapiens
aaagugcuucucuuuggugggu

SEQ ID NO: 1486 - RNA, 22 nt, Homo sapiens
aaaguggacuaagugaauauga

SEQ ID NO: 1487 - RNA, 22 nt, Homo sapiens
aaaguggugggauuccaggcau

SEQ ID NO: 1488 - RNA, 22 nt, Homo sapiens
aaaguggugugaguauguaucu

SEQ ID NO: 1489 - RNA, 22 nt, Homo sapiens
aaaguucuugcugaaggauuau

SEQ ID NO: 1490 - RNA, 22 nt, Homo sapiens
aaaccaccauuacuuuugcacc

SEQ ID NO: 1491 - RNA, 22 nt, Homo sapiens
aaacugaucugaaggccaggcu

SEQ ID NO: 1492 - RNA, 20 nt, Homo sapiens
aaacucugucuucuuuauca

SEQ ID NO: 1493 - RNA, 18 nt, Homo sapiens
aaacugcuuccuuggccu

SEQ ID NO: 1494 - RNA, 22 nt, Homo sapiens
aaacugcuuuccaugguggcug

SEQ ID NO: 1495 - RNA, 23 nt, Homo sapiens
aaauuugccuauuauuccuaugg

SEQ ID NO: 1496 - RNA, 22 nt, Homo sapiens
aaauucaucaaaugguuuguau

SEQ ID NO: 1497 - RNA, 22 nt, Homo sapiens
aaauugcacaaguggugauuug

SEQ ID NO: 1498 - RNA, 22 nt, Homo sapiens
aaauugcaguuaggaugauggu

SEQ ID NO: 1499 - RNA, 22 nt, Homo sapiens
aaauugcauugagcugcuuauu

SEQ ID NO: 1500 - RNA, 22 nt, Homo sapiens
aaauugcuuuugaagacuuagu

SEQ ID NO: 1501 - RNA, 22 nt, Homo sapiens
aaaucccuugcucucucagacc

SEQ ID NO: 1502 - RNA, 22 nt, Homo sapiens
aaaugcacaaagauuuugcacu

SEQ ID NO: 1503 - RNA, 22 nt, Homo sapiens
aaaugcacagaaaggaugugga

SEQ ID NO: 1504 - RNA, 21 nt, Homo sapiens
aaaugcacauuacugcuggug

SEQ ID NO: 1505 - RNA, 22 nt, Homo sapiens
aaaugcaccacucuggugcagg

SEQ ID NO: 1506 - RNA, 22 nt, Homo sapiens
aaaugcacgcuacccagcuaga

SEQ ID NO: 1507 - RNA, 22 nt, Homo sapiens
aaaugcagucuuuguucugggc

SEQ ID NO: 1508 - RNA, 22 nt, Homo sapiens
aaaugcauaucaagauugcccu

SEQ ID NO: 1509 - RNA, 22 nt, Homo sapiens
aaaugccucccauucuacugac

SEQ ID NO: 1510 - RNA, 22 nt, Homo sapiens
aaaugcucucuacacguuucug

SEQ ID NO: 1511 - RNA, 22 nt, Homo sapiens
aaaugcuucuauguggcauguu

SEQ ID NO: 1512 - RNA, 22 nt, Homo sapiens
aaaugcuuucuuggaccauuug

SEQ ID NO: 1513 - RNA, 20 nt, Homo sapiens
aauaacagccccagggaggu

SEQ ID NO: 1514 - RNA, 22 nt, Homo sapiens
aauaaagcagcuuuuugggacu

SEQ ID NO: 1515 - RNA, 22 nt, Homo sapiens
aauaaagcauggcuacuccaua

SEQ ID NO: 1516 - RNA, 22 nt, Homo sapiens
aauaaagcugaauccuuccuga

SEQ ID NO: 1517 - RNA, 22 nt, Homo sapiens
aauaaagucugaagugugcuua

SEQ ID NO: 1518 - RNA, 22 nt, Homo sapiens
aaguuaauguuuaagacuccua

SEQ ID NO: 1519 - RNA, 22 nt, Homo sapiens
aagugaaugaugugaaguguaa

SEQ ID NO: 1520 - RNA, 19 nt, Homo sapiens
aagugaaugcuuuguucac

SEQ ID NO: 1521 - RNA, 22 nt, Homo sapiens
aagugaaugugcuggaauagcu

SEQ ID NO: 1522 - RNA, 22 nt, Homo sapiens
aagugacauugugcccauuuga

SEQ ID NO: 1523 - RNA, 20 nt, Homo sapiens
aagugaguguuaaacugaac

SEQ ID NO: 1524 - RNA, 22 nt, Homo sapiens
aagugcaaauucccaggcucug

SEQ ID NO: 1525 - RNA, 22 nt, Homo sapiens
aauagcauugaaucuaccaauu

SEQ ID NO: 1526 - RNA, 22 nt, Homo sapiens
aauacagcacacagaugggucu

SEQ ID NO: 1527 - RNA, 21 nt, Homo sapiens
aauacucuagguuaagagagc

SEQ ID NO: 1528 - RNA, 22 nt, Homo sapiens
aauacugaaaguauuuucaaau

SEQ ID NO: 1529 - RNA, 22 nt, Homo sapiens
aauacugagaugugagguacua

SEQ ID NO: 1530 - RNA, 22 nt, Homo sapiens
aauacuggcacugaagaccaug

SEQ ID NO: 1531 - RNA, 22 nt, Homo sapiens
aauacugugauaucgagcgauu

SEQ ID NO: 1532 - RNA, 22 nt, Homo sapiens
aaucacacuugauguugagcaa

SEQ ID NO: 1533 - RNA, 22 nt, Homo sapiens
aaucacaggucuuggcugcaug

SEQ ID NO: 1534 - RNA, 22 nt, Homo sapiens
aaucacaguguucuugugaggg

SEQ ID NO: 1535 - RNA, 21 nt, Homo sapiens
aaucacaguuguucugccuuc

SEQ ID NO: 1536 - RNA, 22 nt, Homo sapiens
aaucacauugaaucugcuaccu

SEQ ID NO: 1537 - RNA, 21 nt, Homo sapiens
aaucacugucuguuuccccuu

SEQ ID NO: 1538 - RNA, 22 nt, Homo sapiens
aaucacuuugcuacaaggcagu

SEQ ID NO: 1539 - RNA, 17 nt, Homo sapiens
aaucagauuucugagga

SEQ ID NO: 1540 - RNA, 22 nt, Homo sapiens
aagcuggagugcaguggugcaa

SEQ ID NO: 1541 - RNA, 22 nt, Homo sapiens
aagcuggagugcaguggugcga

SEQ ID NO: 1542 - RNA, 22 nt, Homo sapiens
aagcuggauuuaguguggagca

SEQ ID NO: 1543 - RNA, 22 nt, Homo sapiens
aagcuggauuucgcauccuguu

SEQ ID NO: 1544 - RNA, 22 nt, Homo sapiens
aaggaacuggaauauuuugaac

SEQ ID NO: 1545 - RNA, 22 nt, Homo sapiens
aaggaauucaaauuuucucugg

SEQ ID NO: 1546 - RNA, 22 nt, Homo sapiens
aaggaguagaauagaugcaccu

SEQ ID NO: 1547 - RNA, 22 nt, Homo sapiens
aaggaguagaggaauagcaaug

SEQ ID NO: 1548 - RNA, 22 nt, Homo sapiens
aagcuacauuuuauuuauguca

SEQ ID NO: 1549 - RNA, 22 nt, Homo sapiens
aagggaaugugguagcugguuu

SEQ ID NO: 1550 - RNA, 22 nt, Homo sapiens
aagggaauguuguagcugguuu

SEQ ID NO: 1551 - RNA, 22 nt, Homo sapiens
aagggaauguuguggcugguug

SEQ ID NO: 1552 - RNA, 22 nt, Homo sapiens
aagggaauguuguggcugguuu

SEQ ID NO: 1553 - RNA, 22 nt, Homo sapiens
aagggagcugcauaaucuugug

SEQ ID NO: 1554 - RNA, 22 nt, Homo sapiens
aaggugcuguaagcauccaugu

SEQ ID NO: 1555 - RNA, 17 nt, Homo sapiens
aaggugcuucgaccucc

SEQ ID NO: 1556 - RNA, 22 nt, Homo sapiens
aaguaaauauccgguaguccca

SEQ ID NO: 1557 - RNA, 22 nt, Homo sapiens
aaguacuguuuaaauugcagaa

SEQ ID NO: 1558 - RNA, 22 nt, Homo sapiens
aaguagcuggaugcaguggcac

SEQ ID NO: 1559 - RNA, 22 nt, Homo sapiens
aaguauguaucaagucauacuu

SEQ ID NO: 1560 - RNA, 22 nt, Homo sapiens
aagucaaggagagaagcuucag

SEQ ID NO: 1561 - RNA, 22 nt, Homo sapiens
aagucaguuugggagaagcuau

SEQ ID NO: 1562 - RNA, 20 nt, Homo sapiens
aagugcaucguugugucugc

SEQ ID NO: 1563 - RNA, 22 nt, Homo sapiens
aagugcucuugaaacugccuua

SEQ ID NO: 1564 - RNA, 22 nt, Homo sapiens
aagugcuuacagggaacaugau

SEQ ID NO: 1565 - RNA, 22 nt, Homo sapiens
aagugcuuaggauagugugugg

SEQ ID NO: 1566 - RNA, 22 nt, Homo sapiens
aagugcuucagaagacaauauu

SEQ ID NO: 1567 - RNA, 22 nt, Homo sapiens
aagugcuuccuuucagaggguu

SEQ ID NO: 1568 - RNA, 20 nt, Homo sapiens
aagugcuuccuuuuagaggg

SEQ ID NO: 1569 - RNA, 22 nt, Homo sapiens
aagugcuucuuuccucgagaag

SEQ ID NO: 1570 - RNA, 22 nt, Homo sapiens
aagugcuuuacacaugcaugau

SEQ ID NO: 1571 - RNA, 22 nt, Homo sapiens
aagugcuuuguacagggguuga

SEQ ID NO: 1572 - RNA, 22 nt, Homo sapiens
aagugcuuuuuagauaugguuu

SEQ ID NO: 1573 - RNA, 22 nt, Homo sapiens
aaguggaauguuuguggcacaa

SEQ ID NO: 1574 - RNA, 22 nt, Homo sapiens
aauaucacaggguguacacuca

SEQ ID NO: 1575 - RNA, 22 nt, Homo sapiens
aauaauggcaccaaagcacaag

SEQ ID NO: 1576 - RNA, 22 nt, Homo sapiens
aaucugucuuuuguuauugagg

SEQ ID NO: 1577 - RNA, 22 nt, Homo sapiens
aaucccuuuguccagucucuuu

SEQ ID NO: 1578 - RNA, 22 nt, Homo sapiens
aaugcacauaaaauccuccagg

SEQ ID NO: 1579 - RNA, 22 nt, Homo sapiens
aaugcacauauauuuccuuauu

SEQ ID NO: 1580 - RNA, 22 nt, Homo sapiens
aaugguguuuccguuaagcuga

SEQ ID NO: 1581 - RNA, 22 nt, Homo sapiens
aaugugcacuauuagggugaua

SEQ ID NO: 1582 - RNA, 22 nt, Homo sapiens
aauggcaaauguuuucuguuga

SEQ ID NO: 1583 - RNA, 22 nt, Homo sapiens
aauggcaagagccacagaggcg

SEQ ID NO: 1584 - RNA, 22 nt, Homo sapiens
aaugacuaagaugguacauuuu

SEQ ID NO: 1585 - RNA, 22 nt, Homo sapiens
aaucugggguuguuuggggagu

SEQ ID NO: 1586 - RNA, 22 nt, Homo sapiens
acaauguauauuuuacuguagg

SEQ ID NO: 1587 - RNA, 22 nt, Homo sapiens
acacaaugguaaguguuugugu

SEQ ID NO: 1588 - RNA, 23 nt, Homo sapiens
acacaguaaacuaaaagcuagcu

SEQ ID NO: 1589 - RNA, 22 nt, Homo sapiens
acaagacuucuuguauucuagu

SEQ ID NO: 1590 - RNA, 22 nt, Homo sapiens
acaagcacaaauuuaauccugu

SEQ ID NO: 1591 - RNA, 22 nt, Homo sapiens
acaaagcgcuucucuuuagagu

SEQ ID NO: 1592 - RNA, 22 nt, Homo sapiens
acaaaguauggaauguuggugu

SEQ ID NO: 1593 - RNA, 20 nt, Homo sapiens
acaaaugcauucugugacau

SEQ ID NO: 1594 - RNA, 22 nt, Homo sapiens
aauuacauggcaauugggaaau

SEQ ID NO: 1595 - RNA, 22 nt, Homo sapiens
aauuaguugucgugagaguggu

SEQ ID NO: 1596 - RNA, 23 nt, Homo sapiens
aauugcacauuccuugcuggcag

SEQ ID NO: 1597 - RNA, 22 nt, Homo sapiens
aauugcaccaucuagaucaaga

SEQ ID NO: 1598 - RNA, 22 nt, Homo sapiens
aauugcacuaagcauaguccag

SEQ ID NO: 1599 - RNA, 22 nt, Homo sapiens
aauugcacuacugcacucccac

SEQ ID NO: 1600 - RNA, 22 nt, Homo sapiens
aauugcacuggaaguaacugag

SEQ ID NO: 1601 - RNA, 22 nt, Homo sapiens
aauugcauugaauuuguagcuu

SEQ ID NO: 1602 - RNA, 22 nt, Homo sapiens
aauuggcagugcucuugccaca

SEQ ID NO: 1603 - RNA, 22 nt, Homo sapiens
acuuuuugaugaggucguuugu

SEQ ID NO: 1604 - RNA, 22 nt, Homo sapiens
acuuuuugauggggagaacauu

SEQ ID NO: 1605 - RNA, 22 nt, Homo sapiens
agaaacauucucuugccuccuu

SEQ ID NO: 1606 - RNA, 22 nt, Homo sapiens
agaauguaaacagaauagagga

SEQ ID NO: 1607 - RNA, 22 nt, Homo sapiens
agaauguauauucuguaguugu

SEQ ID NO: 1608 - RNA, 22 nt, Homo sapiens
agaaugucaguauuggcuaaaa

SEQ ID NO: 1609 - RNA, 22 nt, Homo sapiens
agaacacugaguucagggucag

SEQ ID NO: 1610 - RNA, 22 nt, Homo sapiens
agaaccaaucccacauggauac

SEQ ID NO: 1611 - RNA, 22 nt, Homo sapiens
agaacuguccauucagcaugaa

SEQ ID NO: 1612 - RNA, 22 nt, Homo sapiens
acuguauagauggaguugauuu

SEQ ID NO: 1613 - RNA, 22 nt, Homo sapiens
acuucauucucuggaucagaau

SEQ ID NO: 1614 - RNA, 22 nt, Homo sapiens
acuggacuuaaugaugaauugu

SEQ ID NO: 1615 - RNA, 22 nt, Homo sapiens
acuggauguuagggauuuuauu

SEQ ID NO: 1616 - RNA, 22 nt, Homo sapiens
acuggcuuauuucacuuagcau

SEQ ID NO: 1617 - RNA, 22 nt, Homo sapiens
acugaguguugauuuagauuaa

SEQ ID NO: 1618 - RNA, 22 nt, Homo sapiens
acugacaugaucaggcauguuc

SEQ ID NO: 1619 - RNA, 22 nt, Homo sapiens
acugagacugagaauguuucuu

SEQ ID NO: 1620 - RNA, 22 nt, Homo sapiens
acugagaucuuuaaauaaauaa

SEQ ID NO: 1621 - RNA, 22 nt, Homo sapiens
acuagguaguaaucugcagaga

SEQ ID NO: 1622 - RNA, 22 nt, Homo sapiens
acuauacugaagcaaauuaaca

SEQ ID NO: 1623 - RNA, 22 nt, Homo sapiens
acuauacuguaacuguauucag

SEQ ID NO: 1624 - RNA, 22 nt, Homo sapiens
acuccauuucauuuuagcucuu

SEQ ID NO: 1625 - RNA, 22 nt, Homo sapiens
acugaucaauguuaaggcuuau

SEQ ID NO: 1626 - RNA, 22 nt, Homo sapiens
acugcacuccacccuuggcagc

SEQ ID NO: 1627 - RNA, 18 nt, Homo sapiens
acugcacuccaccuuggg

SEQ ID NO: 1628 - RNA, 22 nt, Homo sapiens
acugcacuccaccuugggcaac

SEQ ID NO: 1629 - RNA, 22 nt, Homo sapiens
acugcacuccagccuccugggu

SEQ ID NO: 1630 - RNA, 22 nt, Homo sapiens
acugcacuccagccucggcaau

SEQ ID NO: 1631 - RNA, 22 nt, Homo sapiens
acugcacuccagccuuggcaac

SEQ ID NO: 1632 - RNA, 22 nt, Homo sapiens
acugcacuccagccuuggccac

SEQ ID NO: 1633 - RNA, 22 nt, Homo sapiens
acugcacuccagccuuggcggc

SEQ ID NO: 1634 - RNA, 22 nt, Homo sapiens
acugcacuccaguuugggcagc

SEQ ID NO: 1635 - RNA, 22 nt, Homo sapiens
acugcacuccggccuggcaaca

SEQ ID NO: 1636 - RNA, 19 nt, Homo sapiens
acugcacuccuccuugggu

SEQ ID NO: 1637 - RNA, 22 nt, Homo sapiens
acugcacucuagccuuggcaac

SEQ ID NO: 1638 - RNA, 22 nt, Homo sapiens
acugcacuuauccuccaauguu

SEQ ID NO: 1639 - RNA, 22 nt, Homo sapiens
acugcacuucagccuuggcuac

SEQ ID NO: 1640 - RNA, 22 nt, Homo sapiens
acugcacuucagccuugggaaa

SEQ ID NO: 1641 - RNA, 22 nt, Homo sapiens
agaugauguuuacugagcauca

SEQ ID NO: 1642 - RNA, 22 nt, Homo sapiens
agaugcauugguggcauauuca

SEQ ID NO: 1643 - RNA, 22 nt, Homo sapiens
agauggguuuucacauguuggc

SEQ ID NO: 1644 - RNA, 22 nt, Homo sapiens
agaugguauuauagguuucugu

SEQ ID NO: 1645 - RNA, 22 nt, Homo sapiens
agaucauaugcaguaaugaacu

SEQ ID NO: 1646 - RNA, 22 nt, Homo sapiens
agcaagauuguucccauuuucu

SEQ ID NO: 1647 - RNA, 22 nt, Homo sapiens
agcaauaugacauugcuacauc

SEQ ID NO: 1648 - RNA, 22 nt, Homo sapiens
agcaccaauaacaguuucuagc

SEQ ID NO: 1649 - RNA, 22 nt, Homo sapiens
agcaccaauaaucagaguucuu

SEQ ID NO: 1650 - RNA, 22 nt, Homo sapiens
agcaccauuagcguugggccgg

SEQ ID NO: 1651 - RNA, 22 nt, Homo sapiens
agcagagcaguggauuuuguga

SEQ ID NO: 1652 - RNA, 22 nt, Homo sapiens
agcagagcauauucauucgggg

SEQ ID NO: 1653 - RNA, 23 nt, Homo sapiens
agcaccuuuccuccacuaucugc

SEQ ID NO: 1654 - RNA, 22 nt, Homo sapiens
agagugaagcuuuuuauauucu

SEQ ID NO: 1655 - RNA, 22 nt, Homo sapiens
agagugcaaagguuggggcugg

SEQ ID NO: 1656 - RNA, 23 nt, Homo sapiens
agagugcaauggugccaucucgg

SEQ ID NO: 1657 - RNA, 22 nt, Homo sapiens
agagugcuauagauuagauuuc

SEQ ID NO: 1658 - RNA, 22 nt, Homo sapiens
agagguaagcaguggcaagugc

SEQ ID NO: 1659 - RNA, 22 nt, Homo sapiens
agagguauuggaaggaguguca

SEQ ID NO: 1660 - RNA, 22 nt, Homo sapiens
agaggucuuaucaaacaugcuu

SEQ ID NO: 1661 - RNA, 22 nt, Homo sapiens
agagguuuaauugauucacagu

SEQ ID NO: 1662 - RNA, 22 nt, Homo sapiens
agagguuuugcccucgagauaa

SEQ ID NO: 1663 - RNA, 22 nt, Homo sapiens
agagguuuuggggcugagagcu

SEQ ID NO: 1664 - RNA, 22 nt, Homo sapiens
agaguacaggcaaguuagucau

SEQ ID NO: 1665 - RNA, 21 nt, Homo sapiens
agagucaucucuaucuguacc

SEQ ID NO: 1666 - RNA, 22 nt, Homo sapiens
agacacugaaauguauugaaga

SEQ ID NO: 1667 - RNA, 22 nt, Homo sapiens
agacacuguugaaaaggcccca

SEQ ID NO: 1668 - RNA, 22 nt, Homo sapiens
agacaguguguguauauauggu

SEQ ID NO: 1669 - RNA, 20 nt, Homo sapiens
agacuagggagcagaaagcc

SEQ ID NO: 1670 - RNA, 21 nt, Homo sapiens
agagaacugaaacaugugacu

SEQ ID NO: 1671 - RNA, 22 nt, Homo sapiens
agagaacugauuggaugugggc

SEQ ID NO: 1672 - RNA, 19 nt, Homo sapiens
agagacucauuguagcauu

SEQ ID NO: 1673 - RNA, 22 nt, Homo sapiens
agagagguggguggagccccca

SEQ ID NO: 1674 - RNA, 22 nt, Homo sapiens
agagauuauccuggcuucucug

SEQ ID NO: 1675 - RNA, 18 nt, Homo sapiens
agagcacugaguuuuaga

SEQ ID NO: 1676 - RNA, 22 nt, Homo sapiens
accugguuuuaacauuguauua

SEQ ID NO: 1677 - RNA, 23 nt, Homo sapiens
accuucauucauucagcugaagu

SEQ ID NO: 1678 - RNA, 22 nt, Homo sapiens
acccaguagccagauguagcug

SEQ ID NO: 1679 - RNA, 22 nt, Homo sapiens
acccauguaggugggauuacag

SEQ ID NO: 1680 - RNA, 22 nt, Homo sapiens
acccagaguuccuugucuuuca

SEQ ID NO: 1681 - RNA, 22 nt, Homo sapiens
acccgcccagguguggccggga

SEQ ID NO: 1682 - RNA, 22 nt, Homo sapiens
acccuggauucguggccuugaa

SEQ ID NO: 1683 - RNA, 22 nt, Homo sapiens
acccugucauccacauggugcu

SEQ ID NO: 1684 - RNA, 22 nt, Homo sapiens
acccugugaauauuuaaacuuc

SEQ ID NO: 1685 - RNA, 22 nt, Homo sapiens
acccuuaagcacuaguucagcu

SEQ ID NO: 1686 - RNA, 22 nt, Homo sapiens
accucagcccggggaaguugag

SEQ ID NO: 1687 - RNA, 21 nt, Homo sapiens
acccucuaguuuucaacaggc

SEQ ID NO: 1688 - RNA, 22 nt, Homo sapiens
accugagacuaggcauuuuaua

SEQ ID NO: 1689 - RNA, 22 nt, Homo sapiens
accugagauuacaggugcuggc

SEQ ID NO: 1690 - RNA, 22 nt, Homo sapiens
accuggcacuuagcaaaucuga

SEQ ID NO: 1691 - RNA, 22 nt, Homo sapiens
accagucucagguaugucuuua

SEQ ID NO: 1692 - RNA, 22 nt, Homo sapiens
accaguuuuuuauacaucuucu

SEQ ID NO: 1693 - RNA, 22 nt, Homo sapiens
accaugcaguccaauaugcaca

SEQ ID NO: 1694 - RNA, 22 nt, Homo sapiens
acaucuguacaguggguguggu

SEQ ID NO: 1695 - RNA, 19 nt, Homo sapiens
acauggauuuugugcaaac

SEQ ID NO: 1696 - RNA, 22 nt, Homo sapiens
acauggcacugcgggcuucuug

SEQ ID NO: 1697 - RNA, 22 nt, Homo sapiens
acauguaauugauuuuguguua

SEQ ID NO: 1698 - RNA, 22 nt, Homo sapiens
acauucagcuguuguuucaaug

SEQ ID NO: 1699 - RNA, 18 nt, Homo sapiens
acauucagcuugaagaua

SEQ ID NO: 1700 - RNA, 22 nt, Homo sapiens
acauaaagaagcaggacauugu

SEQ ID NO: 1701 - RNA, 22 nt, Homo sapiens
acauaguagacacugaaaauau

SEQ ID NO: 1702 - RNA, 22 nt, Homo sapiens
acauauaaggagacuagggcau

SEQ ID NO: 1703 - RNA, 22 nt, Homo sapiens
acauaugaguacaugugccaug

SEQ ID NO: 1704 - RNA, 22 nt, Homo sapiens
acaucccuuucccacccuucac

SEQ ID NO: 1705 - RNA, 19 nt, Homo sapiens
acagcugguuuugguuucu

SEQ ID NO: 1706 - RNA, 22 nt, Homo sapiens
acagaaccauucacuccccugg

SEQ ID NO: 1707 - RNA, 22 nt, Homo sapiens
acagaacugggcuugcuuuugg

SEQ ID NO: 1708 - RNA, 22 nt, Homo sapiens
acaagugaauacaggauucucu

SEQ ID NO: 1709 - RNA, 22 nt, Homo sapiens
acaccaugucuguuucugguuu

SEQ ID NO: 1710 - RNA, 22 nt, Homo sapiens
acaccuguggucccaguaacuu

SEQ ID NO: 1711 - RNA, 22 nt, Homo sapiens
acacuggaguuaaaggugauuu

SEQ ID NO: 1712 - RNA, 20 nt, Homo sapiens
acacuggcuuugagauuuag

SEQ ID NO: 1713 - RNA, 22 nt, Homo sapiens
acacuguagcugagggcaugcg

SEQ ID NO: 1714 - RNA, 22 nt, Homo sapiens
acacuuucuggagcugcacaua

SEQ ID NO: 1715 - RNA, 22 nt, Homo sapiens
acaguaaugggccccuuuuccu

SEQ ID NO: 1716 - RNA, 22 nt, Homo sapiens
acagucacaauuuguaccuuuu

SEQ ID NO: 1717 - RNA, 22 nt, Homo sapiens
acagugcuguuguguuuucacg

SEQ ID NO: 1718 - RNA, 22 nt, Homo sapiens
acagugcuucugauaugaugcc

SEQ ID NO: 1719 - RNA, 22 nt, Homo sapiens
acagugcuuggcacacaguaau

SEQ ID NO: 1720 - RNA, 22 nt, Homo sapiens
acagugcuuucaauguucagua

SEQ ID NO: 1721 - RNA, 22 nt, Homo sapiens
acaguguagugacugccaacuu

SEQ ID NO: 1722 - RNA, 18 nt, Homo sapiens
acaguguguaaggguucu

SEQ ID NO: 1723 - RNA, 22 nt, Homo sapiens
acaguguguguguucaccuaga

SEQ ID NO: 1724 - RNA, 22 nt, Homo sapiens
acagccauuccagccaaauacu

SEQ ID NO: 1725 - RNA, 21 nt, Homo sapiens
agcagcuuugguugaagcaga

SEQ ID NO: 1726 - RNA, 22 nt, Homo sapiens
agcccauguggcugaggcuucu

SEQ ID NO: 1727 - RNA, 22 nt, Homo sapiens
agccaguauuuccacagagugg

SEQ ID NO: 1728 - RNA, 22 nt, Homo sapiens
agccauacaacguaugcaugua

SEQ ID NO: 1729 - RNA, 22 nt, Homo sapiens
agcagguguccacaauguuugc

SEQ ID NO: 1730 - RNA, 22 nt, Homo sapiens
agcaguacauaaaaagcauccu

SEQ ID NO: 1731 - RNA, 19 nt, Homo sapiens
agcaguguggagauuucuc

SEQ ID NO: 1732 - RNA, 22 nt, Homo sapiens
agcaguguggccuuagacccgg

SEQ ID NO: 1733 - RNA, 22 nt, Homo sapiens
agcaggucuuaacuugugaggu

SEQ ID NO: 1734 - RNA, 22 nt, Homo sapiens
agcauggucacuuugggcccca

SEQ ID NO: 1735 - RNA, 22 nt, Homo sapiens
agcauuaguugugaagccuuua

SEQ ID NO: 1736 - RNA, 22 nt, Homo sapiens
agccuguguugaauuauagaaa

SEQ ID NO: 1737 - RNA, 22 nt, Homo sapiens
agcgccacugcacuccagccug

SEQ ID NO: 1738 - RNA, 22 nt, Homo sapiens
aggaagguaaacuaacuugccu

SEQ ID NO: 1739 - RNA, 23 nt, Homo sapiens
aggaaguaacuaucuuuucuguc

SEQ ID NO: 1740 - RNA, 22 nt, Homo sapiens
aggaaguaauaaguuugguucu

SEQ ID NO: 1741 - RNA, 23 nt, Homo sapiens
aggaauggaaaaccaaguaucau

SEQ ID NO: 1742 - RNA, 22 nt, Homo sapiens
aggaauguuaguacuucuuagu

SEQ ID NO: 1743 - RNA, 22 nt, Homo sapiens
aggaauuuaauguaugauaaua

SEQ ID NO: 1744 - RNA, 22 nt, Homo sapiens
aggacacugauguaugcugugg

SEQ ID NO: 1745 - RNA, 22 nt, Homo sapiens
aggaagacugaaauugcuguuc

SEQ ID NO: 1746 - RNA, 22 nt, Homo sapiens
agcuuuuugggcagcuauugac

SEQ ID NO: 1747 - RNA, 22 nt, Homo sapiens
agcuugugauuuagagugagag

SEQ ID NO: 1748 - RNA, 22 nt, Homo sapiens
agcuuguggugaauacugcuag

SEQ ID NO: 1749 - RNA, 22 nt, Homo sapiens
agcuuguuuuauagaaagucaa

SEQ ID NO: 1750 - RNA, 22 nt, Homo sapiens
aggcaugauuguauuuugcucu

SEQ ID NO: 1751 - RNA, 23 nt, Homo sapiens
aggcauuguacaguaauggaaaa

SEQ ID NO: 1752 - RNA, 21 nt, Homo sapiens
agcuaaauuggaaauuucugu

SEQ ID NO: 1753 - RNA, 22 nt, Homo sapiens
agcuauauugaggaugccauuc

SEQ ID NO: 1754 - RNA, 22 nt, Homo sapiens
agcugcauuuacuuuugcacaa

SEQ ID NO: 1755 - RNA, 22 nt, Homo sapiens
agcugauggucuuguaugaugu

SEQ ID NO: 1756 - RNA, 22 nt, Homo sapiens
agcugcaaagggagagaugauu

SEQ ID NO: 1757 - RNA, 22 nt, Homo sapiens
agcugcaauguuuaguauaaua

SEQ ID NO: 1758 - RNA, 22 nt, Homo sapiens
agcucuuguuaguauuagcagu

SEQ ID NO: 1759 - RNA, 22 nt, Homo sapiens
agcuggauguauguuaagugaa

SEQ ID NO: 1760 - RNA, 22 nt, Homo sapiens
agcuggcuguagcugcaagucu

SEQ ID NO: 1761 - RNA, 22 nt, Homo sapiens
agcugguauuuugucaaggaua

SEQ ID NO: 1762 - RNA, 22 nt, Homo sapiens
agcugguauuuugucgaggacu

SEQ ID NO: 1763 - RNA, 22 nt, Homo sapiens
agcuggucuacguguguaugag

SEQ ID NO: 1764 - RNA, 22 nt, Homo sapiens
agcugugucuucuuaaagauuu

SEQ ID NO: 1765 - RNA, 22 nt, Homo sapiens
agcuguuguuuuaagauacuaa

SEQ ID NO: 1766 - RNA, 22 nt, Homo sapiens
auacacauuccugggccucacc

SEQ ID NO: 1767 - RNA, 22 nt, Homo sapiens
auacacgguaggcacauauuua

SEQ ID NO: 1768 - RNA, 19 nt, Homo sapiens
auacacguguauacauaca

SEQ ID NO: 1769 - RNA, 22 nt, Homo sapiens
auacaguaaugucuuaggcugu

SEQ ID NO: 1770 - RNA, 22 nt, Homo sapiens
auacaguaucuucuggcaagca

SEQ ID NO: 1771 - RNA, 22 nt, Homo sapiens
auacaguauggagggcccagcu

SEQ ID NO: 1772 - RNA, 22 nt, Homo sapiens
auacaguugccauuucuugugc

SEQ ID NO: 1773 - RNA, 22 nt, Homo sapiens
auacaucugccauguuggugug

SEQ ID NO: 1774 - RNA, 22 nt, Homo sapiens
agugguuuuaaguagagcauac

SEQ ID NO: 1775 - RNA, 22 nt, Homo sapiens
agugguuuuggaauggaauuca

SEQ ID NO: 1776 - RNA, 22 nt, Homo sapiens
aguggcaaugugauguccugaa

SEQ ID NO: 1777 - RNA, 22 nt, Homo sapiens
aguucaaaucgagccuggccau

SEQ ID NO: 1778 - RNA, 22 nt, Homo sapiens
auaaagacacuuggcaugauuu

SEQ ID NO: 1779 - RNA, 22 nt, Homo sapiens
auaaagcaagucucuggccuca

SEQ ID NO: 1780 - RNA, 22 nt, Homo sapiens
auaaagccaugagcuugagaug

SEQ ID NO: 1781 - RNA, 22 nt, Homo sapiens
auaaaguucugcuggcauauau

SEQ ID NO: 1782 - RNA, 22 nt, Homo sapiens
auaaauaguaguugugguggcc

SEQ ID NO: 1783 - RNA, 22 nt, Homo sapiens
auaaaugcaaugguauuuuuga

SEQ ID NO: 1784 - RNA, 19 nt, Homo sapiens
auaaaugccuacaagggug

SEQ ID NO: 1785 - RNA, 22 nt, Homo sapiens
auaaaugccuguuguuuuaagc

SEQ ID NO: 1786 - RNA, 22 nt, Homo sapiens
auaaaugcuuagaucuguauau

SEQ ID NO: 1787 - RNA, 22 nt, Homo sapiens
auaaauucauuuaagcuccuua

SEQ ID NO: 1788 - RNA, 22 nt, Homo sapiens
auaacagcauuauugcauacgu

SEQ ID NO: 1789 - RNA, 22 nt, Homo sapiens
auaacagcugcaaggcaaaagc

SEQ ID NO: 1790 - RNA, 22 nt, Homo sapiens
auaacucuguuuuuuucaugca

SEQ ID NO: 1791 - RNA, 22 nt, Homo sapiens
auaagauaguggaagugggauu

SEQ ID NO: 1792 - RNA, 23 nt, Homo sapiens
auaagccuuuucuuucugcccca

SEQ ID NO: 1793 - RNA, 22 nt, Homo sapiens
auaaggaguaucauauuaaaac

SEQ ID NO: 1794 - RNA, 22 nt, Homo sapiens
auaaguauuuggacuuuacugu

SEQ ID NO: 1795 - RNA, 22 nt, Homo sapiens
auaagugagugauucaguguua

SEQ ID NO: 1796 - RNA, 22 nt, Homo sapiens
auaauagcugaucauuuagaag

SEQ ID NO: 1797 - RNA, 22 nt, Homo sapiens
agugaaaucugaagaaggucau

SEQ ID NO: 1798 - RNA, 22 nt, Homo sapiens
agugacaugggaucaaaucuga

SEQ ID NO: 1799 - RNA, 22 nt, Homo sapiens
aguccauuugaugaugauucca

SEQ ID NO: 1800 - RNA, 22 nt, Homo sapiens
agugauuuuaacuuccagcaau

SEQ ID NO: 1801 - RNA, 22 nt, Homo sapiens
agugcaauaaggauguagaacu

SEQ ID NO: 1802 - RNA, 22 nt, Homo sapiens
agugcaauggugccaucauagc

SEQ ID NO: 1803 - RNA, 22 nt, Homo sapiens
agugcauugcaucucugcuuca

SEQ ID NO: 1804 - RNA, 22 nt, Homo sapiens
agugcauuugcaucucaauaua

SEQ ID NO: 1805 - RNA, 22 nt, Homo sapiens
agugcauuuguucugugucagg

SEQ ID NO: 1806 - RNA, 22 nt, Homo sapiens
agugccaaaucgagggcucuga

SEQ ID NO: 1807 - RNA, 22 nt, Homo sapiens
aguggaaucuguuauacuaacu

SEQ ID NO: 1808 - RNA, 22 nt, Homo sapiens
aguggaauuaagaaacugaauu

SEQ ID NO: 1809 - RNA, 22 nt, Homo sapiens
aguggaguguaaagcgucuuuu

SEQ ID NO: 1810 - RNA, 22 nt, Homo sapiens
aguggauguuguggccugggag

SEQ ID NO: 1811 - RNA, 22 nt, Homo sapiens
aguguuuuuaacaagaaagggu

SEQ ID NO: 1812 - RNA, 22 nt, Homo sapiens
aguguuuuuacaagcacucugg

SEQ ID NO: 1813 - RNA, 22 nt, Homo sapiens
aguguuuuuaucaugaaagggu

SEQ ID NO: 1814 - RNA, 22 nt, Homo sapiens
agguagcauagcgggaauauca

SEQ ID NO: 1815 - RNA, 22 nt, Homo sapiens
agguauguauguaugggagaaa

SEQ ID NO: 1816 - RNA, 22 nt, Homo sapiens
aggucccauguccucccugacc

SEQ ID NO: 1817 - RNA, 22 nt, Homo sapiens
agggcuuguuuaacuaucauua

SEQ ID NO: 1818 - RNA, 22 nt, Homo sapiens
agguaagaugugacuugguguu

SEQ ID NO: 1819 - RNA, 22 nt, Homo sapiens
aggagguaggaauugugcuagg

SEQ ID NO: 1820 - RNA, 21 nt, Homo sapiens
aggauaguagauuaaauauuu

SEQ ID NO: 1821 - RNA, 22 nt, Homo sapiens
aggaucauugacuauuauaagg

SEQ ID NO: 1822 - RNA, 22 nt, Homo sapiens
aggcagcuguuauauacugagu

SEQ ID NO: 1823 - RNA, 22 nt, Homo sapiens
aguaucacaggcaaaacagaau

SEQ ID NO: 1824 - RNA, 22 nt, Homo sapiens
aguauguagugcaaucagucag

SEQ ID NO: 1825 - RNA, 20 nt, Homo sapiens
aguauucacuuuuuucaugg

SEQ ID NO: 1826 - RNA, 22 nt, Homo sapiens
aguauugcuaauaagagauuug

SEQ ID NO: 1827 - RNA, 22 nt, Homo sapiens
aguacaauguugaguagaagug

SEQ ID NO: 1828 - RNA, 22 nt, Homo sapiens
aguagcaauggcucugagcuau

SEQ ID NO: 1829 - RNA, 22 nt, Homo sapiens
aguagguguugguagagguuuc

SEQ ID NO: 1830 - RNA, 22 nt, Homo sapiens
agucaaaugcuuauguauaaag

SEQ ID NO: 1831 - RNA, 22 nt, Homo sapiens
agucaagaaucucagcaucuuu

SEQ ID NO: 1832 - RNA, 22 nt, Homo sapiens
agucacagccuuuuacuuuaga

SEQ ID NO: 1833 - RNA, 22 nt, Homo sapiens
agucacagguucuugggauuag

SEQ ID NO: 1834 - RNA, 22 nt, Homo sapiens
agucacagugaccuugucugac

SEQ ID NO: 1835 - RNA, 22 nt, Homo sapiens
aggugaaugcucacauucuaau

SEQ ID NO: 1836 - RNA, 22 nt, Homo sapiens
aguaaaucacuaauggcuuccg

SEQ ID NO: 1837 - RNA, 22 nt, Homo sapiens
aguaaauuucugugcuuucaua

SEQ ID NO: 1838 - RNA, 22 nt, Homo sapiens
aguaacaggauccaaagaaugu

SEQ ID NO: 1839 - RNA, 22 nt, Homo sapiens
aggugguuuugaugagcaggua

SEQ ID NO: 1840 - RNA, 21 nt, Homo sapiens
auagggcuuguugauaguuaa

SEQ ID NO: 1841 - RNA, 22 nt, Homo sapiens
auagguuuucacuguagauucu

SEQ ID NO: 1842 - RNA, 22 nt, Homo sapiens
auacaagcaguccaacuccaua

SEQ ID NO: 1843 - RNA, 22 nt, Homo sapiens
auacaagugccauguuggugug

SEQ ID NO: 1844 - RNA, 21 nt, Homo sapiens
auagcacuucacuugguuaga

SEQ ID NO: 1845 - RNA, 22 nt, Homo sapiens
auagcagaacagugucucacug

SEQ ID NO: 1846 - RNA, 22 nt, Homo sapiens
auagcagaagaagggacaauuc

SEQ ID NO: 1847 - RNA, 22 nt, Homo sapiens
auagcagaauuuggucaagucu

SEQ ID NO: 1848 - RNA, 22 nt, Homo sapiens
auagcagaccaccucucccacu

SEQ ID NO: 1849 - RNA, 22 nt, Homo sapiens
auaucugcauugccauuuaugu

SEQ ID NO: 1850 - RNA, 22 nt, Homo sapiens
auaucacucccaauaucgcagg

SEQ ID NO: 1851 - RNA, 22 nt, Homo sapiens
auaucccagugaugauugauag

SEQ ID NO: 1852 - RNA, 22 nt, Homo sapiens
auagugcagugaugaaccuagg

SEQ ID NO: 1853 - RNA, 22 nt, Homo sapiens
auagcagcuugucagggcagac

SEQ ID NO: 1854 - RNA, 22 nt, Homo sapiens
auagcaggagaauggucauggg

SEQ ID NO: 1855 - RNA, 22 nt, Homo sapiens
auagcagugugaaaacagacua

SEQ ID NO: 1856 - RNA, 22 nt, Homo sapiens
auagcagugugaaaacagacug

SEQ ID NO: 1857 - RNA, 22 nt, Homo sapiens
auagcagugugaaaauggacua

SEQ ID NO: 1858 - RNA, 22 nt, Homo sapiens
auagcagugugaaaauguacua

SEQ ID NO: 1859 - RNA, 22 nt, Homo sapiens
auagcagugugaaaauugacug

SEQ ID NO: 1860 - RNA, 22 nt, Homo sapiens
auagcagugugagaaugaacua

SEQ ID NO: 1861 - RNA, 22 nt, Homo sapiens
auagcagugugaggacagacua

SEQ ID NO: 1862 - RNA, 22 nt, Homo sapiens
auagcauagucagcuucgcuga

SEQ ID NO: 1863 - RNA, 22 nt, Homo sapiens
auagcauaucccacaugucaga

SEQ ID NO: 1864 - RNA, 23 nt, Homo sapiens
auagagcuaggaugcagacagau

SEQ ID NO: 1865 - RNA, 22 nt, Homo sapiens
auagcaaugcaagaauggcuua

SEQ ID NO: 1866 - RNA, 22 nt, Homo sapiens
auagcacaguguguguacacca

SEQ ID NO: 1867 - RNA, 22 nt, Homo sapiens
auagcacaugugcaaauggcug

SEQ ID NO: 1868 - RNA, 22 nt, Homo sapiens
auacuagucaagaauguaugag

SEQ ID NO: 1869 - RNA, 22 nt, Homo sapiens
auacuguacugaaguacccauu

SEQ ID NO: 1870 - RNA, 22 nt, Homo sapiens
auacuguauaggauuguagccu

SEQ ID NO: 1871 - RNA, 22 nt, Homo sapiens
auacuguuuuacaucauugccu

SEQ ID NO: 1872 - RNA, 22 nt, Homo sapiens
auagaaucaucugugcacuagu

SEQ ID NO: 1873 - RNA, 22 nt, Homo sapiens
auagaauguauuaguaaauuug

SEQ ID NO: 1874 - RNA, 22 nt, Homo sapiens
auagacacugaaaucccugcca

SEQ ID NO: 1875 - RNA, 22 nt, Homo sapiens
aucaaaguaucucaauauggua

SEQ ID NO: 1876 - RNA, 22 nt, Homo sapiens
aucaaagugaauuaaugagaau

SEQ ID NO: 1877 - RNA, 22 nt, Homo sapiens
aucaaaguuucccagaaguugu

SEQ ID NO: 1878 - RNA, 22 nt, Homo sapiens
aucaaaugcuggcagagugccu

SEQ ID NO: 1879 - RNA, 18 nt, Homo sapiens
auauugcauuggauggau

SEQ ID NO: 1880 - RNA, 18 nt, Homo sapiens
auauugccuucagacuag

SEQ ID NO: 1881 - RNA, 22 nt, Homo sapiens
auauuggccuaaaauucucuuu

SEQ ID NO: 1882 - RNA, 17 nt, Homo sapiens
auaugaauuuuggagau

SEQ ID NO: 1883 - RNA, 22 nt, Homo sapiens
auaugacugccagggcccaguc

SEQ ID NO: 1884 - RNA, 22 nt, Homo sapiens
auaugcacgugcauacacacuu

SEQ ID NO: 1885 - RNA, 22 nt, Homo sapiens
auaugcacuauacacacguaua

SEQ ID NO: 1886 - RNA, 20 nt, Homo sapiens
auaugcagacacauacauac

SEQ ID NO: 1887 - RNA, 22 nt, Homo sapiens
auaugcauacauguaugcagga

SEQ ID NO: 1888 - RNA, 22 nt, Homo sapiens
auaugcauacccucaccaacua

SEQ ID NO: 1889 - RNA, 22 nt, Homo sapiens
auaugcauguacccacacaggc

SEQ ID NO: 1890 - RNA, 22 nt, Homo sapiens
auaugcuuauuagcaagaaaua

SEQ ID NO: 1891 - RNA, 21 nt, Homo sapiens
auauggaacuggugacguguu

SEQ ID NO: 1892 - RNA, 22 nt, Homo sapiens
auauguauuuuaacguguaagg

SEQ ID NO: 1893 - RNA, 22 nt, Homo sapiens
auaugucuauuauuagggcagg

SEQ ID NO: 1894 - RNA, 17 nt, Homo sapiens
auaugucugcuggggga

SEQ ID NO: 1895 - RNA, 22 nt, Homo sapiens
auaugucuguuuagucuguaau

SEQ ID NO: 1896 - RNA, 22 nt, Homo sapiens
auaugucuuaguuaccuugggc

SEQ ID NO: 1897 - RNA, 22 nt, Homo sapiens
auauuacagagaggaccuggga

SEQ ID NO: 1898 - RNA, 22 nt, Homo sapiens
auauucacagguaucagagauu

SEQ ID NO: 1899 - RNA, 22 nt, Homo sapiens
aucauacuguuuugauuacugu

SEQ ID NO: 1900 - RNA, 22 nt, Homo sapiens
aucauauccuagauauaacuuc

SEQ ID NO: 1901 - RNA, 22 nt, Homo sapiens
aucaggaaccuuuuuggugugu

SEQ ID NO: 1902 - RNA, 22 nt, Homo sapiens
aucauggaguauuugcaagucu

SEQ ID NO: 1903 - RNA, 22 nt, Homo sapiens
aucaugucuucccagugauucu

SEQ ID NO: 1904 - RNA, 22 nt, Homo sapiens
auccacaugcaguuggaaacag

SEQ ID NO: 1905 - RNA, 22 nt, Homo sapiens
aucacauuuauaguggcacgca

SEQ ID NO: 1906 - RNA, 22 nt, Homo sapiens
aucaccuggaggugaucacuug

SEQ ID NO: 1907 - RNA, 22 nt, Homo sapiens
aucacuagaucauagguaaaca

SEQ ID NO: 1908 - RNA, 20 nt, Homo sapiens
aucacuggagaaggaaaccu

SEQ ID NO: 1909 - RNA, 22 nt, Homo sapiens
aucacuguaaguuuacacuuug

SEQ ID NO: 1910 - RNA, 22 nt, Homo sapiens
aucacugugauuucuacugugc

SEQ ID NO: 1911 - RNA, 23 nt, Homo sapiens
aucacuguuaacaauuucuuccu

SEQ ID NO: 1912 - RNA, 22 nt, Homo sapiens
aucacuguuuugaugcucggac

SEQ ID NO: 1913 - RNA, 16 nt, Homo sapiens
aucacuugcuucuuuu

SEQ ID NO: 1914 - RNA, 22 nt, Homo sapiens
aucagaaucucuagaggacugu

SEQ ID NO: 1915 - RNA, 22 nt, Homo sapiens
aucagaaucucuagugggacca

SEQ ID NO: 1916 - RNA, 20 nt, Homo sapiens
aucagagacuaggauugcca

SEQ ID NO: 1917 - RNA, 22 nt, Homo sapiens
aucagagugaugguuuaaguau

SEQ ID NO: 1918 - RNA, 22 nt, Homo sapiens
aucagaguggguuuuaaaagug

SEQ ID NO: 1919 - RNA, 22 nt, Homo sapiens
auccuuuagacuguccaguuga

SEQ ID NO: 1920 - RNA, 22 nt, Homo sapiens
aucccuugacguggagucucug

SEQ ID NO: 1921 - RNA, 22 nt, Homo sapiens
aucccuuucugauacuuucccu

SEQ ID NO: 1922 - RNA, 22 nt, Homo sapiens
auccugaagcuuuacugaauuc

SEQ ID NO: 1923 - RNA, 22 nt, Homo sapiens
auccaucagacggcaggcguug

SEQ ID NO: 1924 - RNA, 22 nt, Homo sapiens
aucccagaaacucggguuucuc

SEQ ID NO: 1925 - RNA, 22 nt, Homo sapiens
aucucaguuaauuccaucuuuc

SEQ ID NO: 1926 - RNA, 22 nt, Homo sapiens
aucucaguucaggcuggccaca

SEQ ID NO: 1927 - RNA, 22 nt, Homo sapiens
aucucuugccagucagaauggu

SEQ ID NO: 1928 - RNA, 22 nt, Homo sapiens
aucugcacaucuguguuuuugu

SEQ ID NO: 1929 - RNA, 22 nt, Homo sapiens
aucugggguuggcaaaguuugg

SEQ ID NO: 1930 - RNA, 22 nt, Homo sapiens
aucuggguccguucugcuucuc

SEQ ID NO: 1931 - RNA, 22 nt, Homo sapiens
aucagugcauguuuguugagcu

SEQ ID NO: 1932 - RNA, 22 nt, Homo sapiens
aucgcgccauuguacuccagcc

SEQ ID NO: 1933 - RNA, 22 nt, Homo sapiens
aucuacagccagucugguuugu

SEQ ID NO: 1934 - RNA, 22 nt, Homo sapiens
augucaaagaggaaaacuggau

SEQ ID NO: 1935 - RNA, 22 nt, Homo sapiens
augucaaggugaagaaagauca

SEQ ID NO: 1936 - RNA, 22 nt, Homo sapiens
auguagugugauuuucacuaga

SEQ ID NO: 1937 - RNA, 22 nt, Homo sapiens
auguauacaugcaggucacagg

SEQ ID NO: 1938 - RNA, 22 nt, Homo sapiens
augguuuauuuguaagcagagu

SEQ ID NO: 1939 - RNA, 22 nt, Homo sapiens
auguaacugggacacaagccuc

SEQ ID NO: 1940 - RNA, 20 nt, Homo sapiens
auguaauguaugauauguac

SEQ ID NO: 1941 - RNA, 22 nt, Homo sapiens
auguaauguuaaauugcuaauu

SEQ ID NO: 1942 - RNA, 22 nt, Homo sapiens
auggccgggugcgguggcucac

SEQ ID NO: 1943 - RNA, 22 nt, Homo sapiens
auggcuauuccauaggcagagc

SEQ ID NO: 1944 - RNA, 22 nt, Homo sapiens
auggcuuuuuaaaucauguugu

SEQ ID NO: 1945 - RNA, 22 nt, Homo sapiens
augggaaaaucagaaggccugg

SEQ ID NO: 1946 - RNA, 20 nt, Homo sapiens
augguaguagcaccuuuaca

SEQ ID NO: 1947 - RNA, 22 nt, Homo sapiens
augguauggaaggucuggagga

SEQ ID NO: 1948 - RNA, 22 nt, Homo sapiens
auggucccauucauucacguau

SEQ ID NO: 1949 - RNA, 22 nt, Homo sapiens
auggcacagaguagaugcucaa

SEQ ID NO: 1950 - RNA, 22 nt, Homo sapiens
auggcacugccuggcuucaugg

SEQ ID NO: 1951 - RNA, 22 nt, Homo sapiens
auggaaugccauuuauaaugga

SEQ ID NO: 1952 - RNA, 22 nt, Homo sapiens
auggaauguaaguuauguuugc

SEQ ID NO: 1953 - RNA, 22 nt, Homo sapiens
auggaauguauagucauguagg

SEQ ID NO: 1954 - RNA, 22 nt, Homo sapiens
auggacagaaaaaaauagaugu

SEQ ID NO: 1955 - RNA, 22 nt, Homo sapiens
auggacagacacuggccuucug

SEQ ID NO: 1956 - RNA, 22 nt, Homo sapiens
auggagagaauuauucucucag

SEQ ID NO: 1957 - RNA, 22 nt, Homo sapiens
auggaggacaaugucaccuuca

SEQ ID NO: 1958 - RNA, 22 nt, Homo sapiens
auggaggccuacagaauuuugg

SEQ ID NO: 1959 - RNA, 22 nt, Homo sapiens
auggagguguggggagugaguu

SEQ ID NO: 1960 - RNA, 22 nt, Homo sapiens
auggaguguaauauugagagcu

SEQ ID NO: 1961 - RNA, 22 nt, Homo sapiens
auggaguguggaacugggaauc

SEQ ID NO: 1962 - RNA, 22 nt, Homo sapiens
auggauguucuagggaugugau

SEQ ID NO: 1963 - RNA, 22 nt, Homo sapiens
auggauugucuccuugugccau

SEQ ID NO: 1964 - RNA, 22 nt, Homo sapiens
auggcaauaauagcuaccauuu

SEQ ID NO: 1965 - RNA, 22 nt, Homo sapiens
auggcaauaugaugcacuguuu

SEQ ID NO: 1966 - RNA, 22 nt, Homo sapiens
auggcaaugcgaugaugacuga

SEQ ID NO: 1967 - RNA, 22 nt, Homo sapiens
auggcaaugcgauggugacuga

SEQ ID NO: 1968 - RNA, 22 nt, Homo sapiens
auggcaauguaagucagaaaaa

SEQ ID NO: 1969 - RNA, 22 nt, Homo sapiens
augccuagagucaguggaggug

SEQ ID NO: 1970 - RNA, 22 nt, Homo sapiens
augcuguuuuguagcucccucu

SEQ ID NO: 1971 - RNA, 21 nt, Homo sapiens
auggaaagacugccucuucaa

SEQ ID NO: 1972 - RNA, 22 nt, Homo sapiens
auggaacuggagaugguuauau

SEQ ID NO: 1973 - RNA, 22 nt, Homo sapiens
auggaagaaacgauuuucugga

SEQ ID NO: 1974 - RNA, 22 nt, Homo sapiens
auggaagaaaguuggguucuug

SEQ ID NO: 1975 - RNA, 22 nt, Homo sapiens
auggaagaauugucggggaugu

SEQ ID NO: 1976 - RNA, 22 nt, Homo sapiens
auggaagacuccucuuugggua

SEQ ID NO: 1977 - RNA, 22 nt, Homo sapiens
auggaaggagaggaaugaauga

SEQ ID NO: 1978 - RNA, 22 nt, Homo sapiens
augauaaguuauuagaagaaga

SEQ ID NO: 1979 - RNA, 22 nt, Homo sapiens
augauacuggcuucauagaaug

SEQ ID NO: 1980 - RNA, 22 nt, Homo sapiens
augauagucuugagaagcauuu

SEQ ID NO: 1981 - RNA, 22 nt, Homo sapiens
augaccuuguccucagugucau

SEQ ID NO: 1982 - RNA, 22 nt, Homo sapiens
augauggagguagauuguccau

SEQ ID NO: 1983 - RNA, 22 nt, Homo sapiens
augauguaggccauggguuucu

SEQ ID NO: 1984 - RNA, 22 nt, Homo sapiens
augaugucauuuuaauuucuaa

SEQ ID NO: 1985 - RNA, 22 nt, Homo sapiens
augcacauggcuaacuuuuuuc

SEQ ID NO: 1986 - RNA, 22 nt, Homo sapiens
augcacuguauaggaucuugcg

SEQ ID NO: 1987 - RNA, 22 nt, Homo sapiens
augcacuuggcaggaugauucc

SEQ ID NO: 1988 - RNA, 22 nt, Homo sapiens
augcagagaaaucuaaaauaug

SEQ ID NO: 1989 - RNA, 22 nt, Homo sapiens
augcagaucacauuuuucuguc

SEQ ID NO: 1990 - RNA, 22 nt, Homo sapiens
augcagugugcaacagauuaag

SEQ ID NO: 1991 - RNA, 23 nt, Homo sapiens
augacacuccugugcgcacccug

SEQ ID NO: 1992 - RNA, 22 nt, Homo sapiens
augacauguauuuccaggauuu

SEQ ID NO: 1993 - RNA, 22 nt, Homo sapiens
augacauuccacagccguagag

SEQ ID NO: 1994 - RNA, 22 nt, Homo sapiens
augacauugaaaagcaagugga

SEQ ID NO: 1995 - RNA, 22 nt, Homo sapiens
augacauugaugcucuggcugg

SEQ ID NO: 1996 - RNA, 19 nt, Homo sapiens
augacauuuggggguggac

SEQ ID NO: 1997 - RNA, 22 nt, Homo sapiens
augaccaaugggcagagcuaga

SEQ ID NO: 1998 - RNA, 22 nt, Homo sapiens
augagggaagcucacgugucca

SEQ ID NO: 1999 - RNA, 22 nt, Homo sapiens
augagggagggguggugccgca

SEQ ID NO: 2000 - RNA, 22 nt, Homo sapiens
augagguaguagaaagucaggu

SEQ ID NO: 2001 - RNA, 22 nt, Homo sapiens
augaggugaguaaauaaaugaa

SEQ ID NO: 2002 - RNA, 22 nt, Homo sapiens
augaguaguugcuaaauauuga

SEQ ID NO: 2003 - RNA, 22 nt, Homo sapiens
augaguaugagaauacauuaag

SEQ ID NO: 2004 - RNA, 22 nt, Homo sapiens
augaguauguucuguauuuuca

SEQ ID NO: 2005 - RNA, 22 nt, Homo sapiens
augagucacuuauuauuggggu

SEQ ID NO: 2006 - RNA, 19 nt, Homo sapiens
augagucugcaagaaccag

SEQ ID NO: 2007 - RNA, 22 nt, Homo sapiens
augaaaagcauaaacgcugaag

SEQ ID NO: 2008 - RNA, 22 nt, Homo sapiens
aucuucucuugaagggugggga

SEQ ID NO: 2009 - RNA, 22 nt, Homo sapiens
aucuugcauuugcuaaaaugca

SEQ ID NO: 2010 - RNA, 22 nt, Homo sapiens
aucuuguguugaauggugcaga

SEQ ID NO: 2011 - RNA, 22 nt, Homo sapiens
aucuuuaguggcuguuuucaga

SEQ ID NO: 2012 - RNA, 22 nt, Homo sapiens
augaaaacaugauuugccuguu

SEQ ID NO: 2013 - RNA, 22 nt, Homo sapiens
augaaacuggcuaauuuuugua

SEQ ID NO: 2014 - RNA, 22 nt, Homo sapiens
augaaagguauguuuucuguga

SEQ ID NO: 2015 - RNA, 22 nt, Homo sapiens
augaaagguugucuuaagccau

SEQ ID NO: 2016 - RNA, 22 nt, Homo sapiens
augaaaguguguggaaacuuga

SEQ ID NO: 2017 - RNA, 22 nt, Homo sapiens
augaaaucuuuggcagaucuua

SEQ ID NO: 2018 - RNA, 22 nt, Homo sapiens
augaaauugcuaucgcaguacu

SEQ ID NO: 2019 - RNA, 22 nt, Homo sapiens
augaagacaucgucugggauua

SEQ ID NO: 2020 - RNA, 22 nt, Homo sapiens
augaagaucucugccuuguguc

SEQ ID NO: 2021 - RNA, 22 nt, Homo sapiens
augaagauguugccuuuuuaau

SEQ ID NO: 2022 - RNA, 18 nt, Homo sapiens
augaagucaucacuuuua

SEQ ID NO: 2023 - RNA, 22 nt, Homo sapiens
augaagucguuacuaccaauug

SEQ ID NO: 2024 - RNA, 20 nt, Homo sapiens
augaagugaaguuagggaac

SEQ ID NO: 2025 - RNA, 22 nt, Homo sapiens
augaauacugcugcaaugaaca

SEQ ID NO: 2026 - RNA, 22 nt, Homo sapiens
augacuagaggagggauggcca

SEQ ID NO: 2027 - RNA, 22 nt, Homo sapiens
augacuauugcacuuuccuggu

SEQ ID NO: 2028 - RNA, 22 nt, Homo sapiens
augacugaguagcauuccauua

SEQ ID NO: 2029 - RNA, 22 nt, Homo sapiens
augacugucagggcagucauug

SEQ ID NO: 2030 - RNA, 22 nt, Homo sapiens
augagaacauaucaagugauug

SEQ ID NO: 2031 - RNA, 22 nt, Homo sapiens
augagaacugucaaugagagcu

SEQ ID NO: 2032 - RNA, 22 nt, Homo sapiens
augagaauguaaguuaaugaaa

SEQ ID NO: 2033 - RNA, 22 nt, Homo sapiens
augagacauuaaaguguguuug

SEQ ID NO: 2034 - RNA, 22 nt, Homo sapiens
augagauaaaccaucucuuaag

SEQ ID NO: 2035 - RNA, 22 nt, Homo sapiens
augagauacuacaaaugaguuu

SEQ ID NO: 2036 - RNA, 22 nt, Homo sapiens
augagauauguuaaaaguuaaa

SEQ ID NO: 2037 - RNA, 22 nt, Homo sapiens
augagauauuuuauaagaucau

SEQ ID NO: 2038 - RNA, 22 nt, Homo sapiens
augagaugaauaccgacgaugu

SEQ ID NO: 2039 - RNA, 22 nt, Homo sapiens
augagaugaggaauggcccucc

SEQ ID NO: 2040 - RNA, 22 nt, Homo sapiens
augagaugcaagauuagauggg

SEQ ID NO: 2041 - RNA, 22 nt, Homo sapiens
augagauucuuagagaagucug

SEQ ID NO: 2042 - RNA, 22 nt, Homo sapiens
augagcuaauauggguaaguug

SEQ ID NO: 2043 - RNA, 22 nt, Homo sapiens
augagcuaguguaggguacuga

SEQ ID NO: 2044 - RNA, 22 nt, Homo sapiens
augaggauagguuucuauuagg

SEQ ID NO: 2045 - RNA, 22 nt, Homo sapiens
augaggcaggaaaggcguaucu

SEQ ID NO: 2046 - RNA, 22 nt, Homo sapiens
cugagacacucuuaucugcaua

SEQ ID NO: 2047 - RNA, 22 nt, Homo sapiens
cugacuuuagaacccaaaaagu

SEQ ID NO: 2048 - RNA, 22 nt, Homo sapiens
cugagaagaaacagguaaggac

SEQ ID NO: 2049 - RNA, 22 nt, Homo sapiens
cugaaucauugcauuaucaagg

SEQ ID NO: 2050 - RNA, 22 nt, Homo sapiens
cugacagucucauugauuugcu

SEQ ID NO: 2051 - RNA, 22 nt, Homo sapiens
cugacauuguugaucacagcca

SEQ ID NO: 2052 - RNA, 22 nt, Homo sapiens
cucucaagaugcugggauuaca

SEQ ID NO: 2053 - RNA, 22 nt, Homo sapiens
cugaaagagcauguaacacagu

SEQ ID NO: 2054 - RNA, 22 nt, Homo sapiens
cugaaagagcauuugaaugggu

SEQ ID NO: 2055 - RNA, 22 nt, Homo sapiens
cugaaagguauacgcuuguuau

SEQ ID NO: 2056 - RNA, 22 nt, Homo sapiens
cugaaaguuauucaggggcaag

SEQ ID NO: 2057 - RNA, 22 nt, Homo sapiens
cuccuguagccccaucaucuuu

SEQ ID NO: 2058 - RNA, 20 nt, Homo sapiens
cuccuucauuccuuuggacc

SEQ ID NO: 2059 - RNA, 22 nt, Homo sapiens
cuauaacagugugguuuggaga

SEQ ID NO: 2060 - RNA, 21 nt, Homo sapiens
cuaucucaguguuuacauuug

SEQ ID NO: 2061 - RNA, 22 nt, Homo sapiens
cuaugagucugcagaucuauua

SEQ ID NO: 2062 - RNA, 22 nt, Homo sapiens
cuaugucuuucauauuuugggg

SEQ ID NO: 2063 - RNA, 22 nt, Homo sapiens
cuauucacaggcaauauguaca

SEQ ID NO: 2064 - RNA, 19 nt, Homo sapiens
cuauugcacauagcugaag

SEQ ID NO: 2065 - RNA, 21 nt, Homo sapiens
cucaaaguacugauauuacag

SEQ ID NO: 2066 - RNA, 22 nt, Homo sapiens
cucaaagucaagggaaagcagg

SEQ ID NO: 2067 - RNA, 22 nt, Homo sapiens
cucaaguaauccucccgccuug

SEQ ID NO: 2068 - RNA, 22 nt, Homo sapiens
cucaaguacaugggauuacagg

SEQ ID NO: 2069 - RNA, 22 nt, Homo sapiens
cucacaugcucaccugguguuc

SEQ ID NO: 2070 - RNA, 22 nt, Homo sapiens
cucacggcccugcgcacuggca

SEQ ID NO: 2071 - RNA, 22 nt, Homo sapiens
cucacuaggaaguaaaguuugu

SEQ ID NO: 2072 - RNA, 22 nt, Homo sapiens
cucacuaguaaggcuguuuagu

SEQ ID NO: 2073 - RNA, 22 nt, Homo sapiens
cuaggcuguagagaaguucagu

SEQ ID NO: 2074 - RNA, 22 nt, Homo sapiens
cucacugucaacauguauuugg

SEQ ID NO: 2075 - RNA, 22 nt, Homo sapiens
cucagcuacuugggaagcugag

SEQ ID NO: 2076 - RNA, 22 nt, Homo sapiens
cucaguggauuagauaaugcac

SEQ ID NO: 2077 - RNA, 22 nt, Homo sapiens
cucaguuuugccuuguuuaagg

SEQ ID NO: 2078 - RNA, 22 nt, Homo sapiens
cucauggaauacuucacagcca

SEQ ID NO: 2079 - RNA, 19 nt, Homo sapiens
cucauggagaaggagaaua

SEQ ID NO: 2080 - RNA, 22 nt, Homo sapiens
cucauggagauagagaauagaa

SEQ ID NO: 2081 - RNA, 22 nt, Homo sapiens
cucauugcaaucuccaccuccc

SEQ ID NO: 2082 - RNA, 22 nt, Homo sapiens
cucauugcaaucucugccuccc

SEQ ID NO: 2083 - RNA, 22 nt, Homo sapiens
cucauuggcuacugaggcuugu

SEQ ID NO: 2084 - RNA, 22 nt, Homo sapiens
cuccauuuaucugaaauuuuau

SEQ ID NO: 2085 - RNA, 22 nt, Homo sapiens
cuccauuuggaacagauguccu

SEQ ID NO: 2086 - RNA, 22 nt, Homo sapiens
cucccagagccaguuauaggcu

SEQ ID NO: 2087 - RNA, 22 nt, Homo sapiens
cuaaaacuuucugagugcagca

SEQ ID NO: 2088 - RNA, 22 nt, Homo sapiens
cuaaagauagugacaugauuug

SEQ ID NO: 2089 - RNA, 22 nt, Homo sapiens
cuaaagugcuuaaaaucucauu

SEQ ID NO: 2090 - RNA, 22 nt, Homo sapiens
cuaacacagggcaagucaggcu

SEQ ID NO: 2091 - RNA, 21 nt, Homo sapiens
cuaaggaaagcuaugaacccu

SEQ ID NO: 2092 - RNA, 22 nt, Homo sapiens
cuaaggaaggacugaaaggaca

SEQ ID NO: 2093 - RNA, 19 nt, Homo sapiens
cuaaguccccuugauuaga

SEQ ID NO: 2094 - RNA, 22 nt, Homo sapiens
cuacacaugcaggcucccugcc

SEQ ID NO: 2095 - RNA, 22 nt, Homo sapiens
cuacagcacugagcugugugca

SEQ ID NO: 2096 - RNA, 22 nt, Homo sapiens
cuacagcagcccaguccccgaa

SEQ ID NO: 2097 - RNA, 22 nt, Homo sapiens
cuacaguagagaggauguagaa

SEQ ID NO: 2098 - RNA, 22 nt, Homo sapiens
cuacaguaugaaaccuuuacuc

SEQ ID NO: 2099 - RNA, 22 nt, Homo sapiens
cuagaacuagaacugcuggggu

SEQ ID NO: 2100 - RNA, 22 nt, Homo sapiens
cuagacacugacguuccuccga

SEQ ID NO: 2101 - RNA, 22 nt, Homo sapiens
cuagcagaacaauacaauucgg

SEQ ID NO: 2102 - RNA, 22 nt, Homo sapiens
cuagcagacacuuccagagagu

SEQ ID NO: 2103 - RNA, 22 nt, Homo sapiens
cuagcagacaugggcugaacca

SEQ ID NO: 2104 - RNA, 22 nt, Homo sapiens
cuagcugcacuuccugcuacug

SEQ ID NO: 2105 - RNA, 22 nt, Homo sapiens
cuagcuuuugauguaaagugag

SEQ ID NO: 2106 - RNA, 22 nt, Homo sapiens
ccucacaaccuuuauugaagag

SEQ ID NO: 2107 - RNA, 22 nt, Homo sapiens
ccucauggagaacaucugcuag

SEQ ID NO: 2108 - RNA, 22 nt, Homo sapiens
ccugagacgaauggagugaaca

SEQ ID NO: 2109 - RNA, 22 nt, Homo sapiens
ccugagacuugagggggcuucu

SEQ ID NO: 2110 - RNA, 22 nt, Homo sapiens
ccugagaucauacuguuaguaa

SEQ ID NO: 2111 - RNA, 19 nt, Homo sapiens
ccugcuguucuuuugcacc

SEQ ID NO: 2112 - RNA, 22 nt, Homo sapiens
ccuuggcaauggcuggggcuga

SEQ ID NO: 2113 - RNA, 22 nt, Homo sapiens
ccuguguuaugguuucuaaugu

SEQ ID NO: 2114 - RNA, 18 nt, Homo sapiens
ccuuaguuauagagaguc

SEQ ID NO: 2115 - RNA, 22 nt, Homo sapiens
ccuucuuuuguaaggcugaaua

SEQ ID NO: 2116 - RNA, 22 nt, Homo sapiens
cccuguguuguucaaggaucug

SEQ ID NO: 2117 - RNA, 22 nt, Homo sapiens
cccuguguuuagcugaagguuu

SEQ ID NO: 2118 - RNA, 22 nt, Homo sapiens
ccuguagcauccaagaagcugc

SEQ ID NO: 2119 - RNA, 23 nt, Homo sapiens
cccaguuaauccuuaaucuccac

SEQ ID NO: 2120 - RNA, 22 nt, Homo sapiens
cccaguuuugcuucucaugagg

SEQ ID NO: 2121 - RNA, 18 nt, Homo sapiens
ccauucaacagauuuguc

SEQ ID NO: 2122 - RNA, 22 nt, Homo sapiens
ccauugaacaugaaggaaugug

SEQ ID NO: 2123 - RNA, 22 nt, Homo sapiens
ccauuucacucuuccugaagga

SEQ ID NO: 2124 - RNA, 22 nt, Homo sapiens
cccagagacagaaugauaaacu

SEQ ID NO: 2125 - RNA, 22 nt, Homo sapiens
cccagaguucuuaaauacugag

SEQ ID NO: 2126 - RNA, 20 nt, Homo sapiens
ccccaguuuuucuauuagcu

SEQ ID NO: 2127 - RNA, 22 nt, Homo sapiens
ccccauguucucucugcagcuc

SEQ ID NO: 2128 - RNA, 17 nt, Homo sapiens
cccuaguagcugggacu

SEQ ID NO: 2129 - RNA, 22 nt, Homo sapiens
cccugaagauacagaguuuggg

SEQ ID NO: 2130 - RNA, 22 nt, Homo sapiens
cccugagaaaacuuuguccuua

SEQ ID NO: 2131 - RNA, 22 nt, Homo sapiens
cccugagagcagggucuuucuc

SEQ ID NO: 2132 - RNA, 22 nt, Homo sapiens
cccugagaugcuguuaaucugu

SEQ ID NO: 2133 - RNA, 22 nt, Homo sapiens
cccugagaugugaauuucagag

SEQ ID NO: 2134 - RNA, 22 nt, Homo sapiens
ccagucuuggugucuguagcac

SEQ ID NO: 2135 - RNA, 22 nt, Homo sapiens
ccaguguucuggaaggcugagu

SEQ ID NO: 2136 - RNA, 22 nt, Homo sapiens
ccaggguuccacgccuggcugu

SEQ ID NO: 2137 - RNA, 22 nt, Homo sapiens
ccaucacaggccucagugggaa

SEQ ID NO: 2138 - RNA, 19 nt, Homo sapiens
ccauggcaaugaucugaug

SEQ ID NO: 2139 - RNA, 21 nt, Homo sapiens
ccauggcaaugguaaacugac

SEQ ID NO: 2140 - RNA, 22 nt, Homo sapiens
ccauggcaauggucagucuauu

SEQ ID NO: 2141 - RNA, 22 nt, Homo sapiens
caugacacuggcauguuucuuu

SEQ ID NO: 2142 - RNA, 22 nt, Homo sapiens
caugcacugaguccaccucugg

SEQ ID NO: 2143 - RNA, 22 nt, Homo sapiens
caugcauuggucuauuauguga

SEQ ID NO: 2144 - RNA, 22 nt, Homo sapiens
cauugcaacuucugccucccag

SEQ ID NO: 2145 - RNA, 22 nt, Homo sapiens
cauugcacacauuuaccuaugu

SEQ ID NO: 2146 - RNA, 22 nt, Homo sapiens
cauggauuuuuuugaauggcag

SEQ ID NO: 2147 - RNA, 22 nt, Homo sapiens
cauggcccugggcugggcgaac

SEQ ID NO: 2148 - RNA, 19 nt, Homo sapiens
cauggcuuauaauuuuaau

SEQ ID NO: 2149 - RNA, 22 nt, Homo sapiens
caugguguuaggcacugggaau

SEQ ID NO: 2150 - RNA, 21 nt, Homo sapiens
caugucacugcacucuagccu

SEQ ID NO: 2151 - RNA, 22 nt, Homo sapiens
caugucuuuuaaacauucaacu

SEQ ID NO: 2152 - RNA, 22 nt, Homo sapiens
caugucuuuuauucugugugau

SEQ ID NO: 2153 - RNA, 19 nt, Homo sapiens
caugugcacuacuggcuuc

SEQ ID NO: 2154 - RNA, 22 nt, Homo sapiens
cauaaagauggaggaggccagg

SEQ ID NO: 2155 - RNA, 22 nt, Homo sapiens
caucacaugcuuauuuuccuca

SEQ ID NO: 2156 - RNA, 22 nt, Homo sapiens
caucagagugagauauaagauc

SEQ ID NO: 2157 - RNA, 21 nt, Homo sapiens
cauaaugcuacuuauuuuaug

SEQ ID NO: 2158 - RNA, 22 nt, Homo sapiens
cauacaagcuacaaucacaaag

SEQ ID NO: 2159 - RNA, 22 nt, Homo sapiens
cauacagcuaguaaguguaaga

SEQ ID NO: 2160 - RNA, 22 nt, Homo sapiens
cauagguugggcguuugauuuu

SEQ ID NO: 2161 - RNA, 19 nt, Homo sapiens
caguaucauugcacauagu

SEQ ID NO: 2162 - RNA, 22 nt, Homo sapiens
caggugcauuggcugacaccug

SEQ ID NO: 2163 - RNA, 22 nt, Homo sapiens
caggugcuuacuuaauagccau

SEQ ID NO: 2164 - RNA, 22 nt, Homo sapiens
cagucacagugacaggaugugg

SEQ ID NO: 2165 - RNA, 20 nt, Homo sapiens
cagucaugaagaacugugag

SEQ ID NO: 2166 - RNA, 22 nt, Homo sapiens
cagugcauaggaucuaaaauuu

SEQ ID NO: 2167 - RNA, 22 nt, Homo sapiens
cagugcaugacuguauauuauc

SEQ ID NO: 2168 - RNA, 22 nt, Homo sapiens
cagugcuuguuauuguucuauu

SEQ ID NO: 2169 - RNA, 22 nt, Homo sapiens
cagugcuuuaucaaguccucca

SEQ ID NO: 2170 - RNA, 22 nt, Homo sapiens
cauuugcacugagacucagcuu

SEQ ID NO: 2171 - RNA, 22 nt, Homo sapiens
ccacaguggauuaaaguuacug

SEQ ID NO: 2172 - RNA, 22 nt, Homo sapiens
ccacauuaccuugcuugcucca

SEQ ID NO: 2173 - RNA, 19 nt, Homo sapiens
cauugcacuccacccuggg

SEQ ID NO: 2174 - RNA, 22 nt, Homo sapiens
cauugcacuccaccuuggguaa

SEQ ID NO: 2175 - RNA, 22 nt, Homo sapiens
cauugcacuccacuccugaaca

SEQ ID NO: 2176 - RNA, 22 nt, Homo sapiens
cauugcacuccagcccagguga

SEQ ID NO: 2177 - RNA, 22 nt, Homo sapiens
cauugcacuccagcccuggcaa

SEQ ID NO: 2178 - RNA, 22 nt, Homo sapiens
cauugcacuccagccuagccaa

SEQ ID NO: 2179 - RNA, 22 nt, Homo sapiens
cauugcacuccagccuaggcaa

SEQ ID NO: 2180 - RNA, 22 nt, Homo sapiens
cauugcacuccagccucggcaa

SEQ ID NO: 2181 - RNA, 22 nt, Homo sapiens
cauugcacuccagccugaccaa

SEQ ID NO: 2182 - RNA, 22 nt, Homo sapiens
cauugcacuccagccugaggga

SEQ ID NO: 2183 - RNA, 22 nt, Homo sapiens
cauugcacuccagccugaguga

SEQ ID NO: 2184 - RNA, 22 nt, Homo sapiens
cauugcacuccagccugcacga

SEQ ID NO: 2185 - RNA, 22 nt, Homo sapiens
cauugcacuccagccugccugg

SEQ ID NO: 2186 - RNA, 20 nt, Homo sapiens
cauugcacuccagccugcug

SEQ ID NO: 2187 - RNA, 22 nt, Homo sapiens
cauugcacuccagccugcugac

SEQ ID NO: 2188 - RNA, 22 nt, Homo sapiens
cauugcacuccagccuggcaac

SEQ ID NO: 2189 - RNA, 22 nt, Homo sapiens
cauugcacuccagccuggccaa

SEQ ID NO: 2190 - RNA, 22 nt, Homo sapiens
cauugcacuccagccuuggcaa

SEQ ID NO: 2191 - RNA, 22 nt, Homo sapiens
cauugcacuccagccuugguga

SEQ ID NO: 2192 - RNA, 22 nt, Homo sapiens
cauugcacuccagcucugggcg

SEQ ID NO: 2193 - RNA, 20 nt, Homo sapiens
cauugcacuccagcuugggc

SEQ ID NO: 2194 - RNA, 22 nt, Homo sapiens
cauugcacuccagcuugggcaa

SEQ ID NO: 2195 - RNA, 22 nt, Homo sapiens
cauugcacuccagcuugggcga

SEQ ID NO: 2196 - RNA, 22 nt, Homo sapiens
cauugcacuccagucugggcaa

SEQ ID NO: 2197 - RNA, 22 nt, Homo sapiens
cauugcacuccaucccgggaaa

SEQ ID NO: 2198 - RNA, 22 nt, Homo sapiens
cauugcacuccauccuuggcaa

SEQ ID NO: 2199 - RNA, 22 nt, Homo sapiens
cauugcacuccaucuugggcaa

SEQ ID NO: 2200 - RNA, 16 nt, Homo sapiens
cauugcacucuagccu

SEQ ID NO: 2201 - RNA, 22 nt, Homo sapiens
cauugcacucuagccucggcaa

SEQ ID NO: 2202 - RNA, 22 nt, Homo sapiens
cauugcacucuagucuggguga

SEQ ID NO: 2203 - RNA, 22 nt, Homo sapiens
cauugcacucuaucccgguggg

SEQ ID NO: 2204 - RNA, 22 nt, Homo sapiens
cauugcacucugcauuccaguc

SEQ ID NO: 2205 - RNA, 22 nt, Homo sapiens
cauugcacugcagcccgggcaa

SEQ ID NO: 2206 - RNA, 22 nt, Homo sapiens
cauugcacugcauucugggcaa

SEQ ID NO: 2207 - RNA, 22 nt, Homo sapiens
cauugcacugcuucuugggugu

SEQ ID NO: 2208 - RNA, 22 nt, Homo sapiens
cauugcacuuagacaacuuuug

SEQ ID NO: 2209 - RNA, 22 nt, Homo sapiens
cauugcagauccuucaaaugac

SEQ ID NO: 2210 - RNA, 22 nt, Homo sapiens
cauugcaguaagagugggcucu

SEQ ID NO: 2211 - RNA, 22 nt, Homo sapiens
cauugcaguggaguggggaaga

SEQ ID NO: 2212 - RNA, 22 nt, Homo sapiens
cauugcaguuuuugguguaucu

SEQ ID NO: 2213 - RNA, 22 nt, Homo sapiens
cacugcacuccagucccgucuc

SEQ ID NO: 2214 - RNA, 22 nt, Homo sapiens
cacugcaguaaauugcgucggu

SEQ ID NO: 2215 - RNA, 22 nt, Homo sapiens
cacugcgacguccgccucccgg

SEQ ID NO: 2216 - RNA, 22 nt, Homo sapiens
cacacugucuucaauggguggu

SEQ ID NO: 2217 - RNA, 22 nt, Homo sapiens
cacacugucuucauuacuguag

SEQ ID NO: 2218 - RNA, 22 nt, Homo sapiens
cacacugucuuucagaaugguu

SEQ ID NO: 2219 - RNA, 22 nt, Homo sapiens
cacacuguuuuccauggggguu

SEQ ID NO: 2220 - RNA, 22 nt, Homo sapiens
cacagaauucauuggauuaccu

SEQ ID NO: 2221 - RNA, 22 nt, Homo sapiens
cacagugaaugucaucauugcc

SEQ ID NO: 2222 - RNA, 22 nt, Homo sapiens
cacaguguucauagccaucagg

SEQ ID NO: 2223 - RNA, 22 nt, Homo sapiens
cacaguguuccagcuauuugaa

SEQ ID NO: 2224 - RNA, 22 nt, Homo sapiens
cacauugcaggaaaguucauua

SEQ ID NO: 2225 - RNA, 22 nt, Homo sapiens
cacccuaucagauguccagaga

SEQ ID NO: 2226 - RNA, 22 nt, Homo sapiens
cacccuugcagggacagcuuug

SEQ ID NO: 2227 - RNA, 22 nt, Homo sapiens
cagagguaagcaagucagcauu

SEQ ID NO: 2228 - RNA, 22 nt, Homo sapiens
cagagguauugcaaaagccuag

SEQ ID NO: 2229 - RNA, 22 nt, Homo sapiens
cacuuugguucaccugaguuuc

SEQ ID NO: 2230 - RNA, 22 nt, Homo sapiens
cagagaacauucagagcuguag

SEQ ID NO: 2231 - RNA, 22 nt, Homo sapiens
cagagaaugucuuuuuuaacca

SEQ ID NO: 2232 - RNA, 22 nt, Homo sapiens
cagagaucaugcaacugcucgc

SEQ ID NO: 2233 - RNA, 20 nt, Homo sapiens
cagcaaccugcucucuuccu

SEQ ID NO: 2234 - RNA, 22 nt, Homo sapiens
cagcacauuacaaguacuuggu

SEQ ID NO: 2235 - RNA, 22 nt, Homo sapiens
cagcagguuuuuaucaguuaag

SEQ ID NO: 2236 - RNA, 22 nt, Homo sapiens
cagcaucauucaucugggguaa

SEQ ID NO: 2237 - RNA, 22 nt, Homo sapiens
cagcuaaauuguuaaauccaag

SEQ ID NO: 2238 - RNA, 22 nt, Homo sapiens
cagccgggugagguggcuuguu

SEQ ID NO: 2239 - RNA, 22 nt, Homo sapiens
cagggaauguuauuuaauagca

SEQ ID NO: 2240 - RNA, 22 nt, Homo sapiens
caggaaugugaggguucccugc

SEQ ID NO: 2241 - RNA, 22 nt, Homo sapiens
auguggaaagcagcaugauaug

SEQ ID NO: 2242 - RNA, 22 nt, Homo sapiens
auguggcacuugacuuucucgc

SEQ ID NO: 2243 - RNA, 22 nt, Homo sapiens
auguguucaucacagcacaauu

SEQ ID NO: 2244 - RNA, 20 nt, Homo sapiens
augucaggaagggagucagg

SEQ ID NO: 2245 - RNA, 22 nt, Homo sapiens
augucuggcagaagacuucuca

SEQ ID NO: 2246 - RNA, 22 nt, Homo sapiens
augugaacaucauagaaugcac

SEQ ID NO: 2247 - RNA, 22 nt, Homo sapiens
augugaaugugaucggauaguc

SEQ ID NO: 2248 - RNA, 17 nt, Homo sapiens
augugaauguucaaaua

SEQ ID NO: 2249 - RNA, 22 nt, Homo sapiens
augugacuugugaaaaguucag

SEQ ID NO: 2250 - RNA, 22 nt, Homo sapiens
augugcaaagcacuguucagca

SEQ ID NO: 2251 - RNA, 22 nt, Homo sapiens
augugcaaauucauguucuuua

SEQ ID NO: 2252 - RNA, 22 nt, Homo sapiens
augugcaaauuuccaaacucuu

SEQ ID NO: 2253 - RNA, 22 nt, Homo sapiens
augugcaacugcuggaacaguc

SEQ ID NO: 2254 - RNA, 18 nt, Homo sapiens
augugcaauuuuguauuu

SEQ ID NO: 2255 - RNA, 22 nt, Homo sapiens
augugcacaugcuuacauguga

SEQ ID NO: 2256 - RNA, 21 nt, Homo sapiens
augugcacuaugucauuuaau

SEQ ID NO: 2257 - RNA, 22 nt, Homo sapiens
augugcagauguuacaaauugu

SEQ ID NO: 2258 - RNA, 22 nt, Homo sapiens
auuaacaucuagaguuuuggug

SEQ ID NO: 2259 - RNA, 22 nt, Homo sapiens
auuaagugcuugcagaagucca

SEQ ID NO: 2260 - RNA, 22 nt, Homo sapiens
auuaagugcuugccagugcugg

SEQ ID NO: 2261 - RNA, 22 nt, Homo sapiens
auuaaguuaggauuuugagaua

SEQ ID NO: 2262 - RNA, 22 nt, Homo sapiens
auuaaguugugccugaaaacuu

SEQ ID NO: 2263 - RNA, 22 nt, Homo sapiens
auuaaucaggcaaugcuugcua

SEQ ID NO: 2264 - RNA, 22 nt, Homo sapiens
auuaucacaguuuugcauaugg

SEQ ID NO: 2265 - RNA, 22 nt, Homo sapiens
auuauugcucccaauuuuucac

SEQ ID NO: 2266 - RNA, 22 nt, Homo sapiens
auuacacuuucuauucaaugag

SEQ ID NO: 2267 - RNA, 22 nt, Homo sapiens
auuacauagucaaggugucuca

SEQ ID NO: 2268 - RNA, 22 nt, Homo sapiens
auuacaugucuauccaugaaca

SEQ ID NO: 2269 - RNA, 22 nt, Homo sapiens
auuacccuuagacuccagagug

SEQ ID NO: 2270 - RNA, 22 nt, Homo sapiens
auguugcaguuuaauuauccua

SEQ ID NO: 2271 - RNA, 22 nt, Homo sapiens
auucccuuagcugccucagccu

SEQ ID NO: 2272 - RNA, 22 nt, Homo sapiens
auuccuuaggcccuuugguuag

SEQ ID NO: 2273 - RNA, 18 nt, Homo sapiens
auucuacaggccuuuuga

SEQ ID NO: 2274 - RNA, 22 nt, Homo sapiens
auucuauaguccuaggauuggg

SEQ ID NO: 2275 - RNA, 22 nt, Homo sapiens
auucaaagugcauguucccacu

SEQ ID NO: 2276 - RNA, 20 nt, Homo sapiens
auucaaguaugccuugagaa

SEQ ID NO: 2277 - RNA, 22 nt, Homo sapiens
auucacuuuuauagacaggucu

SEQ ID NO: 2278 - RNA, 22 nt, Homo sapiens
auucagaggggcagcugucuug

SEQ ID NO: 2279 - RNA, 22 nt, Homo sapiens
auucauagugcuaagguguauc

SEQ ID NO: 2280 - RNA, 21 nt, Homo sapiens
auuccacuuuuccuucaggga

SEQ ID NO: 2281 - RNA, 22 nt, Homo sapiens
auuccagguggcgccauucaca

SEQ ID NO: 2282 - RNA, 22 nt, Homo sapiens
auuccaguuugugagaagcugu

SEQ ID NO: 2283 - RNA, 22 nt, Homo sapiens
auuccauuuguguggaauggcu

SEQ ID NO: 2284 - RNA, 22 nt, Homo sapiens
auuccauuuguuaucacacccg

SEQ ID NO: 2285 - RNA, 22 nt, Homo sapiens
auugauaguuuaauaggaauug

SEQ ID NO: 2286 - RNA, 22 nt, Homo sapiens
auugcaaagcguagacucuaaa

SEQ ID NO: 2287 - RNA, 22 nt, Homo sapiens
auugcacaaagagggaaacuga

SEQ ID NO: 2288 - RNA, 21 nt, Homo sapiens
auugcacaauauacccaugua

SEQ ID NO: 2289 - RNA, 22 nt, Homo sapiens
auugcacacagaaucaggguaa

SEQ ID NO: 2290 - RNA, 18 nt, Homo sapiens
auugcacaccagccuggg

SEQ ID NO: 2291 - RNA, 22 nt, Homo sapiens
auugcacaccagucugggcaaa

SEQ ID NO: 2292 - RNA, 22 nt, Homo sapiens
auugcacaucugcacuacagcc

SEQ ID NO: 2293 - RNA, 22 nt, Homo sapiens
auugcacuccagccuuggggau

SEQ ID NO: 2294 - RNA, 20 nt, Homo sapiens
auugcagcaugauuuauaau

SEQ ID NO: 2295 - RNA, 22 nt, Homo sapiens
auugcagcccacccugggugau

SEQ ID NO: 2296 - RNA, 22 nt, Homo sapiens
auugcagcuugcagggugugua

SEQ ID NO: 2297 - RNA, 22 nt, Homo sapiens
auugcauaaacacauuucuuau

SEQ ID NO: 2298 - RNA, 22 nt, Homo sapiens
auugcaugucauguuuagugua

SEQ ID NO: 2299 - RNA, 22 nt, Homo sapiens
auugcuauuauuugaccauugu

SEQ ID NO: 2300 - RNA, 22 nt, Homo sapiens
auugcucaaaucaguacuugag

SEQ ID NO: 2301 - RNA, 22 nt, Homo sapiens
auuuggguaaugagugcaaggg

SEQ ID NO: 2302 - RNA, 22 nt, Homo sapiens
auuuggguuuuacaucaggcua

SEQ ID NO: 2303 - RNA, 22 nt, Homo sapiens
auuuguccugccuuuuccuccu

SEQ ID NO: 2304 - RNA, 22 nt, Homo sapiens
caaaagugauugcgguuuuugc

SEQ ID NO: 2305 - RNA, 22 nt, Homo sapiens
caaaagugguucuuauccuuuu

SEQ ID NO: 2306 - RNA, 22 nt, Homo sapiens
caaaggauucauuuccaggagu

SEQ ID NO: 2307 - RNA, 22 nt, Homo sapiens
caaaggcuuccacugcauccuu

SEQ ID NO: 2308 - RNA, 22 nt, Homo sapiens
caaaggcuucugaaacugcaga

SEQ ID NO: 2309 - RNA, 22 nt, Homo sapiens
caaagucuauucuacccuuacc

SEQ ID NO: 2310 - RNA, 22 nt, Homo sapiens
caaagucuucucauuaugucuu

SEQ ID NO: 2311 - RNA, 22 nt, Homo sapiens
caaauacuuucauguugucuug

SEQ ID NO: 2312 - RNA, 21 nt, Homo sapiens
auuguauguaaaccaaaugag

SEQ ID NO: 2313 - RNA, 22 nt, Homo sapiens
auugucacccgggcaguaagca

SEQ ID NO: 2314 - RNA, 22 nt, Homo sapiens
auugucccucuuaaucccagca

SEQ ID NO: 2315 - RNA, 20 nt, Homo sapiens
auuguccuugauuacacaga

SEQ ID NO: 2316 - RNA, 23 nt, Homo sapiens
auugaacacuuucauaugugagg

SEQ ID NO: 2317 - RNA, 22 nt, Homo sapiens
auugaacaugccauauguacca

SEQ ID NO: 2318 - RNA, 22 nt, Homo sapiens
auugaacuuuugucacugacau

SEQ ID NO: 2319 - RNA, 22 nt, Homo sapiens
auugaaucuaaaaugagucucu

SEQ ID NO: 2320 - RNA, 22 nt, Homo sapiens
auuggcagaaaucuuuauagua

SEQ ID NO: 2321 - RNA, 22 nt, Homo sapiens
auuguaauuuuagagaaagugg

SEQ ID NO: 2322 - RNA, 22 nt, Homo sapiens
auuguacuacaccauaguacug

SEQ ID NO: 2323 - RNA, 22 nt, Homo sapiens
auuguacuccagccuuggggac

SEQ ID NO: 2324 - RNA, 22 nt, Homo sapiens
caacacuguuuauuggauagcc

SEQ ID NO: 2325 - RNA, 22 nt, Homo sapiens
caacaguaaagcauuuuuaagu

SEQ ID NO: 2326 - RNA, 22 nt, Homo sapiens
caacagucagcccauccacaga

SEQ ID NO: 2327 - RNA, 22 nt, Homo sapiens
caacauccaccuccuggguuca

SEQ ID NO: 2328 - RNA, 22 nt, Homo sapiens
caagagaccugagugucauucu

SEQ ID NO: 2329 - RNA, 22 nt, Homo sapiens
caaaugacaucauuucauucaa

SEQ ID NO: 2330 - RNA, 22 nt, Homo sapiens
cacaaaguagauuagucuucca

SEQ ID NO: 2331 - RNA, 22 nt, Homo sapiens
caagugaauaguugcucucaga

SEQ ID NO: 2332 - RNA, 22 nt, Homo sapiens
caagugcuacagagaaaucuuu

SEQ ID NO: 2333 - RNA, 22 nt, Homo sapiens
caagugcucuaggauccugagu

SEQ ID NO: 2334 - RNA, 22 nt, Homo sapiens
caagugcuugaugaaugaucaa

SEQ ID NO: 2335 - RNA, 22 nt, Homo sapiens
caagugcuuucuuggggauuua

SEQ ID NO: 2336 - RNA, 22 nt, Homo sapiens
caauacuguguugaauaagagu

SEQ ID NO: 2337 - RNA, 19 nt, Homo sapiens
caauacuucuuggcauaca

SEQ ID NO: 2338 - RNA, 22 nt, Homo sapiens
caaugcauuauucucccacuuc

SEQ ID NO: 2339 - RNA, 22 nt, Homo sapiens
caauggcaaugaaauagugaga

SEQ ID NO: 2340 - RNA, 21 nt, Homo sapiens
caauggcacaaucucugcuca

SEQ ID NO: 2341 - RNA, 22 nt, Homo sapiens
caauggcacgaucucgucucac

SEQ ID NO: 2342 - RNA, 22 nt, Homo sapiens
uuucccauuguucugcucugug

SEQ ID NO: 2343 - RNA, 22 nt, Homo sapiens
uuucccugaaggcucugaaguc

SEQ ID NO: 2344 - RNA, 22 nt, Homo sapiens
uuucccuuuagcuuagugauuu

SEQ ID NO: 2345 - RNA, 16 nt, Homo sapiens
uuucccuuugguguuu

SEQ ID NO: 2346 - RNA, 22 nt, Homo sapiens
uuuccaagaugcuuacuuucuc

SEQ ID NO: 2347 - RNA, 22 nt, Homo sapiens
uuuccagguggccaacauuuua

SEQ ID NO: 2348 - RNA, 22 nt, Homo sapiens
uuucuacagggcuugccaggua

SEQ ID NO: 2349 - RNA, 22 nt, Homo sapiens
uuucuacagugaacgauuucua

SEQ ID NO: 2350 - RNA, 22 nt, Homo sapiens
uuucuauguugaccagucuaga

SEQ ID NO: 2351 - RNA, 22 nt, Homo sapiens
uuucugagaccaaaacuuguaa

SEQ ID NO: 2352 - RNA, 22 nt, Homo sapiens
uuuccuguaggaaggaaauaga

SEQ ID NO: 2353 - RNA, 22 nt, Homo sapiens
uuuccuguagggggcaaggccu

SEQ ID NO: 2354 - RNA, 22 nt, Homo sapiens
uuucugaggccucaccagaagc

SEQ ID NO: 2355 - RNA, 21 nt, Homo sapiens
uuucugggggagcauggcagg

SEQ ID NO: 2356 - RNA, 22 nt, Homo sapiens
uuucugggggugcugauggaaa

SEQ ID NO: 2357 - RNA, 19 nt, Homo sapiens
uuugaauauaaugcagcua

SEQ ID NO: 2358 - RNA, 22 nt, Homo sapiens
uuugaauggaaguuuugugaaa

SEQ ID NO: 2359 - RNA, 22 nt, Homo sapiens
uuugacuuuuagaauaugaguu

SEQ ID NO: 2360 - RNA, 22 nt, Homo sapiens
uuugagaaugcuaccagagaag

SEQ ID NO: 2361 - RNA, 23 nt, Homo sapiens
uuugagugugauaaacacuguca

SEQ ID NO: 2362 - RNA, 21 nt, Homo sapiens
uuugaucauuaaaagugaauc

SEQ ID NO: 2363 - RNA, 22 nt, Homo sapiens
uuugauguugagacuauaaagc

SEQ ID NO: 2364 - RNA, 22 nt, Homo sapiens
uuugauguugauacuaccuuca

SEQ ID NO: 2365 - RNA, 23 nt, Homo sapiens
uuucuugggcaugcuaugucagu

SEQ ID NO: 2366 - RNA, 20 nt, Homo sapiens
uuugcagaaucuaagaagag

SEQ ID NO: 2367 - RNA, 22 nt, Homo sapiens
uuugcagagucuuucgcugggc

SEQ ID NO: 2368 - RNA, 22 nt, Homo sapiens
uuucagagucaucugcccaagu

SEQ ID NO: 2369 - RNA, 17 nt, Homo sapiens
uuucagaguggaagugu

SEQ ID NO: 2370 - RNA, 18 nt, Homo sapiens
uuucaggguggacaugag

SEQ ID NO: 2371 - RNA, 19 nt, Homo sapiens
uuucaauguaaggauggag

SEQ ID NO: 2372 - RNA, 22 nt, Homo sapiens
uuucacagcaauugccuauugu

SEQ ID NO: 2373 - RNA, 22 nt, Homo sapiens
uuucaguguggcaggcauagcu

SEQ ID NO: 2374 - RNA, 22 nt, Homo sapiens
uuucauagaucaugcuuuugga

SEQ ID NO: 2375 - RNA, 22 nt, Homo sapiens
uuucauagccuucuaaugaguu

SEQ ID NO: 2376 - RNA, 22 nt, Homo sapiens
uuucauagccuuugucgucuga

SEQ ID NO: 2377 - RNA, 22 nt, Homo sapiens
uuucauaguuugcauagggcau

SEQ ID NO: 2378 - RNA, 22 nt, Homo sapiens
uuucauggaauauagucauuuu

SEQ ID NO: 2379 - RNA, 22 nt, Homo sapiens
uuucauggaggauuugcuucuu

SEQ ID NO: 2380 - RNA, 18 nt, Homo sapiens
uuucaagucuuaggugac

SEQ ID NO: 2381 - RNA, 22 nt, Homo sapiens
uuucaagugcugucuuagcugu

SEQ ID NO: 2382 - RNA, 22 nt, Homo sapiens
uuuauggagagauauuuauggu

SEQ ID NO: 2383 - RNA, 22 nt, Homo sapiens
uuuaucuguuuaaaacuguuca

SEQ ID NO: 2384 - RNA, 22 nt, Homo sapiens
uuuagguuacauauaauccaaa

SEQ ID NO: 2385 - RNA, 22 nt, Homo sapiens
uuuaguccucugaaaaucuaua

SEQ ID NO: 2386 - RNA, 22 nt, Homo sapiens
uuuaguucauuaaggaaucucc

SEQ ID NO: 2387 - RNA, 22 nt, Homo sapiens
uugugguuuuuaaaacuaggug

SEQ ID NO: 2388 - RNA, 22 nt, Homo sapiens
uuguguacuacaguaugccaca

SEQ ID NO: 2389 - RNA, 22 nt, Homo sapiens
uuuacagucuuuugugugaguc

SEQ ID NO: 2390 - RNA, 22 nt, Homo sapiens
uuuuccagugggacucccauua

SEQ ID NO: 2391 - RNA, 22 nt, Homo sapiens
uuuugcaccauccuaauaguau

SEQ ID NO: 2392 - RNA, 22 nt, Homo sapiens
uuuugcacuguuuuaucugaca

SEQ ID NO: 2393 - RNA, 19 nt, Homo sapiens
uuuugcucuuuauaccuau

SEQ ID NO: 2394 - RNA, 17 nt, Homo sapiens
uuuuggauuagaaaucc

SEQ ID NO: 2395 - RNA, 22 nt, Homo sapiens
uuuuggcuagaaauauaccucc

SEQ ID NO: 2396 - RNA, 22 nt, Homo sapiens
uuuuggcucugucuguaucuuu

SEQ ID NO: 2397 - RNA, 22 nt, Homo sapiens
uuuuuggaggagguuagaucau

SEQ ID NO: 2398 - RNA, 22 nt, Homo sapiens
uuuuuggauaaugguacaugua

SEQ ID NO: 2399 - RNA, 22 nt, Homo sapiens
uuuuuuaguuagcugggcauga

SEQ ID NO: 2400 - RNA, 21 nt, Homo sapiens
uuuggcuucucugcugcagcc

SEQ ID NO: 2401 - RNA, 18 nt, Homo sapiens
uuuggcuguucaugacuc

SEQ ID NO: 2402 - RNA, 22 nt, Homo sapiens
uuuggcuuaagauugacugcaa

SEQ ID NO: 2403 - RNA, 19 nt, Homo sapiens
uuugcauagugagaauaua

SEQ ID NO: 2404 - RNA, 22 nt, Homo sapiens
uuugccuuugugauauggucua

SEQ ID NO: 2405 - RNA, 22 nt, Homo sapiens
uuugcuauagugaauagugcug

SEQ ID NO: 2406 - RNA, 22 nt, Homo sapiens
uuugcuugaggucuagcuaccc

SEQ ID NO: 2407 - RNA, 22 nt, Homo sapiens
uuuggcuuugagaagcagugga

SEQ ID NO: 2408 - RNA, 22 nt, Homo sapiens
uuuggcuuuuguaauaacugcc

SEQ ID NO: 2409 - RNA, 22 nt, Homo sapiens
uuugggaaugaguuuaucauuu

SEQ ID NO: 2410 - RNA, 22 nt, Homo sapiens
uuugguaguuuguugggaccca

SEQ ID NO: 2411 - RNA, 22 nt, Homo sapiens
uuuggucacugccgccgccagc

SEQ ID NO: 2412 - RNA, 18 nt, Homo sapiens
uuugguccuuuauaaaca

SEQ ID NO: 2413 - RNA, 22 nt, Homo sapiens
uuugguguauaaaaaugcuagu

SEQ ID NO: 2414 - RNA, 22 nt, Homo sapiens
uuuguauguuggagauuggaga

SEQ ID NO: 2415 - RNA, 19 nt, Homo sapiens
uuuguauguuuccaguaau

SEQ ID NO: 2416 - RNA, 22 nt, Homo sapiens
uuuguccccgcccagaucucau

SEQ ID NO: 2417 - RNA, 22 nt, Homo sapiens
uuugucccucucaccaacgggg

SEQ ID NO: 2418 - RNA, 22 nt, Homo sapiens
uuugucccuuugcaguggcaca

SEQ ID NO: 2419 - RNA, 19 nt, Homo sapiens
uuuguccugcccuuucuca

SEQ ID NO: 2420 - RNA, 22 nt, Homo sapiens
uuugugaaugucauaagcucca

SEQ ID NO: 2421 - RNA, 23 nt, Homo sapiens
uuuguguccccacccaaaucuca

SEQ ID NO: 2422 - RNA, 22 nt, Homo sapiens
uuuuaguggaauauuuacaguu

SEQ ID NO: 2423 - RNA, 22 nt, Homo sapiens
uuuuaguggacaaagguauuua

SEQ ID NO: 2424 - RNA, 22 nt, Homo sapiens
uuaauguaauugauugauugac

SEQ ID NO: 2425 - RNA, 22 nt, Homo sapiens
uuaauguaucuaucacaucaca

SEQ ID NO: 2426 - RNA, 22 nt, Homo sapiens
uuaauuguccaaguucaucucu

SEQ ID NO: 2427 - RNA, 21 nt, Homo sapiens
uuacaauggcuccuugaaggu

SEQ ID NO: 2428 - RNA, 22 nt, Homo sapiens
uuacagauggauggcagcuggc

SEQ ID NO: 2429 - RNA, 22 nt, Homo sapiens
uuacagcagugccccacuccca

SEQ ID NO: 2430 - RNA, 22 nt, Homo sapiens
uuacaguagaugaggguauaau

SEQ ID NO: 2431 - RNA, 22 nt, Homo sapiens
uuacaguaugaguaagaguucu

SEQ ID NO: 2432 - RNA, 22 nt, Homo sapiens
uuacaguauugcaaggacuagg

SEQ ID NO: 2433 - RNA, 22 nt, Homo sapiens
uuacaguucugguggagaggua

SEQ ID NO: 2434 - RNA, 22 nt, Homo sapiens
uuacaguugugagccaccaugc

SEQ ID NO: 2435 - RNA, 22 nt, Homo sapiens
uuacaucaucacauuaguuugc

SEQ ID NO: 2436 - RNA, 22 nt, Homo sapiens
uuacaugucuugguaagguuag

SEQ ID NO: 2437 - RNA, 22 nt, Homo sapiens
uuaaggaaagcauuuaauucag

SEQ ID NO: 2438 - RNA, 22 nt, Homo sapiens
uuaaggaaggagucuuaaaugg

SEQ ID NO: 2439 - RNA, 22 nt, Homo sapiens
uuaaggcuuuaaguaaacacag

SEQ ID NO: 2440 - RNA, 22 nt, Homo sapiens
uuaaguaaucagagaagagaac

SEQ ID NO: 2441 - RNA, 22 nt, Homo sapiens
uuaagucacacuagacaacuga

SEQ ID NO: 2442 - RNA, 22 nt, Homo sapiens
uuaagugcucaguuacucaguu

SEQ ID NO: 2443 - RNA, 22 nt, Homo sapiens
uuaaguuaggcuucagcagucu

SEQ ID NO: 2444 - RNA, 22 nt, Homo sapiens
uuagaauggaaaugcgagguua

SEQ ID NO: 2445 - RNA, 22 nt, Homo sapiens
uuagaucaacauggaacucuau

SEQ ID NO: 2446 - RNA, 22 nt, Homo sapiens
uuagcaauagccugcaucugca

SEQ ID NO: 2447 - RNA, 22 nt, Homo sapiens
uuaaaagcuaucuccaagguca

SEQ ID NO: 2448 - RNA, 22 nt, Homo sapiens
uuaaaaguauaggccuggcaua

SEQ ID NO: 2449 - RNA, 22 nt, Homo sapiens
uuacuugagauggggugucacu

SEQ ID NO: 2450 - RNA, 22 nt, Homo sapiens
uuaauacugcuuaacuuuagga

SEQ ID NO: 2451 - RNA, 22 nt, Homo sapiens
uuaaucaggccguuuccuaaga

SEQ ID NO: 2452 - RNA, 22 nt, Homo sapiens
uuaaucuguucucuguauucua

SEQ ID NO: 2453 - RNA, 22 nt, Homo sapiens
uuaaugaacuuuauuuuguaga

SEQ ID NO: 2454 - RNA, 22 nt, Homo sapiens
uuaccuuuuuaagacagguuag

SEQ ID NO: 2455 - RNA, 22 nt, Homo sapiens
uuacugcucuuuugucaugagu

SEQ ID NO: 2456 - RNA, 22 nt, Homo sapiens
uuacuguagugucauaucguau

SEQ ID NO: 2457 - RNA, 22 nt, Homo sapiens
uuacuguauagaaucaucuuga

SEQ ID NO: 2458 - RNA, 22 nt, Homo sapiens
uuaacacugccauugauacugu

SEQ ID NO: 2459 - RNA, 22 nt, Homo sapiens
uuaacagcacaugcugucccuu

SEQ ID NO: 2460 - RNA, 22 nt, Homo sapiens
uuaacagcacuacguggggauc

SEQ ID NO: 2461 - RNA, 22 nt, Homo sapiens
uuaacagucacuuagcucauuu

SEQ ID NO: 2462 - RNA, 22 nt, Homo sapiens
uuaagaugcauuuugaaguuaa

SEQ ID NO: 2463 - RNA, 20 nt, Homo sapiens
uuaaaucuagugcagacuca

SEQ ID NO: 2464 - RNA, 22 nt, Homo sapiens
uuaaaugcacauacuugagaaa

SEQ ID NO: 2465 - RNA, 22 nt, Homo sapiens
uuaaaugcauagaauguguagu

SEQ ID NO: 2466 - RNA, 22 nt, Homo sapiens
uuaaaugcuagaauuuucuuug

SEQ ID NO: 2467 - RNA, 22 nt, Homo sapiens
uuaaaugcucacauaaagguag

SEQ ID NO: 2468 - RNA, 22 nt, Homo sapiens
uguggaguguaugugacagaga

SEQ ID NO: 2469 - RNA, 22 nt, Homo sapiens
uuaaagcuggcguuacaguuug

SEQ ID NO: 2470 - RNA, 22 nt, Homo sapiens
uuaaagugaucauaaggauagu

SEQ ID NO: 2471 - RNA, 22 nt, Homo sapiens
uuaaaguguuugcagacaggug

SEQ ID NO: 2472 - RNA, 22 nt, Homo sapiens
uuaaauacagcaugguguuucu

SEQ ID NO: 2473 - RNA, 22 nt, Homo sapiens
ugugguuuuaguaaaacuaugu

SEQ ID NO: 2474 - RNA, 22 nt, Homo sapiens
ugugguuuuucacauuuagaga

SEQ ID NO: 2475 - RNA, 22 nt, Homo sapiens
ugugguuuuuuucuccaauagg

SEQ ID NO: 2476 - RNA, 22 nt, Homo sapiens
uguguaauaccuuugacuauau

SEQ ID NO: 2477 - RNA, 22 nt, Homo sapiens
ugugucuccugaaaauucacau

SEQ ID NO: 2478 - RNA, 22 nt, Homo sapiens
ugugucuuuuaucacacaaugu

SEQ ID NO: 2479 - RNA, 22 nt, Homo sapiens
uguucuugaguugggaguacaa

SEQ ID NO: 2480 - RNA, 19 nt, Homo sapiens
uguugcacauaucaauaug

SEQ ID NO: 2481 - RNA, 22 nt, Homo sapiens
uguugcacuccagccuagguga

SEQ ID NO: 2482 - RNA, 22 nt, Homo sapiens
uguugcacuccagccugggcaa

SEQ ID NO: 2483 - RNA, 22 nt, Homo sapiens
uguugcacuccagccuggguga

SEQ ID NO: 2484 - RNA, 22 nt, Homo sapiens
uguugcacuccauccugggcga

SEQ ID NO: 2485 - RNA, 22 nt, Homo sapiens
uguugcacucuagccugggcaa

SEQ ID NO: 2486 - RNA, 18 nt, Homo sapiens
uguugguguucacucacu

SEQ ID NO: 2487 - RNA, 22 nt, Homo sapiens
uuauacuacuauaaagagguag

SEQ ID NO: 2488 - RNA, 22 nt, Homo sapiens
uuauacucgucugaaugauucu

SEQ ID NO: 2489 - RNA, 22 nt, Homo sapiens
uuauagcuaacaucugugaaaa

SEQ ID NO: 2490 - RNA, 20 nt, Homo sapiens
uuauagcuacaucuugacug

SEQ ID NO: 2491 - RNA, 22 nt, Homo sapiens
uuaggcuuuauugaaaacaaua

SEQ ID NO: 2492 - RNA, 22 nt, Homo sapiens
uuagggaguaaucuaaaaaugg

SEQ ID NO: 2493 - RNA, 22 nt, Homo sapiens
uuagucaaguguacugugaaug

SEQ ID NO: 2494 - RNA, 22 nt, Homo sapiens
uuagugaaugcaccacuucuga

SEQ ID NO: 2495 - RNA, 22 nt, Homo sapiens
uuaucauagugcaguuuucuga

SEQ ID NO: 2496 - RNA, 17 nt, Homo sapiens
uuaugagacuucuuagc

SEQ ID NO: 2497 - RNA, 22 nt, Homo sapiens
uuaugcagcaaagugcuugaaa

SEQ ID NO: 2498 - RNA, 22 nt, Homo sapiens
uuaugucuuugagcaaugcugu

SEQ ID NO: 2499 - RNA, 22 nt, Homo sapiens
uuaugucuuuuguguucagcua

SEQ ID NO: 2500 - RNA, 22 nt, Homo sapiens
uuauuagagauauuugguuagg

SEQ ID NO: 2501 - RNA, 22 nt, Homo sapiens
uuauuagguuaaccuauagcua

SEQ ID NO: 2502 - RNA, 22 nt, Homo sapiens
uuauuagguuagugcaaaaguu

SEQ ID NO: 2503 - RNA, 22 nt, Homo sapiens
uuauuagguugguggaaaagua

SEQ ID NO: 2504 - RNA, 22 nt, Homo sapiens
uuauucauuaacagggaccaaa

SEQ ID NO: 2505 - RNA, 22 nt, Homo sapiens
uuauucauuaauugcuaagguu

SEQ ID NO: 2506 - RNA, 22 nt, Homo sapiens
uucaaaguaaaaauguguucac

SEQ ID NO: 2507 - RNA, 22 nt, Homo sapiens
uucaaaguaaagggauggagac

SEQ ID NO: 2508 - RNA, 22 nt, Homo sapiens
uucaaaguguugguuuugggcu

SEQ ID NO: 2509 - RNA, 22 nt, Homo sapiens
uucaaaguuggaggacaaacug

SEQ ID NO: 2510 - RNA, 22 nt, Homo sapiens
uucaacagugauggccuuugua

SEQ ID NO: 2511 - RNA, 22 nt, Homo sapiens
uucaagaauuaaaguggcuuuu

SEQ ID NO: 2512 - RNA, 22 nt, Homo sapiens
uucaagcuauggugaucuuuuc

SEQ ID NO: 2513 - RNA, 22 nt, Homo sapiens
uucaagucaacaagcacuugag

SEQ ID NO: 2514 - RNA, 22 nt, Homo sapiens
uucaagucaaggaaagaggucu

SEQ ID NO: 2515 - RNA, 22 nt, Homo sapiens
uucaagucuuggcuuugccacc

SEQ ID NO: 2516 - RNA, 22 nt, Homo sapiens
uucaauacuguugauccuuaug

SEQ ID NO: 2517 - RNA, 22 nt, Homo sapiens
uucaauaugucauuggcaggca

SEQ ID NO: 2518 - RNA, 22 nt, Homo sapiens
uucacacugggccuacucugug

SEQ ID NO: 2519 - RNA, 22 nt, Homo sapiens
uucacagagagaacucaaacca

SEQ ID NO: 2520 - RNA, 22 nt, Homo sapiens
uucacaguacucccuggaauua

SEQ ID NO: 2521 - RNA, 22 nt, Homo sapiens
uucacagucacccuucuccaug

SEQ ID NO: 2522 - RNA, 22 nt, Homo sapiens
uucacagugugaucuaugggca

SEQ ID NO: 2523 - RNA, 23 nt, Homo sapiens
uucaccguguuggccaggcuggu

SEQ ID NO: 2524 - RNA, 22 nt, Homo sapiens
uucacuguagccucagccucuu

SEQ ID NO: 2525 - RNA, 22 nt, Homo sapiens
uucacuguuaagcaguuaaacu

SEQ ID NO: 2526 - RNA, 22 nt, Homo sapiens
uuagaacaguguuugccucgcu

SEQ ID NO: 2527 - RNA, 22 nt, Homo sapiens
uuagaacuagaggaguuugagu

SEQ ID NO: 2528 - RNA, 22 nt, Homo sapiens
uuauugcacuccagccugggua

SEQ ID NO: 2529 - RNA, 16 nt, Homo sapiens
uuauugcauucuucuc

SEQ ID NO: 2530 - RNA, 22 nt, Homo sapiens
uucaggcaccauggucauugau

SEQ ID NO: 2531 - RNA, 22 nt, Homo sapiens
uucaggcaccauugucauugau

SEQ ID NO: 2532 - RNA, 22 nt, Homo sapiens
uucagagugaggcucucggaac

SEQ ID NO: 2533 - RNA, 20 nt, Homo sapiens
uucagcaaaggaaugggagu

SEQ ID NO: 2534 - RNA, 22 nt, Homo sapiens
uucagggacuuuagacaagaga

SEQ ID NO: 2535 - RNA, 22 nt, Homo sapiens
uucaguaaauguucuuacuaua

SEQ ID NO: 2536 - RNA, 22 nt, Homo sapiens
uucaguagucaaaagauaaggg

SEQ ID NO: 2537 - RNA, 22 nt, Homo sapiens
uucaguauugcaccuggagucc

SEQ ID NO: 2538 - RNA, 22 nt, Homo sapiens
uucaguccauuuccuuggucac

SEQ ID NO: 2539 - RNA, 20 nt, Homo sapiens
uucagugcagguaacaaucc

SEQ ID NO: 2540 - RNA, 22 nt, Homo sapiens
uucauacaguggcugcacucca

SEQ ID NO: 2541 - RNA, 22 nt, Homo sapiens
uucauaguaacaguaacuaugg

SEQ ID NO: 2542 - RNA, 22 nt, Homo sapiens
uucauagucacauucgaugucu

SEQ ID NO: 2543 - RNA, 22 nt, Homo sapiens
uucauagucuaugcaaguaaga

SEQ ID NO: 2544 - RNA, 22 nt, Homo sapiens
uucauaguucuuuuagucauua

SEQ ID NO: 2545 - RNA, 22 nt, Homo sapiens
uucauaguuuauacugauauuu

SEQ ID NO: 2546 - RNA, 20 nt, Homo sapiens
uucaucaggauauuggucua

SEQ ID NO: 2547 - RNA, 23 nt, Homo sapiens
uucaucagggauauuggccugaa

SEQ ID NO: 2548 - RNA, 22 nt, Homo sapiens
uucaucaguuauauuggccuga

SEQ ID NO: 2549 - RNA, 22 nt, Homo sapiens
uucaucaguugagcugguugcu

SEQ ID NO: 2550 - RNA, 22 nt, Homo sapiens
uucaucuggcaauucagagauu

SEQ ID NO: 2551 - RNA, 22 nt, Homo sapiens
uggucuucuggccuccagaacc

SEQ ID NO: 2552 - RNA, 22 nt, Homo sapiens
ugguccuuuccauuggagacac

SEQ ID NO: 2553 - RNA, 22 nt, Homo sapiens
uggucaguugaguccuugccaa

SEQ ID NO: 2554 - RNA, 21 nt, Homo sapiens
uggucaguuuucucacuagga

SEQ ID NO: 2555 - RNA, 21 nt, Homo sapiens
uggucccauaagauuacaaug

SEQ ID NO: 2556 - RNA, 21 nt, Homo sapiens
uggucccauaagauuauaaug

SEQ ID NO: 2557 - RNA, 22 nt, Homo sapiens
uggucccaugaacuuuagguca

SEQ ID NO: 2558 - RNA, 22 nt, Homo sapiens
uggguaggaccagaaaugcacu

SEQ ID NO: 2559 - RNA, 23 nt, Homo sapiens
uggguucauucuugaagucagug

SEQ ID NO: 2560 - RNA, 22 nt, Homo sapiens
ugguaccuuuuaaugacuaauu

SEQ ID NO: 2561 - RNA, 22 nt, Homo sapiens
ugguauguaugauuaacaugga

SEQ ID NO: 2562 - RNA, 22 nt, Homo sapiens
uggucaccugaauuaugcaugu

SEQ ID NO: 2563 - RNA, 20 nt, Homo sapiens
uggucaccuucaggagguuc

SEQ ID NO: 2564 - RNA, 22 nt, Homo sapiens
uggucaccuucuugcucugucu

SEQ ID NO: 2565 - RNA, 22 nt, Homo sapiens
uguaaaucugguuaauuggaua

SEQ ID NO: 2566 - RNA, 22 nt, Homo sapiens
uguaacacacacuguuuacucc

SEQ ID NO: 2567 - RNA, 22 nt, Homo sapiens
uguaaugaucaaaucagaguaa

SEQ ID NO: 2568 - RNA, 22 nt, Homo sapiens
ugguguuugagaagcugauguc

SEQ ID NO: 2569 - RNA, 20 nt, Homo sapiens
uggugguuuuaugugguuua

SEQ ID NO: 2570 - RNA, 22 nt, Homo sapiens
uggugagaaaugagaugcuuuu

SEQ ID NO: 2571 - RNA, 22 nt, Homo sapiens
uguagcuuuugagauuuauauu

SEQ ID NO: 2572 - RNA, 22 nt, Homo sapiens
uguagucauuccuuuuugcuuu

SEQ ID NO: 2573 - RNA, 22 nt, Homo sapiens
uguaugagagacauggcugcuu

SEQ ID NO: 2574 - RNA, 22 nt, Homo sapiens
uguaugagagugaaagcauuuc

SEQ ID NO: 2575 - RNA, 22 nt, Homo sapiens
uguaugaguuguuuauaaauuu

SEQ ID NO: 2576 - RNA, 22 nt, Homo sapiens
uguaauuuaaaugauccuugga

SEQ ID NO: 2577 - RNA, 22 nt, Homo sapiens
uguacuucaagauuaugguuua

SEQ ID NO: 2578 - RNA, 22 nt, Homo sapiens
uguagcagccauaaacacagug

SEQ ID NO: 2579 - RNA, 22 nt, Homo sapiens
ugucacagagauuuugguaugu

SEQ ID NO: 2580 - RNA, 22 nt, Homo sapiens
ugucacaguuuguacuuuauag

SEQ ID NO: 2581 - RNA, 22 nt, Homo sapiens
ugucacccuuuauccauuuccu

SEQ ID NO: 2582 - RNA, 22 nt, Homo sapiens
ugucaguuucuugagauggaac

SEQ ID NO: 2583 - RNA, 22 nt, Homo sapiens
ugucaguuuuaacuagggaaua

SEQ ID NO: 2584 - RNA, 22 nt, Homo sapiens
ugucauagaugauuuuuuucgg

SEQ ID NO: 2585 - RNA, 22 nt, Homo sapiens
ugucaugaacucacauucuggg

SEQ ID NO: 2586 - RNA, 22 nt, Homo sapiens
ugucauguaaagaguaaauggu

SEQ ID NO: 2587 - RNA, 22 nt, Homo sapiens
ugucauguuucuacugaccaaa

SEQ ID NO: 2588 - RNA, 22 nt, Homo sapiens
ugucauucaggaaauucuaagu

SEQ ID NO: 2589 - RNA, 22 nt, Homo sapiens
ugucuugagagaggacaugacu

SEQ ID NO: 2590 - RNA, 22 nt, Homo sapiens
ugucuuguagacaauguauagu

SEQ ID NO: 2591 - RNA, 22 nt, Homo sapiens
ugugaaaucagauagccuuuuu

SEQ ID NO: 2592 - RNA, 22 nt, Homo sapiens
ugugaacaaaauuuguugcaua

SEQ ID NO: 2593 - RNA, 22 nt, Homo sapiens
ugugaacacagaggcuauggca

SEQ ID NO: 2594 - RNA, 22 nt, Homo sapiens
ugugaacagaauuagucaccua

SEQ ID NO: 2595 - RNA, 19 nt, Homo sapiens
ugugaacaucacagagugu

SEQ ID NO: 2596 - RNA, 21 nt, Homo sapiens
ugugaacauguuggguggcau

SEQ ID NO: 2597 - RNA, 22 nt, Homo sapiens
ugugaacauuuuguauauauua

SEQ ID NO: 2598 - RNA, 22 nt, Homo sapiens
ugugaagaaagucauugguagc

SEQ ID NO: 2599 - RNA, 22 nt, Homo sapiens
ugugaagauggacuaauauagu

SEQ ID NO: 2600 - RNA, 22 nt, Homo sapiens
ugugaagauguuucuuaauuga

SEQ ID NO: 2601 - RNA, 22 nt, Homo sapiens
ugugaauggugcugcaaugaac

SEQ ID NO: 2602 - RNA, 22 nt, Homo sapiens
ugugaauguaagaaaauccaac

SEQ ID NO: 2603 - RNA, 18 nt, Homo sapiens
ugugacauugagcauguc

SEQ ID NO: 2604 - RNA, 22 nt, Homo sapiens
uguggaaauaaaagaaagguua

SEQ ID NO: 2605 - RNA, 22 nt, Homo sapiens
ugugcucaucucagucaacugu

SEQ ID NO: 2606 - RNA, 20 nt, Homo sapiens
ugugauuauuuaguugcaug

SEQ ID NO: 2607 - RNA, 17 nt, Homo sapiens
ugugauugaagucaucc

SEQ ID NO: 2608 - RNA, 22 nt, Homo sapiens
ugugcaaucagcuucauuacau

SEQ ID NO: 2609 - RNA, 23 nt, Homo sapiens
ugugcacauuuacauauauacac

SEQ ID NO: 2610 - RNA, 22 nt, Homo sapiens
ugugcauaugucuuuauaguag

SEQ ID NO: 2611 - RNA, 22 nt, Homo sapiens
ugugcaugacagcauacaaacg

SEQ ID NO: 2612 - RNA, 22 nt, Homo sapiens
ugugccacuccagcucuagcuu

SEQ ID NO: 2613 - RNA, 22 nt, Homo sapiens
ugugccacugcacucccgccug

SEQ ID NO: 2614 - RNA, 22 nt, Homo sapiens
ugugccacugcacuccugccug

SEQ ID NO: 2615 - RNA, 22 nt, Homo sapiens
ugugccacugcacucuggccug

SEQ ID NO: 2616 - RNA, 22 nt, Homo sapiens
ugugccacugcacuucagccug

SEQ ID NO: 2617 - RNA, 22 nt, Homo sapiens
uguauguagugaccagggccag

SEQ ID NO: 2618 - RNA, 22 nt, Homo sapiens
uguauguuguaagacuuagacc

SEQ ID NO: 2619 - RNA, 16 nt, Homo sapiens
uguauugcuaaaaaga

SEQ ID NO: 2620 - RNA, 22 nt, Homo sapiens
uguauuuguuguuaaauggaga

SEQ ID NO: 2621 - RNA, 16 nt, Homo sapiens
uguccaaauaaauaca

SEQ ID NO: 2622 - RNA, 22 nt, Homo sapiens
ugucccaguuggguauugaauu

SEQ ID NO: 2623 - RNA, 21 nt, Homo sapiens
ugugaccucugucucugaguc

SEQ ID NO: 2624 - RNA, 22 nt, Homo sapiens
ugugauaguuggcuaaagcagu

SEQ ID NO: 2625 - RNA, 22 nt, Homo sapiens
ugugaugaagaguccaagaaca

SEQ ID NO: 2626 - RNA, 22 nt, Homo sapiens
uugacagaccuuggucauaucc

SEQ ID NO: 2627 - RNA, 20 nt, Homo sapiens
uugacaguggguuguuaaag

SEQ ID NO: 2628 - RNA, 22 nt, Homo sapiens
uugacauaaucauuucacagug

SEQ ID NO: 2629 - RNA, 22 nt, Homo sapiens
uugacauaguuucugaaauaga

SEQ ID NO: 2630 - RNA, 22 nt, Homo sapiens
uugacauugcuguaguguccag

SEQ ID NO: 2631 - RNA, 22 nt, Homo sapiens
uugaccuaugggaguuugacua

SEQ ID NO: 2632 - RNA, 22 nt, Homo sapiens
uugacuucagagcugauucaag

SEQ ID NO: 2633 - RNA, 22 nt, Homo sapiens
uugagguaauaaacagccauuc

SEQ ID NO: 2634 - RNA, 22 nt, Homo sapiens
uugaguuuaucuaaagaccugg

SEQ ID NO: 2635 - RNA, 22 nt, Homo sapiens
uugaguuugaguauucuaaagc

SEQ ID NO: 2636 - RNA, 22 nt, Homo sapiens
uugauauucugagaagcugaag

SEQ ID NO: 2637 - RNA, 22 nt, Homo sapiens
uugaugauguuucugccuugcc

SEQ ID NO: 2638 - RNA, 22 nt, Homo sapiens
uugauagacacauauccaugug

SEQ ID NO: 2639 - RNA, 22 nt, Homo sapiens
uugauagacaucugaguuguug

SEQ ID NO: 2640 - RNA, 22 nt, Homo sapiens
uugauagaucagggauuugauu

SEQ ID NO: 2641 - RNA, 22 nt, Homo sapiens
uugauaguuuuaaaauuaaucu

SEQ ID NO: 2642 - RNA, 22 nt, Homo sapiens
uugauauguaguuggacuugau

SEQ ID NO: 2643 - RNA, 22 nt, Homo sapiens
uugauauguuguuagauucagu

SEQ ID NO: 2644 - RNA, 22 nt, Homo sapiens
uugauauguuguuggauucacu

SEQ ID NO: 2645 - RNA, 22 nt, Homo sapiens
uucugaguggcuuucaacacug

SEQ ID NO: 2646 - RNA, 22 nt, Homo sapiens
uucuggaaaucagcagagggug

SEQ ID NO: 2647 - RNA, 22 nt, Homo sapiens
uucuuagucauguaauagucca

SEQ ID NO: 2648 - RNA, 18 nt, Homo sapiens
uucuuguguugauauuuu

SEQ ID NO: 2649 - RNA, 22 nt, Homo sapiens
uugacaaggagccauugcaucu

SEQ ID NO: 2650 - RNA, 22 nt, Homo sapiens
uugacaaugcacugugcuaagu

SEQ ID NO: 2651 - RNA, 22 nt, Homo sapiens
uucuggccccucccaaucucau

SEQ ID NO: 2652 - RNA, 22 nt, Homo sapiens
uucuggccuccauuuuucuccu

SEQ ID NO: 2653 - RNA, 22 nt, Homo sapiens
uugagacggagucuugcucuuu

SEQ ID NO: 2654 - RNA, 22 nt, Homo sapiens
uugagacggaguuuugcucuug

SEQ ID NO: 2655 - RNA, 22 nt, Homo sapiens
uugagagaaaaaauuuauuggu

SEQ ID NO: 2656 - RNA, 22 nt, Homo sapiens
uugagagaaaaggccaugccuu

SEQ ID NO: 2657 - RNA, 22 nt, Homo sapiens
uugagauaggagcuguuguucu

SEQ ID NO: 2658 - RNA, 22 nt, Homo sapiens
uugagaucaugcuacugcacuc

SEQ ID NO: 2659 - RNA, 22 nt, Homo sapiens
uugagaugauggauaugcuaau

SEQ ID NO: 2660 - RNA, 22 nt, Homo sapiens
uugagauggaguuucaauauug

SEQ ID NO: 2661 - RNA, 22 nt, Homo sapiens
uugagauguaagauguuaauau

SEQ ID NO: 2662 - RNA, 22 nt, Homo sapiens
uugagauguauguauauaaugu

SEQ ID NO: 2663 - RNA, 22 nt, Homo sapiens
uugagauuuuccucaaauauuu

SEQ ID NO: 2664 - RNA, 22 nt, Homo sapiens
uugagcaauccuccugccaugu

SEQ ID NO: 2665 - RNA, 22 nt, Homo sapiens
uugagccaaggauugucuuucc

SEQ ID NO: 2666 - RNA, 22 nt, Homo sapiens
uugagcccuggagguggaggcu

SEQ ID NO: 2667 - RNA, 22 nt, Homo sapiens
uugaggaaugucauuuguguuu

SEQ ID NO: 2668 - RNA, 22 nt, Homo sapiens
uugaggaaugugauuucaaaua

SEQ ID NO: 2669 - RNA, 22 nt, Homo sapiens
uugaaagaaaggagacugaguu

SEQ ID NO: 2670 - RNA, 22 nt, Homo sapiens
uugaaagacagaggggcaaguu

SEQ ID NO: 2671 - RNA, 22 nt, Homo sapiens
uugaaagacaucaccuacugcu

SEQ ID NO: 2672 - RNA, 22 nt, Homo sapiens
uugaaagaugaacuggauugga

SEQ ID NO: 2673 - RNA, 22 nt, Homo sapiens
uugaaagcuaucagagauucca

SEQ ID NO: 2674 - RNA, 22 nt, Homo sapiens
uugaaagcuaucucaaaucgcu

SEQ ID NO: 2675 - RNA, 22 nt, Homo sapiens
uugaaagucauuucuucuaagu

SEQ ID NO: 2676 - RNA, 22 nt, Homo sapiens
uugaaagucuaggcuuacagua

SEQ ID NO: 2677 - RNA, 22 nt, Homo sapiens
uugaaauguuuagaaguuugga

SEQ ID NO: 2678 - RNA, 22 nt, Homo sapiens
uugaaccauucuuuugauagag

SEQ ID NO: 2679 - RNA, 22 nt, Homo sapiens
uugaacuagaaccugcaaauuu

SEQ ID NO: 2680 - RNA, 22 nt, Homo sapiens
uugaaggaggugcucacucucg

SEQ ID NO: 2681 - RNA, 22 nt, Homo sapiens
uugaaguagaaagacgaaauuu

SEQ ID NO: 2682 - RNA, 22 nt, Homo sapiens
uugaagugaagaacaauaucac

SEQ ID NO: 2683 - RNA, 22 nt, Homo sapiens
uugaauagaagguuuuuuguuc

SEQ ID NO: 2684 - RNA, 22 nt, Homo sapiens
uugaauagaaguguugaaagug

SEQ ID NO: 2685 - RNA, 18 nt, Homo sapiens
uugaauaguguccaaucu

SEQ ID NO: 2686 - RNA, 22 nt, Homo sapiens
uucucuguggauugggugagag

SEQ ID NO: 2687 - RNA, 22 nt, Homo sapiens
uucuaaacaucuuacaaugcau

SEQ ID NO: 2688 - RNA, 22 nt, Homo sapiens
uucuaaguaauuuugcaugccu

SEQ ID NO: 2689 - RNA, 22 nt, Homo sapiens
uucuacaggcuguucaagaagc

SEQ ID NO: 2690 - RNA, 20 nt, Homo sapiens
uucuacagucacaggaagau

SEQ ID NO: 2691 - RNA, 22 nt, Homo sapiens
uucuacagugacugcagccaua

SEQ ID NO: 2692 - RNA, 22 nt, Homo sapiens
uucuauggucacagaugcuuga

SEQ ID NO: 2693 - RNA, 20 nt, Homo sapiens
uucuauggugaugaguccug

SEQ ID NO: 2694 - RNA, 22 nt, Homo sapiens
uucuauguuugaaaaugccaaa

SEQ ID NO: 2695 - RNA, 22 nt, Homo sapiens
uucucaauggcaacuuguugcu

SEQ ID NO: 2696 - RNA, 21 nt, Homo sapiens
uucucagaggcaggggauaaa

SEQ ID NO: 2697 - RNA, 22 nt, Homo sapiens
uucucaguuccuacuuugguga

SEQ ID NO: 2698 - RNA, 17 nt, Homo sapiens
uucucaguucugaucuc

SEQ ID NO: 2699 - RNA, 22 nt, Homo sapiens
uucuccugguggacccuaaacg

SEQ ID NO: 2700 - RNA, 20 nt, Homo sapiens
uuccuuaggcauuggaagaa

SEQ ID NO: 2701 - RNA, 22 nt, Homo sapiens
uuccuugugacuaguagugacc

SEQ ID NO: 2702 - RNA, 22 nt, Homo sapiens
uucccugagcaucuguugagcc

SEQ ID NO: 2703 - RNA, 22 nt, Homo sapiens
uuccuggagaguuuucccaaag

SEQ ID NO: 2704 - RNA, 22 nt, Homo sapiens
uucccuuucugccuugaaucuu

SEQ ID NO: 2705 - RNA, 20 nt, Homo sapiens
uuccagcacauuagggaagc

SEQ ID NO: 2706 - RNA, 22 nt, Homo sapiens
uuccaguguguucauccucaga

SEQ ID NO: 2707 - RNA, 22 nt, Homo sapiens
uuccaguuauuauaccucuuaa

SEQ ID NO: 2708 - RNA, 22 nt, Homo sapiens
uucauggaacaaguggguucaa

SEQ ID NO: 2709 - RNA, 22 nt, Homo sapiens
uucauggaauauugaccauuuu

SEQ ID NO: 2710 - RNA, 22 nt, Homo sapiens
uucauguaauauuucacagcuu

SEQ ID NO: 2711 - RNA, 22 nt, Homo sapiens
uucauguaauuccauaagguaa

SEQ ID NO: 2712 - RNA, 22 nt, Homo sapiens
uucaugucuuggcuguuagagu

SEQ ID NO: 2713 - RNA, 22 nt, Homo sapiens
uuccacaauggcugaacuaguu

SEQ ID NO: 2714 - RNA, 22 nt, Homo sapiens
uuccacaaugguugaacuaauu

SEQ ID NO: 2715 - RNA, 22 nt, Homo sapiens
uuccacaaugguugaacuagcu

SEQ ID NO: 2716 - RNA, 22 nt, Homo sapiens
uuccacaaugguugaacuaguu

SEQ ID NO: 2717 - RNA, 22 nt, Homo sapiens
uuccaguugugagcuauccggg

SEQ ID NO: 2718 - RNA, 22 nt, Homo sapiens
uuccaugagaugcaucaaagcu

SEQ ID NO: 2719 - RNA, 22 nt, Homo sapiens
uuccauguaguugagcaguuuu

SEQ ID NO: 2720 - RNA, 22 nt, Homo sapiens
uuccaugugggcuugucaagua

SEQ ID NO: 2721 - RNA, 22 nt, Homo sapiens
uugcugagucuuucuagguugc

SEQ ID NO: 2722 - RNA, 22 nt, Homo sapiens
uuggcagcuguggaaucugggc

SEQ ID NO: 2723 - RNA, 22 nt, Homo sapiens
uuggcaguaucuacuacagcua

SEQ ID NO: 2724 - RNA, 22 nt, Homo sapiens
uuggcagugcccgaugcugggg

SEQ ID NO: 2725 - RNA, 22 nt, Homo sapiens
uuggccagugucuuuuuuuccu

SEQ ID NO: 2726 - RNA, 22 nt, Homo sapiens
uuggccauaugacuugcuuugg

SEQ ID NO: 2727 - RNA, 22 nt, Homo sapiens
uuggcuuggagaguugaaaugu

SEQ ID NO: 2728 - RNA, 22 nt, Homo sapiens
uugggacuggaaggaguaaggg

SEQ ID NO: 2729 - RNA, 22 nt, Homo sapiens
uugggauaaucacaaaguaaaa

SEQ ID NO: 2730 - RNA, 22 nt, Homo sapiens
uugccuaggcuggagugcagua

SEQ ID NO: 2731 - RNA, 22 nt, Homo sapiens
uugccuaggcuggagugcagug

SEQ ID NO: 2732 - RNA, 22 nt, Homo sapiens
uugccuaggcuggaguucagug

SEQ ID NO: 2733 - RNA, 22 nt, Homo sapiens
uugccuaggcuggauugcagug

SEQ ID NO: 2734 - RNA, 22 nt, Homo sapiens
uugcgcuuuuccuauguugccc

SEQ ID NO: 2735 - RNA, 22 nt, Homo sapiens
uuggagugugagagcagccugg

SEQ ID NO: 2736 - RNA, 22 nt, Homo sapiens
uuggagugugcucauaacugcu

SEQ ID NO: 2737 - RNA, 22 nt, Homo sapiens
uuggauuuuaacaaacuaggug

SEQ ID NO: 2738 - RNA, 22 nt, Homo sapiens
uuggcaaauagguuuuauugca

SEQ ID NO: 2739 - RNA, 22 nt, Homo sapiens
uuggcaacauagugagaccccc

SEQ ID NO: 2740 - RNA, 22 nt, Homo sapiens
uuggcaaguccccaccucucuc

SEQ ID NO: 2741 - RNA, 22 nt, Homo sapiens
uuggcaauauuuacugaaguug

SEQ ID NO: 2742 - RNA, 22 nt, Homo sapiens
uuggcaaucaauucugacgucu

SEQ ID NO: 2743 - RNA, 22 nt, Homo sapiens
uuggcaauucagauucuuuuau

SEQ ID NO: 2744 - RNA, 22 nt, Homo sapiens
uuggcaauugcuaugauuugaa

SEQ ID NO: 2745 - RNA, 22 nt, Homo sapiens
uuggcagcacgcaguccagagg

SEQ ID NO: 2746 - RNA, 22 nt, Homo sapiens
uuggcagcauuccagccaagca

SEQ ID NO: 2747 - RNA, 22 nt, Homo sapiens
uugcauaagugcauucugugau

SEQ ID NO: 2748 - RNA, 23 nt, Homo sapiens
uugcauagacauccucauagauu

SEQ ID NO: 2749 - RNA, 22 nt, Homo sapiens
uugcauagaccgaugucuugga

SEQ ID NO: 2750 - RNA, 22 nt, Homo sapiens
uugcaucagcaggcauaauugg

SEQ ID NO: 2751 - RNA, 22 nt, Homo sapiens
uugcaaagaccucuucacuucc

SEQ ID NO: 2752 - RNA, 18 nt, Homo sapiens
uugcaaauucuucccugu

SEQ ID NO: 2753 - RNA, 22 nt, Homo sapiens
uugcaacuuagaaaaaucauuu

SEQ ID NO: 2754 - RNA, 22 nt, Homo sapiens
uugcaaugugaugugauuugga

SEQ ID NO: 2755 - RNA, 22 nt, Homo sapiens
uugcacaauccugugagugagu

SEQ ID NO: 2756 - RNA, 22 nt, Homo sapiens
uugcacaauggaauuuaucuuu

SEQ ID NO: 2757 - RNA, 22 nt, Homo sapiens
uugcacauggcaggugcucaau

SEQ ID NO: 2758 - RNA, 22 nt, Homo sapiens
uugcacauggcuggggaggccu

SEQ ID NO: 2759 - RNA, 22 nt, Homo sapiens
uugcacauguugaaccagcaaa

SEQ ID NO: 2760 - RNA, 22 nt, Homo sapiens
uugcacauugauuuuguauccu

SEQ ID NO: 2761 - RNA, 22 nt, Homo sapiens
uugcacauugauuuuguaucuu

SEQ ID NO: 2762 - RNA, 22 nt, Homo sapiens
uugcacauugcaccuuuuguau

SEQ ID NO: 2763 - RNA, 22 nt, Homo sapiens
uugcacauuuuuucuggcagaa

SEQ ID NO: 2764 - RNA, 20 nt, Homo sapiens
uugcagagcccaacccugga

SEQ ID NO: 2765 - RNA, 22 nt, Homo sapiens
uugcuuuguuacugcaguuucc

SEQ ID NO: 2766 - RNA, 22 nt, Homo sapiens
uuggaaaaauccaccuugaucu

SEQ ID NO: 2767 - RNA, 22 nt, Homo sapiens
uuggaaagagguguuuaugacu

SEQ ID NO: 2768 - RNA, 22 nt, Homo sapiens
uuggaaaguuguuguaguuauu

SEQ ID NO: 2769 - RNA, 22 nt, Homo sapiens
uuggaaauguguuugcauucag

SEQ ID NO: 2770 - RNA, 22 nt, Homo sapiens
uuggaagacaaugcugauucuc

SEQ ID NO: 2771 - RNA, 22 nt, Homo sapiens
uuggaagacauucugucugcua

SEQ ID NO: 2772 - RNA, 22 nt, Homo sapiens
uuggaagagaagggagauaaac

SEQ ID NO: 2773 - RNA, 22 nt, Homo sapiens
uuggaagauuacuuaguuuucu

SEQ ID NO: 2774 - RNA, 22 nt, Homo sapiens
uuggaauguacucuagccuaug

SEQ ID NO: 2775 - RNA, 22 nt, Homo sapiens
uuggacuggaacuauaccauug

SEQ ID NO: 2776 - RNA, 22 nt, Homo sapiens
uuggacuucucaaggcaauaaa

SEQ ID NO: 2777 - RNA, 22 nt, Homo sapiens
uuggagagaaaggcaguuccug

SEQ ID NO: 2778 - RNA, 22 nt, Homo sapiens
uuggagagagaggacucccggc

SEQ ID NO: 2779 - RNA, 22 nt, Homo sapiens
uuggagagucacuaguuagugc

SEQ ID NO: 2780 - RNA, 22 nt, Homo sapiens
uuggagagugauauucagaugc

SEQ ID NO: 2781 - RNA, 22 nt, Homo sapiens
uuuaaugcaucccaaaauguag

SEQ ID NO: 2782 - RNA, 22 nt, Homo sapiens
uuuaaugcgucucugaguuuug

SEQ ID NO: 2783 - RNA, 17 nt, Homo sapiens
uuuaaugcuaggacucu

SEQ ID NO: 2784 - RNA, 22 nt, Homo sapiens
uuuaaagcacggaguuuguggc

SEQ ID NO: 2785 - RNA, 22 nt, Homo sapiens
uuuaaagcaugacgagaagaag

SEQ ID NO: 2786 - RNA, 22 nt, Homo sapiens
uuuaaagcuaaaauauguuuau

SEQ ID NO: 2787 - RNA, 22 nt, Homo sapiens
uuuaaagcuccaagcaugucug

SEQ ID NO: 2788 - RNA, 22 nt, Homo sapiens
uuuaacauuggaugagaucguc

SEQ ID NO: 2789 - RNA, 22 nt, Homo sapiens
uuuaaggcaugccuguacaugc

SEQ ID NO: 2790 - RNA, 21 nt, Homo sapiens
uuggggaauggagagguuuuc

SEQ ID NO: 2791 - RNA, 22 nt, Homo sapiens
uugucuccuagacgaccaggcg

SEQ ID NO: 2792 - RNA, 22 nt, Homo sapiens
uugugaaaaaccucucguggaa

SEQ ID NO: 2793 - RNA, 22 nt, Homo sapiens
uugugaaaucuaggcagagguu

SEQ ID NO: 2794 - RNA, 22 nt, Homo sapiens
uugugaaugaugccgcaauaaa

SEQ ID NO: 2795 - RNA, 22 nt, Homo sapiens
uugugaaugaugucgcaauaaa

SEQ ID NO: 2796 - RNA, 22 nt, Homo sapiens
uugugaaugaugucgcaguaaa

SEQ ID NO: 2797 - RNA, 22 nt, Homo sapiens
uugugaauggaguagcaggauc

SEQ ID NO: 2798 - RNA, 22 nt, Homo sapiens
uugugaauggugccacaauaaa

SEQ ID NO: 2799 - RNA, 22 nt, Homo sapiens
uugugaauggugccgcaauaaa

SEQ ID NO: 2800 - RNA, 22 nt, Homo sapiens
uugugaauggugccgcaguaaa

SEQ ID NO: 2801 - RNA, 22 nt, Homo sapiens
uugugaauggugccgcgauaaa

SEQ ID NO: 2802 - RNA, 22 nt, Homo sapiens
uugugaauggugccucaguaaa

SEQ ID NO: 2803 - RNA, 22 nt, Homo sapiens
uugugaauggugcugcaguaaa

SEQ ID NO: 2804 - RNA, 22 nt, Homo sapiens
uugugaucauugucaaauagug

SEQ ID NO: 2805 - RNA, 22 nt, Homo sapiens
uugugcauaucagagguuugcu

SEQ ID NO: 2806 - RNA, 22 nt, Homo sapiens
uugugcaugaugcauacauggu

SEQ ID NO: 2807 - RNA, 22 nt, Homo sapiens
uuguaacaugcuuucacuucag

SEQ ID NO: 2808 - RNA, 22 nt, Homo sapiens
uuguaaucaacacaucauuggg

SEQ ID NO: 2809 - RNA, 22 nt, Homo sapiens
uuguacuuuuaguagagacggg

SEQ ID NO: 2810 - RNA, 22 nt, Homo sapiens
uuguauaggcucaguaagaauc

SEQ ID NO: 2811 - RNA, 22 nt, Homo sapiens
uugguucucuuagccaucuuaa

SEQ ID NO: 2812 - RNA, 22 nt, Homo sapiens
uuguaaacaucuguacauugcu

SEQ ID NO: 2813 - RNA, 22 nt, Homo sapiens
uuguaaagaucauaugcuguuc

SEQ ID NO: 2814 - RNA, 22 nt, Homo sapiens
uuguaaaguucucucccgaaaa

SEQ ID NO: 2815 - RNA, 22 nt, Homo sapiens
uugucaacaugaaacuguguuu

SEQ ID NO: 2816 - RNA, 22 nt, Homo sapiens
uugucacccuacauaacaggga

SEQ ID NO: 2817 - RNA, 22 nt, Homo sapiens
uugucauuuucagaguguuacg

SEQ ID NO: 2818 - RNA, 22 nt, Homo sapiens
uugucccauggggucuuccuuu

SEQ ID NO: 2819 - RNA, 22 nt, Homo sapiens
uuggucaggcuaaucucgaacg

SEQ ID NO: 2820 - RNA, 22 nt, Homo sapiens
uuggucaucucccuccuuuuag

SEQ ID NO: 2821 - RNA, 22 nt, Homo sapiens
uugguccccuucaaccagcugu

SEQ ID NO: 2822 - RNA, 22 nt, Homo sapiens
uugguccucccaugcucaagag

SEQ ID NO: 2823 - RNA, 22 nt, Homo sapiens
uuggucucaucaagagcagcuu

SEQ ID NO: 2824 - RNA, 22 nt, Homo sapiens
ugaaacacacauugcccuuuau

SEQ ID NO: 2825 - RNA, 22 nt, Homo sapiens
ugaaacacaccuccucuccauc

SEQ ID NO: 2826 - RNA, 22 nt, Homo sapiens
ugaaacauacacucugaugggg

SEQ ID NO: 2827 - RNA, 22 nt, Homo sapiens
ugaaagacugaaagcuuuucuu

SEQ ID NO: 2828 - RNA, 22 nt, Homo sapiens
ugaaagacugaagaauaggcau

SEQ ID NO: 2829 - RNA, 22 nt, Homo sapiens
ucuugcuuguuguucccuucau

SEQ ID NO: 2830 - RNA, 22 nt, Homo sapiens
ucuugggugaguuugugaauaa

SEQ ID NO: 2831 - RNA, 22 nt, Homo sapiens
ucuuugauuuuguuacuaagac

SEQ ID NO: 2832 - RNA, 19 nt, Homo sapiens
ucuuugcuuuucuaagagg

SEQ ID NO: 2833 - RNA, 22 nt, Homo sapiens
ucuuuggaggcgaucuguuuga

SEQ ID NO: 2834 - RNA, 22 nt, Homo sapiens
ucuuuggauggaaauuggaguc

SEQ ID NO: 2835 - RNA, 22 nt, Homo sapiens
ucuuuggucuacuuucauaugu

SEQ ID NO: 2836 - RNA, 22 nt, Homo sapiens
ucuugcacaaauuauuuuaacu

SEQ ID NO: 2837 - RNA, 22 nt, Homo sapiens
ucuugccacuucauccccuuuc

SEQ ID NO: 2838 - RNA, 22 nt, Homo sapiens
ucuucaugcuugaaauaauagc

SEQ ID NO: 2839 - RNA, 22 nt, Homo sapiens
ucugguggugaugagagacagu

SEQ ID NO: 2840 - RNA, 22 nt, Homo sapiens
ucugucuugugguuugagugcc

SEQ ID NO: 2841 - RNA, 22 nt, Homo sapiens
ucugugaaugaacacuugaaaa

SEQ ID NO: 2842 - RNA, 22 nt, Homo sapiens
ucugugcauuacacuuuucuca

SEQ ID NO: 2843 - RNA, 22 nt, Homo sapiens
ucuggcuuauuucacuuagcau

SEQ ID NO: 2844 - RNA, 18 nt, Homo sapiens
ucuggcuucuuuguucca

SEQ ID NO: 2845 - RNA, 22 nt, Homo sapiens
ucuggcuugugaacugucuucu

SEQ ID NO: 2846 - RNA, 22 nt, Homo sapiens
ucugacacagugauuaguaaau

SEQ ID NO: 2847 - RNA, 22 nt, Homo sapiens
ucugccuuuucaugugggaugg

SEQ ID NO: 2848 - RNA, 23 nt, Homo sapiens
ucugcggguguggacccuagugc

SEQ ID NO: 2849 - RNA, 22 nt, Homo sapiens
ucuggagugugaaguggauaug

SEQ ID NO: 2850 - RNA, 22 nt, Homo sapiens
ucugagaucaugucugugcugu

SEQ ID NO: 2851 - RNA, 22 nt, Homo sapiens
ucugagaugagacuuugaauuu

SEQ ID NO: 2852 - RNA, 22 nt, Homo sapiens
ucucugagaaaaguuucuccca

SEQ ID NO: 2853 - RNA, 22 nt, Homo sapiens
ucucuggauaucuacuuauguu

SEQ ID NO: 2854 - RNA, 22 nt, Homo sapiens
ucucuguuugucuguuacuggu

SEQ ID NO: 2855 - RNA, 23 nt, Homo sapiens
ucucauuccuugaaaauaaugac

SEQ ID NO: 2856 - RNA, 22 nt, Homo sapiens
ucuccauuguccagaugaggaa

SEQ ID NO: 2857 - RNA, 22 nt, Homo sapiens
ugaacugagacuagacuuguuc

SEQ ID NO: 2858 - RNA, 22 nt, Homo sapiens
ugaagacauuuuugggugugua

SEQ ID NO: 2859 - RNA, 21 nt, Homo sapiens
ugaacacuggacugagugucc

SEQ ID NO: 2860 - RNA, 22 nt, Homo sapiens
ugaacagcacguuuauucagaa

SEQ ID NO: 2861 - RNA, 22 nt, Homo sapiens
ugaacagucaucucucuuguau

SEQ ID NO: 2862 - RNA, 21 nt, Homo sapiens
ugaaccccugcucucaagaaa

SEQ ID NO: 2863 - RNA, 22 nt, Homo sapiens
ugaaaugaucaguuugguuacu

SEQ ID NO: 2864 - RNA, 21 nt, Homo sapiens
ugaaaugcaugugcacauuaa

SEQ ID NO: 2865 - RNA, 22 nt, Homo sapiens
ugaaaugccuuuaaugaauuua

SEQ ID NO: 2866 - RNA, 22 nt, Homo sapiens
ugaaauguuaaacaaguggcuc

SEQ ID NO: 2867 - RNA, 22 nt, Homo sapiens
ugaaauuauucuuaccaaggug

SEQ ID NO: 2868 - RNA, 22 nt, Homo sapiens
ugaaauuguuugcaaggauagg

SEQ ID NO: 2869 - RNA, 22 nt, Homo sapiens
ugaaagguauagguucuggagg

SEQ ID NO: 2870 - RNA, 22 nt, Homo sapiens
ugaaagguuuaauucugugaga

SEQ ID NO: 2871 - RNA, 22 nt, Homo sapiens
ugaaagcuacaggaaaguauuu

SEQ ID NO: 2872 - RNA, 22 nt, Homo sapiens
ugaaagcuacagucuccuagga

SEQ ID NO: 2873 - RNA, 22 nt, Homo sapiens
ugaaaguuauauugugaaauuc

SEQ ID NO: 2874 - RNA, 22 nt, Homo sapiens
ugaaauacuuaauuucuccaug

SEQ ID NO: 2875 - RNA, 22 nt, Homo sapiens
ucuuuuggguauggagccauca

SEQ ID NO: 2876 - RNA, 22 nt, Homo sapiens
ugaaaucauguaguuauugcaa

SEQ ID NO: 2877 - RNA, 22 nt, Homo sapiens
ugaauauguuucuaaaagugca

SEQ ID NO: 2878 - RNA, 22 nt, Homo sapiens
ugaaucauuucuugucuucagu

SEQ ID NO: 2879 - RNA, 22 nt, Homo sapiens
ugaagugaagacucacagaagg

SEQ ID NO: 2880 - RNA, 22 nt, Homo sapiens
ugaauaguuugacagaacucuu

SEQ ID NO: 2881 - RNA, 22 nt, Homo sapiens
ugaauacugugcaaaggauuug

SEQ ID NO: 2882 - RNA, 22 nt, Homo sapiens
ugaauagacacuaaagacugua

SEQ ID NO: 2883 - RNA, 22 nt, Homo sapiens
ugaaguaauguuuuauucuauu

SEQ ID NO: 2884 - RNA, 22 nt, Homo sapiens
ugaagcuaacuugauugugaug

SEQ ID NO: 2885 - RNA, 22 nt, Homo sapiens
ugaaggacauaaggcagaguga

SEQ ID NO: 2886 - RNA, 22 nt, Homo sapiens
ugaaggacauucuaugguagau

SEQ ID NO: 2887 - RNA, 22 nt, Homo sapiens
ugaaugcuucaugucugggcug

SEQ ID NO: 2888 - RNA, 22 nt, Homo sapiens
ugaauguaagaugucugcuggu

SEQ ID NO: 2889 - RNA, 18 nt, Homo sapiens
ugacaucauuuagaaagg

SEQ ID NO: 2890 - RNA, 19 nt, Homo sapiens
ugacaugaaacccaagauc

SEQ ID NO: 2891 - RNA, 22 nt, Homo sapiens
ugacaugaugagcaauaauggc

SEQ ID NO: 2892 - RNA, 22 nt, Homo sapiens
ugacaugauuguauauuuagaa

SEQ ID NO: 2893 - RNA, 22 nt, Homo sapiens
ugacauggagguggaggaagau

SEQ ID NO: 2894 - RNA, 22 nt, Homo sapiens
ugacauuacagucacuugcugu

SEQ ID NO: 2895 - RNA, 22 nt, Homo sapiens
ugacaacugauuaacuccuuua

SEQ ID NO: 2896 - RNA, 20 nt, Homo sapiens
ugacaagugagaauuauggg

SEQ ID NO: 2897 - RNA, 19 nt, Homo sapiens
ugacacuguuggugggagg

SEQ ID NO: 2898 - RNA, 21 nt, Homo sapiens
ugacagaaaauugaguuugcu

SEQ ID NO: 2899 - RNA, 17 nt, Homo sapiens
ugacagaaacuuguugu

SEQ ID NO: 2900 - RNA, 22 nt, Homo sapiens
ugacagagaagcauugaguuca

SEQ ID NO: 2901 - RNA, 22 nt, Homo sapiens
ugacagcugaagauguugaacc

SEQ ID NO: 2902 - RNA, 22 nt, Homo sapiens
ugacagguuggaauuaugggag

SEQ ID NO: 2903 - RNA, 23 nt, Homo sapiens
ugacagucucccgauggcuaggc

SEQ ID NO: 2904 - RNA, 22 nt, Homo sapiens
ugacauagcuauuaagugaugc

SEQ ID NO: 2905 - RNA, 22 nt, Homo sapiens
ugagaaugacugggcaugcugc

SEQ ID NO: 2906 - RNA, 22 nt, Homo sapiens
ugagaaugaugauuuccaguuu

SEQ ID NO: 2907 - RNA, 22 nt, Homo sapiens
ugagaaugcagaaucucgugca

SEQ ID NO: 2908 - RNA, 22 nt, Homo sapiens
ugagacacugaauccggccuga

SEQ ID NO: 2909 - RNA, 22 nt, Homo sapiens
ugagacacuucccagaucccuu

SEQ ID NO: 2910 - RNA, 22 nt, Homo sapiens
ugagacgaagucuugcucuguu

SEQ ID NO: 2911 - RNA, 22 nt, Homo sapiens
ugagacggagucuugcucuguc

SEQ ID NO: 2912 - RNA, 22 nt, Homo sapiens
ugagacugguuaauugauaaag

SEQ ID NO: 2913 - RNA, 22 nt, Homo sapiens
ugagagacagacauuaucuuau

SEQ ID NO: 2914 - RNA, 22 nt, Homo sapiens
ugacggaggcauuggaagcuug

SEQ ID NO: 2915 - RNA, 22 nt, Homo sapiens
ugacuagagcaauuggaaacaa

SEQ ID NO: 2916 - RNA, 22 nt, Homo sapiens
ugacuaggaaauuagaacuuuu

SEQ ID NO: 2917 - RNA, 22 nt, Homo sapiens
ugacuaggaggcuggaggauga

SEQ ID NO: 2918 - RNA, 22 nt, Homo sapiens
ugacuagggacauucuuccacg

SEQ ID NO: 2919 - RNA, 21 nt, Homo sapiens
ugacuagggauaugugccacu

SEQ ID NO: 2920 - RNA, 22 nt, Homo sapiens
ugacuagggcucuaaacagcuc

SEQ ID NO: 2921 - RNA, 22 nt, Homo sapiens
ugacuaggggcccuggcuucuu

SEQ ID NO: 2922 - RNA, 22 nt, Homo sapiens
ugacuagugcccuuugcugccu

SEQ ID NO: 2923 - RNA, 22 nt, Homo sapiens
ugacuauaggauaacaugcauu

SEQ ID NO: 2924 - RNA, 22 nt, Homo sapiens
ugacucaguuguuagucuucau

SEQ ID NO: 2925 - RNA, 22 nt, Homo sapiens
ugacucaguuucucagguagua

SEQ ID NO: 2926 - RNA, 18 nt, Homo sapiens
ugacuguccagguggacc

SEQ ID NO: 2927 - RNA, 20 nt, Homo sapiens
ugacuuguccgagguccccc

SEQ ID NO: 2928 - RNA, 22 nt, Homo sapiens
ugagaacagauggcuuuauuau

SEQ ID NO: 2929 - RNA, 22 nt, Homo sapiens
ugagaacaugcacuugagguug

SEQ ID NO: 2930 - RNA, 22 nt, Homo sapiens
ugagaacuaaaaugugguauau

SEQ ID NO: 2931 - RNA, 22 nt, Homo sapiens
ugagaacugguagcacuuguga

SEQ ID NO: 2932 - RNA, 22 nt, Homo sapiens
ugagaacuuauggugauuuuuu

SEQ ID NO: 2933 - RNA, 22 nt, Homo sapiens
ugagaagcauaccagugucugu

SEQ ID NO: 2934 - RNA, 22 nt, Homo sapiens
ugagaggugauaaagcaagggu

SEQ ID NO: 2935 - RNA, 22 nt, Homo sapiens
ugagaguauaaauugaugcagc

SEQ ID NO: 2936 - RNA, 22 nt, Homo sapiens
ugagauaaggaaauugaggcuc

SEQ ID NO: 2937 - RNA, 22 nt, Homo sapiens
ugagauaauuuacuuguugagg

SEQ ID NO: 2938 - RNA, 22 nt, Homo sapiens
ugagauaggaucuugcucuguu

SEQ ID NO: 2939 - RNA, 22 nt, Homo sapiens
ugagauagggucucacucuguc

SEQ ID NO: 2940 - RNA, 22 nt, Homo sapiens
ugagauauugggaguaauguca

SEQ ID NO: 2941 - RNA, 22 nt, Homo sapiens
ugagaucaacugagucagagca

SEQ ID NO: 2942 - RNA, 22 nt, Homo sapiens
ugagaucaaggugggcccuggg

SEQ ID NO: 2943 - RNA, 22 nt, Homo sapiens
ugagaucacgccacugcacucc

SEQ ID NO: 2944 - RNA, 22 nt, Homo sapiens
ugagaucacuaagagguaaugg

SEQ ID NO: 2945 - RNA, 22 nt, Homo sapiens
ugagaucaugccacugcacuuc

SEQ ID NO: 2946 - RNA, 22 nt, Homo sapiens
ugagaucugucuuuauaguauu

SEQ ID NO: 2947 - RNA, 22 nt, Homo sapiens
ugagaugaacuugauuguuuua

SEQ ID NO: 2948 - RNA, 22 nt, Homo sapiens
ugagaugaagcuagaagaaugg

SEQ ID NO: 2949 - RNA, 22 nt, Homo sapiens
ugagaugaagugauguaaaaca

SEQ ID NO: 2950 - RNA, 22 nt, Homo sapiens
ugagaugagaaucaguucuaau

SEQ ID NO: 2951 - RNA, 22 nt, Homo sapiens
ugagaugagagaaugcuugccu

SEQ ID NO: 2952 - RNA, 22 nt, Homo sapiens
ugagaugagucucgcucuguca

SEQ ID NO: 2953 - RNA, 22 nt, Homo sapiens
ugagaugaguugcgcucugucg

SEQ ID NO: 2954 - RNA, 22 nt, Homo sapiens
ugagaugauagauauguuaauu

SEQ ID NO: 2955 - RNA, 22 nt, Homo sapiens
ugagaugcauauucuggcuccu

SEQ ID NO: 2956 - RNA, 22 nt, Homo sapiens
ugagaugcuccucuugcaaagc

SEQ ID NO: 2957 - RNA, 22 nt, Homo sapiens
ugagaugcuuguaaauucauuu

SEQ ID NO: 2958 - RNA, 22 nt, Homo sapiens
ugagauggagucuugucgccua

SEQ ID NO: 2959 - RNA, 22 nt, Homo sapiens
ugagauggguaauuaaauggug

SEQ ID NO: 2960 - RNA, 23 nt, Homo sapiens
ugagaugucugauugcgaggguc

SEQ ID NO: 2961 - RNA, 22 nt, Homo sapiens
ugagaugugaagaucacaugaa

SEQ ID NO: 2962 - RNA, 21 nt, Homo sapiens
ugagaugugaccagggcauca

SEQ ID NO: 2963 - RNA, 22 nt, Homo sapiens
ugagaugugaucaccugaaggg

SEQ ID NO: 2964 - RNA, 22 nt, Homo sapiens
ugagauguggcuagagagguug

SEQ ID NO: 2965 - RNA, 22 nt, Homo sapiens
ugagaugugugcauucaacuca

SEQ ID NO: 2966 - RNA, 22 nt, Homo sapiens
ugagauuaaucuuuaaguaaga

SEQ ID NO: 2967 - RNA, 23 nt, Homo sapiens
ugagauuacccagaaagaguaua

SEQ ID NO: 2968 - RNA, 23 nt, Homo sapiens
ugagauuauaaucuuuuacuucu

SEQ ID NO: 2969 - RNA, 22 nt, Homo sapiens
ugagauuauauuucuuaacaga

SEQ ID NO: 2970 - RNA, 22 nt, Homo sapiens
ugagauuaucuugaucuugaaa

SEQ ID NO: 2971 - RNA, 22 nt, Homo sapiens
ugagauuguaucugcaaugugu

SEQ ID NO: 2972 - RNA, 22 nt, Homo sapiens
ugagcacauuuacaucaguucc

SEQ ID NO: 2973 - RNA, 22 nt, Homo sapiens
ugagcagaaagcugcaaggucg

SEQ ID NO: 2974 - RNA, 22 nt, Homo sapiens
ugagcagagaagugcccugcgc

SEQ ID NO: 2975 - RNA, 22 nt, Homo sapiens
ugagcagagggagaaguaaauu

SEQ ID NO: 2976 - RNA, 22 nt, Homo sapiens
ugaugacacugauuucuucaau

SEQ ID NO: 2977 - RNA, 22 nt, Homo sapiens
ugaugacauugucacagucuga

SEQ ID NO: 2978 - RNA, 22 nt, Homo sapiens
ugaucucagcucacugguugaa

SEQ ID NO: 2979 - RNA, 22 nt, Homo sapiens
ugaggucauguucugucagguu

SEQ ID NO: 2980 - RNA, 22 nt, Homo sapiens
ugagguuauuuguucaagaagu

SEQ ID NO: 2981 - RNA, 22 nt, Homo sapiens
ugagguuggguaauuuaugaag

SEQ ID NO: 2982 - RNA, 22 nt, Homo sapiens
ugagguugguauuacugucucu

SEQ ID NO: 2983 - RNA, 22 nt, Homo sapiens
ugauauauugaaugaugaaaca

SEQ ID NO: 2984 - RNA, 22 nt, Homo sapiens
ugauauggcuuggcuaugucac

SEQ ID NO: 2985 - RNA, 21 nt, Homo sapiens
ugauaugguuuggauaugugu

SEQ ID NO: 2986 - RNA, 22 nt, Homo sapiens
ugauauguaacuacuccuuaua

SEQ ID NO: 2987 - RNA, 22 nt, Homo sapiens
ugagacauauuauacugcuuuu

SEQ ID NO: 2988 - RNA, 22 nt, Homo sapiens
ugagaggugaauggcaggcuca

SEQ ID NO: 2989 - RNA, 22 nt, Homo sapiens
ugaggaacuagcuacccuaaua

SEQ ID NO: 2990 - RNA, 22 nt, Homo sapiens
ugaggagugaacuauuucugau

SEQ ID NO: 2991 - RNA, 22 nt, Homo sapiens
ugaggauaguguugaaggcagg

SEQ ID NO: 2992 - RNA, 22 nt, Homo sapiens
ugaggcacucccuagcggggug

SEQ ID NO: 2993 - RNA, 22 nt, Homo sapiens
ugaguagaacuccuggagaugu

SEQ ID NO: 2994 - RNA, 22 nt, Homo sapiens
ugaguagagaauucagcuaagg

SEQ ID NO: 2995 - RNA, 22 nt, Homo sapiens
ugaguauguuuagaaguaaagg

SEQ ID NO: 2996 - RNA, 22 nt, Homo sapiens
ugagucuguucucacauugcua

SEQ ID NO: 2997 - RNA, 22 nt, Homo sapiens
ugaguuagguaauaauaaauau

SEQ ID NO: 2998 - RNA, 22 nt, Homo sapiens
ugaguucuuuguagauucugug

SEQ ID NO: 2999 - RNA, 22 nt, Homo sapiens
ugauaacauuucuucugguaca

SEQ ID NO: 3000 - RNA, 17 nt, Homo sapiens
ugauaagugugagguga

SEQ ID NO: 3001 - RNA, 22 nt, Homo sapiens
ugauacugugcauuagaggcua

SEQ ID NO: 3002 - RNA, 22 nt, Homo sapiens
ugauagaucugggcaaaguaaa

SEQ ID NO: 3003 - RNA, 22 nt, Homo sapiens
ugauaggucuguuuugaaaagg

SEQ ID NO: 3004 - RNA, 22 nt, Homo sapiens
ugauugcacaccugcacucaag

SEQ ID NO: 3005 - RNA, 20 nt, Homo sapiens
ugaugcaaaucuuuaaaagu

SEQ ID NO: 3006 - RNA, 19 nt, Homo sapiens
ugcaaauucuaaaaacuga

SEQ ID NO: 3007 - RNA, 22 nt, Homo sapiens
ugauuugucugcaggaauagug

SEQ ID NO: 3008 - RNA, 22 nt, Homo sapiens
ugauuuguuucaggaguuuucu

SEQ ID NO: 3009 - RNA, 22 nt, Homo sapiens
ugcaaaugcugcuauuucucuu

SEQ ID NO: 3010 - RNA, 22 nt, Homo sapiens
ugcaaauguuaggugucauuau

SEQ ID NO: 3011 - RNA, 22 nt, Homo sapiens
ugaugcuaccuaaagcaaccau

SEQ ID NO: 3012 - RNA, 22 nt, Homo sapiens
ugauggcaauggcauucauuuu

SEQ ID NO: 3013 - RNA, 22 nt, Homo sapiens
ugauggcacagugaguuccagg

SEQ ID NO: 3014 - RNA, 22 nt, Homo sapiens
ugaugguuuuaaaaagaggagu

SEQ ID NO: 3015 - RNA, 22 nt, Homo sapiens
ugaugucuugcaggcacgagau

SEQ ID NO: 3016 - RNA, 22 nt, Homo sapiens
ugaugugucaucugagagagug

SEQ ID NO: 3017 - RNA, 22 nt, Homo sapiens
ugauguguuuuguaguucaacu

SEQ ID NO: 3018 - RNA, 17 nt, Homo sapiens
ugcaauuuaagcuagau

SEQ ID NO: 3019 - RNA, 21 nt, Homo sapiens
ugcagccauucagcccuaugc

SEQ ID NO: 3020 - RNA, 22 nt, Homo sapiens
ugcagagaaacauuuuguauuu

SEQ ID NO: 3021 - RNA, 19 nt, Homo sapiens
ugcagcaauguaaaagaca

SEQ ID NO: 3022 - RNA, 22 nt, Homo sapiens
ugcgccauugcacuccagccug

SEQ ID NO: 3023 - RNA, 22 nt, Homo sapiens
ugcgccauugcauuccagccug

SEQ ID NO: 3024 - RNA, 22 nt, Homo sapiens
ugcuaugucagccaggcugguc

SEQ ID NO: 3025 - RNA, 21 nt, Homo sapiens
ugcuauguuguccaggcuggc

SEQ ID NO: 3026 - RNA, 22 nt, Homo sapiens
ugcucaguuuaaaacuuuugag

SEQ ID NO: 3027 - RNA, 22 nt, Homo sapiens
ugcugcaaacaggcaucugugg

SEQ ID NO: 3028 - RNA, 22 nt, Homo sapiens
ugcugcaaacaugagaggaagu

SEQ ID NO: 3029 - RNA, 22 nt, Homo sapiens
ugcugcaaucucggcacuuugg

SEQ ID NO: 3030 - RNA, 22 nt, Homo sapiens
ugcuuguguucagguaaccuuu

SEQ ID NO: 3031 - RNA, 22 nt, Homo sapiens
ugcuuugguagaaaucuuuggu

SEQ ID NO: 3032 - RNA, 21 nt, Homo sapiens
ugcuuuggucauacuucuucc

SEQ ID NO: 3033 - RNA, 22 nt, Homo sapiens
ugcuguguugcuggcuuaaaga

SEQ ID NO: 3034 - RNA, 22 nt, Homo sapiens
ugcuguuguuugaugaaguaau

SEQ ID NO: 3035 - RNA, 23 nt, Homo sapiens
uggaaguauggaggaggcagaau

SEQ ID NO: 3036 - RNA, 22 nt, Homo sapiens
uggaagccuagauucuuuucuu

SEQ ID NO: 3037 - RNA, 22 nt, Homo sapiens
uggaagguaaguuuugagcauu

SEQ ID NO: 3038 - RNA, 22 nt, Homo sapiens
uggaaguaaccaugaauggaau

SEQ ID NO: 3039 - RNA, 20 nt, Homo sapiens
uggaaguaagaauauaggug

SEQ ID NO: 3040 - RNA, 22 nt, Homo sapiens
uggaaguaaucaugagguagca

SEQ ID NO: 3041 - RNA, 22 nt, Homo sapiens
uggaaguagauagauuguguca

SEQ ID NO: 3042 - RNA, 22 nt, Homo sapiens
uggaaguauagauaauugaaag

SEQ ID NO: 3043 - RNA, 20 nt, Homo sapiens
uggaaaguaagucaugauau

SEQ ID NO: 3044 - RNA, 22 nt, Homo sapiens
uggaaaguacugagguccaccu

SEQ ID NO: 3045 - RNA, 22 nt, Homo sapiens
uggaaaguacuugaguuuguau

SEQ ID NO: 3046 - RNA, 22 nt, Homo sapiens
uggaaaguaguucuaaucuaag

SEQ ID NO: 3047 - RNA, 22 nt, Homo sapiens
uggaaaguccaagccaaccggg

SEQ ID NO: 3048 - RNA, 22 nt, Homo sapiens
uggaaaucuaaguuuggauuga

SEQ ID NO: 3049 - RNA, 22 nt, Homo sapiens
uggaaauuaacagggauugucc

SEQ ID NO: 3050 - RNA, 20 nt, Homo sapiens
uggaaauuaaccuuucaggu

SEQ ID NO: 3051 - RNA, 19 nt, Homo sapiens
uggaacugauucaguucug

SEQ ID NO: 3052 - RNA, 20 nt, Homo sapiens
uggaacuuaauugauggaca

SEQ ID NO: 3053 - RNA, 19 nt, Homo sapiens
ugccauguagcacaugguc

SEQ ID NO: 3054 - RNA, 22 nt, Homo sapiens
ugcauguucuuacucauacaug

SEQ ID NO: 3055 - RNA, 19 nt, Homo sapiens
ugcauugucugggaaaugg

SEQ ID NO: 3056 - RNA, 22 nt, Homo sapiens
ugcauuguuuagaaacacuggg

SEQ ID NO: 3057 - RNA, 19 nt, Homo sapiens
ugccaagaaagucagcuua

SEQ ID NO: 3058 - RNA, 23 nt, Homo sapiens
ugccuagaugcugcccugggaca

SEQ ID NO: 3059 - RNA, 22 nt, Homo sapiens
ugccuaguagaaggugaacaug

SEQ ID NO: 3060 - RNA, 22 nt, Homo sapiens
ugccuaguggaaggagagcaaa

SEQ ID NO: 3061 - RNA, 22 nt, Homo sapiens
ugcagugucaauaauaauuagu

SEQ ID NO: 3062 - RNA, 22 nt, Homo sapiens
ugcaguuuaggaacugguaaca

SEQ ID NO: 3063 - RNA, 22 nt, Homo sapiens
ugcauccauucuagacucaucu

SEQ ID NO: 3064 - RNA, 22 nt, Homo sapiens
ugcaugaugcugagauuuggga

SEQ ID NO: 3065 - RNA, 22 nt, Homo sapiens
ugcauacacaagcauacaugua

SEQ ID NO: 3066 - RNA, 18 nt, Homo sapiens
ugcauacuaucugauuuu

SEQ ID NO: 3067 - RNA, 22 nt, Homo sapiens
ugcauauguugagaugcauauu

SEQ ID NO: 3068 - RNA, 22 nt, Homo sapiens
ugcauauucgaguuauuuuggg

SEQ ID NO: 3069 - RNA, 21 nt, Homo sapiens
ugcauauuggaacuuucucuc

SEQ ID NO: 3070 - RNA, 22 nt, Homo sapiens
uggacugagauuucagcugcca

SEQ ID NO: 3071 - RNA, 22 nt, Homo sapiens
uggacuguaauagagaacagaa

SEQ ID NO: 3072 - RNA, 22 nt, Homo sapiens
uggagaacauucauuugcaaga

SEQ ID NO: 3073 - RNA, 22 nt, Homo sapiens
uggagacugaucccucuuuccu

SEQ ID NO: 3074 - RNA, 22 nt, Homo sapiens
uggagagucauuuauaguauuu

SEQ ID NO: 3075 - RNA, 22 nt, Homo sapiens
uggagagugauaaguaaaugga

SEQ ID NO: 3076 - RNA, 19 nt, Homo sapiens
uggagucaucaugcugcua

SEQ ID NO: 3077 - RNA, 22 nt, Homo sapiens
uggagucuugaugauuuucaaa

SEQ ID NO: 3078 - RNA, 20 nt, Homo sapiens
uggagugaagguucuggacc

SEQ ID NO: 3079 - RNA, 22 nt, Homo sapiens
uggagugagaacuucaaugaug

SEQ ID NO: 3080 - RNA, 22 nt, Homo sapiens
uggagugauaugguuauauggg

SEQ ID NO: 3081 - RNA, 22 nt, Homo sapiens
uggagugcaauggcaccaucuu

SEQ ID NO: 3082 - RNA, 22 nt, Homo sapiens
uggaguguaaauuaguucagcc

SEQ ID NO: 3083 - RNA, 22 nt, Homo sapiens
uggaguguagaagccagccucc

SEQ ID NO: 3084 - RNA, 22 nt, Homo sapiens
uggaguguguugcagaugaagg

SEQ ID NO: 3085 - RNA, 20 nt, Homo sapiens
uggaguuugaguucuuggag

SEQ ID NO: 3086 - RNA, 19 nt, Homo sapiens
uggaaugaaauguuagggg

SEQ ID NO: 3087 - RNA, 18 nt, Homo sapiens
uggacagugauuauccau

SEQ ID NO: 3088 - RNA, 22 nt, Homo sapiens
uggacauguacauauguguaug

SEQ ID NO: 3089 - RNA, 20 nt, Homo sapiens
uggaccagagagguggggac

SEQ ID NO: 3090 - RNA, 22 nt, Homo sapiens
uggaagucuucauuauguauag

SEQ ID NO: 3091 - RNA, 22 nt, Homo sapiens
uggaagugaacaaccaaggcag

SEQ ID NO: 3092 - RNA, 22 nt, Homo sapiens
uggaagugucugugcccagcuc

SEQ ID NO: 3093 - RNA, 22 nt, Homo sapiens
uggaauaucaugagaguuuguu

SEQ ID NO: 3094 - RNA, 22 nt, Homo sapiens
uggaaugguaucuuguuggggu

SEQ ID NO: 3095 - RNA, 22 nt, Homo sapiens
uggaauguaacuugaaacuuuu

SEQ ID NO: 3096 - RNA, 22 nt, Homo sapiens
uggaauguagcguugacacgag

SEQ ID NO: 3097 - RNA, 22 nt, Homo sapiens
uggaaugucagcuacaagaggg

SEQ ID NO: 3098 - RNA, 22 nt, Homo sapiens
uggaaugugaauaacuuccuuc

SEQ ID NO: 3099 - RNA, 21 nt, Homo sapiens
uggaauuaauggagagguguu

SEQ ID NO: 3100 - RNA, 22 nt, Homo sapiens
uggaauuaauuaaaauauacug

SEQ ID NO: 3101 - RNA, 22 nt, Homo sapiens
uggauaguaaagucagauuccc

SEQ ID NO: 3102 - RNA, 22 nt, Homo sapiens
uggauaguaauaaacauauagg

SEQ ID NO: 3103 - RNA, 18 nt, Homo sapiens
uggauaguuguuggcaga

SEQ ID NO: 3104 - RNA, 22 nt, Homo sapiens
uggauaguuuacugaagagugg

SEQ ID NO: 3105 - RNA, 22 nt, Homo sapiens
uggauggagaggcuugugaugc

SEQ ID NO: 3106 - RNA, 22 nt, Homo sapiens
uggauguacagucaguauuugu

SEQ ID NO: 3107 - RNA, 22 nt, Homo sapiens
uggauugaaagcuuuaauauug

SEQ ID NO: 3108 - RNA, 22 nt, Homo sapiens
uggauugagaagcuguggcuca

SEQ ID NO: 3109 - RNA, 22 nt, Homo sapiens
uggcaaaaaucacaaguaccuu

SEQ ID NO: 3110 - RNA, 22 nt, Homo sapiens
uggcaaaucagaggcauggaca

SEQ ID NO: 3111 - RNA, 22 nt, Homo sapiens
uggcaaaugaaagaaagccagu

SEQ ID NO: 3112 - RNA, 21 nt, Homo sapiens
uggcaacauggauggauucug

SEQ ID NO: 3113 - RNA, 23 nt, Homo sapiens
uggcaagaauucuuaccgugugg

SEQ ID NO: 3114 - RNA, 22 nt, Homo sapiens
uggcaagaccccaucucuacaa

SEQ ID NO: 3115 - RNA, 22 nt, Homo sapiens
uggcaagagauaugugucuaua

SEQ ID NO: 3116 - RNA, 22 nt, Homo sapiens
uggcaagauuguuccgguuugg

SEQ ID NO: 3117 - RNA, 18 nt, Homo sapiens
uggcaagugccauacggu

SEQ ID NO: 3118 - RNA, 22 nt, Homo sapiens
uggcaauaaaaugcaguuacuu

SEQ ID NO: 3119 - RNA, 18 nt, Homo sapiens
uggcaauaugguucuacc

SEQ ID NO: 3120 - RNA, 19 nt, Homo sapiens
uggcaaugucagcagagau

SEQ ID NO: 3121 - RNA, 22 nt, Homo sapiens
uggcaauguggaaugguccagg

SEQ ID NO: 3122 - RNA, 19 nt, Homo sapiens
uggcacauguauacauaug

SEQ ID NO: 3123 - RNA, 22 nt, Homo sapiens
uggcagugggagauauuuuauu

SEQ ID NO: 3124 - RNA, 22 nt, Homo sapiens
uggcaguuuacaaaugccauga

SEQ ID NO: 3125 - RNA, 22 nt, Homo sapiens
uggcauauaauauagaagacua

SEQ ID NO: 3126 - RNA, 23 nt, Homo sapiens
uggcauuuuaguuagcuucagug

SEQ ID NO: 3127 - RNA, 23 nt, Homo sapiens
uggaggacaagcauggauaguga

SEQ ID NO: 3128 - RNA, 22 nt, Homo sapiens
uggcagcugcuucaugggaugc

SEQ ID NO: 3129 - RNA, 22 nt, Homo sapiens
uggcaccauccaggugucucua

SEQ ID NO: 3130 - RNA, 20 nt, Homo sapiens
uggcaccugacagauagcca

SEQ ID NO: 3131 - RNA, 22 nt, Homo sapiens
uggcagauaggauacaggacua

SEQ ID NO: 3132 - RNA, 22 nt, Homo sapiens
uggcagaugagccgcgcuccaa

SEQ ID NO: 3133 - RNA, 22 nt, Homo sapiens
uggcgagaugcucgugugcaga

SEQ ID NO: 3134 - RNA, 19 nt, Homo sapiens
uggcuagagcagauauccu

SEQ ID NO: 3135 - RNA, 22 nt, Homo sapiens
uggcuagaugagauguacugca

SEQ ID NO: 3136 - RNA, 21 nt, Homo sapiens
uggcuauuucuguggcauaca

SEQ ID NO: 3137 - RNA, 22 nt, Homo sapiens
uggcuccguuguacaggcugga

SEQ ID NO: 3138 - RNA, 22 nt, Homo sapiens
ugggcggagacgugcagccgcc

SEQ ID NO: 3139 - RNA, 22 nt, Homo sapiens
ugggagacuacauuuuuaacaa

SEQ ID NO: 3140 - RNA, 22 nt, Homo sapiens
uggcucuuucuagacuuaauua

SEQ ID NO: 3141 - RNA, 20 nt, Homo sapiens
uggcucuuugcugcuaaagu

SEQ ID NO: 3142 - RNA, 22 nt, Homo sapiens
uggcuugauggcacaagguuuc

SEQ ID NO: 3143 - RNA, 22 nt, Mycobacterium avium subsp. paratuberculosis
uggcuggccgucaucaccggcg

SEQ ID NO: 3144 - RNA, 22 nt, Mycobacterium avium subsp. paratuberculosis
uggcugaccagaaagucgacca

SEQ ID NO: 3145 - RNA, 22 nt, Mycobacterium avium subsp. paratuberculosis
ugggccaacggaauguagucgg

SEQ ID NO: 3146 - RNA, 22 nt, Mycobacterium avium subsp. paratuberculosis
ugggccgacggcggcauccggc

SEQ ID NO: 3147 - RNA, 22 nt, Mycobacterium avium subsp. paratuberculosis
ugggcggugguccucaaugcgc

SEQ ID NO: 3148 - RNA, 22 nt, Mycobacterium avium subsp. paratuberculosis
ugggcucaccaggacgucgcgc

SEQ ID NO: 3149 - RNA, 22 nt, Mycobacterium avium subsp. paratuberculosis
ugggcucagccugcuggucgaa

SEQ ID NO: 3150 - RNA, 22 nt, Mycobacterium avium subsp. paratuberculosis
ugggcgcacuuucgccggacgc

SEQ ID NO: 3151 - RNA, 22 nt, Mycobacterium avium subsp. paratuberculosis
ugggcgcgugcguugcagccgg

SEQ ID NO: 3152 - RNA, 22 nt, Mycobacterium avium subsp. paratuberculosis
uggcguggcccugcugcacgcg

SEQ ID NO: 3153 - RNA, 22 nt, Mycobacterium avium subsp. paratuberculosis
uggccagccggccguguagcuc

SEQ ID NO: 3154 - RNA, 22 nt, Mycobacterium avium subsp. paratuberculosis
uggccagcuugguggugucggu

SEQ ID NO: 3155 - RNA, 22 nt, Mycobacterium avium subsp. paratuberculosis
uggcgcaauuggcggacaugcu

SEQ ID NO: 3156 - RNA, 23 nt, Mycobacterium avium subsp. paratuberculosis
uggcaggccggccugaugguggc

SEQ ID NO: 3157 - RNA, 22 nt, Mycobacterium avium subsp. paratuberculosis
uggcaccaagaaguggggggug

SEQ ID NO: 3158 - RNA, 22 nt, Mycobacterium avium subsp. paratuberculosis
uggacgcgggccugucccacgu

SEQ ID NO: 3159 - RNA, 22 nt, Mycobacterium avium subsp. paratuberculosis
ugcaggauccgccaggcgacuu

SEQ ID NO: 3160 - RNA, 22 nt, Mycobacterium avium subsp. paratuberculosis
ugcaggccgucgcggguguugu

SEQ ID NO: 3161 - RNA, 22 nt, Mycobacterium avium subsp. paratuberculosis
ugcgcagcccugggaagcggcc

SEQ ID NO: 3162 - RNA, 22 nt, Mycobacterium avium subsp. paratuberculosis
ugcgccaccaagauaucgggcg

SEQ ID NO: 3163 - RNA, 22 nt, Mycobacterium avium subsp. paratuberculosis
ugcgccaccgguggaacggucg

SEQ ID NO: 3164 - RNA, 22 nt, Mycobacterium avium subsp. paratuberculosis
ugcgcgcggaccugcuccacca

SEQ ID NO: 3165 - RNA, 22 nt, Mycobacterium avium subsp. paratuberculosis
ugcccaccacgccgucgggcca

SEQ ID NO: 3166 - RNA, 22 nt, Mycobacterium avium subsp. paratuberculosis
ugccccuacuugucccgcucgg

SEQ ID NO: 3167 - RNA, 22 nt, Mycobacterium avium subsp. paratuberculosis
ugcccggcggugcgccuaccgg

SEQ ID NO: 3168 - RNA, 22 nt, Mycobacterium avium subsp. paratuberculosis
ugcccggcugggaagccggcau

SEQ ID NO: 3169 - RNA, 22 nt, Mycobacterium avium subsp. paratuberculosis
ugcccggcuucaucgacucgac

SEQ ID NO: 3170 - RNA, 22 nt, Mycobacterium avium subsp. paratuberculosis
ugcugggcggugccgcagccga

SEQ ID NO: 3171 - RNA, 22 nt, Mycobacterium avium subsp. paratuberculosis
ugcugggcucgcugcggaucgg

SEQ ID NO: 3172 - RNA, 22 nt, Mycobacterium avium subsp. paratuberculosis
ugcugcgcacuuugccgcuccu

SEQ ID NO: 3173 - RNA, 22 nt, Mycobacterium avium subsp. paratuberculosis
ugcuggucgagcggaugcaguc

SEQ ID NO: 3174 - RNA, 22 nt, Mycobacterium avium subsp. paratuberculosis
ugcuuggacuccucggggaugu

SEQ ID NO: 3175 - RNA, 22 nt, Mycobacterium avium subsp. paratuberculosis
uggaaaagauggguccgguccg

SEQ ID NO: 3176 - RNA, 23 nt, Mycobacterium avium subsp. paratuberculosis
ugcuggcccccguguucuccucc

SEQ ID NO: 3177 - RNA, 22 nt, Mycobacterium avium subsp. paratuberculosis
ugcuggccgacauggcgagaau

SEQ ID NO: 3178 - RNA, 22 nt, Mycobacterium avium subsp. paratuberculosis
ugcugggaucgcuccccgacau

SEQ ID NO: 3179 - RNA, 22 nt, Mycobacterium avium subsp. paratuberculosis
ugcacugccgugaagagugcuc

SEQ ID NO: 3180 - RNA, 23 nt, Mycobacterium avium subsp. paratuberculosis
ugcacgucugccucgccgacccc

SEQ ID NO: 3181 - RNA, 22 nt, Mycobacterium avium subsp. paratuberculosis
ugagaggugacgcaauugacgc

SEQ ID NO: 3182 - RNA, 22 nt, Mycobacterium avium subsp. paratuberculosis
ugaccugcgaccaggaccgguc

SEQ ID NO: 3183 - RNA, 22 nt, Mycobacterium avium subsp. paratuberculosis
ugaccugcgcggcccggccacu

SEQ ID NO: 3184 - RNA, 22 nt, Mycobacterium avium subsp. paratuberculosis
ugacgccaguucuccgcgccga

SEQ ID NO: 3185 - RNA, 22 nt, Mycobacterium avium subsp. paratuberculosis
ucucggccggccgcgccguguc

SEQ ID NO: 3186 - RNA, 17 nt, Mycobacterium avium subsp. paratuberculosis
ucugcagcugcgccugc

SEQ ID NO: 3187 - RNA, 19 nt, Mycobacterium avium subsp. paratuberculosis
ucugcaggguggcccaguu

SEQ ID NO: 3188 - RNA, 22 nt, Mycobacterium avium subsp. paratuberculosis
ucugcauucgaaaguacuauuu

SEQ ID NO: 3189 - RNA, 22 nt, Mycobacterium avium subsp. paratuberculosis
ucugccaacauaagagccgacg

SEQ ID NO: 3190 - RNA, 22 nt, Mycobacterium avium subsp. paratuberculosis
ucuggccaccaccaaacgccug

SEQ ID NO: 3191 - RNA, 22 nt, Mycobacterium avium subsp. paratuberculosis
ucugucucaggugcaggacgac

SEQ ID NO: 3192 - RNA, 23 nt, Mycobacterium avium subsp. paratuberculosis
ucuggccucggagccgccgagcc

SEQ ID NO: 3193 - RNA, 22 nt, Mycobacterium avium subsp. paratuberculosis
ucugggcccgucacggugccgg

SEQ ID NO: 3194 - RNA, 22 nt, Mycobacterium avium subsp. paratuberculosis
ucuugcagggccuggagcuugg

SEQ ID NO: 3195 - RNA, 22 nt, Mycobacterium avium subsp. paratuberculosis
ucuuggugcacgaucagcucgc

SEQ ID NO: 3196 - RNA, 22 nt, Mycobacterium avium subsp. paratuberculosis
uuggucucgcucagcucggugg

SEQ ID NO: 3197 - RNA, 22 nt, Mycobacterium avium subsp. paratuberculosis
uuggugguggucgucgacgagc

SEQ ID NO: 3198 - RNA, 22 nt, Mycobacterium avium subsp. paratuberculosis
uuggucacccugaccucaccga

SEQ ID NO: 3199 - RNA, 21 nt, Mycobacterium avium subsp. paratuberculosis
uugucaccgccguccggcgac

SEQ ID NO: 3200 - RNA, 22 nt, Mycobacterium avium subsp. paratuberculosis
uuguaugaccucgguugaugcu

SEQ ID NO: 3201 - RNA, 22 nt, Mycobacterium avium subsp. paratuberculosis
uuguggccggugucucaugucg

SEQ ID NO: 3202 - RNA, 21 nt, Mycobacterium avium subsp. paratuberculosis
uugguguugcggcugcggucc

SEQ ID NO: 3203 - RNA, 22 nt, Mycobacterium avium subsp. paratuberculosis
uuguuuuuggccggauggccgu

SEQ ID NO: 3204 - RNA, 22 nt, Mycobacterium avium subsp. paratuberculosis
uugcgcugcugccauaccugcu

SEQ ID NO: 3205 - RNA, 22 nt, Mycobacterium avium subsp. paratuberculosis
uugcuggcaccgcugcgcuggg

SEQ ID NO: 3206 - RNA, 22 nt, Mycobacterium avium subsp. paratuberculosis
uucggggagcgcgacaccguuu

SEQ ID NO: 3207 - RNA, 22 nt, Mycobacterium avium subsp. paratuberculosis
uugaggaucagguucagcuggc

SEQ ID NO: 3208 - RNA, 22 nt, Mycobacterium avium subsp. paratuberculosis
uucugguccuucauccggugcg

SEQ ID NO: 3209 - RNA, 22 nt, Mycobacterium avium subsp. paratuberculosis
uugagguugaacuugccggugc

SEQ ID NO: 3210 - RNA, 22 nt, Mycobacterium avium subsp. paratuberculosis
uguccgcagaucgagcagccgu

SEQ ID NO: 3211 - RNA, 22 nt, Mycobacterium avium subsp. paratuberculosis
uguccugcgacccgucgcgcgg

SEQ ID NO: 3212 - RNA, 22 nt, Mycobacterium avium subsp. paratuberculosis
ugucgccaccggcuccgcaucg

SEQ ID NO: 3213 - RNA, 23 nt, Mycobacterium avium subsp. paratuberculosis
ugugcuuccgggugucgucggac

SEQ ID NO: 3214 - RNA, 22 nt, Mycobacterium avium subsp. paratuberculosis
ugugaccuccggugggcugauc

SEQ ID NO: 3215 - RNA, 22 nt, Mycobacterium avium subsp. paratuberculosis
ugguggagcagguccgcgcgca

SEQ ID NO: 3216 - RNA, 22 nt, Mycobacterium avium subsp. paratuberculosis
ugguggcgcuggucgcggugcu

SEQ ID NO: 3217 - RNA, 22 nt, Mycobacterium avium subsp. paratuberculosis
ugguggucgcgcugacgcucgc

SEQ ID NO: 3218 - RNA, 22 nt, Mycobacterium avium subsp. paratuberculosis
ugguggucuugcgcgccagccg

SEQ ID NO: 3219 - RNA, 22 nt, Mycobacterium avium subsp. paratuberculosis
ugguggugcccggcgucggcgc

SEQ ID NO: 3220 - RNA, 22 nt, Mycobacterium avium subsp. paratuberculosis
uggugguggucaucgcgauccu

SEQ ID NO: 3221 - RNA, 22 nt, Mycobacterium avium subsp. paratuberculosis
uggugguccgagugaccauggu

SEQ ID NO: 3222 - RNA, 22 nt, Mycobacterium avium subsp. paratuberculosis
ugguuggucaccaucaccgacg

SEQ ID NO: 3223 - RNA, 18 nt, Mycobacterium avium subsp. paratuberculosis
uggguccaaguauccuga

SEQ ID NO: 3224 - RNA, 22 nt, Mycobacterium avium subsp. paratuberculosis
ugggcuggcgcgccgccgaggu

SEQ ID NO: 3225 - RNA, 18 nt, Mycobacterium avium subsp. paratuberculosis
ugggcuggcgguccugcg

SEQ ID NO: 3226 - RNA, 22 nt, Mycobacterium avium subsp. paratuberculosis
uggucagccgccaggcgucggc

SEQ ID NO: 3227 - RNA, 22 nt, Mycobacterium avium subsp. paratuberculosis
uuacuuaucgguaagucaguua

SEQ ID NO: 3228 - RNA, 22 nt, Mycobacterium avium subsp. paratuberculosis
uucagggucucgccgaucaccc

SEQ ID NO: 3229 - RNA, 22 nt, Mycobacterium avium subsp. paratuberculosis
uucaagguugaagcccuaaccu

SEQ ID NO: 3230 - RNA, 22 nt, Mycobacterium avium subsp. paratuberculosis
ugugggaugaggugcaggugca

SEQ ID NO: 3231 - RNA, 22 nt, Mycobacterium avium subsp. paratuberculosis
ugugguaccggcccguugcugc

SEQ ID NO: 3232 - RNA, 22 nt, Mycobacterium avium subsp. paratuberculosis
uuuggcugagcacgucgacccg

SEQ ID NO: 3233 - RNA, 22 nt, Mycobacterium avium subsp. paratuberculosis
uugucaccggccuggcccuggu

SEQ ID NO: 3234 - RNA, 22 nt, Mycobacterium avium subsp. paratuberculosis
uuucugaguucgcgggucaccg

SEQ ID NO: 3235 - RNA, 22 nt, Mycobacterium avium subsp. paratuberculosis
uuucauucgcccguuggguugg

SEQ ID NO: 3236 - RNA, 22 nt, Mycobacterium avium subsp. paratuberculosis
caauuucuacgugaugcgcaac

SEQ ID NO: 3237 - RNA, 22 nt, Mycobacterium avium subsp. paratuberculosis
caagcugcgcgccggaccgugg

SEQ ID NO: 3238 - RNA, 20 nt, Mycobacterium avium subsp. paratuberculosis
caagggaguauucgggguuc

SEQ ID NO: 3239 - RNA, 22 nt, Mycobacterium avium subsp. paratuberculosis
auugcucagcagcuuguucagg

SEQ ID NO: 3240 - RNA, 22 nt, Mycobacterium avium subsp. paratuberculosis
auuggcacgucguagaauuggg

SEQ ID NO: 3241 - RNA, 22 nt, Mycobacterium avium subsp. paratuberculosis
auguuggccagccacgcguccg

SEQ ID NO: 3242 - RNA, 22 nt, Mycobacterium avium subsp. paratuberculosis
cagcuuggccaggucucccucg

SEQ ID NO: 3243 - RNA, 22 nt, Mycobacterium avium subsp. paratuberculosis
cagcuugucgccgacgugcgcg

SEQ ID NO: 3244 - RNA, 22 nt, Mycobacterium avium subsp. paratuberculosis
caggaugaagccgacuucgacc

SEQ ID NO: 3245 - RNA, 22 nt, Mycobacterium avium subsp. paratuberculosis
caggauguggcugaccugcagg

SEQ ID NO: 3246 - RNA, 22 nt, Mycobacterium avium subsp. paratuberculosis
caggcugcccggcugcugccca

SEQ ID NO: 3247 - RNA, 22 nt, Mycobacterium avium subsp. paratuberculosis
caggcuggcaucgucggcgccg

SEQ ID NO: 3248 - RNA, 22 nt, Mycobacterium avium subsp. paratuberculosis
cagcccggccagcucgucgggg

SEQ ID NO: 3249 - RNA, 22 nt, Mycobacterium avium subsp. paratuberculosis
cagcgcgccgcggguggaguug

SEQ ID NO: 3250 - RNA, 22 nt, Mycobacterium avium subsp. paratuberculosis
cagcgggugcucggccugccgc

SEQ ID NO: 3251 - RNA, 22 nt, Mycobacterium avium subsp. paratuberculosis
cagcucgcccgcggccuggccg

SEQ ID NO: 3252 - RNA, 22 nt, Mycobacterium avium subsp. paratuberculosis
cagcugcaggguggccagcgac

SEQ ID NO: 3253 - RNA, 22 nt, Mycobacterium avium subsp. paratuberculosis
cagcauccgacgcgccggagcc

SEQ ID NO: 3254 - RNA, 22 nt, Mycobacterium avium subsp. paratuberculosis
cagcaugucgaucgaccagguc

SEQ ID NO: 3255 - RNA, 22 nt, Mycobacterium avium subsp. paratuberculosis
cagcaggucauguucuagcggc

SEQ ID NO: 3256 - RNA, 22 nt, Mycobacterium avium subsp. paratuberculosis
cagcacgcggcguccaucaucg

SEQ ID NO: 3257 - RNA, 22 nt, Mycobacterium avium subsp. paratuberculosis
cagcaaggcgcaugucggagcg

SEQ ID NO: 3258 - RNA, 22 nt, Mycobacterium avium subsp. paratuberculosis
cagcacaccgcgguguucaacg

SEQ ID NO: 3259 - RNA, 22 nt, Mycobacterium avium subsp. paratuberculosis
cacuuccauuucccuugcccgc

SEQ ID NO: 3260 - RNA, 22 nt, Mycobacterium avium subsp. paratuberculosis
cacaccugggaagagcgcuggg

SEQ ID NO: 3261 - RNA, 22 nt, Mycobacterium avium subsp. paratuberculosis
caccagcaggauugggacgucg

SEQ ID NO: 3262 - RNA, 22 nt, Mycobacterium avium subsp. paratuberculosis
cacaggugaucaucgaugcggc

SEQ ID NO: 3263 - RNA, 22 nt, Mycobacterium avium subsp. paratuberculosis
cacggcccgcucggacacccgc

SEQ ID NO: 3264 - RNA, 22 nt, Mycobacterium avium subsp. paratuberculosis
cacgaugcuggagaucaccagg

SEQ ID NO: 3265 - RNA, 22 nt, Mycobacterium avium subsp. paratuberculosis
cacgcacugaccgggcugcagg

SEQ ID NO: 3266 - RNA, 23 nt, Mycobacterium avium subsp. paratuberculosis
cacgccagcgugacgcucggugc

SEQ ID NO: 3267 - RNA, 22 nt, Mycobacterium avium subsp. paratuberculosis
ccaccaccugcggcagcucgaa

SEQ ID NO: 3268 - RNA, 22 nt, Mycobacterium avium subsp. paratuberculosis
ccacacccgcugcgagaucagc

SEQ ID NO: 3269 - RNA, 22 nt, Mycobacterium avium subsp. paratuberculosis
ccaacaacucgacguucggcgg

SEQ ID NO: 3270 - RNA, 22 nt, Mycobacterium avium subsp. paratuberculosis
ccaaccgcaucggcagcgccac

SEQ ID NO: 3271 - RNA, 22 nt, Mycobacterium avium subsp. paratuberculosis
ccagagccuuuccagcaggccc

SEQ ID NO: 3272 - RNA, 22 nt, Mycobacterium avium subsp. paratuberculosis
ccacagagacucacgcgauggc

SEQ ID NO: 3273 - RNA, 22 nt, Mycobacterium avium subsp. paratuberculosis
ccagcagcgagaugacccggug

SEQ ID NO: 3274 - RNA, 22 nt, Mycobacterium avium subsp. paratuberculosis
ccacccgcaucccgugccaggc

SEQ ID NO: 3275 - RNA, 22 nt, Mycobacterium avium subsp. paratuberculosis
caguuccucgucgcagucggcg

SEQ ID NO: 3276 - RNA, 22 nt, Mycobacterium avium subsp. paratuberculosis
caguucggcuuugagcucgucg

SEQ ID NO: 3277 - RNA, 22 nt, Mycobacterium avium subsp. paratuberculosis
cagguucgugccuucggacagg

SEQ ID NO: 3278 - RNA, 22 nt, Mycobacterium avium subsp. paratuberculosis
caguauggauuggccggcgcgc

SEQ ID NO: 3279 - RNA, 18 nt, Mycobacterium avium subsp. paratuberculosis
cagggucuuucuggugcc

SEQ ID NO: 3280 - RNA, 22 nt, Mycobacterium avium subsp. paratuberculosis
cagggugccgccuccaggucgc

SEQ ID NO: 3281 - RNA, 22 nt, Mycobacterium avium subsp. paratuberculosis
caggucuuccagaaggcggucg

SEQ ID NO: 3282 - RNA, 22 nt, Mycobacterium avium subsp. paratuberculosis
caucucgggcgcgauguaggcg

SEQ ID NO: 3283 - RNA, 22 nt, Mycobacterium avium subsp. paratuberculosis
caucugcacgcaggccugcacg

SEQ ID NO: 3284 - RNA, 22 nt, Mycobacterium avium subsp. paratuberculosis
cauccaccuggagggcccgugg

SEQ ID NO: 3285 - RNA, 22 nt, Mycobacterium avium subsp. paratuberculosis
caugaggugacguucgaauccg

SEQ ID NO: 3286 - RNA, 22 nt, Mycobacterium avium subsp. paratuberculosis
caugaguacaagugaguaccga

SEQ ID NO: 3287 - RNA, 22 nt, Mycobacterium avium subsp. paratuberculosis
cauccugggcgccaccgcgcac

SEQ ID NO: 3288 - RNA, 22 nt, Mycobacterium avium subsp. paratuberculosis
ccagguugcgguggucccggug

SEQ ID NO: 3289 - RNA, 22 nt, Mycobacterium avium subsp. paratuberculosis
ccaguucgacggcgucgacgcc

SEQ ID NO: 3290 - RNA, 22 nt, Mycobacterium avium subsp. paratuberculosis
ccauaaguaguccuaauugccc

SEQ ID NO: 3291 - RNA, 22 nt, Mycobacterium avium subsp. paratuberculosis
ccagcaggucgcgguuggccag

SEQ ID NO: 3292 - RNA, 22 nt, Mycobacterium avium subsp. paratuberculosis
ccagccgcggucgggcagccag

SEQ ID NO: 3293 - RNA, 22 nt, Mycobacterium avium subsp. paratuberculosis
ccagcccgaacuaucggcugug

SEQ ID NO: 3294 - RNA, 22 nt, Mycobacterium avium subsp. paratuberculosis
ccagcccuaugagcagcccggc

SEQ ID NO: 3295 - RNA, 22 nt, Mycobacterium avium subsp. paratuberculosis
ccagccgcagcccguccuccau

SEQ ID NO: 3296 - RNA, 22 nt, Mycobacterium avium subsp. paratuberculosis
ccagccguggcaggacaacgag

SEQ ID NO: 3297 - RNA, 22 nt, Mycobacterium avium subsp. paratuberculosis
ccagccguugucgaacagcagc

SEQ ID NO: 3298 - RNA, 22 nt, Mycobacterium avium subsp. paratuberculosis
ccagcugggcgccaccugcaac

SEQ ID NO: 3299 - RNA, 22 nt, Mycobacterium avium subsp. paratuberculosis
ccagcugguccagcacgucggg

SEQ ID NO: 3300 - RNA, 22 nt, Mycobacterium avium subsp. paratuberculosis
cccugggccugacauacgugcg

SEQ ID NO: 3301 - RNA, 22 nt, Mycobacterium avium subsp. paratuberculosis
cccgcgcccggguucgaggcca

SEQ ID NO: 3302 - RNA, 22 nt, Mycobacterium avium subsp. paratuberculosis
cccagcagcugcaggccgacag

SEQ ID NO: 3303 - RNA, 22 nt, Mycobacterium avium subsp. paratuberculosis
cccagcagcuggaggggcucgc

SEQ ID NO: 3304 - RNA, 22 nt, Mycobacterium avium subsp. paratuberculosis
cccagcagcuggauccgcaggc

SEQ ID NO: 3305 - RNA, 22 nt, Mycobacterium avium subsp. paratuberculosis
ccaugguggcguccaggaugcg

SEQ ID NO: 3306 - RNA, 18 nt, Mycobacterium avium subsp. paratuberculosis
cccaugaguuuugccgcc

SEQ ID NO: 3307 - RNA, 22 nt, Mycobacterium avium subsp. paratuberculosis
ccccagccgagcgugcaccggc

SEQ ID NO: 3308 - RNA, 22 nt, Mycobacterium avium subsp. paratuberculosis
cccaggcuggccaggaugccca

SEQ ID NO: 3309 - RNA, 22 nt, Mycobacterium avium subsp. paratuberculosis
ccuugugaccgcgcuguacguc

SEQ ID NO: 3310 - RNA, 22 nt, Mycobacterium avium subsp. paratuberculosis
cgaccugcggccgucggaugcg

SEQ ID NO: 3311 - RNA, 22 nt, Mycobacterium avium subsp. paratuberculosis
cgagcucaagauccaugccgcc

SEQ ID NO: 3312 - RNA, 22 nt, Mycobacterium avium subsp. paratuberculosis
cgagcugcucgacaucgacgag

SEQ ID NO: 3313 - RNA, 22 nt, Mycobacterium avium subsp. paratuberculosis
cgacuugagcgcggccaggaug

SEQ ID NO: 3314 - RNA, 19 nt, Mycobacterium avium subsp. paratuberculosis
cgcaagggccuagucggga

SEQ ID NO: 3315 - RNA, 22 nt, Mycobacterium avium subsp. paratuberculosis
cgcauccagccgcuggcgcccg

SEQ ID NO: 3316 - RNA, 22 nt, Mycobacterium avium subsp. paratuberculosis
cgcacccuguccggcgggcagc

SEQ ID NO: 3317 - RNA, 21 nt, Mycobacterium avium subsp. paratuberculosis
cgcagcagucggucgauguuc

SEQ ID NO: 3318 - RNA, 22 nt, Mycobacterium avium subsp. paratuberculosis
cgcagcauugcguccgccuaac

SEQ ID NO: 3319 - RNA, 22 nt, Mycobacterium avium subsp. paratuberculosis
cgcagcauuucuucgaucgcgg

SEQ ID NO: 3320 - RNA, 22 nt, Mycobacterium avium subsp. paratuberculosis
cgccacccccgagcaggcggcg

SEQ ID NO: 3321 - RNA, 22 nt, Mycobacterium avium subsp. paratuberculosis
cgccccaccgauugcucgaaau

SEQ ID NO: 3322 - RNA, 22 nt, Mycobacterium avium subsp. paratuberculosis
cgcccggcgccgcgacugguga

SEQ ID NO: 3323 - RNA, 22 nt, Mycobacterium avium subsp. paratuberculosis
cgcccggcgcgaccuuccuguc

SEQ ID NO: 3324 - RNA, 22 nt, Mycobacterium avium subsp. paratuberculosis
cgccuugggcucccaguggucg

SEQ ID NO: 3325 - RNA, 22 nt, Mycobacterium avium subsp. paratuberculosis
cgcgcgccguagacguccagca

SEQ ID NO: 3326 - RNA, 22 nt, Mycobacterium avium subsp. paratuberculosis
ccgacgaguucggccuguucga

SEQ ID NO: 3327 - RNA, 17 nt, Mycobacterium avium subsp. paratuberculosis
ccgagcaccaccagcac

SEQ ID NO: 3328 - RNA, 22 nt, Mycobacterium avium subsp. paratuberculosis
ccgagcaccggauccaguccgc

SEQ ID NO: 3329 - RNA, 22 nt, Mycobacterium avium subsp. paratuberculosis
ccgagcucgcgcugcugaccgc

SEQ ID NO: 3330 - RNA, 22 nt, Mycobacterium avium subsp. paratuberculosis
ccgccuccccguuggggugauu

SEQ ID NO: 3331 - RNA, 22 nt, Mycobacterium avium subsp. paratuberculosis
ccuugagcaccgguccggcguu

SEQ ID NO: 3332 - RNA, 20 nt, Mycobacterium avium subsp. paratuberculosis
ccugggccaaaaaucgcacc

SEQ ID NO: 3333 - RNA, 22 nt, Mycobacterium avium subsp. paratuberculosis
ccuggccgacaccaaccccgaa

SEQ ID NO: 3334 - RNA, 22 nt, Mycobacterium avium subsp. paratuberculosis
ccugccagucccgcucgauggg

SEQ ID NO: 3335 - RNA, 22 nt, Mycobacterium avium subsp. paratuberculosis
ccuccuggccgcccagggcgug

SEQ ID NO: 3336 - RNA, 23 nt, Mycobacterium avium subsp. paratuberculosis
ccgguuugcggugcagcacuguc

SEQ ID NO: 3337 - RNA, 22 nt, Mycobacterium avium subsp. paratuberculosis
ccguggccuugccgccggauga

SEQ ID NO: 3338 - RNA, 22 nt, Mycobacterium avium subsp. paratuberculosis
ccgcucccaccgccgggcugau

SEQ ID NO: 3339 - RNA, 22 nt, Mycobacterium avium subsp. paratuberculosis
ccgccacuucccgcagguuguc

SEQ ID NO: 3340 - RNA, 22 nt, Mycobacterium avium subsp. paratuberculosis
ccgggccagcuccacgcacugg

SEQ ID NO: 3341 - RNA, 22 nt, Mycobacterium avium subsp. paratuberculosis
cgugguggcgcagaccaagacc

SEQ ID NO: 3342 - RNA, 22 nt, Mycobacterium avium subsp. paratuberculosis
cguggugguagccggcggucag

SEQ ID NO: 3343 - RNA, 22 nt, Mycobacterium avium subsp. paratuberculosis
cguggagggcugcacggcgccg

SEQ ID NO: 3344 - RNA, 22 nt, Mycobacterium avium subsp. paratuberculosis
cggucaggccacugcucggccc

SEQ ID NO: 3345 - RNA, 23 nt, Mycobacterium avium subsp. paratuberculosis
cggucagggugaugaugccguuc

SEQ ID NO: 3346 - RNA, 22 nt, Mycobacterium avium subsp. paratuberculosis
cggucaccccguagcgggccag

SEQ ID NO: 3347 - RNA, 22 nt, Mycobacterium avium subsp. paratuberculosis
cggucaccgccgcgccggacgg

SEQ ID NO: 3348 - RNA, 22 nt, Mycobacterium avium subsp. paratuberculosis
cggucaccgguguggagauguu

SEQ ID NO: 3349 - RNA, 22 nt, Mycobacterium avium subsp. paratuberculosis
cggugguggccggcagccaguc

SEQ ID NO: 3350 - RNA, 22 nt, Mycobacterium avium subsp. paratuberculosis
cggugguggcgccgcugcuguc

SEQ ID NO: 3351 - RNA, 22 nt, Mycobacterium avium subsp. paratuberculosis
cgugccccgcgacaagccaggc

SEQ ID NO: 3352 - RNA, 22 nt, Mycobacterium avium subsp. paratuberculosis
cucccggggcgagcugcacggc

SEQ ID NO: 3353 - RNA, 22 nt, Mycobacterium avium subsp. paratuberculosis
cucccuggcugccgcuggagcg

SEQ ID NO: 3354 - RNA, 22 nt, Mycobacterium avium subsp. paratuberculosis
cucacuccucguucaccugugu

SEQ ID NO: 3355 - RNA, 22 nt, Mycobacterium avium subsp. paratuberculosis
cucacgccgucggugcugggcc

SEQ ID NO: 3356 - RNA, 19 nt, Mycobacterium avium subsp. paratuberculosis
cucuagccuacgcagcccg

SEQ ID NO: 3357 - RNA, 22 nt, Mycobacterium avium subsp. paratuberculosis
cucgcugguggccgcggugcug

SEQ ID NO: 3358 - RNA, 22 nt, Mycobacterium avium subsp. paratuberculosis
cucggccaagggcccgcacgcc

SEQ ID NO: 3359 - RNA, 22 nt, Mycobacterium avium subsp. paratuberculosis
cucggccaggcucgcggcgaug

SEQ ID NO: 3360 - RNA, 22 nt, Mycobacterium avium subsp. paratuberculosis
cuccgggcugaucgcccgcacc

SEQ ID NO: 3361 - RNA, 20 nt, Mycobacterium avium subsp. paratuberculosis
cuaccugguggagcaggccc

SEQ ID NO: 3362 - RNA, 22 nt, Mycobacterium avium subsp. paratuberculosis
cuccuggaagccggccgcgacg

SEQ ID NO: 3363 - RNA, 22 nt, Mycobacterium avium subsp. paratuberculosis
cucugcugcgcugccuggucga

SEQ ID NO: 3364 - RNA, 22 nt, Mycobacterium avium subsp. paratuberculosis
cugaccccggcgcgccagucgg

SEQ ID NO: 3365 - RNA, 21 nt, Mycobacterium avium subsp. paratuberculosis
cgcugcccggcgcgauguugg

SEQ ID NO: 3366 - RNA, 22 nt, Mycobacterium avium subsp. paratuberculosis
cgccuugagacaggacacgucg

SEQ ID NO: 3367 - RNA, 22 nt, Mycobacterium avium subsp. paratuberculosis
cgcccggccaccgacgugaugg

SEQ ID NO: 3368 - RNA, 22 nt, Mycobacterium avium subsp. paratuberculosis
cggagaccauguucgccgagca

SEQ ID NO: 3369 - RNA, 22 nt, Mycobacterium avium subsp. paratuberculosis
cgggccaaccggcuggcccggc

SEQ ID NO: 3370 - RNA, 22 nt, Mycobacterium avium subsp. paratuberculosis
cggguucaccgcggugauccug

SEQ ID NO: 3371 - RNA, 22 nt, Mycobacterium avium subsp. paratuberculosis
cggcugcaacgacugaccggcg

SEQ ID NO: 3372 - RNA, 22 nt, Mycobacterium avium subsp. paratuberculosis
aucuucuucuccgcggugcuga

SEQ ID NO: 3373 - RNA, 22 nt, Mycobacterium avium subsp. paratuberculosis
augauggugguaagcauuucgg

SEQ ID NO: 3374 - RNA, 22 nt, Mycobacterium avium subsp. paratuberculosis
augcuuggggguucucagcggu

SEQ ID NO: 3375 - RNA, 22 nt, Mycobacterium avium subsp. paratuberculosis
augccucacucucgcaacgguc

SEQ ID NO: 3376 - RNA, 22 nt, Mycobacterium avium subsp. paratuberculosis
auggacaaccacuucgugccga

SEQ ID NO: 3377 - RNA, 22 nt, Mycobacterium avium subsp. paratuberculosis
auggcagcagcaucgugguggc

SEQ ID NO: 3378 - RNA, 22 nt, Mycobacterium avium subsp. paratuberculosis
auggcagcggauccucgacauc

SEQ ID NO: 3379 - RNA, 22 nt, Mycobacterium avium subsp. paratuberculosis
auggucaggaugucgaccucga

SEQ ID NO: 3380 - RNA, 22 nt, Mycobacterium avium subsp. paratuberculosis
auggcgaucggcgggcacggcc

SEQ ID NO: 3381 - RNA, 22 nt, Mycobacterium avium subsp. paratuberculosis
augguggccagcacccccggca

SEQ ID NO: 3382 - RNA, 22 nt, Mycobacterium avium subsp. paratuberculosis
auccaggccgccgagaucgagc

SEQ ID NO: 3383 - RNA, 23 nt, Mycobacterium avium subsp. paratuberculosis
auccaggcgcugcgcgagcaccg

SEQ ID NO: 3384 - RNA, 22 nt, Mycobacterium avium subsp. paratuberculosis
auccaggcgguguucggcuuca

SEQ ID NO: 3385 - RNA, 22 nt, Mycobacterium avium subsp. paratuberculosis
auccaggcguugaucgacggcc

SEQ ID NO: 3386 - RNA, 18 nt, Mycobacterium avium subsp. paratuberculosis
auccugcacugcgacggc

SEQ ID NO: 3387 - RNA, 22 nt, Mycobacterium avium subsp. paratuberculosis
aucagcagcgaccgcacgugcg

SEQ ID NO: 3388 - RNA, 22 nt, Mycobacterium avium subsp. paratuberculosis
aucaccuuggucagcagcgcgg

SEQ ID NO: 3389 - RNA, 22 nt, Mycobacterium avium subsp. paratuberculosis
aucaccugcaugagcugguggc

SEQ ID NO: 3390 - RNA, 22 nt, Mycobacterium avium subsp. paratuberculosis
auccagcagcggccggucccgc

SEQ ID NO: 3391 - RNA, 22 nt, Mycobacterium avium subsp. paratuberculosis
aucaggucggugcggugcuugg

SEQ ID NO: 3392 - RNA, 22 nt, Mycobacterium avium subsp. paratuberculosis
aggugcugcgcggacucuugcu

SEQ ID NO: 3393 - RNA, 22 nt, Mycobacterium avium subsp. paratuberculosis
aggggcugcacgucggccaccc

SEQ ID NO: 3394 - RNA, 22 nt, Mycobacterium avium subsp. paratuberculosis
agggucuaguugaacgagucgc

SEQ ID NO: 3395 - RNA, 22 nt, Mycobacterium avium subsp. paratuberculosis
aggcuugcgcuggcaacucaac

SEQ ID NO: 3396 - RNA, 22 nt, Mycobacterium avium subsp. paratuberculosis
aggucacccugggcgaguuggu

SEQ ID NO: 3397 - RNA, 22 nt, Mycobacterium avium subsp. paratuberculosis
aggucaccgaagagguugccgc

SEQ ID NO: 3398 - RNA, 22 nt, Mycobacterium avium subsp. paratuberculosis
aguccuugaccaggaacuucag

SEQ ID NO: 3399 - RNA, 22 nt, Mycobacterium avium subsp. paratuberculosis
agucccugcugcagcgggguca

SEQ ID NO: 3400 - RNA, 22 nt, Mycobacterium avium subsp. paratuberculosis
agcuggucucggaucuggugcg

SEQ ID NO: 3401 - RNA, 22 nt, Mycobacterium avium subsp. paratuberculosis
agcucagcgaccacacgguguc

SEQ ID NO: 3402 - RNA, 22 nt, Mycobacterium avium subsp. paratuberculosis
agcccggccgcagccuggagcg

SEQ ID NO: 3403 - RNA, 22 nt, Mycobacterium avium subsp. paratuberculosis
agcccggcgaucugcuggcugc

SEQ ID NO: 3404 - RNA, 22 nt, Mycobacterium avium subsp. paratuberculosis
agccgggcgugcucguuggcgu

SEQ ID NO: 3405 - RNA, 22 nt, Mycobacterium avium subsp. paratuberculosis
agcagguggugcgcugcagcga

SEQ ID NO: 3406 - RNA, 21 nt, Mycobacterium avium subsp. paratuberculosis
agcaugaagccggugcucagc

SEQ ID NO: 3407 - RNA, 22 nt, Mycobacterium avium subsp. paratuberculosis
agcagcaugccgucgcggcgaa

SEQ ID NO: 3408 - RNA, 22 nt, Mycobacterium avium subsp. paratuberculosis
acagccgcagcacgggcuggcg

SEQ ID NO: 3409 - RNA, 22 nt, Mycobacterium avium subsp. paratuberculosis
acagcugcgaccacgucagggu

SEQ ID NO: 3410 - RNA, 22 nt, Mycobacterium avium subsp. paratuberculosis
acagaugucaauagugugaguu

SEQ ID NO: 3411 - RNA, 22 nt, Mycobacterium avium subsp. paratuberculosis
accauggccgcccggguggugu

SEQ ID NO: 3412 - RNA, 18 nt, Mycobacterium avium subsp. paratuberculosis
accacccaggagaucguc

SEQ ID NO: 3413 - RNA, 22 nt, Mycobacterium avium subsp. paratuberculosis
accacgaggaccagcgucgcga

SEQ ID NO: 3414 - RNA, 22 nt, Mycobacterium avium subsp. paratuberculosis
accagcagcgcgucacgcugag

SEQ ID NO: 3415 - RNA, 22 nt, Mycobacterium avium subsp. paratuberculosis
accagcagcugcccgggcggua

SEQ ID NO: 3416 - RNA, 22 nt, Mycobacterium avium subsp. paratuberculosis
accagcaguaugggcgccgguu

SEQ ID NO: 3417 - RNA, 22 nt, Mycobacterium avium subsp. paratuberculosis
accugggccagaugcucgacuu

SEQ ID NO: 3418 - RNA, 22 nt, Mycobacterium avium subsp. paratuberculosis
accugggcgcgccggucgagcc

SEQ ID NO: 3419 - RNA, 22 nt, Mycobacterium avium subsp. paratuberculosis
accuccagcacccgggucagcg

SEQ ID NO: 3420 - RNA, 22 nt, Mycobacterium avium subsp. paratuberculosis
accucccagcccucggugaacu

SEQ ID NO: 3421 - RNA, 22 nt, Mycobacterium avium subsp. paratuberculosis
accggcaucaccacggcgaugg

SEQ ID NO: 3422 - RNA, 22 nt, Mycobacterium avium subsp. paratuberculosis
acccggcugccggaccaccuca

SEQ ID NO: 3423 - RNA, 22 nt, Mycobacterium avium subsp. paratuberculosis
acccggcugggcgccuacgcgc

SEQ ID NO: 3424 - RNA, 22 nt, Mycobacterium avium subsp. paratuberculosis
acccggcuggucgaggaccugc

SEQ ID NO: 3425 - RNA, 22 nt, Mycobacterium avium subsp. paratuberculosis
accuugacggcgugcccgacgu

SEQ ID NO: 3426 - RNA, 22 nt, Mycobacterium avium subsp. paratuberculosis
accuugacguccucaucguggg

SEQ ID NO: 3427 - RNA, 22 nt, Mycobacterium avium subsp. paratuberculosis
acgagcuguggguuuccaggua

SEQ ID NO: 3428 - RNA, 22 nt, Mycobacterium avium subsp. paratuberculosis
acgcacccgccgaucgaggacc

SEQ ID NO: 3429 - RNA, 22 nt, Mycobacterium avium subsp. paratuberculosis
acgccgugguacuccggcgcga

SEQ ID NO: 3430 - RNA, 22 nt, Mycobacterium avium subsp. paratuberculosis
acguugggcagaaacgcuuuuc

SEQ ID NO: 3431 - RNA, 22 nt, Mycobacterium avium subsp. paratuberculosis
acgcugggcuacgaggugcgcu

SEQ ID NO: 3432 - RNA, 20 nt, Mycobacterium avium subsp. paratuberculosis
acgucccaauccugcuggug

SEQ ID NO: 3433 - RNA, 22 nt, Mycobacterium avium subsp. paratuberculosis
acguccuggauguggcccgcgc

SEQ ID NO: 3434 - RNA, 22 nt, Mycobacterium avium subsp. paratuberculosis
agacccagcagcaccgacgcga

SEQ ID NO: 3435 - RNA, 22 nt, Mycobacterium avium subsp. paratuberculosis
agaccgagcuguuggccggcgc

SEQ ID NO: 3436 - RNA, 22 nt, Mycobacterium avium subsp. paratuberculosis
agagucucaugggcaucaucgg

SEQ ID NO: 3437 - RNA, 22 nt, Mycobacterium avium subsp. paratuberculosis
agcaccgccagcacccacgaca

SEQ ID NO: 3438 - RNA, 22 nt, Mycobacterium avium subsp. paratuberculosis
agcaccgccgucaccugcccga

SEQ ID NO: 3439 - RNA, 22 nt, Mycobacterium avium subsp. paratuberculosis
agcagagccuugcgcugacgau

SEQ ID NO: 3440 - RNA, 22 nt, Mycobacterium avium subsp. paratuberculosis
agauccagccgagcagcaccau

SEQ ID NO: 3441 - RNA, 22 nt, Mycobacterium avium subsp. paratuberculosis
agagcuccagcgagaacgggcc

SEQ ID NO: 3442 - RNA, 22 nt, Mycobacterium avium subsp. paratuberculosis
agaggaacaucgcgauggcccu

SEQ ID NO: 3443 - RNA, 21 nt, Mycobacterium avium subsp. paratuberculosis
agcaacaauggcgcucggccg

SEQ ID NO: 3444 - RNA, 22 nt, Mycobacterium avium subsp. paratuberculosis
acugccacaacgacucccgcgu

SEQ ID NO: 3445 - RNA, 19 nt, Mycobacterium avium subsp. paratuberculosis
acugcgacgaucaaccggc

SEQ ID NO: 3446 - RNA, 22 nt, Mycobacterium avium subsp. paratuberculosis
acucgcccggcgcccugcugcg

SEQ ID NO: 3447 - RNA, 22 nt, Mycobacterium avium subsp. paratuberculosis
acugggccgcccuguaccggaa

SEQ ID NO: 3448 - RNA, 22 nt, Mycobacterium avium subsp. paratuberculosis
aaugccucaucgaggcgcugca

SEQ ID NO: 3449 - RNA, 22 nt, Mycobacterium avium subsp. paratuberculosis
aauccacaucgccgacggcgug

SEQ ID NO: 3450 - RNA, 22 nt, Mycobacterium avium subsp. paratuberculosis
aaguaucuagaugaauucagug

SEQ ID NO: 3451 - RNA, 22 nt, Mycobacterium avium subsp. paratuberculosis
aaaccagcacugagugcccacc

SEQ ID NO: 3452 - RNA, 22 nt, Mycobacterium avium subsp. paratuberculosis
aaaguuugcgguuucagcauuc

SEQ ID NO: 3453 - RNA, 22 nt, Mycobacterium avium subsp. paratuberculosis
aagacaacgcgugucauuggcg

SEQ ID NO: 3454 - RNA, 22 nt, Mycobacterium avium subsp. paratuberculosis
aagaaggcccagucgcggcugc

SEQ ID NO: 3455 - RNA, 22 nt, Mycobacterium avium subsp. paratuberculosis
aagcaguacgcgaugucggauc

SEQ ID NO: 3456 - RNA, 22 nt, Mycobacterium avium subsp. paratuberculosis
aacugcuggcccggcacagugu

SEQ ID NO: 3457 - RNA, 22 nt, Mycobacterium avium subsp. paratuberculosis
aacaggccgcggcguugcaacu

SEQ ID NO: 3458 - RNA, 22 nt, Mycobacterium avium subsp. paratuberculosis
aacgugaagcuaguuucacguu

SEQ ID NO: 3459 - RNA, 22 nt, Mycobacterium avium subsp. paratuberculosis
gucaccaucaguugccacgacg

SEQ ID NO: 3460 - RNA, 22 nt, Mycobacterium avium subsp. paratuberculosis
gucacgccagcgugacgcucgg

SEQ ID NO: 3461 - RNA, 22 nt, Mycobacterium avium subsp. paratuberculosis
gucacgcuagcgugacgcucgc

SEQ ID NO: 3462 - RNA, 22 nt, Mycobacterium avium subsp. paratuberculosis
guacaugccgccgcaggcgccc

SEQ ID NO: 3463 - RNA, 23 nt, Mycobacterium avium subsp. paratuberculosis
gguucuucuuacggucgcuguca

SEQ ID NO: 3464 - RNA, 22 nt, Mycobacterium avium subsp. paratuberculosis
gguugguggcggcgaucaggau

SEQ ID NO: 3465 - RNA, 22 nt, Mycobacterium avium subsp. paratuberculosis
ggguaucaccucgggcgaggcc

SEQ ID NO: 3466 - RNA, 22 nt, Mycobacterium avium subsp. paratuberculosis
ggguugaugccgaccgucucgu

SEQ ID NO: 3467 - RNA, 22 nt, Mycobacterium avium subsp. paratuberculosis
gggucaccggauggucgaugac

SEQ ID NO: 3468 - RNA, 22 nt, Mycobacterium avium subsp. paratuberculosis
gggugcuuucgcgucugcucgc

SEQ ID NO: 3469 - RNA, 22 nt, Mycobacterium avium subsp. paratuberculosis
ggguggcucaacaccccggacg

SEQ ID NO: 3470 - RNA, 22 nt, Mycobacterium avium subsp. paratuberculosis
ggguggucagcgcgaucuucag

SEQ ID NO: 3471 - RNA, 22 nt, Mycobacterium avium subsp. paratuberculosis
ggucacccgcaacggcgagcag

SEQ ID NO: 3472 - RNA, 22 nt, Mycobacterium avium subsp. paratuberculosis
ggucacccgguugggggucacc

SEQ ID NO: 3473 - RNA, 22 nt, Mycobacterium avium subsp. paratuberculosis
ggugacgccgcaucugcuggug

SEQ ID NO: 3474 - RNA, 22 nt, Mycobacterium avium subsp. paratuberculosis
ggucaccuccaucgcgacgucg

SEQ ID NO: 3475 - RNA, 22 nt, Mycobacterium avium subsp. paratuberculosis
ggucaccuucuccgagcgggcc

SEQ ID NO: 3476 - RNA, 22 nt, Mycobacterium avium subsp. paratuberculosis
ggugguggucgacgaggcgcag

SEQ ID NO: 3477 - RNA, 22 nt, Mycobacterium avium subsp. paratuberculosis
gguucaaggugaugcccgacga

SEQ ID NO: 3478 - RNA, 22 nt, Mycobacterium avium subsp. paratuberculosis
ggugguggcccggaucgacugg

SEQ ID NO: 3479 - RNA, 22 nt, Mycobacterium avium subsp. paratuberculosis
ggguuugguccucgaucacgcg

SEQ ID NO: 3480 - RNA, 22 nt, Mycobacterium avium subsp. paratuberculosis
ggugcugcggcuccacgaaguc

SEQ ID NO: 3481 - RNA, 21 nt, Mycobacterium avium subsp. paratuberculosis
ggugcuuuugugucugcucgc

SEQ ID NO: 3482 - RNA, 22 nt, Mycobacterium avium subsp. paratuberculosis
gggcaccaccgaguagcugccg

SEQ ID NO: 3483 - RNA, 22 nt, Mycobacterium avium subsp. paratuberculosis
ggcuugacaucuauuccggacu

SEQ ID NO: 3484 - RNA, 22 nt, Mycobacterium avium subsp. paratuberculosis
ggcuugaggucgucgcggucac

SEQ ID NO: 3485 - RNA, 22 nt, Mycobacterium avium subsp. paratuberculosis
gggccagaaccaccaggugcgc

SEQ ID NO: 3486 - RNA, 22 nt, Mycobacterium avium subsp. paratuberculosis
gggcgcuggcgcuggacagcga

SEQ ID NO: 3487 - RNA, 22 nt, Mycobacterium avium subsp. paratuberculosis
gggcggcacggugacggccagg

SEQ ID NO: 3488 - RNA, 22 nt, Mycobacterium avium subsp. paratuberculosis
gggcgggucgaucugcagcggg

SEQ ID NO: 3489 - RNA, 21 nt, Mycobacterium avium subsp. paratuberculosis
gggcucagccgaagccggcgc

SEQ ID NO: 3490 - RNA, 22 nt, Mycobacterium avium subsp. paratuberculosis
gggcugaccggcgauggccauc

SEQ ID NO: 3491 - RNA, 22 nt, Mycobacterium avium subsp. paratuberculosis
gggcugcacgacggccuugacu

SEQ ID NO: 3492 - RNA, 22 nt, Mycobacterium avium subsp. paratuberculosis
gggcugguucucggucggcgac

SEQ ID NO: 3493 - RNA, 22 nt, Mycobacterium avium subsp. paratuberculosis
gggcuuggcgcagcgccgcaua

SEQ ID NO: 3494 - RNA, 22 nt, Mycobacterium avium subsp. paratuberculosis
gggguucaucuccgcggcgucg

SEQ ID NO: 3495 - RNA, 22 nt, Mycobacterium avium subsp. paratuberculosis
gggguugacgaucgcugcggcg

SEQ ID NO: 3496 - RNA, 21 nt, Mycobacterium avium subsp. paratuberculosis
gggguuggcacaugaucaccg

SEQ ID NO: 3497 - RNA, 22 nt, Mycobacterium avium subsp. paratuberculosis
ggcugauuuugcgggccgcccg

SEQ ID NO: 3498 - RNA, 22 nt, Mycobacterium avium subsp. paratuberculosis
ggcuggauaacacaggacgacg

SEQ ID NO: 3499 - RNA, 22 nt, Mycobacterium avium subsp. paratuberculosis
ggcuggucaaacagcuugcgcc

SEQ ID NO: 3500 - RNA, 22 nt, Mycobacterium avium subsp. paratuberculosis
ggcugugcucgggcggcagguc

SEQ ID NO: 3501 - RNA, 22 nt, Mycobacterium avium subsp. paratuberculosis
ggcgcgggcgucccgguggugc

SEQ ID NO: 3502 - RNA, 22 nt, Mycobacterium avium subsp. paratuberculosis
ggcgcgggcguuggccacccag

SEQ ID NO: 3503 - RNA, 22 nt, Mycobacterium avium subsp. paratuberculosis
ggcggcgccggcgaucacggug

SEQ ID NO: 3504 - RNA, 22 nt, Mycobacterium avium subsp. paratuberculosis
ggcgagcagacgcaaaagcccc

SEQ ID NO: 3505 - RNA, 22 nt, Mycobacterium avium subsp. paratuberculosis
gugguggugucggccgacguug

SEQ ID NO: 3506 - RNA, 22 nt, Mycobacterium avium subsp. paratuberculosis
gugguguccaccccgccggcgg

SEQ ID NO: 3507 - RNA, 22 nt, Mycobacterium avium subsp. paratuberculosis
guuccagcucggcgagcgugcg

SEQ ID NO: 3508 - RNA, 22 nt, Mycobacterium avium subsp. paratuberculosis
guugaugugcaccaucucugcg

SEQ ID NO: 3509 - RNA, 22 nt, Mycobacterium avium subsp. paratuberculosis
guugcagcgccgucugcagcug

SEQ ID NO: 3510 - RNA, 22 nt, Mycobacterium avium subsp. paratuberculosis
guugguggaucgucgcgaaguc

SEQ ID NO: 3511 - RNA, 22 nt, Mycobacterium avium subsp. paratuberculosis
guugggggcgcugggauuugcc

SEQ ID NO: 3512 - RNA, 22 nt, Mycobacterium avium subsp. paratuberculosis
gugguggcggcgcuggcgcaca

SEQ ID NO: 3513 - RNA, 22 nt, Mycobacterium avium subsp. paratuberculosis
gugugaaaacgcccgcgacuac

SEQ ID NO: 3514 - RNA, 22 nt, Mycobacterium avium subsp. paratuberculosis
guggcgucgaugcgaaucccgg

SEQ ID NO: 3515 - RNA, 22 nt, Mycobacterium avium subsp. paratuberculosis
guggcuggccgaguucgcgcug

SEQ ID NO: 3516 - RNA, 22 nt, Mycobacterium avium subsp. paratuberculosis
guggcugggucuggucgccaac

SEQ ID NO: 3517 - RNA, 22 nt, Mycobacterium avium subsp. paratuberculosis
gugguggccgcggugaccaaug

SEQ ID NO: 3518 - RNA, 22 nt, Mycobacterium avium subsp. paratuberculosis
gugguggucaaucacgcucggc

SEQ ID NO: 3519 - RNA, 22 nt, Mycobacterium avium subsp. paratuberculosis
guggcagccagcauucggccgc

SEQ ID NO: 3520 - RNA, 22 nt, Mycobacterium avium subsp. paratuberculosis
gugcuuuugcgucugcucgcca

SEQ ID NO: 3521 - RNA, 19 nt, Mycobacterium avium subsp. paratuberculosis
guggccaagacggccagca

SEQ ID NO: 3522 - RNA, 22 nt, Mycobacterium avium subsp. paratuberculosis
guggccacgaucgccgcggugg

SEQ ID NO: 3523 - RNA, 22 nt, Mycobacterium avium subsp. paratuberculosis
guggccagccgggcgaccgucu

SEQ ID NO: 3524 - RNA, 22 nt, Mycobacterium avium subsp. paratuberculosis
gugggcugucggugaccuggcu

SEQ ID NO: 3525 - RNA, 20 nt, Mycobacterium avium subsp. paratuberculosis
guggucaccggcgauggugc

SEQ ID NO: 3526 - RNA, 22 nt, Mycobacterium avium subsp. paratuberculosis
gugggccaacgugagcuccagu

SEQ ID NO: 3527 - RNA, 22 nt, Mycobacterium avium subsp. paratuberculosis
gugccccagcagcucggugagc

SEQ ID NO: 3528 - RNA, 22 nt, Mycobacterium avium subsp. paratuberculosis
gugcaccugcuggaucacggcg

SEQ ID NO: 3529 - RNA, 22 nt, Mycobacterium avium subsp. paratuberculosis
gugaagccgccgcggcccagcu

SEQ ID NO: 3530 - RNA, 22 nt, Mycobacterium avium subsp. paratuberculosis
gugauggcggcgaccaccaucg

SEQ ID NO: 3531 - RNA, 22 nt, Mycobacterium avium subsp. paratuberculosis
gugcucacgcugcugcuggccg

SEQ ID NO: 3532 - RNA, 20 nt, Mycobacterium avium subsp. paratuberculosis
gugcacaucgacccggcgga

SEQ ID NO: 3533 - RNA, 22 nt, Mycobacterium avium subsp. paratuberculosis
gugaccagggugcccagcugga

SEQ ID NO: 3534 - RNA, 22 nt, Mycobacterium avium subsp. paratuberculosis
gucggcuccuugcuggacggcc

SEQ ID NO: 3535 - RNA, 22 nt, Mycobacterium avium subsp. paratuberculosis
guccagccgucgaauugugccc

SEQ ID NO: 3536 - RNA, 22 nt, Mycobacterium avium subsp. paratuberculosis
gucaucagcuggcugucggcca

SEQ ID NO: 3537 - RNA, 22 nt, Mycobacterium avium subsp. paratuberculosis
ucucauuccugagacuuucuug

SEQ ID NO: 3538 - RNA, 22 nt, Mycobacterium avium subsp. paratuberculosis
ucggcucaccgacgacgaggug

SEQ ID NO: 3539 - RNA, 22 nt, Mycobacterium avium subsp. paratuberculosis
ucgguggcugcagcucggccug

SEQ ID NO: 3540 - RNA, 22 nt, Mycobacterium avium subsp. paratuberculosis
ucgauguuguggucaacuucca

SEQ ID NO: 3541 - RNA, 22 nt, Mycobacterium avium subsp. paratuberculosis
ucgccugcggcaaugagcccua

SEQ ID NO: 3542 - RNA, 22 nt, Mycobacterium avium subsp. paratuberculosis
ucgcuggacugccacagguucg

SEQ ID NO: 3543 - RNA, 22 nt, Mycobacterium avium subsp. paratuberculosis
ucgcugggcgcccaggcgcguu

SEQ ID NO: 3544 - RNA, 22 nt, Mycobacterium avium subsp. paratuberculosis
ucgcugggcggcagcucggcau

SEQ ID NO: 3545 - RNA, 22 nt, Mycobacterium avium subsp. paratuberculosis
ucggcagcagcuggcucagcga

SEQ ID NO: 3546 - RNA, 22 nt, Mycobacterium avium subsp. paratuberculosis
uccugcgccgccacgacagcaa

SEQ ID NO: 3547 - RNA, 22 nt, Mycobacterium avium subsp. paratuberculosis
uccuggggccgggcccgagcau

SEQ ID NO: 3548 - RNA, 22 nt, Mycobacterium avium subsp. paratuberculosis
uccuggugaucuccagcaucgu

SEQ ID NO: 3549 - RNA, 22 nt, Mycobacterium avium subsp. paratuberculosis
uccuggugcguccaagcggagu

SEQ ID NO: 3550 - RNA, 22 nt, Mycobacterium avium subsp. paratuberculosis
uccugggcaucgccaagucggu

SEQ ID NO: 3551 - RNA, 22 nt, Mycobacterium avium subsp. paratuberculosis
ucgagcagccgaccagcgucac

SEQ ID NO: 3552 - RNA, 22 nt, Mycobacterium avium subsp. paratuberculosis
uccgcgccucgacgcccggaua

SEQ ID NO: 3553 - RNA, 22 nt, Mycobacterium avium subsp. paratuberculosis
uccauucucggccgggugcaca

SEQ ID NO: 3554 - RNA, 22 nt, Mycobacterium avium subsp. paratuberculosis
ucccaaggcuguucgugggcgu

SEQ ID NO: 3555 - RNA, 22 nt, Mycobacterium avium subsp. paratuberculosis
ucaggccgguggcgguguugcu

SEQ ID NO: 3556 - RNA, 22 nt, Mycobacterium avium subsp. paratuberculosis
ucaggcuggaagugcucggcuu

SEQ ID NO: 3557 - RNA, 22 nt, Mycobacterium avium subsp. paratuberculosis
ucagguugguggcucccaguau

SEQ ID NO: 3558 - RNA, 22 nt, Mycobacterium avium subsp. paratuberculosis
ucauuuggugcucaccgugcag

SEQ ID NO: 3559 - RNA, 22 nt, Mycobacterium avium subsp. paratuberculosis
uccacccgcagagaucccaagg

SEQ ID NO: 3560 - RNA, 22 nt, Mycobacterium avium subsp. paratuberculosis
uccaccgcccaggucgaugcgc

SEQ ID NO: 3561 - RNA, 22 nt, Mycobacterium avium subsp. paratuberculosis
uccagcagcugggcgcgcauuc

SEQ ID NO: 3562 - RNA, 22 nt, Mycobacterium avium subsp. paratuberculosis
uccagccaggcgcggcggcuca

SEQ ID NO: 3563 - RNA, 22 nt, Mycobacterium avium subsp. paratuberculosis
uccagcuggucgacgccgccag

SEQ ID NO: 3564 - RNA, 22 nt, Mycobacterium avium subsp. paratuberculosis
ucagcaggucgaugcgguugcg

SEQ ID NO: 3565 - RNA, 22 nt, Mycobacterium avium subsp. paratuberculosis
ucagcgucgucgcgccggcuuu

SEQ ID NO: 3566 - RNA, 22 nt, Mycobacterium avium subsp. paratuberculosis
ucagccucggccuggacagucg

SEQ ID NO: 3567 - RNA, 22 nt, Mycobacterium avium subsp. paratuberculosis
ucaauuccgguggugugcugaa

SEQ ID NO: 3568 - RNA, 22 nt, Mycobacterium avium subsp. paratuberculosis
ucaccaugcacccagaucucgc

SEQ ID NO: 3569 - RNA, 22 nt, Mycobacterium avium subsp. paratuberculosis
ucaccgccggcguggaccggcu

SEQ ID NO: 3570 - RNA, 23 nt, Mycobacterium avium subsp. paratuberculosis
guuuggguacguuaugggcuugc

SEQ ID NO: 3571 - RNA, 22 nt, Mycobacterium avium subsp. paratuberculosis
ggccuggucaucgagcuggcgg

SEQ ID NO: 3572 - RNA, 22 nt, Mycobacterium avium subsp. paratuberculosis
ggccuggucggcguucagcguc

SEQ ID NO: 3573 - RNA, 22 nt, Mycobacterium avium subsp. paratuberculosis
ggccucccacagcgggcggugc

SEQ ID NO: 3574 - RNA, 22 nt, Mycobacterium avium subsp. paratuberculosis
ggccugcagaaugcgcguuuug

SEQ ID NO: 3575 - RNA, 22 nt, Mycobacterium avium subsp. paratuberculosis
ggcgccacgcccgggcaccugg

SEQ ID NO: 3576 - RNA, 22 nt, Mycobacterium avium subsp. paratuberculosis
ggcgccacgcggaaucgccagc

SEQ ID NO: 3577 - RNA, 22 nt, Mycobacterium avium subsp. paratuberculosis
ggccagcucggcgaucgcccgu

SEQ ID NO: 3578 - RNA, 22 nt, Mycobacterium avium subsp. paratuberculosis
ggccagcagggugggguuacgg

SEQ ID NO: 3579 - RNA, 22 nt, Mycobacterium avium subsp. paratuberculosis
ggccagccgggcgacggucugc

SEQ ID NO: 3580 - RNA, 22 nt, Mycobacterium avium subsp. paratuberculosis
ggcccggcuucuggcacggcgc

SEQ ID NO: 3581 - RNA, 22 nt, Mycobacterium avium subsp. paratuberculosis
ggccgcgcucaaacaccugggc

SEQ ID NO: 3582 - RNA, 22 nt, Mycobacterium avium subsp. paratuberculosis
ggcagcacgugcagcgcggucu

SEQ ID NO: 3583 - RNA, 22 nt, Mycobacterium avium subsp. paratuberculosis
ggcagcagcgagaagugcaggu

SEQ ID NO: 3584 - RNA, 22 nt, Mycobacterium avium subsp. paratuberculosis
ggcagcacccgcagcaggucgu

SEQ ID NO: 3585 - RNA, 22 nt, Mycobacterium avium subsp. paratuberculosis
ggcagcaugcucuccucguggu

SEQ ID NO: 3586 - RNA, 22 nt, Mycobacterium avium subsp. paratuberculosis
ggcagccuguaucaccacuucu

SEQ ID NO: 3587 - RNA, 22 nt, Mycobacterium avium subsp. paratuberculosis
ggcagcgaugcggccggucuca

SEQ ID NO: 3588 - RNA, 22 nt, Mycobacterium avium subsp. paratuberculosis
ggccagcacgguguugacggug

SEQ ID NO: 3589 - RNA, 22 nt, Mycobacterium avium subsp. paratuberculosis
ggaguuucuggccggcaagaag

SEQ ID NO: 3590 - RNA, 22 nt, Mycobacterium avium subsp. paratuberculosis
ggagggucgcuaucugcgcggc

SEQ ID NO: 3591 - RNA, 23 nt, Mycobacterium avium subsp. paratuberculosis
ggaaagugugaucccgaugaugg

SEQ ID NO: 3592 - RNA, 22 nt, Mycobacterium avium subsp. paratuberculosis
gcuucuucgcgcaugcgcugcc

SEQ ID NO: 3593 - RNA, 22 nt, Mycobacterium avium subsp. paratuberculosis
ggaccugcgacugcaccccacc

SEQ ID NO: 3594 - RNA, 22 nt, Mycobacterium avium subsp. paratuberculosis
ggaccugcuggaccggcugcac

SEQ ID NO: 3595 - RNA, 22 nt, Mycobacterium avium subsp. paratuberculosis
ggagccggccgagguugcgcug

SEQ ID NO: 3596 - RNA, 18 nt, Mycobacterium avium subsp. paratuberculosis
gcugcggcugcagcagga

SEQ ID NO: 3597 - RNA, 22 nt, Mycobacterium avium subsp. paratuberculosis
gcuggccaacugcggagacgcc

SEQ ID NO: 3598 - RNA, 22 nt, Mycobacterium avium subsp. paratuberculosis
gcuggccaccggcaccgcggcg

SEQ ID NO: 3599 - RNA, 22 nt, Mycobacterium avium subsp. paratuberculosis
gcuggccacgcucggcccgcug

SEQ ID NO: 3600 - RNA, 22 nt, Mycobacterium avium subsp. paratuberculosis
gcugguagacgacgacgccgag

SEQ ID NO: 3601 - RNA, 22 nt, Mycobacterium avium subsp. paratuberculosis
gcugggcacgccggagcugcgg

SEQ ID NO: 3602 - RNA, 22 nt, Mycobacterium avium subsp. paratuberculosis
gcugggccgcugguugcccgag

SEQ ID NO: 3603 - RNA, 19 nt, Mycobacterium avium subsp. paratuberculosis
gcugggccuggucgcgucc

SEQ ID NO: 3604 - RNA, 22 nt, Mycobacterium avium subsp. paratuberculosis
gcuggcgccacugcagcccggu

SEQ ID NO: 3605 - RNA, 22 nt, Mycobacterium avium subsp. paratuberculosis
gcugaaccugauccucaagggc

SEQ ID NO: 3606 - RNA, 22 nt, Mycobacterium avium subsp. paratuberculosis
gcguggugaucguguuccccgg

SEQ ID NO: 3607 - RNA, 22 nt, Mycobacterium avium subsp. paratuberculosis
gcugcaucgcgaaccggucgcc

SEQ ID NO: 3608 - RNA, 21 nt, Mycobacterium avium subsp. paratuberculosis
gcugccagggcacgcugcggg

SEQ ID NO: 3609 - RNA, 22 nt, Mycobacterium avium subsp. paratuberculosis
gcugccagucggccgccuuggu

SEQ ID NO: 3610 - RNA, 22 nt, Mycobacterium avium subsp. paratuberculosis
gcugcggcccgaggucgagggu

SEQ ID NO: 3611 - RNA, 22 nt, Mycobacterium avium subsp. paratuberculosis
gcgccgcugcaggcugcacucg

SEQ ID NO: 3612 - RNA, 21 nt, Mycobacterium avium subsp. paratuberculosis
gccugggcaccaggucgacga

SEQ ID NO: 3613 - RNA, 22 nt, Mycobacterium avium subsp. paratuberculosis
gccuccagcgccaucaccagcu

SEQ ID NO: 3614 - RNA, 22 nt, Mycobacterium avium subsp. paratuberculosis
gccucgacgugcgugucgccgc

SEQ ID NO: 3615 - RNA, 22 nt, Mycobacterium avium subsp. paratuberculosis
gccugcagauaguccagcgugu

SEQ ID NO: 3616 - RNA, 22 nt, Mycobacterium avium subsp. paratuberculosis
gccugccaccggucucgaacuc

SEQ ID NO: 3617 - RNA, 22 nt, Mycobacterium avium subsp. paratuberculosis
gccugcugacggggucgcugga

SEQ ID NO: 3618 - RNA, 22 nt, Mycobacterium avium subsp. paratuberculosis
gccuggaccuggacuggcgccc

SEQ ID NO: 3619 - RNA, 22 nt, Mycobacterium avium subsp. paratuberculosis
gcgaugaggaucugucucaucg

SEQ ID NO: 3620 - RNA, 22 nt, Mycobacterium avium subsp. paratuberculosis
gcgaccuggauggcguggcugc

SEQ ID NO: 3621 - RNA, 22 nt, Mycobacterium avium subsp. paratuberculosis
gccccgacucgacgcuggcggu

SEQ ID NO: 3622 - RNA, 22 nt, Mycobacterium avium subsp. paratuberculosis
gcccgccaugcccgggaucugg

SEQ ID NO: 3623 - RNA, 22 nt, Mycobacterium avium subsp. paratuberculosis
gcccgccucugagcgacaauca

SEQ ID NO: 3624 - RNA, 22 nt, Mycobacterium avium subsp. paratuberculosis
gccgaacugcugggccugggca

SEQ ID NO: 3625 - RNA, 20 nt, Mycobacterium avium subsp. paratuberculosis
gccaugagugcacguugggc

SEQ ID NO: 3626 - RNA, 21 nt, Mycobacterium avium subsp. paratuberculosis
gccguggcguuacgagcgagc

SEQ ID NO: 3627 - RNA, 22 nt, Mycobacterium avium subsp. paratuberculosis
gccguggugguuagcggcauga

SEQ ID NO: 3628 - RNA, 22 nt, Mycobacterium avium subsp. paratuberculosis
cuugacgugcucggcgcucagc

SEQ ID NO: 3629 - RNA, 22 nt, Mycobacterium avium subsp. paratuberculosis
cugugucuguccgcggcaucgc

SEQ ID NO: 3630 - RNA, 22 nt, Mycobacterium avium subsp. paratuberculosis
cuucuugcgauugcggcuggcg

SEQ ID NO: 3631 - RNA, 22 nt, Mycobacterium avium subsp. paratuberculosis
cuugaaccgguucaucgcgcug

SEQ ID NO: 3632 - RNA, 22 nt, Mycobacterium avium subsp. paratuberculosis
cugggcgcgcugccacagcgug

SEQ ID NO: 3633 - RNA, 22 nt, Mycobacterium avium subsp. paratuberculosis
cugggcgcggugguggccgcca

SEQ ID NO: 3634 - RNA, 22 nt, Mycobacterium avium subsp. paratuberculosis
cugggccaucgaccgcggcgcg

SEQ ID NO: 3635 - RNA, 22 nt, Mycobacterium avium subsp. paratuberculosis
cuggugaaucggcccauagcgg

SEQ ID NO: 3636 - RNA, 22 nt, Mycobacterium avium subsp. paratuberculosis
cuggugaucagcgccggcaucc

SEQ ID NO: 3637 - RNA, 22 nt, Mycobacterium avium subsp. paratuberculosis
cuggucacgcuguucgucaucu

SEQ ID NO: 3638 - RNA, 22 nt, Mycobacterium avium subsp. paratuberculosis
cuggcgcaguuuucggccgaag

SEQ ID NO: 3639 - RNA, 22 nt, Mycobacterium avium subsp. paratuberculosis
cuggacugggacaagggcaaga

SEQ ID NO: 3640 - RNA, 22 nt, Mycobacterium avium subsp. paratuberculosis
cuggcugacgucagcgacuucg

SEQ ID NO: 3641 - RNA, 22 nt, Mycobacterium avium subsp. paratuberculosis
cuggccagcuugcgggccgacu

SEQ ID NO: 3642 - RNA, 22 nt, Mycobacterium avium subsp. paratuberculosis
cuggccauggcguucggccggu

SEQ ID NO: 3643 - RNA, 22 nt, Mycobacterium avium subsp. paratuberculosis
cuggcccacuacgccgggcugg

SEQ ID NO: 3644 - RNA, 22 nt, Mycobacterium avium subsp. paratuberculosis
cuggccgacgcgcuggugcgac

SEQ ID NO: 3645 - RNA, 22 nt, Mycobacterium avium subsp. paratuberculosis
cuggccgaggccggccacaccg

SEQ ID NO: 3646 - RNA, 22 nt, Mycobacterium avium subsp. paratuberculosis
cugcagacccgcgccgucuggc

SEQ ID NO: 3647 - RNA, 22 nt, Mycobacterium avium subsp. paratuberculosis
cugcccaaggacaccgcggcgc

SEQ ID NO: 3648 - RNA, 20 nt, Mycobacterium avium subsp. paratuberculosis
cugccccggcgggauggcga

SEQ ID NO: 3649 - RNA, 22 nt, Mycobacterium avium subsp. paratuberculosis
cugcccgaccaggaccugccgu

SEQ ID NO: 3650 - RNA, 22 nt, Mycobacterium avium subsp. paratuberculosis
cugcgagccgguauugugaucg

SEQ ID NO: 3651 - RNA, 22 nt, Mycobacterium avium subsp. paratuberculosis
gagacccacccaggucugccgg

SEQ ID NO: 3652 - RNA, 22 nt, Mycobacterium avium subsp. paratuberculosis
gagaaccaguccucgggcguca

SEQ ID NO: 3653 - RNA, 20 nt, Mycobacterium avium subsp. paratuberculosis
gacguucuccacgcugcggc

SEQ ID NO: 3654 - RNA, 22 nt, Mycobacterium avium subsp. paratuberculosis
gaccagguggccgcccgcaccc

SEQ ID NO: 3655 - RNA, 22 nt, Mycobacterium avium subsp. paratuberculosis
gaccagguuggucaccggcacc

SEQ ID NO: 3656 - RNA, 20 nt, Mycobacterium avium subsp. paratuberculosis
gaccaugcagcaggaccgcu

SEQ ID NO: 3657 - RNA, 22 nt, Mycobacterium avium subsp. paratuberculosis
gaccccagucggacaggucgcg

SEQ ID NO: 3658 - RNA, 22 nt, Mycobacterium avium subsp. paratuberculosis
gaccugcagccggaugugcuga

SEQ ID NO: 3659 - RNA, 22 nt, Mycobacterium avium subsp. paratuberculosis
gaccugcucgacgggugggugg

SEQ ID NO: 3660 - RNA, 22 nt, Mycobacterium avium subsp. paratuberculosis
gaagugcaccugguugcugauc

SEQ ID NO: 3661 - RNA, 22 nt, Mycobacterium avium subsp. paratuberculosis
gaagugcugcgcgaugauaagc

SEQ ID NO: 3662 - RNA, 22 nt, Mycobacterium avium subsp. paratuberculosis
cuuugaaauaggcgugcaggcg

SEQ ID NO: 3663 - RNA, 22 nt, Mycobacterium avium subsp. paratuberculosis
gaaagugcaaccagcgacgugu

SEQ ID NO: 3664 - RNA, 22 nt, Mycobacterium avium subsp. paratuberculosis
gauggugccgcggaacuucucg

SEQ ID NO: 3665 - RNA, 22 nt, Mycobacterium avium subsp. paratuberculosis
gauggugucgcgcuggcuggac

SEQ ID NO: 3666 - RNA, 22 nt, Mycobacterium avium subsp. paratuberculosis
gauggcgacggauucgcggguc

SEQ ID NO: 3667 - RNA, 22 nt, Mycobacterium avium subsp. paratuberculosis
gaugccuucgacaaggcgaaga

SEQ ID NO: 3668 - RNA, 22 nt, Mycobacterium avium subsp. paratuberculosis
gaugggucugcgccucgaucag

SEQ ID NO: 3669 - RNA, 22 nt, Mycobacterium avium subsp. paratuberculosis
gagauacacccgggcauccgac

SEQ ID NO: 3670 - RNA, 22 nt, Mycobacterium avium subsp. paratuberculosis
gagacgagcgccuguaugaccg

SEQ ID NO: 3671 - RNA, 22 nt, Mycobacterium avium subsp. paratuberculosis
gagcaggaaggccaccagcgca

SEQ ID NO: 3672 - RNA, 22 nt, Mycobacterium avium subsp. paratuberculosis
gagcucacccggcucgccgugc

SEQ ID NO: 3673 - RNA, 22 nt, Mycobacterium avium subsp. paratuberculosis
gagggccugggcuacuacugcg

SEQ ID NO: 3674 - RNA, 22 nt, Mycobacterium avium subsp. paratuberculosis
gaggguggcguacagggugccg

SEQ ID NO: 3675 - RNA, 22 nt, Mycobacterium avium subsp. paratuberculosis
gcauggcccugcccgucgucag

SEQ ID NO: 3676 - RNA, 22 nt, Mycobacterium avium subsp. paratuberculosis
gccaccaccgucugcucggcgg

SEQ ID NO: 3677 - RNA, 22 nt, Mycobacterium avium subsp. paratuberculosis
gccacccugcugggcaugcugg

SEQ ID NO: 3678 - RNA, 22 nt, Mycobacterium avium subsp. paratuberculosis
gccaccucggcacccuggugau

SEQ ID NO: 3679 - RNA, 22 nt, Mycobacterium avium subsp. paratuberculosis
gccagcacccgcaacagcuguu

SEQ ID NO: 3680 - RNA, 22 nt, Mycobacterium avium subsp. paratuberculosis
gccagcaccgcgcugugcgugg

SEQ ID NO: 3681 - RNA, 22 nt, Mycobacterium avium subsp. paratuberculosis
gccagcagccgcgaggugucac

SEQ ID NO: 3682 - RNA, 22 nt, Mycobacterium avium subsp. paratuberculosis
gccauuuucccgagucccggca

SEQ ID NO: 3683 - RNA, 22 nt, Mycobacterium avium subsp. paratuberculosis
gcccacaaguccgaggugcugg

SEQ ID NO: 3684 - RNA, 22 nt, Mycobacterium avium subsp. paratuberculosis
gccaggccuccugcacggcguc

SEQ ID NO: 3685 - RNA, 22 nt, Mycobacterium avium subsp. paratuberculosis
gccagccagccguugccggauc

SEQ ID NO: 3686 - RNA, 22 nt, Mycobacterium avium subsp. paratuberculosis
gccaggcugggcgagcugcuag

SEQ ID NO: 3687 - RNA, 22 nt, Mycobacterium avium subsp. paratuberculosis
gccagguuguuguuggugcggc

SEQ ID NO: 3688 - RNA, 23 nt, Mycobacterium avium subsp. paratuberculosis
gccagcucgacggggugcucggc

SEQ ID NO: 3689 - RNA, 22 nt, Mycobacterium avium subsp. paratuberculosis
gcagcaugucccagucguggua

SEQ ID NO: 3690 - RNA, 22 nt, Mycobacterium avium subsp. paratuberculosis
gcagcauguccugccggcgggu

SEQ ID NO: 3691 - RNA, 22 nt, Mycobacterium avium subsp. paratuberculosis
gcagcaggacgagcucaccucg

SEQ ID NO: 3692 - RNA, 22 nt, Mycobacterium avium subsp. paratuberculosis
gcagcgugaugagcgaugccgc

SEQ ID NO: 3693 - RNA, 22 nt, Mycobacterium avium subsp. paratuberculosis
gcacgcccgcgagcaccgccau

SEQ ID NO: 3694 - RNA, 20 nt, Mycobacterium avium subsp. paratuberculosis
gcaaggggcgaucgcggcaa

SEQ ID NO: 3695 - RNA, 22 nt, Mycobacterium avium subsp. paratuberculosis
gcaacugcucagccacuccuug

SEQ ID NO: 3696 - RNA, 22 nt, Mycobacterium avium subsp. paratuberculosis
gcaacaaccccacguucggcgu

SEQ ID NO: 3697 - RNA, 22 nt, Mycobacterium bovis subsp bovis AF2122/97
gcacggccaaaggcaucgccga

SEQ ID NO: 3698 - RNA, 22 nt, Mycobacterium bovis subsp bovis AF2122/97
gcacggccuccggaccgagcaa

SEQ ID NO: 3699 - RNA, 22 nt, Mycobacterium bovis subsp bovis AF2122/97
gcaccccagagcacugauacgc

SEQ ID NO: 3700 - RNA, 22 nt, Mycobacterium bovis subsp bovis AF2122/97
gcagagccgaucguccuguugc

SEQ ID NO: 3701 - RNA, 22 nt, Mycobacterium bovis subsp bovis AF2122/97
gcagaugagugcagaggaucuc

SEQ ID NO: 3702 - RNA, 22 nt, Mycobacterium bovis subsp bovis AF2122/97
gcacggguucguugcugugcau

SEQ ID NO: 3703 - RNA, 22 nt, Mycobacterium bovis subsp bovis AF2122/97
gcagacacggcggugacgcgag

SEQ ID NO: 3704 - RNA, 22 nt, Mycobacterium bovis subsp bovis AF2122/97
gcagcgugucaccgucgaggac

SEQ ID NO: 3705 - RNA, 21 nt, Mycobacterium bovis subsp bovis AF2122/97
gccagcauggucgaggaugca

SEQ ID NO: 3706 - RNA, 22 nt, Mycobacterium bovis subsp bovis AF2122/97
gccagcagcucggcgauaucgg

SEQ ID NO: 3707 - RNA, 22 nt, Mycobacterium bovis subsp bovis AF2122/97
gccagguugacguugguuucgg

SEQ ID NO: 3708 - RNA, 22 nt, Mycobacterium bovis subsp bovis AF2122/97
gccaggcuagguacuggguugc

SEQ ID NO: 3709 - RNA, 22 nt, Mycobacterium bovis subsp bovis AF2122/97
gccagcaccaucugcgaucccg

SEQ ID NO: 3710 - RNA, 21 nt, Mycobacterium bovis subsp bovis AF2122/97
gccagcacgguguucaaguug

SEQ ID NO: 3711 - RNA, 22 nt, Mycobacterium bovis subsp bovis AF2122/97
gccagcacgucacgcaggccga

SEQ ID NO: 3712 - RNA, 22 nt, Mycobacterium bovis subsp bovis AF2122/97
gccaccacucaggccgcgguca

SEQ ID NO: 3713 - RNA, 22 nt, Mycobacterium bovis subsp bovis AF2122/97
gccacucggggccgcugcggcc

SEQ ID NO: 3714 - RNA, 22 nt, Mycobacterium bovis subsp bovis AF2122/97
gccagaacugccggccccaggg

SEQ ID NO: 3715 - RNA, 22 nt, Mycobacterium bovis subsp bovis AF2122/97
gccaagacgcgucggggccacc

SEQ ID NO: 3716 - RNA, 21 nt, Mycobacterium bovis subsp bovis AF2122/97
gccaacucaggcggacgaauc

SEQ ID NO: 3717 - RNA, 22 nt, Mycobacterium bovis subsp bovis AF2122/97
gcauggcagcaggcccgucccg

SEQ ID NO: 3718 - RNA, 22 nt, Mycobacterium bovis subsp bovis AF2122/97
gcagcgugaucaccgaaccugg

SEQ ID NO: 3719 - RNA, 22 nt, Mycobacterium bovis subsp bovis AF2122/97
gcauccagggggccgacgcauu

SEQ ID NO: 3720 - RNA, 22 nt, Mycobacterium bovis subsp bovis AF2122/97
gaggggcagcucggcuccgcgu

SEQ ID NO: 3721 - RNA, 22 nt, Mycobacterium bovis subsp bovis AF2122/97
gagggacuuaugcgucugcuag

SEQ ID NO: 3722 - RNA, 22 nt, Mycobacterium bovis subsp bovis AF2122/97
gagcaugggcguggacguuguc

SEQ ID NO: 3723 - RNA, 22 nt, Mycobacterium bovis subsp bovis AF2122/97
gagaugagccgaaauuacccug

SEQ ID NO: 3724 - RNA, 22 nt, Mycobacterium bovis subsp bovis AF2122/97
gauggcgaugcgcaccccgucg

SEQ ID NO: 3725 - RNA, 23 nt, Mycobacterium bovis subsp bovis AF2122/97
gauguuaacgcgagucagacaug

SEQ ID NO: 3726 - RNA, 22 nt, Mycobacterium bovis subsp bovis AF2122/97
gaguaccugcaggugccgucgc

SEQ ID NO: 3727 - RNA, 22 nt, Mycobacterium bovis subsp bovis AF2122/97
gaugacagcgaggugcacucgg

SEQ ID NO: 3728 - RNA, 22 nt, Mycobacterium bovis subsp bovis AF2122/97
gaucucugcgggguaguucggc

SEQ ID NO: 3729 - RNA, 22 nt, Mycobacterium bovis subsp bovis AF2122/97
gaagcugcugggccaguucgug

SEQ ID NO: 3730 - RNA, 22 nt, Mycobacterium bovis subsp bovis AF2122/97
gaagccagugugaccgccugga

SEQ ID NO: 3731 - RNA, 22 nt, Mycobacterium bovis subsp bovis AF2122/97
gaacagcuugcccuggaugccg

SEQ ID NO: 3732 - RNA, 22 nt, Mycobacterium bovis subsp bovis AF2122/97
gacaaaguuccacccgccgucc

SEQ ID NO: 3733 - RNA, 22 nt, Mycobacterium bovis subsp bovis AF2122/97
gaaucauugcccggcuccuggc

SEQ ID NO: 3734 - RNA, 22 nt, Mycobacterium bovis subsp bovis AF2122/97
gaauacaucggugucggcggcc

SEQ ID NO: 3735 - RNA, 22 nt, Mycobacterium bovis subsp bovis AF2122/97
gacagcuuucagcgaaucaccg

SEQ ID NO: 3736 - RNA, 22 nt, Mycobacterium bovis subsp bovis AF2122/97
gacugcccaggcugcgcguggc

SEQ ID NO: 3737 - RNA, 22 nt, Mycobacterium bovis subsp bovis AF2122/97
gagacccaucagagccgagucg

SEQ ID NO: 3738 - RNA, 22 nt, Mycobacterium bovis subsp bovis AF2122/97
cugccacuggugucacgucaug

SEQ ID NO: 3739 - RNA, 22 nt, Mycobacterium bovis subsp bovis AF2122/97
cugguccagccgcagcgugcgc

SEQ ID NO: 3740 - RNA, 22 nt, Mycobacterium bovis subsp bovis AF2122/97
cuggguucgacccaguccaagc

SEQ ID NO: 3741 - RNA, 17 nt, Mycobacterium bovis subsp bovis AF2122/97
cuggucacgaucauggc

SEQ ID NO: 3742 - RNA, 22 nt, Mycobacterium bovis subsp bovis AF2122/97
cugguggcgcgggaugccgacg

SEQ ID NO: 3743 - RNA, 22 nt, Mycobacterium bovis subsp bovis AF2122/97
cuggcuugccuccugccgcgac

SEQ ID NO: 3744 - RNA, 22 nt, Mycobacterium bovis subsp bovis AF2122/97
cuguggaguucggcgguguccu

SEQ ID NO: 3745 - RNA, 22 nt, Mycobacterium bovis subsp bovis AF2122/97
cuugaccuugcaccauggcguc

SEQ ID NO: 3746 - RNA, 23 nt, Mycobacterium bovis subsp bovis AF2122/97
cuugacgugaucgcugagacccu

SEQ ID NO: 3747 - RNA, 22 nt, Mycobacterium bovis subsp bovis AF2122/97
cuuccuggaguugccggaccag

SEQ ID NO: 3748 - RNA, 22 nt, Mycobacterium bovis subsp bovis AF2122/97
cuugggcguuugcguucgccgc

SEQ ID NO: 3749 - RNA, 22 nt, Mycobacterium bovis subsp bovis AF2122/97
cuugcugguaugccgggccacc

SEQ ID NO: 3750 - RNA, 22 nt, Mycobacterium bovis subsp bovis AF2122/97
gccgccaccgcuaccacccgug

SEQ ID NO: 3751 - RNA, 22 nt, Mycobacterium bovis subsp bovis AF2122/97
gccgcaccgacuaccaccgacu

SEQ ID NO: 3752 - RNA, 22 nt, Mycobacterium bovis subsp bovis AF2122/97
gccgaagccgaccggcccagcg

SEQ ID NO: 3753 - RNA, 22 nt, Mycobacterium bovis subsp bovis AF2122/97
gcccagagugcgcaggcucucg

SEQ ID NO: 3754 - RNA, 22 nt, Mycobacterium bovis subsp bovis AF2122/97
gccgcccaauucuccggucgcg

SEQ ID NO: 3755 - RNA, 22 nt, Mycobacterium bovis subsp bovis AF2122/97
gcgaaacacgggaucgggcgag

SEQ ID NO: 3756 - RNA, 22 nt, Mycobacterium bovis subsp bovis AF2122/97
gcgcacgcccuugcgcugcaau

SEQ ID NO: 3757 - RNA, 22 nt, Mycobacterium bovis subsp bovis AF2122/97
gcgcagcagcgacaggguggcg

SEQ ID NO: 3758 - RNA, 21 nt, Mycobacterium bovis subsp bovis AF2122/97
gcgcagcaucucagccagugc

SEQ ID NO: 3759 - RNA, 22 nt, Mycobacterium bovis subsp bovis AF2122/97
gccuggacuccgcuuuuggcac

SEQ ID NO: 3760 - RNA, 22 nt, Mycobacterium bovis subsp bovis AF2122/97
gccucagcguugcggcggguac

SEQ ID NO: 3761 - RNA, 22 nt, Mycobacterium bovis subsp bovis AF2122/97
gccuggugcaccggucgccggg

SEQ ID NO: 3762 - RNA, 22 nt, Mycobacterium bovis subsp bovis AF2122/97
gccugguguccgagcggcccuu

SEQ ID NO: 3763 - RNA, 22 nt, Mycobacterium bovis subsp bovis AF2122/97
gccuugacgagcgggccggcaa

SEQ ID NO: 3764 - RNA, 22 nt, Mycobacterium bovis subsp bovis AF2122/97
gccuugaauucgccccggccug

SEQ ID NO: 3765 - RNA, 22 nt, Mycobacterium bovis subsp bovis AF2122/97
gccuugaccgccuugauggcgg

SEQ ID NO: 3766 - RNA, 22 nt, Mycobacterium bovis subsp bovis AF2122/97
gccuugucgagaucgucgccgu

SEQ ID NO: 3767 - RNA, 22 nt, Mycobacterium bovis subsp bovis AF2122/97
gcgccgccggggaucccgaccu

SEQ ID NO: 3768 - RNA, 22 nt, Mycobacterium bovis subsp bovis AF2122/97
gcgauagccgaaccacccgccg

SEQ ID NO: 3769 - RNA, 22 nt, Mycobacterium bovis subsp bovis AF2122/97
gcgccacuggggucaccgacgg

SEQ ID NO: 3770 - RNA, 22 nt, Mycobacterium bovis subsp bovis AF2122/97
gcgccagugcugcgcgugcaca

SEQ ID NO: 3771 - RNA, 22 nt, Mycobacterium bovis subsp bovis AF2122/97
gcgcgcccgacgggcggugauc

SEQ ID NO: 3772 - RNA, 22 nt, Mycobacterium bovis subsp bovis AF2122/97
gcggcaugcgcgaucugcagag

SEQ ID NO: 3773 - RNA, 22 nt, Mycobacterium bovis subsp bovis AF2122/97
gcggccaacgaggcagcggcgg

SEQ ID NO: 3774 - RNA, 22 nt, Mycobacterium bovis subsp bovis AF2122/97
gcgcuuggccggcagcgagacc

SEQ ID NO: 3775 - RNA, 22 nt, Mycobacterium bovis subsp bovis AF2122/97
gcguggucggaugcaggccagc

SEQ ID NO: 3776 - RNA, 22 nt, Mycobacterium bovis subsp bovis AF2122/97
gcucaugucgccguagaccggg

SEQ ID NO: 3777 - RNA, 22 nt, Mycobacterium bovis subsp bovis AF2122/97
gcugccccgcgagcuggugcug

SEQ ID NO: 3778 - RNA, 22 nt, Mycobacterium bovis subsp bovis AF2122/97
gcucagccgugugcggauacuu

SEQ ID NO: 3779 - RNA, 22 nt, Mycobacterium bovis subsp bovis AF2122/97
gcugaaccugauccucaagggc

SEQ ID NO: 3780 - RNA, 22 nt, Mycobacterium bovis subsp bovis AF2122/97
gcuggccuuacugcccgacguc

SEQ ID NO: 3781 - RNA, 22 nt, Mycobacterium bovis subsp bovis AF2122/97
gcugggccuuacgcaccugccg

SEQ ID NO: 3782 - RNA, 22 nt, Mycobacterium bovis subsp bovis AF2122/97
gcuggccagggcguuuccgcuc

SEQ ID NO: 3783 - RNA, 22 nt, Mycobacterium bovis subsp bovis AF2122/97
gcuggccaguucgcccugaccu

SEQ ID NO: 3784 - RNA, 22 nt, Mycobacterium bovis subsp bovis AF2122/97
gcugcgucgggccucggaaugg

SEQ ID NO: 3785 - RNA, 22 nt, Mycobacterium bovis subsp bovis AF2122/97
ggacgaggugcgggcgcugcag

SEQ ID NO: 3786 - RNA, 22 nt, Mycobacterium bovis subsp bovis AF2122/97
ggaaguucuaucugccgccaaa

SEQ ID NO: 3787 - RNA, 22 nt, Mycobacterium bovis subsp bovis AF2122/97
gcuuuuaugacugcucggcggg

SEQ ID NO: 3788 - RNA, 22 nt, Mycobacterium bovis subsp bovis AF2122/97
gcuggugguaucgcuggccaag

SEQ ID NO: 3789 - RNA, 22 nt, Mycobacterium bovis subsp bovis AF2122/97
gcuuaugugacgacccccagcg

SEQ ID NO: 3790 - RNA, 22 nt, Mycobacterium bovis subsp bovis AF2122/97
ggauauugcccuggcgguggcu

SEQ ID NO: 3791 - RNA, 22 nt, Mycobacterium bovis subsp bovis AF2122/97
ggcaccaagucaccggcaucca

SEQ ID NO: 3792 - RNA, 22 nt, Mycobacterium bovis subsp bovis AF2122/97
ggcagagccagcgcacggaaau

SEQ ID NO: 3793 - RNA, 22 nt, Mycobacterium bovis subsp bovis AF2122/97
ggcaacaccuuucccccuucga

SEQ ID NO: 3794 - RNA, 22 nt, Mycobacterium bovis subsp bovis AF2122/97
ggccacgccgcccuugccggac

SEQ ID NO: 3795 - RNA, 22 nt, Mycobacterium bovis subsp bovis AF2122/97
ggccacucguccggcgauggcg

SEQ ID NO: 3796 - RNA, 23 nt, Mycobacterium bovis subsp bovis AF2122/97
ggccaaggagcacgaccucaacu

SEQ ID NO: 3797 - RNA, 22 nt, Mycobacterium bovis subsp bovis AF2122/97
ggcaggaucgggaugcguccag

SEQ ID NO: 3798 - RNA, 22 nt, Mycobacterium bovis subsp bovis AF2122/97
ggcagcgcccgggucaccagcc

SEQ ID NO: 3799 - RNA, 22 nt, Mycobacterium bovis subsp bovis AF2122/97
ggcagcagcgagaagugcaggu

SEQ ID NO: 3800 - RNA, 22 nt, Mycobacterium bovis subsp bovis AF2122/97
ggccgcauccccgucguagcgg

SEQ ID NO: 3801 - RNA, 22 nt, Mycobacterium bovis subsp bovis AF2122/97
ggccaggguggccuggaugagu

SEQ ID NO: 3802 - RNA, 22 nt, Mycobacterium bovis subsp bovis AF2122/97
ggccagggccgacggcacaucc

SEQ ID NO: 3803 - RNA, 22 nt, Mycobacterium bovis subsp bovis AF2122/97
ggcccggcucgccacgaggagg

SEQ ID NO: 3804 - RNA, 22 nt, Mycobacterium bovis subsp bovis AF2122/97
ggcccggcugccggcuacggcg

SEQ ID NO: 3805 - RNA, 22 nt, Mycobacterium bovis subsp bovis AF2122/97
ggcccggcugcgcgucguguca

SEQ ID NO: 3806 - RNA, 22 nt, Mycobacterium bovis subsp bovis AF2122/97
uaagcugcgccagccacgccgu

SEQ ID NO: 3807 - RNA, 22 nt, Mycobacterium bovis subsp bovis AF2122/97
uagguaaauaaauccguguuug

SEQ ID NO: 3808 - RNA, 22 nt, Mycobacterium bovis subsp bovis AF2122/97
uauguucaauaaaucauuaugu

SEQ ID NO: 3809 - RNA, 22 nt, Mycobacterium bovis subsp bovis AF2122/97
uaucuggcccaaggggcgcuuc

SEQ ID NO: 3810 - RNA, 22 nt, Mycobacterium bovis subsp bovis AF2122/97
ucaccaccggcacccaaggcga

SEQ ID NO: 3811 - RNA, 22 nt, Mycobacterium bovis subsp bovis AF2122/97
uauucaucgaguacagcugaau

SEQ ID NO: 3812 - RNA, 22 nt, Mycobacterium bovis subsp bovis AF2122/97
ucaccgccgcgguuggugcgca

SEQ ID NO: 3813 - RNA, 22 nt, Mycobacterium bovis subsp bovis AF2122/97
ucaccugcccggcaccuggagc

SEQ ID NO: 3814 - RNA, 22 nt, Mycobacterium bovis subsp bovis AF2122/97
ucacccccgagguggccacgcg

SEQ ID NO: 3815 - RNA, 22 nt, Mycobacterium bovis subsp bovis AF2122/97
ucagccgcaagcaccgucagcg

SEQ ID NO: 3816 - RNA, 19 nt, Mycobacterium bovis subsp bovis AF2122/97
ucagcuguacucgaugaau

SEQ ID NO: 3817 - RNA, 22 nt, Mycobacterium bovis subsp bovis AF2122/97
ucagcugucaugguuggugauu

SEQ ID NO: 3818 - RNA, 22 nt, Mycobacterium bovis subsp bovis AF2122/97
ucagcuguguccgcacaaccgg

SEQ ID NO: 3819 - RNA, 22 nt, Mycobacterium bovis subsp bovis AF2122/97
ucagcgucgaugaccaugucga

SEQ ID NO: 3820 - RNA, 18 nt, Mycobacterium bovis subsp bovis AF2122/97
ucacugcugcggucuggg

SEQ ID NO: 3821 - RNA, 22 nt, Mycobacterium bovis subsp bovis AF2122/97
uccagcacugucuuggcuucgg

SEQ ID NO: 3822 - RNA, 22 nt, Mycobacterium bovis subsp bovis AF2122/97
uccagcacuucuggggggaucc

SEQ ID NO: 3823 - RNA, 22 nt, Mycobacterium bovis subsp bovis AF2122/97
uccagcagcaacgccaagucgc

SEQ ID NO: 3824 - RNA, 22 nt, Mycobacterium bovis subsp bovis AF2122/97
uccagcagcacgucggugcgau

SEQ ID NO: 3825 - RNA, 22 nt, Mycobacterium bovis subsp bovis AF2122/97
ucacgccggggcuggagucacc

SEQ ID NO: 3826 - RNA, 22 nt, Mycobacterium bovis subsp bovis AF2122/97
ucaggcugggcgaaccugggca

SEQ ID NO: 3827 - RNA, 22 nt, Mycobacterium bovis subsp bovis AF2122/97
ucccgggcaucggcauccccgg

SEQ ID NO: 3828 - RNA, 23 nt, Mycobacterium bovis subsp bovis AF2122/97
ucccagaggcgagucaccuguuc

SEQ ID NO: 3829 - RNA, 23 nt, Mycobacterium bovis subsp bovis AF2122/97
ucccaggugccauacgagcugaa

SEQ ID NO: 3830 - RNA, 22 nt, Mycobacterium bovis subsp bovis AF2122/97
ucgagcucccggugagacgaga

SEQ ID NO: 3831 - RNA, 22 nt, Mycobacterium bovis subsp bovis AF2122/97
ucgaggacggugucgagccccg

SEQ ID NO: 3832 - RNA, 22 nt, Mycobacterium bovis subsp bovis AF2122/97
uccuuuccgucgaugcggaagc

SEQ ID NO: 3833 - RNA, 22 nt, Mycobacterium bovis subsp bovis AF2122/97
ucgaaacccagccaccucuugg

SEQ ID NO: 3834 - RNA, 22 nt, Mycobacterium bovis subsp bovis AF2122/97
uccugcgcgugguacucgucgg

SEQ ID NO: 3835 - RNA, 22 nt, Mycobacterium bovis subsp bovis AF2122/97
uccugcaggcgaucgcccuggc

SEQ ID NO: 3836 - RNA, 22 nt, Mycobacterium bovis subsp bovis AF2122/97
ucggccucccaugcggcgaucu

SEQ ID NO: 3837 - RNA, 22 nt, Mycobacterium bovis subsp bovis AF2122/97
ucgcgccaguguccgccgccga

SEQ ID NO: 3838 - RNA, 22 nt, Mycobacterium bovis subsp bovis AF2122/97
ucgcgccaucggcuacaccagc

SEQ ID NO: 3839 - RNA, 22 nt, Mycobacterium bovis subsp bovis AF2122/97
ucgauguuccgcagcuucgucg

SEQ ID NO: 3840 - RNA, 19 nt, Mycobacterium bovis subsp bovis AF2122/97
ucguccugcugugggugac

SEQ ID NO: 3841 - RNA, 22 nt, Mycobacterium bovis subsp bovis AF2122/97
ucggggacuucugcgucugcuc

SEQ ID NO: 3842 - RNA, 22 nt, Mycobacterium bovis subsp bovis AF2122/97
ucggugacggacugcacagcga

SEQ ID NO: 3843 - RNA, 22 nt, Mycobacterium bovis subsp bovis AF2122/97
ucgguggccagcgaggcgccgg

SEQ ID NO: 3844 - RNA, 22 nt, Mycobacterium bovis subsp bovis AF2122/97
ucgguggcgccgacaugccggu

SEQ ID NO: 3845 - RNA, 22 nt, Mycobacterium bovis subsp bovis AF2122/97
guccaagcagcgacuagucaag

SEQ ID NO: 3846 - RNA, 22 nt, Mycobacterium bovis subsp bovis AF2122/97
guccaagcaggcgaucggccgg

SEQ ID NO: 3847 - RNA, 22 nt, Mycobacterium bovis subsp bovis AF2122/97
guccagcagcccggucuggugu

SEQ ID NO: 3848 - RNA, 22 nt, Mycobacterium bovis subsp bovis AF2122/97
guccucaagccggcguuccagc

SEQ ID NO: 3849 - RNA, 22 nt, Mycobacterium bovis subsp bovis AF2122/97
gucgaggugaccagcggugagg

SEQ ID NO: 3850 - RNA, 22 nt, Mycobacterium bovis subsp bovis AF2122/97
gucgcuggugggaucgcagcgc

SEQ ID NO: 3851 - RNA, 22 nt, Mycobacterium bovis subsp bovis AF2122/97
gucgguggccgcugccaugucg

SEQ ID NO: 3852 - RNA, 22 nt, Mycobacterium bovis subsp bovis AF2122/97
gucugagagccccggaaagcgc

SEQ ID NO: 3853 - RNA, 22 nt, Mycobacterium bovis subsp bovis AF2122/97
gucuggaugaaagccuuguuga

SEQ ID NO: 3854 - RNA, 22 nt, Mycobacterium bovis subsp bovis AF2122/97
gugaaauugaaaacgccguugc

SEQ ID NO: 3855 - RNA, 22 nt, Mycobacterium bovis subsp bovis AF2122/97
gugcugggcaucaaccaggauc

SEQ ID NO: 3856 - RNA, 22 nt, Mycobacterium bovis subsp bovis AF2122/97
gugguggccaacuuccugcucg

SEQ ID NO: 3857 - RNA, 22 nt, Mycobacterium bovis subsp bovis AF2122/97
guggccaaggccaggucggccg

SEQ ID NO: 3858 - RNA, 22 nt, Mycobacterium bovis subsp bovis AF2122/97
gugcuuucagcuugucucgacg

SEQ ID NO: 3859 - RNA, 22 nt, Mycobacterium bovis subsp bovis AF2122/97
gugcugguggucagugacgccg

SEQ ID NO: 3860 - RNA, 22 nt, Mycobacterium bovis subsp bovis AF2122/97
gugguggucuccagcgcgcucg

SEQ ID NO: 3861 - RNA, 22 nt, Mycobacterium bovis subsp bovis AF2122/97
gugguggccguggccgcgucgu

SEQ ID NO: 3862 - RNA, 22 nt, Mycobacterium bovis subsp bovis AF2122/97
gugguggcgcaauucgaccagg

SEQ ID NO: 3863 - RNA, 22 nt, Mycobacterium bovis subsp bovis AF2122/97
guggugggaaccgcuccagggc

SEQ ID NO: 3864 - RNA, 22 nt, Mycobacterium bovis subsp bovis AF2122/97
guggugguguaggucucgaugc

SEQ ID NO: 3865 - RNA, 22 nt, Mycobacterium bovis subsp bovis AF2122/97
guucauucccgaggugcugagc

SEQ ID NO: 3866 - RNA, 21 nt, Mycobacterium bovis subsp bovis AF2122/97
guugguggacagcgcuucccg

SEQ ID NO: 3867 - RNA, 22 nt, Mycobacterium bovis subsp bovis AF2122/97
guuuggcgcgcccacagcccgg

SEQ ID NO: 3868 - RNA, 22 nt, Mycobacterium bovis subsp bovis AF2122/97
guuugguugccuaccgcguggg

SEQ ID NO: 3869 - RNA, 22 nt, Mycobacterium bovis subsp bovis AF2122/97
guugucuugcucgcuuuggcug

SEQ ID NO: 3870 - RNA, 22 nt, Mycobacterium bovis subsp bovis AF2122/97
guugugaacggaaccgccggga

SEQ ID NO: 3871 - RNA, 22 nt, Mycobacterium bovis subsp bovis AF2122/97
guugugaagacgccauucgcag

SEQ ID NO: 3872 - RNA, 22 nt, Mycobacterium bovis subsp bovis AF2122/97
guuguucaacgccgucaauguu

SEQ ID NO: 3873 - RNA, 22 nt, Mycobacterium bovis subsp bovis AF2122/97
guuucgggcgauuuugcguccu

SEQ ID NO: 3874 - RNA, 22 nt, Mycobacterium bovis subsp bovis AF2122/97
guugaccagcacgacugcaucg

SEQ ID NO: 3875 - RNA, 22 nt, Mycobacterium bovis subsp bovis AF2122/97
guugaucagcuuguugagcugc

SEQ ID NO: 3876 - RNA, 21 nt, Mycobacterium bovis subsp bovis AF2122/97
guuaggaucaucugcgccgcu

SEQ ID NO: 3877 - RNA, 22 nt, Mycobacterium bovis subsp bovis AF2122/97
guuuucagcguguaggaggugu

SEQ ID NO: 3878 - RNA, 22 nt, Mycobacterium bovis subsp bovis AF2122/97
guuuugggccucggcgagccga

SEQ ID NO: 3879 - RNA, 22 nt, Mycobacterium bovis subsp bovis AF2122/97
uaaaagaacuuugcauccgugc

SEQ ID NO: 3880 - RNA, 22 nt, Mycobacterium bovis subsp bovis AF2122/97
ggcgagcagacacagagucgca

SEQ ID NO: 3881 - RNA, 22 nt, Mycobacterium bovis subsp bovis AF2122/97
ggcguggucaccggcguggucg

SEQ ID NO: 3882 - RNA, 22 nt, Mycobacterium bovis subsp bovis AF2122/97
ggcgugguuggcgauggcacgu

SEQ ID NO: 3883 - RNA, 22 nt, Mycobacterium bovis subsp bovis AF2122/97
ggcuggcuugccgacauucagc

SEQ ID NO: 3884 - RNA, 22 nt, Mycobacterium bovis subsp bovis AF2122/97
ggcugcgcuggcccgccgguuu

SEQ ID NO: 3885 - RNA, 22 nt, Mycobacterium bovis subsp bovis AF2122/97
gggguuggugauguagccgaua

SEQ ID NO: 3886 - RNA, 22 nt, Mycobacterium bovis subsp bovis AF2122/97
gggcuggaccgcgaggagcugc

SEQ ID NO: 3887 - RNA, 22 nt, Mycobacterium bovis subsp bovis AF2122/97
gggcucggccaguugcuccugg

SEQ ID NO: 3888 - RNA, 22 nt, Mycobacterium bovis subsp bovis AF2122/97
gggguggugaaguacacgcccg

SEQ ID NO: 3889 - RNA, 22 nt, Mycobacterium bovis subsp bovis AF2122/97
gggcugcccaaucagcgcugcg

SEQ ID NO: 3890 - RNA, 22 nt, Mycobacterium bovis subsp bovis AF2122/97
gggcuacaccucgacgaggccg

SEQ ID NO: 3891 - RNA, 22 nt, Mycobacterium bovis subsp bovis AF2122/97
gggcgggucagggccugcacga

SEQ ID NO: 3892 - RNA, 19 nt, Mycobacterium bovis subsp bovis AF2122/97
gggaucuuggggcugcccc

SEQ ID NO: 3893 - RNA, 22 nt, Mycobacterium bovis subsp bovis AF2122/97
gggcagcaggaugcgccugcga

SEQ ID NO: 3894 - RNA, 22 nt, Mycobacterium bovis subsp bovis AF2122/97
gggcacaggccgauggcgcuga

SEQ ID NO: 3895 - RNA, 22 nt, Mycobacterium bovis subsp bovis AF2122/97
ggugcuuuugcgucugcucggc

SEQ ID NO: 3896 - RNA, 22 nt, Mycobacterium bovis subsp bovis AF2122/97
ggugguggcccgugaccguacc

SEQ ID NO: 3897 - RNA, 22 nt, Mycobacterium bovis subsp bovis AF2122/97
gguggcgcacaucgccgugcac

SEQ ID NO: 3898 - RNA, 22 nt, Mycobacterium bovis subsp bovis AF2122/97
gguggcguggucgccgaugucc

SEQ ID NO: 3899 - RNA, 22 nt, Mycobacterium bovis subsp bovis AF2122/97
ggugguuucguggccggcgagc

SEQ ID NO: 3900 - RNA, 22 nt, Mycobacterium bovis subsp bovis AF2122/97
ggugguggugccgucgucgcgc

SEQ ID NO: 3901 - RNA, 22 nt, Mycobacterium bovis subsp bovis AF2122/97
ggucgcgcccgcagccgguggu

SEQ ID NO: 3902 - RNA, 22 nt, Mycobacterium bovis subsp bovis AF2122/97
ggucgugguggugcucaacucg

SEQ ID NO: 3903 - RNA, 20 nt, Mycobacterium bovis subsp bovis AF2122/97
ggucacccugggugagccgg

SEQ ID NO: 3904 - RNA, 22 nt, Mycobacterium bovis subsp bovis AF2122/97
ggucagcacgcaugugcggugg

SEQ ID NO: 3905 - RNA, 22 nt, Mycobacterium bovis subsp bovis AF2122/97
ggguggugaaguuggcggccgg

SEQ ID NO: 3906 - RNA, 22 nt, Mycobacterium bovis subsp bovis AF2122/97
gggugguggucgccaacgccga

SEQ ID NO: 3907 - RNA, 22 nt, Mycobacterium bovis subsp bovis AF2122/97
gggucacgaucgccgccggcgc

SEQ ID NO: 3908 - RNA, 22 nt, Mycobacterium bovis subsp bovis AF2122/97
guaggucagggcguauuugucg

SEQ ID NO: 3909 - RNA, 22 nt, Mycobacterium bovis subsp bovis AF2122/97
gucauugcgucauuuccuucga

SEQ ID NO: 3910 - RNA, 22 nt, Mycobacterium bovis subsp bovis AF2122/97
gucaccuugcaccuggccgccg

SEQ ID NO: 3911 - RNA, 22 nt, Mycobacterium bovis subsp bovis AF2122/97
gguguaggucguugccgaccuc

SEQ ID NO: 3912 - RNA, 22 nt, Mycobacterium bovis subsp bovis AF2122/97
aacuccgguaguuucaacaccg

SEQ ID NO: 3913 - RNA, 22 nt, Mycobacterium bovis subsp bovis AF2122/97
aacaggccuugcgagacagcac

SEQ ID NO: 3914 - RNA, 22 nt, Mycobacterium bovis subsp bovis AF2122/97
aagccuuguggugcgcccauuu

SEQ ID NO: 3915 - RNA, 22 nt, Mycobacterium bovis subsp bovis AF2122/97
aaacugcaaccacgcaccgaug

SEQ ID NO: 3916 - RNA, 22 nt, Mycobacterium bovis subsp bovis AF2122/97
aaggugaacucacggcgagguu

SEQ ID NO: 3917 - RNA, 22 nt, Mycobacterium bovis subsp bovis AF2122/97
aagugcaacacgaacguuggau

SEQ ID NO: 3918 - RNA, 22 nt, Mycobacterium bovis subsp bovis AF2122/97
aaguccagcagaucgaucucgc

SEQ ID NO: 3919 - RNA, 22 nt, Mycobacterium bovis subsp bovis AF2122/97
aaggcuggagcgcacagcgcgg

SEQ ID NO: 3920 - RNA, 22 nt, Mycobacterium bovis subsp bovis AF2122/97
aaggcagggaggaauucgacac

SEQ ID NO: 3921 - RNA, 22 nt, Mycobacterium bovis subsp bovis AF2122/97
aauccggccugugucgggucgu

SEQ ID NO: 3922 - RNA, 22 nt, Mycobacterium bovis subsp bovis AF2122/97
aauggggugucaccuaccugca

SEQ ID NO: 3923 - RNA, 22 nt, Mycobacterium bovis subsp bovis AF2122/97
aauuuuacccacuugugcaucc

SEQ ID NO: 3924 - RNA, 22 nt, Mycobacterium bovis subsp bovis AF2122/97
acaagcccggcgcggugcuggu

SEQ ID NO: 3925 - RNA, 22 nt, Mycobacterium bovis subsp bovis AF2122/97
acaccaagcgcccgcagcuugc

SEQ ID NO: 3926 - RNA, 22 nt, Mycobacterium bovis subsp bovis AF2122/97
acaccaaggccgucagcuuggc

SEQ ID NO: 3927 - RNA, 22 nt, Mycobacterium bovis subsp bovis AF2122/97
acuggccagcccgcacaaccac

SEQ ID NO: 3928 - RNA, 22 nt, Mycobacterium bovis subsp bovis AF2122/97
acugucccgagcgcaccaggaa

SEQ ID NO: 3929 - RNA, 22 nt, Mycobacterium bovis subsp bovis AF2122/97
acugcuuuccugucugggcggc

SEQ ID NO: 3930 - RNA, 22 nt, Mycobacterium bovis subsp bovis AF2122/97
acuccucagccggcggcccugg

SEQ ID NO: 3931 - RNA, 23 nt, Mycobacterium bovis subsp bovis AF2122/97
agauggagcucucgcuguaucgc

SEQ ID NO: 3932 - RNA, 23 nt, Mycobacterium bovis subsp bovis AF2122/97
agcaaugcgcacggcauccagcg

SEQ ID NO: 3933 - RNA, 22 nt, Mycobacterium bovis subsp bovis AF2122/97
acuacgucggugauuugguugc

SEQ ID NO: 3934 - RNA, 22 nt, Mycobacterium bovis subsp bovis AF2122/97
acguucugcacgcucgggccgg

SEQ ID NO: 3935 - RNA, 22 nt, Mycobacterium bovis subsp bovis AF2122/97
acgccccaacaacguuucgguu

SEQ ID NO: 3936 - RNA, 19 nt, Mycobacterium bovis subsp bovis AF2122/97
acccaggccgucacuucga

SEQ ID NO: 3937 - RNA, 22 nt, Mycobacterium bovis subsp bovis AF2122/97
accggccuggugcucaauagcc

SEQ ID NO: 3938 - RNA, 22 nt, Mycobacterium bovis subsp bovis AF2122/97
acccagaggcuguugccgacgc

SEQ ID NO: 3939 - RNA, 19 nt, Mycobacterium bovis subsp bovis AF2122/97
acaggcccucgugaucacc

SEQ ID NO: 3940 - RNA, 22 nt, Mycobacterium bovis subsp bovis AF2122/97
accaaguagcgcgacucccguu

SEQ ID NO: 3941 - RNA, 22 nt, Mycobacterium bovis subsp bovis AF2122/97
acagccagcugcccgguccgcc

SEQ ID NO: 3942 - RNA, 22 nt, Mycobacterium bovis subsp bovis AF2122/97
acacccaggggcugccgcagcg

SEQ ID NO: 3943 - RNA, 22 nt, Mycobacterium bovis subsp bovis AF2122/97
acagcugcugguuugagucugc

SEQ ID NO: 3944 - RNA, 22 nt, Mycobacterium bovis subsp bovis AF2122/97
agcagggccgcagcggcucggu

SEQ ID NO: 3945 - RNA, 22 nt, Mycobacterium bovis subsp bovis AF2122/97
agccaagccguaguccucgacg

SEQ ID NO: 3946 - RNA, 22 nt, Mycobacterium bovis subsp bovis AF2122/97
agccccagucgcuuugucucga

SEQ ID NO: 3947 - RNA, 22 nt, Mycobacterium bovis subsp bovis AF2122/97
agccgggcaucuggaaguggcu

SEQ ID NO: 3948 - RNA, 22 nt, Mycobacterium bovis subsp bovis AF2122/97
agcccggcggugcucgaggaag

SEQ ID NO: 3949 - RNA, 22 nt, Mycobacterium bovis subsp bovis AF2122/97
agcucccggaugagccggcucg

SEQ ID NO: 3950 - RNA, 22 nt, Mycobacterium bovis subsp bovis AF2122/97
agccuccagcucgcgaagccaa

SEQ ID NO: 3951 - RNA, 22 nt, Mycobacterium bovis subsp bovis AF2122/97
agcuuggaggcgaucgcgcggg

SEQ ID NO: 3952 - RNA, 22 nt, Mycobacterium bovis subsp bovis AF2122/97
aguccugggccaacugccggua

SEQ ID NO: 3953 - RNA, 22 nt, Mycobacterium bovis subsp bovis AF2122/97
agguugccgcacuagacugcug

SEQ ID NO: 3954 - RNA, 22 nt, Mycobacterium bovis subsp bovis AF2122/97
aguuucucagcgagcaggugcu

SEQ ID NO: 3955 - RNA, 22 nt, Mycobacterium bovis subsp bovis AF2122/97
aggucaccgagaugacgucacc

SEQ ID NO: 3956 - RNA, 22 nt, Mycobacterium bovis subsp bovis AF2122/97
aggucugucggaccuggccgcg

SEQ ID NO: 3957 - RNA, 22 nt, Mycobacterium bovis subsp bovis AF2122/97
agguagacgugucccgcauggg

SEQ ID NO: 3958 - RNA, 22 nt, Mycobacterium bovis subsp bovis AF2122/97
agguggcgacggcguugaccga

SEQ ID NO: 3959 - RNA, 22 nt, Mycobacterium bovis subsp bovis AF2122/97
agggcugccacagucgccuggg

SEQ ID NO: 3960 - RNA, 22 nt, Mycobacterium bovis subsp bovis AF2122/97
aggugcgccguggcaucgccuc

SEQ ID NO: 3961 - RNA, 22 nt, Mycobacterium bovis subsp bovis AF2122/97
agucaccuacaacgggguggag

SEQ ID NO: 3962 - RNA, 22 nt, Mycobacterium bovis subsp bovis AF2122/97
agucagagucucgggcauguac

SEQ ID NO: 3963 - RNA, 22 nt, Mycobacterium bovis subsp bovis AF2122/97
auccaggaauugucagacguua

SEQ ID NO: 3964 - RNA, 22 nt, Mycobacterium bovis subsp bovis AF2122/97
aucaccaccgagaugccgaacc

SEQ ID NO: 3965 - RNA, 22 nt, Mycobacterium bovis subsp bovis AF2122/97
aucacgccucucgguggugggg

SEQ ID NO: 3966 - RNA, 22 nt, Mycobacterium bovis subsp bovis AF2122/97
aucaccuuccucggcaugagau

SEQ ID NO: 3967 - RNA, 22 nt, Mycobacterium bovis subsp bovis AF2122/97
auccaggcgaccggccggggua

SEQ ID NO: 3968 - RNA, 22 nt, Mycobacterium bovis subsp bovis AF2122/97
aucgcagccacggaguucgauu

SEQ ID NO: 3969 - RNA, 22 nt, Mycobacterium bovis subsp bovis AF2122/97
aucuaaaccgacgcgcacgaga

SEQ ID NO: 3970 - RNA, 22 nt, Mycobacterium bovis subsp bovis AF2122/97
aucugcagguuccuggguugac

SEQ ID NO: 3971 - RNA, 22 nt, Mycobacterium bovis subsp bovis AF2122/97
auaccagcaauugcucgacgaa

SEQ ID NO: 3972 - RNA, 22 nt, Mycobacterium bovis subsp bovis AF2122/97
augguguacgccgcagcgcggg

SEQ ID NO: 3973 - RNA, 23 nt, Mycobacterium bovis subsp bovis AF2122/97
auggccucccggccgaugcgggc

SEQ ID NO: 3974 - RNA, 22 nt, Mycobacterium bovis subsp bovis AF2122/97
auggccaaccucccgacuggua

SEQ ID NO: 3975 - RNA, 22 nt, Mycobacterium bovis subsp bovis AF2122/97
augaccuggcgggucgugguug

SEQ ID NO: 3976 - RNA, 22 nt, Mycobacterium bovis subsp bovis AF2122/97
augaaaccgguggccaugccgc

SEQ ID NO: 3977 - RNA, 22 nt, Mycobacterium bovis subsp bovis AF2122/97
augaggcgauuuugcgucugcu

SEQ ID NO: 3978 - RNA, 22 nt, Mycobacterium bovis subsp bovis AF2122/97
cggcugcagugcgacgacgaga

SEQ ID NO: 3979 - RNA, 22 nt, Mycobacterium bovis subsp bovis AF2122/97
cggcucccgugccggugccgau

SEQ ID NO: 3980 - RNA, 22 nt, Mycobacterium bovis subsp bovis AF2122/97
cggguuugguguccgcacugcu

SEQ ID NO: 3981 - RNA, 22 nt, Mycobacterium bovis subsp bovis AF2122/97
cggggcugccggugagugcgcg

SEQ ID NO: 3982 - RNA, 22 nt, Mycobacterium bovis subsp bovis AF2122/97
cgggucuauggguggaugcucg

SEQ ID NO: 3983 - RNA, 22 nt, Mycobacterium bovis subsp bovis AF2122/97
cgggcugcagcgguaguacuuu

SEQ ID NO: 3984 - RNA, 22 nt, Mycobacterium bovis subsp bovis AF2122/97
cggggaucggcacccuggccgc

SEQ ID NO: 3985 - RNA, 22 nt, Mycobacterium bovis subsp bovis AF2122/97
cggcucaggcuuaugcagccgu

SEQ ID NO: 3986 - RNA, 22 nt, Mycobacterium bovis subsp bovis AF2122/97
cgcucagggcgucaccgccccg

SEQ ID NO: 3987 - RNA, 22 nt, Mycobacterium bovis subsp bovis AF2122/97
cggcagcacgagcucgucgugg

SEQ ID NO: 3988 - RNA, 22 nt, Mycobacterium bovis subsp bovis AF2122/97
cgcccggccgcuggucgcguac

SEQ ID NO: 3989 - RNA, 22 nt, Mycobacterium bovis subsp bovis AF2122/97
cgccucccgggcugggcugguu

SEQ ID NO: 3990 - RNA, 17 nt, Mycobacterium bovis subsp bovis AF2122/97
cgccuggcgcugacccc

SEQ ID NO: 3991 - RNA, 22 nt, Mycobacterium bovis subsp bovis AF2122/97
cgccugggccagugccgacuuc

SEQ ID NO: 3992 - RNA, 22 nt, Mycobacterium bovis subsp bovis AF2122/97
cgccuuggacgacgguuccgau

SEQ ID NO: 3993 - RNA, 22 nt, Mycobacterium bovis subsp bovis AF2122/97
cgcucgagauugcagcgggccc

SEQ ID NO: 3994 - RNA, 22 nt, Mycobacterium bovis subsp bovis AF2122/97
cgcugggcagucucgaggaccu

SEQ ID NO: 3995 - RNA, 22 nt, Mycobacterium bovis subsp bovis AF2122/97
cgugauccacagccacccggug

SEQ ID NO: 3996 - RNA, 22 nt, Mycobacterium bovis subsp bovis AF2122/97
cggucaccuucgcaucggugau

SEQ ID NO: 3997 - RNA, 22 nt, Mycobacterium bovis subsp bovis AF2122/97
cggucaccaucucgcagacaua

SEQ ID NO: 3998 - RNA, 22 nt, Mycobacterium bovis subsp bovis AF2122/97
cgugggccugagcagcgacgac

SEQ ID NO: 3999 - RNA, 22 nt, Mycobacterium bovis subsp bovis AF2122/97
cguggaaugcaugaucgucgcc

SEQ ID NO: 4000 - RNA, 22 nt, Mycobacterium bovis subsp bovis AF2122/97
cguucagcacggccgacagcga

SEQ ID NO: 4001 - RNA, 22 nt, Mycobacterium bovis subsp bovis AF2122/97
cuaccagccggcgcagcagcgc

SEQ ID NO: 4002 - RNA, 22 nt, Mycobacterium bovis subsp bovis AF2122/97
ccgcccaggcucccgcucgacg

SEQ ID NO: 4003 - RNA, 21 nt, Mycobacterium bovis subsp bovis AF2122/97
cccugggccgccucgcucacc

SEQ ID NO: 4004 - RNA, 22 nt, Mycobacterium bovis subsp bovis AF2122/97
ccguugacgaaccggaccaauc

SEQ ID NO: 4005 - RNA, 22 nt, Mycobacterium bovis subsp bovis AF2122/97
ccugggcgacuuggcguugcug

SEQ ID NO: 4006 - RNA, 22 nt, Mycobacterium bovis subsp bovis AF2122/97
ccuggcgcgcagcacggccugc

SEQ ID NO: 4007 - RNA, 22 nt, Mycobacterium bovis subsp bovis AF2122/97
ccugggaucgaggggucuucau

SEQ ID NO: 4008 - RNA, 22 nt, Mycobacterium bovis subsp bovis AF2122/97
ccugggauggucaacaccguga

SEQ ID NO: 4009 - RNA, 22 nt, Mycobacterium bovis subsp bovis AF2122/97
ccugggauugugggcgggcguc

SEQ ID NO: 4010 - RNA, 22 nt, Mycobacterium bovis subsp bovis AF2122/97
ccugucucggcaagccuggucg

SEQ ID NO: 4011 - RNA, 22 nt, Mycobacterium bovis subsp bovis AF2122/97
ccgcccggggcauggccaagcu

SEQ ID NO: 4012 - RNA, 21 nt, Mycobacterium bovis subsp bovis AF2122/97
cgccccagaugcacgcucggc

SEQ ID NO: 4013 - RNA, 22 nt, Mycobacterium bovis subsp bovis AF2122/97
cgcccgccaaggacuuccgcgc

SEQ ID NO: 4014 - RNA, 22 nt, Mycobacterium bovis subsp bovis AF2122/97
cgcaggaugaggcuugccaccg

SEQ ID NO: 4015 - RNA, 22 nt, Mycobacterium bovis subsp bovis AF2122/97
cgccacucuggucuugcaccug

SEQ ID NO: 4016 - RNA, 22 nt, Mycobacterium bovis subsp bovis AF2122/97
cgccagcaccaccugguugggc

SEQ ID NO: 4017 - RNA, 22 nt, Mycobacterium bovis subsp bovis AF2122/97
cgcagcaucggcgauugucggc

SEQ ID NO: 4018 - RNA, 22 nt, Mycobacterium bovis subsp bovis AF2122/97
cgccaagccgcaaggcucggcg

SEQ ID NO: 4019 - RNA, 22 nt, Mycobacterium bovis subsp bovis AF2122/97
cgagccuggccacugggaagga

SEQ ID NO: 4020 - RNA, 21 nt, Mycobacterium bovis subsp bovis AF2122/97
cgagcucgcggcccagaguuc

SEQ ID NO: 4021 - RNA, 22 nt, Mycobacterium bovis subsp bovis AF2122/97
cgaccugccgcagcguugcuau

SEQ ID NO: 4022 - RNA, 22 nt, Mycobacterium bovis subsp bovis AF2122/97
cccagccaggguaaggccuuug

SEQ ID NO: 4023 - RNA, 22 nt, Mycobacterium bovis subsp bovis AF2122/97
cccagcgccagcgugaucggca

SEQ ID NO: 4024 - RNA, 22 nt, Mycobacterium bovis subsp bovis AF2122/97
ccaugccgaugacgcuguuggc

SEQ ID NO: 4025 - RNA, 22 nt, Mycobacterium bovis subsp bovis AF2122/97
cccagcaccgaccagugccggc

SEQ ID NO: 4026 - RNA, 22 nt, Mycobacterium bovis subsp bovis AF2122/97
cccgcgccgggauagucaccgc

SEQ ID NO: 4027 - RNA, 22 nt, Mycobacterium bovis subsp bovis AF2122/97
cccuggugguccgaucguucau

SEQ ID NO: 4028 - RNA, 22 nt, Mycobacterium bovis subsp bovis AF2122/97
cccagcaccugccaggacgggc

SEQ ID NO: 4029 - RNA, 22 nt, Mycobacterium bovis subsp bovis AF2122/97
ccccuaccgucgauguggcggg

SEQ ID NO: 4030 - RNA, 22 nt, Mycobacterium bovis subsp bovis AF2122/97
ccagcuugucgccacgaaccuu

SEQ ID NO: 4031 - RNA, 22 nt, Mycobacterium bovis subsp bovis AF2122/97
ccagccugcgcaagacggugac

SEQ ID NO: 4032 - RNA, 22 nt, Mycobacterium bovis subsp bovis AF2122/97
ccagccgccagcaucucggauc

SEQ ID NO: 4033 - RNA, 22 nt, Mycobacterium bovis subsp bovis AF2122/97
ccagcagugcgggcgaucguga

SEQ ID NO: 4034 - RNA, 22 nt, Mycobacterium bovis subsp bovis AF2122/97
ccagcagcgcguacagcaucga

SEQ ID NO: 4035 - RNA, 22 nt, Mycobacterium bovis subsp bovis AF2122/97
ccaggugcauugugcaccacau

SEQ ID NO: 4036 - RNA, 22 nt, Mycobacterium bovis subsp bovis AF2122/97
ccaggugccgucggguuguucg

SEQ ID NO: 4037 - RNA, 22 nt, Mycobacterium bovis subsp bovis AF2122/97
ccaugagcacccggauggccug

SEQ ID NO: 4038 - RNA, 22 nt, Mycobacterium bovis subsp bovis AF2122/97
ccagcucaucgccguagcugag

SEQ ID NO: 4039 - RNA, 22 nt, Mycobacterium bovis subsp bovis AF2122/97
ccaggccaccgcgcggccaccg

SEQ ID NO: 4040 - RNA, 23 nt, Mycobacterium bovis subsp bovis AF2122/97
cauccugcuggugcggaccggca

SEQ ID NO: 4041 - RNA, 22 nt, Mycobacterium bovis subsp bovis AF2122/97
caugacuuccagcaacgccgac

SEQ ID NO: 4042 - RNA, 22 nt, Mycobacterium bovis subsp bovis AF2122/97
caugcaucggaagaaccggcau

SEQ ID NO: 4043 - RNA, 22 nt, Mycobacterium bovis subsp bovis AF2122/97
cauugcaccggugcgcucggcg

SEQ ID NO: 4044 - RNA, 22 nt, Mycobacterium bovis subsp bovis AF2122/97
cauggaaacgcaggugguguca

SEQ ID NO: 4045 - RNA, 22 nt, Mycobacterium bovis subsp bovis AF2122/97
cauccagcaguacgaggacggg

SEQ ID NO: 4046 - RNA, 22 nt, Mycobacterium bovis subsp bovis AF2122/97
cauccaggcgaugguggcaacc

SEQ ID NO: 4047 - RNA, 22 nt, Mycobacterium bovis subsp bovis AF2122/97
caucuguuggcgcucucggccu

SEQ ID NO: 4048 - RNA, 22 nt, Mycobacterium bovis subsp bovis AF2122/97
caguucggucucuauccgccgc

SEQ ID NO: 4049 - RNA, 22 nt, Mycobacterium bovis subsp bovis AF2122/97
ccacccgcgccagccggacggc

SEQ ID NO: 4050 - RNA, 22 nt, Mycobacterium bovis subsp bovis AF2122/97
ccaccgccacggccagcaccgc

SEQ ID NO: 4051 - RNA, 23 nt, Mycobacterium bovis subsp bovis AF2122/97
ccagauccagccguacgacgggc

SEQ ID NO: 4052 - RNA, 22 nt, Mycobacterium bovis subsp bovis AF2122/97
ccaagcucuggauggccugccg

SEQ ID NO: 4053 - RNA, 22 nt, Mycobacterium bovis subsp bovis AF2122/97
ccaaugggauguugccgagcau

SEQ ID NO: 4054 - RNA, 22 nt, Mycobacterium bovis subsp bovis AF2122/97
ccaccagcuggacgccgucgcg

SEQ ID NO: 4055 - RNA, 22 nt, Mycobacterium bovis subsp bovis AF2122/97
ccaccaugcgcgccuacgcgaa

SEQ ID NO: 4056 - RNA, 22 nt, Mycobacterium bovis subsp bovis AF2122/97
cacgccggcgugcaucggugac

SEQ ID NO: 4057 - RNA, 22 nt, Mycobacterium bovis subsp bovis AF2122/97
cacgccagcgucccggguugcu

SEQ ID NO: 4058 - RNA, 22 nt, Mycobacterium bovis subsp bovis AF2122/97
caccugccgaucgcacagguug

SEQ ID NO: 4059 - RNA, 22 nt, Mycobacterium bovis subsp bovis AF2122/97
cacgagcguaaccccagugcga

SEQ ID NO: 4060 - RNA, 20 nt, Mycobacterium bovis subsp bovis AF2122/97
cacuccuggcuggauucggc

SEQ ID NO: 4061 - RNA, 22 nt, Mycobacterium bovis subsp bovis AF2122/97
caccagggugcugccggugauu

SEQ ID NO: 4062 - RNA, 22 nt, Mycobacterium bovis subsp bovis AF2122/97
cacugacuagugaagaaccuuu

SEQ ID NO: 4063 - RNA, 22 nt, Mycobacterium bovis subsp bovis AF2122/97
cagccagggucagcacgcggau

SEQ ID NO: 4064 - RNA, 22 nt, Mycobacterium bovis subsp bovis AF2122/97
cagccggcgcauggucaaagcg

SEQ ID NO: 4065 - RNA, 22 nt, Mycobacterium bovis subsp bovis AF2122/97
cagcucccaacgguggccccgg

SEQ ID NO: 4066 - RNA, 22 nt, Mycobacterium bovis subsp bovis AF2122/97
cagcguugucucggcgaacacc

SEQ ID NO: 4067 - RNA, 22 nt, Mycobacterium bovis subsp bovis AF2122/97
caggauauccaggcggcagcag

SEQ ID NO: 4068 - RNA, 22 nt, Mycobacterium bovis subsp bovis AF2122/97
caggcgaaucaccccgccgcgc

SEQ ID NO: 4069 - RNA, 22 nt, Mycobacterium bovis subsp bovis AF2122/97
caggggcucgauccggccgggc

SEQ ID NO: 4070 - RNA, 22 nt, Mycobacterium bovis subsp bovis AF2122/97
caggaugacgccgcagcgcucg

SEQ ID NO: 4071 - RNA, 22 nt, Mycobacterium bovis subsp bovis AF2122/97
augguguagaucuuggucgggu

SEQ ID NO: 4072 - RNA, 22 nt, Mycobacterium bovis subsp bovis AF2122/97
auucucuucauggugguguuga

SEQ ID NO: 4073 - RNA, 22 nt, Mycobacterium bovis subsp bovis AF2122/97
auuccguugcgccuauuugaaa

SEQ ID NO: 4074 - RNA, 22 nt, Mycobacterium bovis subsp bovis AF2122/97
caaguaguaggcgagaucaccg

SEQ ID NO: 4075 - RNA, 22 nt, Mycobacterium bovis subsp bovis AF2122/97
cacaccgcgaugacuccggcga

SEQ ID NO: 4076 - RNA, 22 nt, Mycobacterium bovis subsp bovis AF2122/97
caauguuucgacgggcaccaaa

SEQ ID NO: 4077 - RNA, 22 nt, Mycobacterium bovis subsp bovis AF2122/97
caagaccaggacggcgccgucg

SEQ ID NO: 4078 - RNA, 22 nt, Mycobacterium bovis subsp bovis AF2122/97
auuggccaggcugacagaggca

SEQ ID NO: 4079 - RNA, 22 nt, Mycobacterium bovis subsp bovis AF2122/97
caaauauuucguggcgaugcgc

SEQ ID NO: 4080 - RNA, 21 nt, Mycobacterium bovis subsp bovis AF2122/97
auuugcaacgcaacggcgugc

SEQ ID NO: 4081 - RNA, 22 nt, Mycobacterium bovis subsp bovis AF2122/97
uuucauucguugcgcgcagacc

SEQ ID NO: 4082 - RNA, 22 nt, Mycobacterium bovis subsp bovis AF2122/97
uuugauauccgcaaccugcggu

SEQ ID NO: 4083 - RNA, 22 nt, Mycobacterium bovis subsp bovis AF2122/97
uuucauucagacgagaggcgug

SEQ ID NO: 4084 - RNA, 22 nt, Mycobacterium bovis subsp bovis AF2122/97
uuucagguccagcuuccgucga

SEQ ID NO: 4085 - RNA, 22 nt, Mycobacterium bovis subsp bovis AF2122/97
uuagccuuaugccugucacacc

SEQ ID NO: 4086 - RNA, 22 nt, Mycobacterium bovis subsp bovis AF2122/97
uucaccuuccuugacgccauau

SEQ ID NO: 4087 - RNA, 22 nt, Mycobacterium bovis subsp bovis AF2122/97
uucagcagggugauguccagcc

SEQ ID NO: 4088 - RNA, 22 nt, Mycobacterium bovis subsp bovis AF2122/97
uucaggcuacgguagcggugcg

SEQ ID NO: 4089 - RNA, 22 nt, Mycobacterium bovis subsp bovis AF2122/97
uucaucaguuggucgagguuga

SEQ ID NO: 4090 - RNA, 22 nt, Mycobacterium bovis subsp bovis AF2122/97
uggucaggcggccgucgucggc

SEQ ID NO: 4091 - RNA, 22 nt, Mycobacterium bovis subsp bovis AF2122/97
uggucggcgaguucgccgugca

SEQ ID NO: 4092 - RNA, 22 nt, Mycobacterium bovis subsp bovis AF2122/97
uggguggcuucggcgcgcugaa

SEQ ID NO: 4093 - RNA, 22 nt, Mycobacterium bovis subsp bovis AF2122/97
uggggcuggcucugcuugccgc

SEQ ID NO: 4094 - RNA, 22 nt, Mycobacterium bovis subsp bovis AF2122/97
uggucacguacggccgccgcgg

SEQ ID NO: 4095 - RNA, 22 nt, Mycobacterium bovis subsp bovis AF2122/97
ugguuggugccgaacugcaucu

SEQ ID NO: 4096 - RNA, 22 nt, Mycobacterium bovis subsp bovis AF2122/97
ugguuucccgugaggugaucgc

SEQ ID NO: 4097 - RNA, 23 nt, Mycobacterium bovis subsp bovis AF2122/97
ugguggucaccccgacgacgcuc

SEQ ID NO: 4098 - RNA, 22 nt, Mycobacterium bovis subsp bovis AF2122/97
ugguuucccuacccgggcagca

SEQ ID NO: 4099 - RNA, 22 nt, Mycobacterium bovis subsp bovis AF2122/97
ugguggcgugcagcgccaucuc

SEQ ID NO: 4100 - RNA, 22 nt, Mycobacterium bovis subsp bovis AF2122/97
ugguggcugugucgaccgggaa

SEQ ID NO: 4101 - RNA, 22 nt, Mycobacterium bovis subsp bovis AF2122/97
uggucaccgucgccgcaaucga

SEQ ID NO: 4102 - RNA, 18 nt, Mycobacterium bovis subsp bovis AF2122/97
uggugcaccuuguuuggg

SEQ ID NO: 4103 - RNA, 22 nt, Mycobacterium bovis subsp bovis AF2122/97
uguggaauacgcugcuggucuu

SEQ ID NO: 4104 - RNA, 22 nt, Mycobacterium bovis subsp bovis AF2122/97
ugucgcgcaagcucuccggcac

SEQ ID NO: 4105 - RNA, 22 nt, Mycobacterium bovis subsp bovis AF2122/97
ugucccgcacucgauccgcaag

SEQ ID NO: 4106 - RNA, 22 nt, Mycobacterium bovis subsp bovis AF2122/97
uugauccagggugcgugguugg

SEQ ID NO: 4107 - RNA, 22 nt, Mycobacterium bovis subsp bovis AF2122/97
uugaugaugcggauccggauuc

SEQ ID NO: 4108 - RNA, 22 nt, Mycobacterium bovis subsp bovis AF2122/97
uugaggaucagguucagcuggc

SEQ ID NO: 4109 - RNA, 22 nt, Mycobacterium bovis subsp bovis AF2122/97
uucguggcgaccaugcgccggu

SEQ ID NO: 4110 - RNA, 22 nt, Mycobacterium bovis subsp bovis AF2122/97
uucuagccgccccgggcgcagc

SEQ ID NO: 4111 - RNA, 22 nt, Mycobacterium bovis subsp bovis AF2122/97
uuccagccacagcccggcggcg

SEQ ID NO: 4112 - RNA, 22 nt, Mycobacterium bovis subsp bovis AF2122/97
uuggccaacccgguguuggcau

SEQ ID NO: 4113 - RNA, 22 nt, Mycobacterium bovis subsp bovis AF2122/97
uuggccaaccugcugcacgaga

SEQ ID NO: 4114 - RNA, 22 nt, Mycobacterium bovis subsp bovis AF2122/97
uuggcaguccagccgggugccg

SEQ ID NO: 4115 - RNA, 22 nt, Mycobacterium bovis subsp bovis AF2122/97
uuggccgcggcccaugcuggcg

SEQ ID NO: 4116 - RNA, 22 nt, Mycobacterium bovis subsp bovis AF2122/97
uugcgcaggggcaugucagcgu

SEQ ID NO: 4117 - RNA, 22 nt, Mycobacterium bovis subsp bovis AF2122/97
uuggcagcgugaaguguucggg

SEQ ID NO: 4118 - RNA, 22 nt, Mycobacterium bovis subsp bovis AF2122/97
uugcccaagcccggcggaccgg

SEQ ID NO: 4119 - RNA, 22 nt, Mycobacterium bovis subsp bovis AF2122/97
uuguggcugaucccggccaggc

SEQ ID NO: 4120 - RNA, 22 nt, Mycobacterium bovis subsp bovis AF2122/97
uugucaccgcuuccauggcguu

SEQ ID NO: 4121 - RNA, 22 nt, Mycobacterium bovis subsp bovis AF2122/97
uugucgccgucucgguccagcu

SEQ ID NO: 4122 - RNA, 22 nt, Mycobacterium bovis subsp bovis AF2122/97
uugucgccgugcaccaccugga

SEQ ID NO: 4123 - RNA, 22 nt, Mycobacterium bovis subsp bovis AF2122/97
uuggucaccgcggcgcgggccg

SEQ ID NO: 4124 - RNA, 22 nt, Mycobacterium bovis subsp bovis AF2122/97
uuggucaccuccgagcccacgg

SEQ ID NO: 4125 - RNA, 22 nt, Mycobacterium bovis subsp bovis AF2122/97
uugggauuguugauuccgccga

SEQ ID NO: 4126 - RNA, 22 nt, Mycobacterium bovis subsp bovis AF2122/97
uugggcagacgcuggucaacga

SEQ ID NO: 4127 - RNA, 22 nt, Mycobacterium bovis subsp bovis AF2122/97
ucuuucccuccagaucggugcg

SEQ ID NO: 4128 - RNA, 22 nt, Mycobacterium bovis subsp bovis AF2122/97
ucugugcgcgguuugugcacag

SEQ ID NO: 4129 - RNA, 22 nt, Mycobacterium bovis subsp bovis AF2122/97
ucuggccgggcggcauggagau

SEQ ID NO: 4130 - RNA, 20 nt, Mycobacterium bovis subsp bovis AF2122/97
ucuggccaaggugucgagca

SEQ ID NO: 4131 - RNA, 22 nt, Mycobacterium bovis subsp bovis AF2122/97
ucguggcccucccggcggccac

SEQ ID NO: 4132 - RNA, 22 nt, Mycobacterium bovis subsp bovis AF2122/97
ugaaggucuugugcccguugag

SEQ ID NO: 4133 - RNA, 22 nt, Mycobacterium bovis subsp bovis AF2122/97
ugaccugacgcggcuccggcgc

SEQ ID NO: 4134 - RNA, 22 nt, Mycobacterium bovis subsp bovis AF2122/97
ugacccaggcgccggucggugu

SEQ ID NO: 4135 - RNA, 22 nt, Mycobacterium bovis subsp bovis AF2122/97
ugagacccccgucgaagucuag

SEQ ID NO: 4136 - RNA, 22 nt, Mycobacterium bovis subsp bovis AF2122/97
ugagguuucaucgaucggccug

SEQ ID NO: 4137 - RNA, 22 nt, Mycobacterium bovis subsp bovis AF2122/97
ugaucucacccgaaguuguguc

SEQ ID NO: 4138 - RNA, 19 nt, Mycobacterium bovis subsp bovis AF2122/97
ugcacuccaccgcuggcgc

SEQ ID NO: 4139 - RNA, 22 nt, Mycobacterium bovis subsp bovis AF2122/97
ugcacuccgacccgccgacguu

SEQ ID NO: 4140 - RNA, 22 nt, Mycobacterium bovis subsp bovis AF2122/97
ugcacgccucaaagccgaugag

SEQ ID NO: 4141 - RNA, 18 nt, Mycobacterium bovis subsp bovis AF2122/97
ugcgcgccgccagcuauc

SEQ ID NO: 4142 - RNA, 22 nt, Mycobacterium bovis subsp bovis AF2122/97
ugcgcgccuugauccggcuguc

SEQ ID NO: 4143 - RNA, 22 nt, Mycobacterium bovis subsp bovis AF2122/97
ugcuccacugcugccaagucgg

SEQ ID NO: 4144 - RNA, 22 nt, Mycobacterium bovis subsp bovis AF2122/97
uggaaaaacggcggccccgacc

SEQ ID NO: 4145 - RNA, 22 nt, Mycobacterium bovis subsp bovis AF2122/97
ugcccaacucggccagaauguu

SEQ ID NO: 4146 - RNA, 22 nt, Mycobacterium bovis subsp bovis AF2122/97
ugcgccagcgccucccgcagga

SEQ ID NO: 4147 - RNA, 22 nt, Mycobacterium bovis subsp bovis AF2122/97
ugcgccaccgccagaggauaac

SEQ ID NO: 4148 - RNA, 22 nt, Mycobacterium bovis subsp bovis AF2122/97
ugcaggucgagguggucgguuu

SEQ ID NO: 4149 - RNA, 19 nt, Mycobacterium bovis subsp bovis AF2122/97
ugcaugagucguggaaugg

SEQ ID NO: 4150 - RNA, 22 nt, Mycobacterium bovis subsp bovis AF2122/97
ugccgccaccaggcagccggug

SEQ ID NO: 4151 - RNA, 22 nt, Mycobacterium bovis subsp bovis AF2122/97
uggccaagcggaccgucggcau

SEQ ID NO: 4152 - RNA, 22 nt, Mycobacterium bovis subsp bovis AF2122/97
uggccagaucuccccgcgggcc

SEQ ID NO: 4153 - RNA, 22 nt, Mycobacterium bovis subsp bovis AF2122/97
uggcagcaaucggguauccgau

SEQ ID NO: 4154 - RNA, 21 nt, Mycobacterium bovis subsp bovis AF2122/97
uggcgagccgggccacgcccg

SEQ ID NO: 4155 - RNA, 22 nt, Mycobacterium bovis subsp bovis AF2122/97
uggcccacugcaaccggaccuc

SEQ ID NO: 4156 - RNA, 22 nt, Mycobacterium bovis subsp bovis AF2122/97
uggcgagcagacgcaaaagccc

SEQ ID NO: 4157 - RNA, 22 nt, Mycobacterium bovis subsp bovis AF2122/97
uggcgcugugcugcucgacgug

SEQ ID NO: 4158 - RNA, 22 nt, Mycobacterium bovis subsp bovis AF2122/97
uggcucagcgggucaacgaggc

SEQ ID NO: 4159 - RNA, 23 nt, Mycobacterium bovis subsp bovis AF2122/97
ugggcucaggauguggcugcgau

SEQ ID NO: 4160 - RNA, 22 nt, Mycobacterium bovis subsp bovis AF2122/97
ugggcugaacaggacggccgcc

SEQ ID NO: 4161 - RNA, 22 nt, Mycobacterium bovis subsp bovis AF2122/97
ugggcugcugcgccgcaucggc

SEQ ID NO: 4162 - RNA, 22 nt, Mycobacterium bovis subsp bovis AF2122/97
ugggcaugaucuguggaucagg

SEQ ID NO: 4163 - RNA, 22 nt, Mycobacterium bovis subsp bovis AF2122/97
ugggccaacacgugcgcggucg

SEQ ID NO: 4164 - RNA, 22 nt, Mycobacterium bovis subsp bovis AF2122/97
ugggacagcuggaaguuaucgg

SEQ ID NO: 4165 - RNA, 22 nt, Mycobacterium bovis subsp bovis AF2122/97
uggcugggcgaccgcggugucg

SEQ ID NO: 4166 - RNA, 22 nt, Mycobacterium bovis subsp bovis AF2122/97
uggcuggucggaccgucagcga

SEQ ID NO: 4167 - RNA, 22 nt, Mycobacterium leprae
uggcuuuuggcugaaacugacc

SEQ ID NO: 4168 - RNA, 22 nt, Mycobacterium leprae
ugggaaaaugggcuucgucuuc

SEQ ID NO: 4169 - RNA, 22 nt, Mycobacterium leprae
uggaggagaggucgcauguugg

SEQ ID NO: 4170 - RNA, 22 nt, Mycobacterium leprae
ugcugaugucgaagacaaugua

SEQ ID NO: 4171 - RNA, 23 nt, Mycobacterium leprae
ugcugcugaugaucgcauccagc

SEQ ID NO: 4172 - RNA, 22 nt, Mycobacterium leprae
ugauggcgguauguaauguugg

SEQ ID NO: 4173 - RNA, 22 nt, Mycobacterium leprae
ugaugaaguauugguaccaggc

SEQ ID NO: 4174 - RNA, 22 nt, Mycobacterium leprae
ugaugauuggcauggcagugaa

SEQ ID NO: 4175 - RNA, 22 nt, Mycobacterium leprae
ugauaucuauacgcgaccaggu

SEQ ID NO: 4176 - RNA, 21 nt, Mycobacterium leprae
ugaccuagauaugaccugagc

SEQ ID NO: 4177 - RNA, 22 nt, Mycobacterium leprae
ugagaaggugcgccagcgcagc

SEQ ID NO: 4178 - RNA, 23 nt, Mycobacterium leprae
ugaagccacgugaucgcacaucc

SEQ ID NO: 4179 - RNA, 23 nt, Mycobacterium leprae
ugaauagcggcagcuugggcuca

SEQ ID NO: 4180 - RNA, 22 nt, Mycobacterium leprae
ugaauuugaucuugucauuguu

SEQ ID NO: 4181 - RNA, 22 nt, Mycobacterium leprae
ugaacugacuacgcucagagcg

SEQ ID NO: 4182 - RNA, 22 nt, Mycobacterium leprae
ucuuccugcaugggcugauccg

SEQ ID NO: 4183 - RNA, 22 nt, Mycobacterium leprae
ucuuuugacuugucauguucau

SEQ ID NO: 4184 - RNA, 22 nt, Mycobacterium leprae
ucuuguuugcgggauugucgug

SEQ ID NO: 4185 - RNA, 22 nt, Mycobacterium leprae
uucgauuucggggaauucgaaa

SEQ ID NO: 4186 - RNA, 22 nt, Mycobacterium leprae
uucugagugauccgcacgaugg

SEQ ID NO: 4187 - RNA, 22 nt, Mycobacterium leprae
uugaggaucagguucagcuggc

SEQ ID NO: 4188 - RNA, 22 nt, Mycobacterium leprae
uucuugacuugcuugcgcguau

SEQ ID NO: 4189 - RNA, 22 nt, Mycobacterium leprae
ugucaaggaugccaucgagugu

SEQ ID NO: 4190 - RNA, 21 nt, Mycobacterium leprae
ugucuugacuguuggacagga

SEQ ID NO: 4191 - RNA, 20 nt, Mycobacterium leprae
ugguguagcgcacacccugu

SEQ ID NO: 4192 - RNA, 22 nt, Mycobacterium leprae
ugggcuaugugguucauucugg

SEQ ID NO: 4193 - RNA, 20 nt, Mycobacterium leprae
uucaucuugcaagucccggu

SEQ ID NO: 4194 - RNA, 22 nt, Mycobacterium leprae
uucagacuaguaauuagaguua

SEQ ID NO: 4195 - RNA, 22 nt, Mycobacterium leprae
uuacugugccgcaacuguauuc

SEQ ID NO: 4196 - RNA, 22 nt, Mycobacterium leprae
uuaaaaccaucguggggcucga

SEQ ID NO: 4197 - RNA, 22 nt, Mycobacterium leprae
uuuggcuugacgugcuuuagcu

SEQ ID NO: 4198 - RNA, 22 nt, Mycobacterium leprae
caacaucucggggugcaacuug

SEQ ID NO: 4199 - RNA, 22 nt, Mycobacterium leprae
auguucagaucggcaucgguua

SEQ ID NO: 4200 - RNA, 22 nt, Mycobacterium leprae
augugguuggcagcgcuggaaa

SEQ ID NO: 4201 - RNA, 22 nt, Mycobacterium leprae
augugugaauuuaacauguuga

SEQ ID NO: 4202 - RNA, 22 nt, Mycobacterium leprae
caggagcacgguaacucggugc

SEQ ID NO: 4203 - RNA, 18 nt, Mycobacterium leprae
caggggcuucgaugcggu

SEQ ID NO: 4204 - RNA, 22 nt, Mycobacterium leprae
cagccaggcagcugcuaggcgg

SEQ ID NO: 4205 - RNA, 22 nt, Mycobacterium leprae
cagcaacagcgcagaauuuucu

SEQ ID NO: 4206 - RNA, 22 nt, Mycobacterium leprae
ccacaucuggcagaagagcugu

SEQ ID NO: 4207 - RNA, 22 nt, Mycobacterium leprae
ccaagcugcuccggucggugcu

SEQ ID NO: 4208 - RNA, 22 nt, Mycobacterium leprae
cagucaacuagcuuggcuucuc

SEQ ID NO: 4209 - RNA, 22 nt, Mycobacterium leprae
caugggauucgacguaguucac

SEQ ID NO: 4210 - RNA, 19 nt, Mycobacterium leprae
caugaugacguaccuaguc

SEQ ID NO: 4211 - RNA, 22 nt, Mycobacterium leprae
ccaucaccggcaguuuagaacu

SEQ ID NO: 4212 - RNA, 22 nt, Mycobacterium leprae
cccugcucaguagucggacccg

SEQ ID NO: 4213 - RNA, 22 nt, Mycobacterium leprae
cccugcucaucaugucggugga

SEQ ID NO: 4214 - RNA, 22 nt, Mycobacterium leprae
cgaaggaaugcaggcuucaguc

SEQ ID NO: 4215 - RNA, 22 nt, Mycobacterium leprae
cgaccugcaggucguuaucgcg

SEQ ID NO: 4216 - RNA, 21 nt, Mycobacterium leprae
cgauggggguugaucuuugag

SEQ ID NO: 4217 - RNA, 22 nt, Mycobacterium leprae
cgcaaauggcguucauaauggg

SEQ ID NO: 4218 - RNA, 22 nt, Mycobacterium leprae
cgccagugcgcuggcuaggcug

SEQ ID NO: 4219 - RNA, 22 nt, Mycobacterium leprae
cuaggcaguuuucgggguaucg

SEQ ID NO: 4220 - RNA, 22 nt, Mycobacterium leprae
cugaacaguucgucuuagccgc

SEQ ID NO: 4221 - RNA, 22 nt, Mycobacterium leprae
cucgaugucauccggauagugg

SEQ ID NO: 4222 - RNA, 22 nt, Mycobacterium leprae
cgcugauggugucgggcggcag

SEQ ID NO: 4223 - RNA, 22 nt, Mycobacterium leprae
augccauugcuggaccuaaucc

SEQ ID NO: 4224 - RNA, 22 nt, Mycobacterium leprae
augcugaugcccacgcgucgac

SEQ ID NO: 4225 - RNA, 22 nt, Mycobacterium leprae
augcuguguuucaaccguauug

SEQ ID NO: 4226 - RNA, 22 nt, Mycobacterium leprae
augguaugugguguugagacau

SEQ ID NO: 4227 - RNA, 22 nt, Mycobacterium leprae
auggggguguucggugucaacc

SEQ ID NO: 4228 - RNA, 22 nt, Mycobacterium leprae
augucacuucccgugccgauuu

SEQ ID NO: 4229 - RNA, 22 nt, Mycobacterium leprae
auguauuggugcaaguguccug

SEQ ID NO: 4230 - RNA, 22 nt, Mycobacterium leprae
auauugucggcgaguuugaucc

SEQ ID NO: 4231 - RNA, 22 nt, Mycobacterium leprae
aucggcagcggugggggaucca

SEQ ID NO: 4232 - RNA, 22 nt, Mycobacterium leprae
agucagugacucgagcgauaca

SEQ ID NO: 4233 - RNA, 20 nt, Mycobacterium leprae
aguauuuugccgcaggccau

SEQ ID NO: 4234 - RNA, 22 nt, Mycobacterium leprae
agugauuccuugccuggacguc

SEQ ID NO: 4235 - RNA, 22 nt, Mycobacterium leprae
agcugauagacggcggcagugg

SEQ ID NO: 4236 - RNA, 22 nt, Mycobacterium leprae
agcugaugagcacgcgggcggg

SEQ ID NO: 4237 - RNA, 22 nt, Mycobacterium leprae
agccauccuggugagcuuucuu

SEQ ID NO: 4238 - RNA, 17 nt, Mycobacterium leprae
agcagggcagcgaucga

SEQ ID NO: 4239 - RNA, 18 nt, Mycobacterium leprae
accugcucgaagcugaag

SEQ ID NO: 4240 - RNA, 22 nt, Mycobacterium leprae
agcagaucauguucgaacuugc

SEQ ID NO: 4241 - RNA, 22 nt, Mycobacterium leprae
acugaguuuaugcaguguuccg

SEQ ID NO: 4242 - RNA, 22 nt, Mycobacterium leprae
acaagcuguguccgucggcaga

SEQ ID NO: 4243 - RNA, 22 nt, Mycobacterium leprae
aaugugaacgugcaagaagcga

SEQ ID NO: 4244 - RNA, 22 nt, Mycobacterium leprae
aaugcuaugauaauuuggcuga

SEQ ID NO: 4245 - RNA, 22 nt, Mycobacterium leprae
aaauauuuugggcaagcaacag

SEQ ID NO: 4246 - RNA, 22 nt, Mycobacterium leprae
aaauguucgaaguaguucgcgg

SEQ ID NO: 4247 - RNA, 22 nt, Mycobacterium leprae
aacuuuugguugucgucuggcg

SEQ ID NO: 4248 - RNA, 22 nt, Mycobacterium leprae
guaaagcacacagcgucgcccc

SEQ ID NO: 4249 - RNA, 22 nt, Mycobacterium leprae
ggguugcauuucaucugucgcg

SEQ ID NO: 4250 - RNA, 22 nt, Mycobacterium leprae
gguaaugauugcguaacaacca

SEQ ID NO: 4251 - RNA, 22 nt, Mycobacterium leprae
ggguugauccgcgcgauggaga

SEQ ID NO: 4252 - RNA, 22 nt, Mycobacterium leprae
ggugauagugcugcuguuggca

SEQ ID NO: 4253 - RNA, 22 nt, Mycobacterium leprae
gggagcucaaguucuuuggcua

SEQ ID NO: 4254 - RNA, 22 nt, Mycobacterium leprae
gggguugcuggauugcccuggu

SEQ ID NO: 4255 - RNA, 22 nt, Mycobacterium leprae
guuugguuuuucaggcuauucu

SEQ ID NO: 4256 - RNA, 22 nt, Mycobacterium leprae
guuuuauuuaacuagacaucca

SEQ ID NO: 4257 - RNA, 22 nt, Mycobacterium leprae
gugcguugccguuauguuacgg

SEQ ID NO: 4258 - RNA, 22 nt, Mycobacterium leprae
gucuacauguugaugaugccag

SEQ ID NO: 4259 - RNA, 22 nt, Mycobacterium leprae
gucuuugcuaacgguuuggucu

SEQ ID NO: 4260 - RNA, 22 nt, Mycobacterium leprae
gucuuguccggccaagcuagga

SEQ ID NO: 4261 - RNA, 20 nt, Mycobacterium leprae
ucuauuaagauuaacguggc

SEQ ID NO: 4262 - RNA, 22 nt, Mycobacterium leprae
uccugcucggcguggugcucgg

SEQ ID NO: 4263 - RNA, 22 nt, Mycobacterium leprae
ucccggcugcgagcauuugcaa

SEQ ID NO: 4264 - RNA, 22 nt, Mycobacterium leprae
uauuagcuugcacgguaacaac

SEQ ID NO: 4265 - RNA, 22 nt, Mycobacterium leprae
uaucucauugggcgacgacugc

SEQ ID NO: 4266 - RNA, 23 nt, Mycobacterium leprae
uagcugaugccaggcuccgggac

SEQ ID NO: 4267 - RNA, 22 nt, Mycobacterium leprae
uagcaugccgguaggguuugug

SEQ ID NO: 4268 - RNA, 19 nt, Mycobacterium leprae
gcuugaggguuguccggug

SEQ ID NO: 4269 - RNA, 22 nt, Mycobacterium leprae
ggaauuugcaacguagugcagg

SEQ ID NO: 4270 - RNA, 22 nt, Mycobacterium leprae
ggaagaauggcuaccacgucga

SEQ ID NO: 4271 - RNA, 22 nt, Mycobacterium leprae
gcugcugcuagggcacccguug

SEQ ID NO: 4272 - RNA, 22 nt, Mycobacterium leprae
gcugguagcgaugucgagccug

SEQ ID NO: 4273 - RNA, 22 nt, Mycobacterium leprae
cugguuuugguccuggggcagg

SEQ ID NO: 4274 - RNA, 22 nt, Mycobacterium leprae
cuuaauccgacgacccugccau

SEQ ID NO: 4275 - RNA, 22 nt, Mycobacterium leprae
cugcugcugacacgccguuccg

SEQ ID NO: 4276 - RNA, 22 nt, Mycobacterium leprae
cugcugcugccaggcaugcggu

SEQ ID NO: 4277 - RNA, 22 nt, Mycobacterium leprae
cuggcacccagggccugcuguc

SEQ ID NO: 4278 - RNA, 22 nt, Mycobacterium leprae
gacaaauuccugggacagguac

SEQ ID NO: 4279 - RNA, 19 nt, Mycobacterium leprae
gaaaagugugauuuauuga

SEQ ID NO: 4280 - RNA, 22 nt, Mycobacterium leprae
gaaaaugacgaugucgccgggc

SEQ ID NO: 4281 - RNA, 22 nt, Mycobacterium leprae
cuuuugaagcugcuggcugagg

SEQ ID NO: 4282 - RNA, 22 nt, Mycobacterium leprae
cuuuggcuucggguagauugga

SEQ ID NO: 4283 - RNA, 22 nt, Mycobacterium leprae
gaggaugaagucgacgagcuac

SEQ ID NO: 4284 - RNA, 19 nt, Mycobacterium leprae
gcagugaucugggccaguu

SEQ ID NO: 4285 - RNA, 22 nt, Mycobacterium leprae
gcaguuucggauucgccgggac

SEQ ID NO: 4286 - RNA, 22 nt, Mycobacterium leprae
gcccacaacgcaacugagccga

SEQ ID NO: 4287 - RNA, 22 nt, Mycobacterium leprae
gcagauugcccacuuuggcacg

SEQ ID NO: 4288 - RNA, 22 nt, Mycobacterium tuberculosis CDC1551
gcaccgccggccugucccacga

SEQ ID NO: 4289 - RNA, 22 nt, Mycobacterium tuberculosis CDC1551
gcaccccagagcacugauacgc

SEQ ID NO: 4290 - RNA, 21 nt, Mycobacterium tuberculosis CDC1551
gcacacuggaagccagcacgc

SEQ ID NO: 4291 - RNA, 22 nt, Mycobacterium tuberculosis CDC1551
gcagcagguucaccacguaugc

SEQ ID NO: 4292 - RNA, 19 nt, Mycobacterium tuberculosis CDC1551
gccauagcggagugccggg

SEQ ID NO: 4293 - RNA, 21 nt, Mycobacterium tuberculosis CDC1551
gccauauaccagaucgcuggg

SEQ ID NO: 4294 - RNA, 22 nt, Mycobacterium tuberculosis CDC1551
gccaggcuggugucggcggugg

SEQ ID NO: 4295 - RNA, 22 nt, Mycobacterium tuberculosis CDC1551
gccagcagcucggcgauaucgg

SEQ ID NO: 4296 - RNA, 23 nt, Mycobacterium tuberculosis CDC1551
gccagcucggcagcggcggcucc

SEQ ID NO: 4297 - RNA, 22 nt, Mycobacterium tuberculosis CDC1551
gccagcacaggcgcgauugcgu

SEQ ID NO: 4298 - RNA, 22 nt, Mycobacterium tuberculosis CDC1551
gccacgccucgacgcacggccu

SEQ ID NO: 4299 - RNA, 21 nt, Mycobacterium tuberculosis CDC1551
gccagcagcgucuuggcauuc

SEQ ID NO: 4300 - RNA, 22 nt, Mycobacterium tuberculosis CDC1551
gaggccagcucggccagcugga

SEQ ID NO: 4301 - RNA, 22 nt, Mycobacterium tuberculosis CDC1551
gagaacugaccgugguuacgca

SEQ ID NO: 4302 - RNA, 20 nt, Mycobacterium tuberculosis CDC1551
gaugaugaucguguaugcga

SEQ ID NO: 4303 - RNA, 22 nt, Mycobacterium tuberculosis CDC1551
gaugagcgagcgacagcgugcg

SEQ ID NO: 4304 - RNA, 22 nt, Mycobacterium tuberculosis CDC1551
gagguguccgacgaaccugguu

SEQ ID NO: 4305 - RNA, 22 nt, Mycobacterium tuberculosis CDC1551
gagguuuggcggggcgugaccu

SEQ ID NO: 4306 - RNA, 22 nt, Mycobacterium tuberculosis CDC1551
gaguaccugcaggugccgucgc

SEQ ID NO: 4307 - RNA, 22 nt, Mycobacterium tuberculosis CDC1551
gaguagccggaguggcccuugc

SEQ ID NO: 4308 - RNA, 20 nt, Mycobacterium tuberculosis CDC1551
gcaaacucguucuggguuag

SEQ ID NO: 4309 - RNA, 22 nt, Mycobacterium tuberculosis CDC1551
gacuccagccguucacguucga

SEQ ID NO: 4310 - RNA, 22 nt, Mycobacterium tuberculosis CDC1551
gacgaggucuggggucagcuga

SEQ ID NO: 4311 - RNA, 22 nt, Mycobacterium tuberculosis CDC1551
gaccagcucggccuucucgaga

SEQ ID NO: 4312 - RNA, 22 nt, Mycobacterium tuberculosis CDC1551
cucuugggucaaccaggugacu

SEQ ID NO: 4313 - RNA, 21 nt, Mycobacterium tuberculosis CDC1551
cugcugauggcggcgauaucg

SEQ ID NO: 4314 - RNA, 22 nt, Mycobacterium tuberculosis CDC1551
cugguguuccagcugcuguggu

SEQ ID NO: 4315 - RNA, 22 nt, Mycobacterium tuberculosis CDC1551
cugguccagcucguacaccacg

SEQ ID NO: 4316 - RNA, 22 nt, Mycobacterium tuberculosis CDC1551
gcuggcuuucgcgcugggccuu

SEQ ID NO: 4317 - RNA, 22 nt, Mycobacterium tuberculosis CDC1551
gcugagacaugacgugccucac

SEQ ID NO: 4318 - RNA, 22 nt, Mycobacterium tuberculosis CDC1551
gcugcaaacccuagaguacuua

SEQ ID NO: 4319 - RNA, 22 nt, Mycobacterium tuberculosis CDC1551
ggaaagugacggucugaugcga

SEQ ID NO: 4320 - RNA, 22 nt, Mycobacterium tuberculosis CDC1551
gcuggguuaccugguggcggcc

SEQ ID NO: 4321 - RNA, 22 nt, Mycobacterium tuberculosis CDC1551
ggcccggcaccggucaucguca

SEQ ID NO: 4322 - RNA, 22 nt, Mycobacterium tuberculosis CDC1551
ggccgggucucgcuuggcggcg

SEQ ID NO: 4323 - RNA, 22 nt, Mycobacterium tuberculosis CDC1551
ggccagggccgacggcacaucc

SEQ ID NO: 4324 - RNA, 22 nt, Mycobacterium tuberculosis CDC1551
ggccaugucgguccuuccagca

SEQ ID NO: 4325 - RNA, 22 nt, Mycobacterium tuberculosis CDC1551
ggccgaaacaccgcgcgaaggg

SEQ ID NO: 4326 - RNA, 22 nt, Mycobacterium tuberculosis CDC1551
ggccgcgcucgacuagccgggu

SEQ ID NO: 4327 - RNA, 22 nt, Mycobacterium tuberculosis CDC1551
ggccaaggugcgucgcgccccg

SEQ ID NO: 4328 - RNA, 22 nt, Mycobacterium tuberculosis CDC1551
ggcagagcgcggccucggcguc

SEQ ID NO: 4329 - RNA, 22 nt, Mycobacterium tuberculosis CDC1551
ggcaccaagucaccggcaucca

SEQ ID NO: 4330 - RNA, 22 nt, Mycobacterium tuberculosis CDC1551
ggagcuccuucaucuccgcugc

SEQ ID NO: 4331 - RNA, 22 nt, Mycobacterium tuberculosis CDC1551
gcucgcgcagguccacccgagc

SEQ ID NO: 4332 - RNA, 22 nt, Mycobacterium tuberculosis CDC1551
gcguggucggaugcaggccagc

SEQ ID NO: 4333 - RNA, 22 nt, Mycobacterium tuberculosis CDC1551
gcgcuuuucguguucgucugcu

SEQ ID NO: 4334 - RNA, 22 nt, Mycobacterium tuberculosis CDC1551
gcggccaacgaggcagcggcgg

SEQ ID NO: 4335 - RNA, 22 nt, Mycobacterium tuberculosis CDC1551
gcggccaaccggcccgccuacu

SEQ ID NO: 4336 - RNA, 22 nt, Mycobacterium tuberculosis CDC1551
gcgauagcuuaucgaggauuuc

SEQ ID NO: 4337 - RNA, 22 nt, Mycobacterium tuberculosis CDC1551
gccuugucgagaucgucgccgu

SEQ ID NO: 4338 - RNA, 22 nt, Mycobacterium tuberculosis CDC1551
gccuugaccgccuugauggcgg

SEQ ID NO: 4339 - RNA, 22 nt, Mycobacterium tuberculosis CDC1551
gccuugccauaugcggccgacg

SEQ ID NO: 4340 - RNA, 22 nt, Mycobacterium tuberculosis CDC1551
gccguugaggcggcuggcuggu

SEQ ID NO: 4341 - RNA, 22 nt, Mycobacterium tuberculosis CDC1551
gccguugaucgucucggcuagu

SEQ ID NO: 4342 - RNA, 21 nt, Mycobacterium tuberculosis CDC1551
gcgagcucgucauggucuuuc

SEQ ID NO: 4343 - RNA, 22 nt, Mycobacterium tuberculosis CDC1551
gccgaagccgaccggcccagcg

SEQ ID NO: 4344 - RNA, 22 nt, Mycobacterium tuberculosis CDC1551
gccgcaccgacuaccaccgacu

SEQ ID NO: 4345 - RNA, 22 nt, Mycobacterium tuberculosis CDC1551
gcccgcacguggccgccgguga

SEQ ID NO: 4346 - RNA, 22 nt, Mycobacterium tuberculosis CDC1551
gccgccaccgcuaccacccgug

SEQ ID NO: 4347 - RNA, 22 nt, Mycobacterium tuberculosis CDC1551
uagugauucgcaucucugcacc

SEQ ID NO: 4348 - RNA, 22 nt, Mycobacterium tuberculosis CDC1551
uaagugaaagccugacgugguc

SEQ ID NO: 4349 - RNA, 22 nt, Mycobacterium tuberculosis CDC1551
uaagugaaugccgugccguccg

SEQ ID NO: 4350 - RNA, 22 nt, Mycobacterium tuberculosis CDC1551
ucccgcagggcacgccuagacg

SEQ ID NO: 4351 - RNA, 22 nt, Mycobacterium tuberculosis CDC1551
uccugcaggcgaucgcccuggc

SEQ ID NO: 4352 - RNA, 22 nt, Mycobacterium tuberculosis CDC1551
uccgggccggcuuugccgccgu

SEQ ID NO: 4353 - RNA, 22 nt, Mycobacterium tuberculosis CDC1551
ucgaagcccuugauguccuuca

SEQ ID NO: 4354 - RNA, 22 nt, Mycobacterium tuberculosis CDC1551
ucgaggccgggguugcgcugca

SEQ ID NO: 4355 - RNA, 18 nt, Mycobacterium tuberculosis CDC1551
uccugggccauggcccgg

SEQ ID NO: 4356 - RNA, 22 nt, Mycobacterium tuberculosis CDC1551
uccugggcgaccgcgacgaagu

SEQ ID NO: 4357 - RNA, 22 nt, Mycobacterium tuberculosis CDC1551
ucggugacggacugcacagcga

SEQ ID NO: 4358 - RNA, 22 nt, Mycobacterium tuberculosis CDC1551
ucggcucaucgcugcuugcauu

SEQ ID NO: 4359 - RNA, 22 nt, Mycobacterium tuberculosis CDC1551
ucgccagcaccaccugguuggg

SEQ ID NO: 4360 - RNA, 23 nt, Mycobacterium tuberculosis CDC1551
ucgcugucccgaggucacgcuuu

SEQ ID NO: 4361 - RNA, 22 nt, Mycobacterium tuberculosis CDC1551
ucggagaccucgccggaccucg

SEQ ID NO: 4362 - RNA, 18 nt, Mycobacterium tuberculosis CDC1551
ucaggugaucccgccgac

SEQ ID NO: 4363 - RNA, 19 nt, Mycobacterium tuberculosis CDC1551
ucauggccgaugcggucgc

SEQ ID NO: 4364 - RNA, 22 nt, Mycobacterium tuberculosis CDC1551
ucacugugacgccgggcugggu

SEQ ID NO: 4365 - RNA, 22 nt, Mycobacterium tuberculosis CDC1551
ucagcgucgaugaccaugucga

SEQ ID NO: 4366 - RNA, 22 nt, Mycobacterium tuberculosis CDC1551
ucagcuguguccgcacaaccgg

SEQ ID NO: 4367 - RNA, 22 nt, Mycobacterium tuberculosis CDC1551
ucagccgccgggcuugccugcg

SEQ ID NO: 4368 - RNA, 22 nt, Mycobacterium tuberculosis CDC1551
ucagccucaacucggcgugccg

SEQ ID NO: 4369 - RNA, 22 nt, Mycobacterium tuberculosis CDC1551
ucaccgccacggucaccggacu

SEQ ID NO: 4370 - RNA, 19 nt, Mycobacterium tuberculosis CDC1551
ucaccgccgaugccaccgc

SEQ ID NO: 4371 - RNA, 22 nt, Mycobacterium tuberculosis CDC1551
ucaccugcccggcaccuggagc

SEQ ID NO: 4372 - RNA, 22 nt, Mycobacterium tuberculosis CDC1551
ucaccgccgcgguuggugcgca

SEQ ID NO: 4373 - RNA, 22 nt, Mycobacterium tuberculosis CDC1551
gucuggccgacgccaucagcga

SEQ ID NO: 4374 - RNA, 22 nt, Mycobacterium tuberculosis CDC1551
gugaccugcgcggcagggucau

SEQ ID NO: 4375 - RNA, 22 nt, Mycobacterium tuberculosis CDC1551
gucgaggugaccagcggugagg

SEQ ID NO: 4376 - RNA, 22 nt, Mycobacterium tuberculosis CDC1551
guccaggccgucgaacugcagg

SEQ ID NO: 4377 - RNA, 22 nt, Mycobacterium tuberculosis CDC1551
gugaagcccgguggguguggcc

SEQ ID NO: 4378 - RNA, 22 nt, Mycobacterium tuberculosis CDC1551
guuugguugccuaccgcguggg

SEQ ID NO: 4379 - RNA, 22 nt, Mycobacterium tuberculosis CDC1551
guuuggcgcgcccacagcccgg

SEQ ID NO: 4380 - RNA, 22 nt, Mycobacterium tuberculosis CDC1551
guuucgggcgauuuugcgucug

SEQ ID NO: 4381 - RNA, 19 nt, Mycobacterium tuberculosis CDC1551
guuggcagcggucgcggag

SEQ ID NO: 4382 - RNA, 22 nt, Mycobacterium tuberculosis CDC1551
guuacaggucaccacguagcgg

SEQ ID NO: 4383 - RNA, 22 nt, Mycobacterium tuberculosis CDC1551
uaaccgcuacaaaugaaguugg

SEQ ID NO: 4384 - RNA, 22 nt, Mycobacterium tuberculosis CDC1551
guggugggaaccgcuccagggc

SEQ ID NO: 4385 - RNA, 22 nt, Mycobacterium tuberculosis CDC1551
gugguggugagcaccaacggug

SEQ ID NO: 4386 - RNA, 22 nt, Mycobacterium tuberculosis CDC1551
gugguggugaguuugagaucgg

SEQ ID NO: 4387 - RNA, 22 nt, Mycobacterium tuberculosis CDC1551
guggcagccagcgccuccggga

SEQ ID NO: 4388 - RNA, 21 nt, Mycobacterium tuberculosis CDC1551
gggcugguuccaacgacagug

SEQ ID NO: 4389 - RNA, 22 nt, Mycobacterium tuberculosis CDC1551
ggggagacgauugccgccccgc

SEQ ID NO: 4390 - RNA, 22 nt, Mycobacterium tuberculosis CDC1551
gggcucaggauguggcugcgau

SEQ ID NO: 4391 - RNA, 22 nt, Mycobacterium tuberculosis CDC1551
gggcugcccaaucagcgcugcg

SEQ ID NO: 4392 - RNA, 22 nt, Mycobacterium tuberculosis CDC1551
gggaguacgcgggccaggugcg

SEQ ID NO: 4393 - RNA, 22 nt, Mycobacterium tuberculosis CDC1551
ggcucacgauguagucgauccg

SEQ ID NO: 4394 - RNA, 22 nt, Mycobacterium tuberculosis CDC1551
ggcugcgcaccugcgccgacga

SEQ ID NO: 4395 - RNA, 22 nt, Mycobacterium tuberculosis CDC1551
ggcuggcucggcgacuggacua

SEQ ID NO: 4396 - RNA, 22 nt, Mycobacterium tuberculosis CDC1551
ggcucaggucgauacccgaggg

SEQ ID NO: 4397 - RNA, 20 nt, Mycobacterium tuberculosis CDC1551
ggcucgagggcuggccggug

SEQ ID NO: 4398 - RNA, 22 nt, Mycobacterium tuberculosis CDC1551
ggcguggccguuucaccgcguu

SEQ ID NO: 4399 - RNA, 22 nt, Mycobacterium tuberculosis CDC1551
ggcgagcuugcggugcaguaug

SEQ ID NO: 4400 - RNA, 22 nt, Mycobacterium tuberculosis CDC1551
ggugcugcacgccuucgccagc

SEQ ID NO: 4401 - RNA, 22 nt, Mycobacterium tuberculosis CDC1551
ggugcuuuugcgucugcucggc

SEQ ID NO: 4402 - RNA, 22 nt, Mycobacterium tuberculosis CDC1551
ggugguggugccgucgucgcgc

SEQ ID NO: 4403 - RNA, 22 nt, Mycobacterium tuberculosis CDC1551
gguggugccgguacgccaaugc

SEQ ID NO: 4404 - RNA, 22 nt, Mycobacterium tuberculosis CDC1551
ggugguggccaccgcagugggu

SEQ ID NO: 4405 - RNA, 22 nt, Mycobacterium tuberculosis CDC1551
ggguaucaggcagccggcgcug

SEQ ID NO: 4406 - RNA, 22 nt, Mycobacterium tuberculosis CDC1551
gggugguggucgccaacgccga

SEQ ID NO: 4407 - RNA, 22 nt, Mycobacterium tuberculosis CDC1551
gggugguguugauugcggcggu

SEQ ID NO: 4408 - RNA, 22 nt, Mycobacterium tuberculosis CDC1551
ggucagcacgcaugugcggugg

SEQ ID NO: 4409 - RNA, 22 nt, Mycobacterium tuberculosis CDC1551
ggucagcaugaauaccgggucg

SEQ ID NO: 4410 - RNA, 22 nt, Mycobacterium tuberculosis CDC1551
ggucuccuugccuauccagcug

SEQ ID NO: 4411 - RNA, 22 nt, Mycobacterium tuberculosis CDC1551
gguugcgcuuggugaacucguc

SEQ ID NO: 4412 - RNA, 22 nt, Mycobacterium tuberculosis CDC1551
guagugcacaccgacaacagcg

SEQ ID NO: 4413 - RNA, 22 nt, Mycobacterium tuberculosis CDC1551
aacugcaucgccaccacuuccu

SEQ ID NO: 4414 - RNA, 22 nt, Mycobacterium tuberculosis CDC1551
aacagguggcggccggaccgcu

SEQ ID NO: 4415 - RNA, 22 nt, Mycobacterium tuberculosis CDC1551
aacacuaugcagcauuugggau

SEQ ID NO: 4416 - RNA, 22 nt, Mycobacterium tuberculosis CDC1551
aaguaguaaugugcgagcugag

SEQ ID NO: 4417 - RNA, 22 nt, Mycobacterium tuberculosis CDC1551
acugagcagcggcguuuucagg

SEQ ID NO: 4418 - RNA, 22 nt, Mycobacterium tuberculosis CDC1551
acugucccgagcgcaccaggaa

SEQ ID NO: 4419 - RNA, 22 nt, Mycobacterium tuberculosis CDC1551
acuggccagcgcgcgccacaug

SEQ ID NO: 4420 - RNA, 22 nt, Mycobacterium tuberculosis CDC1551
agcaagagcagcggccccuggg

SEQ ID NO: 4421 - RNA, 22 nt, Mycobacterium tuberculosis CDC1551
agagauaucguagugaucgggc

SEQ ID NO: 4422 - RNA, 22 nt, Mycobacterium tuberculosis CDC1551
agaucucuggugcgcagauccc

SEQ ID NO: 4423 - RNA, 22 nt, Mycobacterium tuberculosis CDC1551
accggccuggugcucaauagcc

SEQ ID NO: 4424 - RNA, 22 nt, Mycobacterium tuberculosis CDC1551
accucgcugaugauccaugaca

SEQ ID NO: 4425 - RNA, 22 nt, Mycobacterium tuberculosis CDC1551
accucgcugcgggaugggucgc

SEQ ID NO: 4426 - RNA, 22 nt, Mycobacterium tuberculosis CDC1551
acccagcaggcugguggugccg

SEQ ID NO: 4427 - RNA, 22 nt, Mycobacterium tuberculosis CDC1551
accgcgccgccaaugcagcguc

SEQ ID NO: 4428 - RNA, 22 nt, Mycobacterium tuberculosis CDC1551
acgaggucgcgaugaugacggu

SEQ ID NO: 4429 - RNA, 22 nt, Mycobacterium tuberculosis CDC1551
acgagcguaacggcacugcgaa

SEQ ID NO: 4430 - RNA, 22 nt, Mycobacterium tuberculosis CDC1551
acagcaugucgucggcagguuc

SEQ ID NO: 4431 - RNA, 22 nt, Mycobacterium tuberculosis CDC1551
accaauucaccaaggacgaggu

SEQ ID NO: 4432 - RNA, 22 nt, Mycobacterium tuberculosis CDC1551
agcacugcuuucugagcucgag

SEQ ID NO: 4433 - RNA, 22 nt, Mycobacterium tuberculosis CDC1551
agcccaccggugcuguaggcga

SEQ ID NO: 4434 - RNA, 22 nt, Mycobacterium tuberculosis CDC1551
agccagcccgaugcugagcaau

SEQ ID NO: 4435 - RNA, 22 nt, Mycobacterium tuberculosis CDC1551
agccaggccgucgcgaccaugc

SEQ ID NO: 4436 - RNA, 22 nt, Mycobacterium tuberculosis CDC1551
agcuguccgacaaaguauccga

SEQ ID NO: 4437 - RNA, 22 nt, Mycobacterium tuberculosis CDC1551
agcuggucgacacuggccgaaa

SEQ ID NO: 4438 - RNA, 22 nt, Mycobacterium tuberculosis CDC1551
agcugggcgccgacgcuuugca

SEQ ID NO: 4439 - RNA, 22 nt, Mycobacterium tuberculosis CDC1551
aggaaucaccgugagcagccca

SEQ ID NO: 4440 - RNA, 22 nt, Mycobacterium tuberculosis CDC1551
aguuucucagcgagcaggugcu

SEQ ID NO: 4441 - RNA, 22 nt, Mycobacterium tuberculosis CDC1551
aguggucaugaauggcgaaugg

SEQ ID NO: 4442 - RNA, 22 nt, Mycobacterium tuberculosis CDC1551
aggaucacacuggccugcucaa

SEQ ID NO: 4443 - RNA, 22 nt, Mycobacterium tuberculosis CDC1551
aucgcuugccgaugccgucggu

SEQ ID NO: 4444 - RNA, 22 nt, Mycobacterium tuberculosis CDC1551
aucuggccguccggcgucccga

SEQ ID NO: 4445 - RNA, 22 nt, Mycobacterium tuberculosis CDC1551
auccaugagcagcucgccgccg

SEQ ID NO: 4446 - RNA, 22 nt, Mycobacterium tuberculosis CDC1551
aucacgccucucgguggugggg

SEQ ID NO: 4447 - RNA, 22 nt, Mycobacterium tuberculosis CDC1551
aucauucuggggaugaacgguc

SEQ ID NO: 4448 - RNA, 22 nt, Mycobacterium tuberculosis CDC1551
aucaggcugcgcacccgcucgg

SEQ ID NO: 4449 - RNA, 22 nt, Mycobacterium tuberculosis CDC1551
aucaucaggcgcgacauaucga

SEQ ID NO: 4450 - RNA, 22 nt, Mycobacterium tuberculosis CDC1551
augguguacgccgcagcgcggg

SEQ ID NO: 4451 - RNA, 19 nt, Mycobacterium tuberculosis CDC1551
augguggccgggaucgugc

SEQ ID NO: 4452 - RNA, 22 nt, Mycobacterium tuberculosis CDC1551
augguuuuggccagcuuugucg

SEQ ID NO: 4453 - RNA, 22 nt, Mycobacterium tuberculosis CDC1551
augguggccacggcgugggcgu

SEQ ID NO: 4454 - RNA, 23 nt, Mycobacterium tuberculosis CDC1551
augacgggauucugcuucgcaaa

SEQ ID NO: 4455 - RNA, 22 nt, Mycobacterium tuberculosis CDC1551
augcaguuggcggucgacugcg

SEQ ID NO: 4456 - RNA, 22 nt, Mycobacterium tuberculosis CDC1551
cgcugcaccgcggccuggcccu

SEQ ID NO: 4457 - RNA, 22 nt, Mycobacterium tuberculosis CDC1551
cgccugggccagugccgacuuc

SEQ ID NO: 4458 - RNA, 22 nt, Mycobacterium tuberculosis CDC1551
cgcugggcgaugaagcgcuggg

SEQ ID NO: 4459 - RNA, 22 nt, Mycobacterium tuberculosis CDC1551
cgcucgagauugcagcgggccc

SEQ ID NO: 4460 - RNA, 22 nt, Mycobacterium tuberculosis CDC1551
cggccaagggugcggacgccga

SEQ ID NO: 4461 - RNA, 22 nt, Mycobacterium tuberculosis CDC1551
cggcugcagugcgacgacgaga

SEQ ID NO: 4462 - RNA, 18 nt, Mycobacterium tuberculosis CDC1551
cuccuuggacuacggcug

SEQ ID NO: 4463 - RNA, 22 nt, Mycobacterium tuberculosis CDC1551
cugaauucgucggguaucuggu

SEQ ID NO: 4464 - RNA, 22 nt, Mycobacterium tuberculosis CDC1551
cucccgccgugugucgcgggcu

SEQ ID NO: 4465 - RNA, 22 nt, Mycobacterium tuberculosis CDC1551
cguggaauuucuucgccauggg

SEQ ID NO: 4466 - RNA, 22 nt, Mycobacterium tuberculosis CDC1551
cguggcaaaugugaucccgugc

SEQ ID NO: 4467 - RNA, 22 nt, Mycobacterium tuberculosis CDC1551
cgguggugaccgccgcgacguc

SEQ ID NO: 4468 - RNA, 22 nt, Mycobacterium tuberculosis CDC1551
cgggacagcuuggucuuucgcg

SEQ ID NO: 4469 - RNA, 22 nt, Mycobacterium tuberculosis CDC1551
cggucaccaucaccggcaccag

SEQ ID NO: 4470 - RNA, 22 nt, Mycobacterium tuberculosis CDC1551
cgugauccacagccacccggug

SEQ ID NO: 4471 - RNA, 22 nt, Mycobacterium tuberculosis CDC1551
cgguuucucggccgaacuuggc

SEQ ID NO: 4472 - RNA, 22 nt, Mycobacterium tuberculosis CDC1551
cguaagccucgucagcuauccg

SEQ ID NO: 4473 - RNA, 22 nt, Mycobacterium tuberculosis CDC1551
cgucaccugcacggugguugcc

SEQ ID NO: 4474 - RNA, 22 nt, Mycobacterium tuberculosis CDC1551
cgucccugaggcuacgccccag

SEQ ID NO: 4475 - RNA, 18 nt, Mycobacterium tuberculosis CDC1551
cgccacucgcagugggac

SEQ ID NO: 4476 - RNA, 22 nt, Mycobacterium tuberculosis CDC1551
cgccaaaccgaacggcgagcug

SEQ ID NO: 4477 - RNA, 22 nt, Mycobacterium tuberculosis CDC1551
cgcagagcuuuucacgacgcug

SEQ ID NO: 4478 - RNA, 22 nt, Mycobacterium tuberculosis CDC1551
cgaaacugcggaccgcgcaacc

SEQ ID NO: 4479 - RNA, 22 nt, Mycobacterium tuberculosis CDC1551
cgaccugcgacagccguuaacg

SEQ ID NO: 4480 - RNA, 22 nt, Mycobacterium tuberculosis CDC1551
ccgcccggggcauggccaagcu

SEQ ID NO: 4481 - RNA, 22 nt, Mycobacterium tuberculosis CDC1551
ccugugccaagcgcugaccgcu

SEQ ID NO: 4482 - RNA, 23 nt, Mycobacterium tuberculosis CDC1551
ccuugggcagaugccagcugaag

SEQ ID NO: 4483 - RNA, 22 nt, Mycobacterium tuberculosis CDC1551
ccuggcgcgcagcacggccugc

SEQ ID NO: 4484 - RNA, 22 nt, Mycobacterium tuberculosis CDC1551
ccgcccggcugcgcgagcuggg

SEQ ID NO: 4485 - RNA, 22 nt, Mycobacterium tuberculosis CDC1551
ccguugacccagaccggcucgu

SEQ ID NO: 4486 - RNA, 22 nt, Mycobacterium tuberculosis CDC1551
cccagcaccgaccagugccggc

SEQ ID NO: 4487 - RNA, 22 nt, Mycobacterium tuberculosis CDC1551
ccaugccgaugacgcuguuggc

SEQ ID NO: 4488 - RNA, 22 nt, Mycobacterium tuberculosis CDC1551
cccacugccgccgguuggccac

SEQ ID NO: 4489 - RNA, 22 nt, Mycobacterium tuberculosis CDC1551
ccaugagggcgauaugcacgau

SEQ ID NO: 4490 - RNA, 22 nt, Mycobacterium tuberculosis CDC1551
ccaugggccggguucuugacca

SEQ ID NO: 4491 - RNA, 22 nt, Mycobacterium tuberculosis CDC1551
ccagcggguuugucacguagcc

SEQ ID NO: 4492 - RNA, 22 nt, Mycobacterium tuberculosis CDC1551
ccagcucaucgccguagcugag

SEQ ID NO: 4493 - RNA, 22 nt, Mycobacterium tuberculosis CDC1551
ccaggcguagaagguucuccgg

SEQ ID NO: 4494 - RNA, 22 nt, Mycobacterium tuberculosis CDC1551
caugcaucggaagaaccggcau

SEQ ID NO: 4495 - RNA, 22 nt, Mycobacterium tuberculosis CDC1551
caugagcgccgaacagcgcuga

SEQ ID NO: 4496 - RNA, 22 nt, Mycobacterium tuberculosis CDC1551
caugacgguacguuugccucgu

SEQ ID NO: 4497 - RNA, 22 nt, Mycobacterium tuberculosis CDC1551
caucacaucgaggucaccacgc

SEQ ID NO: 4498 - RNA, 22 nt, Mycobacterium tuberculosis CDC1551
cauggucacuggcugugacuga

SEQ ID NO: 4499 - RNA, 23 nt, Mycobacterium tuberculosis CDC1551
cauguugaccgcgcccaggaugg

SEQ ID NO: 4500 - RNA, 22 nt, Mycobacterium tuberculosis CDC1551
caucuguuggcgcucucggccu

SEQ ID NO: 4501 - RNA, 22 nt, Mycobacterium tuberculosis CDC1551
ccaaugggauguugccgagcau

SEQ ID NO: 4502 - RNA, 22 nt, Mycobacterium tuberculosis CDC1551
ccagcacucggucgaugaucuu

SEQ ID NO: 4503 - RNA, 22 nt, Mycobacterium tuberculosis CDC1551
ccaccgccacggccagcaccgc

SEQ ID NO: 4504 - RNA, 22 nt, Mycobacterium tuberculosis CDC1551
cauuggcaccggaaaucgccgg

SEQ ID NO: 4505 - RNA, 20 nt, Mycobacterium tuberculosis CDC1551
cacugacuagugaagaaccu

SEQ ID NO: 4506 - RNA, 22 nt, Mycobacterium tuberculosis CDC1551
cacgccugcgcgacauggacgc

SEQ ID NO: 4507 - RNA, 22 nt, Mycobacterium tuberculosis CDC1551
cagggcgccaagcucaccugau

SEQ ID NO: 4508 - RNA, 22 nt, Mycobacterium tuberculosis CDC1551
caggaugacgccgcagcgcucg

SEQ ID NO: 4509 - RNA, 22 nt, Mycobacterium tuberculosis CDC1551
cagcgccaauacaucacggcag

SEQ ID NO: 4510 - RNA, 22 nt, Mycobacterium tuberculosis CDC1551
cagccgccaaaccgcugaggaa

SEQ ID NO: 4511 - RNA, 22 nt, Mycobacterium tuberculosis CDC1551
caagaccagguacguggaccau

SEQ ID NO: 4512 - RNA, 22 nt, Mycobacterium tuberculosis CDC1551
auuggcuguggugaagagcaau

SEQ ID NO: 4513 - RNA, 22 nt, Mycobacterium tuberculosis CDC1551
uuuggccaugccgcgggcgacc

SEQ ID NO: 4514 - RNA, 22 nt, Mycobacterium tuberculosis CDC1551
uuugggugugagaacgguuggu

SEQ ID NO: 4515 - RNA, 22 nt, Mycobacterium tuberculosis CDC1551
uuucauucagacgagaggcgug

SEQ ID NO: 4516 - RNA, 20 nt, Mycobacterium tuberculosis CDC1551
uuucugagcggcucaugacg

SEQ ID NO: 4517 - RNA, 22 nt, Mycobacterium tuberculosis CDC1551
ugugguuucccuacccgggcag

SEQ ID NO: 4518 - RNA, 22 nt, Mycobacterium tuberculosis CDC1551
uucaggcuacgguagcggugcg

SEQ ID NO: 4519 - RNA, 22 nt, Mycobacterium tuberculosis CDC1551
uucaucaaggacgcgugcaccc

SEQ ID NO: 4520 - RNA, 22 nt, Mycobacterium tuberculosis CDC1551
uggggcaugagcguguccaggc

SEQ ID NO: 4521 - RNA, 20 nt, Mycobacterium tuberculosis CDC1551
uggucaccggguucgacacc

SEQ ID NO: 4522 - RNA, 22 nt, Mycobacterium tuberculosis CDC1551
uggucggcgaguucgccgugca

SEQ ID NO: 4523 - RNA, 22 nt, Mycobacterium tuberculosis CDC1551
uggucggcggucauacccgcgg

SEQ ID NO: 4524 - RNA, 23 nt, Mycobacterium tuberculosis CDC1551
ugguggucgacaugucggccagc

SEQ ID NO: 4525 - RNA, 22 nt, Mycobacterium tuberculosis CDC1551
ugguuucccgugaggugaucgc

SEQ ID NO: 4526 - RNA, 22 nt, Mycobacterium tuberculosis CDC1551
ugguuaggcgggacggggagug

SEQ ID NO: 4527 - RNA, 23 nt, Mycobacterium tuberculosis CDC1551
ugguggacgcagagucaacggau

SEQ ID NO: 4528 - RNA, 22 nt, Mycobacterium tuberculosis CDC1551
ugguggccggugccgacaccuc

SEQ ID NO: 4529 - RNA, 22 nt, Mycobacterium tuberculosis CDC1551
ugguggcuguuguugcgccggc

SEQ ID NO: 4530 - RNA, 22 nt, Mycobacterium tuberculosis CDC1551
ugguggcuagcaaggucuuccc

SEQ ID NO: 4531 - RNA, 22 nt, Mycobacterium tuberculosis CDC1551
ugucgcgcaagcucuccggcac

SEQ ID NO: 4532 - RNA, 22 nt, Mycobacterium tuberculosis CDC1551
ugugauggagugaucggcagcc

SEQ ID NO: 4533 - RNA, 18 nt, Mycobacterium tuberculosis CDC1551
ugugaccacagggcuggc

SEQ ID NO: 4534 - RNA, 22 nt, Mycobacterium tuberculosis CDC1551
ugucauucgggucgguuacguc

SEQ ID NO: 4535 - RNA, 22 nt, Mycobacterium tuberculosis CDC1551
uucuucagcauggcgaugacgg

SEQ ID NO: 4536 - RNA, 22 nt, Mycobacterium tuberculosis CDC1551
uugaugaugcggauccggauuc

SEQ ID NO: 4537 - RNA, 22 nt, Mycobacterium tuberculosis CDC1551
uugagggugugggccacgucgg

SEQ ID NO: 4538 - RNA, 22 nt, Mycobacterium tuberculosis CDC1551
uugauauuaccgauggaauguc

SEQ ID NO: 4539 - RNA, 22 nt, Mycobacterium tuberculosis CDC1551
uugaccuugcgcccggccagca

SEQ ID NO: 4540 - RNA, 22 nt, Mycobacterium tuberculosis CDC1551
uugacgucagcgccgcccgguc

SEQ ID NO: 4541 - RNA, 21 nt, Mycobacterium tuberculosis CDC1551
uuccggcccggguccagcgac

SEQ ID NO: 4542 - RNA, 22 nt, Mycobacterium tuberculosis CDC1551
uugggccaccaguccugguuuc

SEQ ID NO: 4543 - RNA, 22 nt, Mycobacterium tuberculosis CDC1551
uugggccaccucggcggccagc

SEQ ID NO: 4544 - RNA, 22 nt, Mycobacterium tuberculosis CDC1551
uugguguccgccgacgccaagu

SEQ ID NO: 4545 - RNA, 22 nt, Mycobacterium tuberculosis CDC1551
uugucaccgcuuccauggcguu

SEQ ID NO: 4546 - RNA, 22 nt, Mycobacterium tuberculosis CDC1551
uugccauucaccguuggugacc

SEQ ID NO: 4547 - RNA, 22 nt, Mycobacterium tuberculosis CDC1551
uuggcagcgugaaguguucggg

SEQ ID NO: 4548 - RNA, 22 nt, Mycobacterium tuberculosis CDC1551
uugcgcaggggcaugucagcgu

SEQ ID NO: 4549 - RNA, 22 nt, Mycobacterium tuberculosis CDC1551
uugcgcagcgaucgcaugacug

SEQ ID NO: 4550 - RNA, 22 nt, Mycobacterium tuberculosis CDC1551
uuggccgcugcgacaagccggc

SEQ ID NO: 4551 - RNA, 22 nt, Mycobacterium tuberculosis CDC1551
uuggcaggcggucaagccacaa

SEQ ID NO: 4552 - RNA, 22 nt, Mycobacterium tuberculosis CDC1551
ucuuucccuccagaucggugcg

SEQ ID NO: 4553 - RNA, 18 nt, Mycobacterium tuberculosis CDC1551
ucgugggcgcgccgccaa

SEQ ID NO: 4554 - RNA, 22 nt, Mycobacterium tuberculosis CDC1551
ucucggccgucgcgagcuccuc

SEQ ID NO: 4555 - RNA, 21 nt, Mycobacterium tuberculosis CDC1551
ugacccacugggccgagucgg

SEQ ID NO: 4556 - RNA, 22 nt, Mycobacterium tuberculosis CDC1551
ugacauauaucaaagagauguu

SEQ ID NO: 4557 - RNA, 22 nt, Mycobacterium tuberculosis CDC1551
ugcacuccgacccgccgacguu

SEQ ID NO: 4558 - RNA, 18 nt, Mycobacterium tuberculosis CDC1551
ugcgccacaacggcggga

SEQ ID NO: 4559 - RNA, 22 nt, Mycobacterium tuberculosis CDC1551
ugcgcgccuugauccggcuguc

SEQ ID NO: 4560 - RNA, 22 nt, Mycobacterium tuberculosis CDC1551
ugcuccacugcugccaagucgg

SEQ ID NO: 4561 - RNA, 22 nt, Mycobacterium tuberculosis CDC1551
uggaaaaacggcggccccgacc

SEQ ID NO: 4562 - RNA, 22 nt, Mycobacterium tuberculosis CDC1551
ugcugcgccuccugcggaccgu

SEQ ID NO: 4563 - RNA, 22 nt, Mycobacterium tuberculosis CDC1551
ugcgccagcgccucccgcagga

SEQ ID NO: 4564 - RNA, 22 nt, Mycobacterium tuberculosis CDC1551
ugcccggcaugggcagccugcu

SEQ ID NO: 4565 - RNA, 22 nt, Mycobacterium tuberculosis CDC1551
ugcccggcgaacaggaauugcu

SEQ ID NO: 4566 - RNA, 23 nt, Mycobacterium tuberculosis CDC1551
uggaauggaucucggcgauaaug

SEQ ID NO: 4567 - RNA, 22 nt, Mycobacterium tuberculosis CDC1551
uggacaccauuccguugggaug

SEQ ID NO: 4568 - RNA, 22 nt, Mycobacterium tuberculosis CDC1551
uggccagcacgguguucaaguu

SEQ ID NO: 4569 - RNA, 22 nt, Mycobacterium tuberculosis CDC1551
uggcugcggccgaucaccgaug

SEQ ID NO: 4570 - RNA, 22 nt, Mycobacterium tuberculosis CDC1551
uggcugcggugccacgaacgau

SEQ ID NO: 4571 - RNA, 22 nt, Mycobacterium tuberculosis CDC1551
uggcgcugucgaucaccgacuu

SEQ ID NO: 4572 - RNA, 22 nt, Mycobacterium tuberculosis CDC1551
ugggcagcggucaaggggccca

SEQ ID NO: 4573 - RNA, 22 nt, Mycobacterium tuberculosis CDC1551
ugggcugcugcgccgcaucggc

SEQ ID NO: 4574 - RNA, 20 nt, Mycobacterium tuberculosis CDC1551
ugggcuaauggcaaccacgg

SEQ ID NO: 4575 - RNA, 22 nt, Mycobacterium tuberculosis CDC1551
ugggcggucaucgcgccgaucg

SEQ ID NO: 4576 - RNA, 22 nt, Mycobacterium tuberculosis CDC1551
uggcucagcgggucaacgaggc

SEQ ID NO: 4577 - RNA, 22 nt, Mycobacterium tuberculosis CDC1551
uggcucagauugccggugccgc

SEQ ID NO: 4578 - RNA, 17 nt, Mycobacterium tuberculosis CDC1551
uggcguggcugcaugag

SEQ ID NO: 4579 - RNA, 22 nt, Mycobacterium tuberculosis CDC1551
uggcgcgcggaucgacgacagg

SEQ ID NO: 4580 - RNA, 22 nt, Mycobacterium tuberculosis CDC1551
uggcgagcagacgcaaaagccc

SEQ ID NO: 4581 - RNA, 22 nt, Pseudomonas aeruginosa PA01
uggcgagcagggcaccgccgac

SEQ ID NO: 4582 - RNA, 22 nt, Pseudomonas aeruginosa PA01
uggccgggaucuccaggcugac

SEQ ID NO: 4583 - RNA, 22 nt, Pseudomonas aeruginosa PA01
uggccgggcagaugcuggucuc

SEQ ID NO: 4584 - RNA, 22 nt, Pseudomonas aeruginosa PA01
uggcgagcuugaacagguggcg

SEQ ID NO: 4585 - RNA, 22 nt, Pseudomonas aeruginosa PA01
uggcgaggaucucgcggaucuu

SEQ ID NO: 4586 - RNA, 22 nt, Pseudomonas aeruginosa PA01
uggcgaccuucaagcgucggcu

SEQ ID NO: 4587 - RNA, 22 nt, Pseudomonas aeruginosa PA01
uggcgcgccugcugccggucga

SEQ ID NO: 4588 - RNA, 22 nt, Pseudomonas aeruginosa PA01
uggcgcgccuggaccgucggcg

SEQ ID NO: 4589 - RNA, 22 nt, Pseudomonas aeruginosa PA01
uggcgcgccuggcugauggcac

SEQ ID NO: 4590 - RNA, 22 nt, Pseudomonas aeruginosa PA01
uggcgcgcucgaaguaacugaa

SEQ ID NO: 4591 - RNA, 18 nt, Pseudomonas aeruginosa PA01
uggcgcgcugcuggugga

SEQ ID NO: 4592 - RNA, 22 nt, Pseudomonas aeruginosa PA01
uggcgcgggcguugagcucggc

SEQ ID NO: 4593 - RNA, 22 nt, Pseudomonas aeruginosa PA01
uggcggagcgccaggcggcguu

SEQ ID NO: 4594 - RNA, 20 nt, Pseudomonas aeruginosa PA01
uggcggcugaucuucggcug

SEQ ID NO: 4595 - RNA, 22 nt, Pseudomonas aeruginosa PA01
ugggcggcaagccugcgcgaca

SEQ ID NO: 4596 - RNA, 22 nt, Pseudomonas aeruginosa PA01
ugggcgggcacugucaggguca

SEQ ID NO: 4597 - RNA, 18 nt, Pseudomonas aeruginosa PA01
ugggcgagcggucgucga

SEQ ID NO: 4598 - RNA, 22 nt, Pseudomonas aeruginosa PA01
uggcagcucagggugcucauga

SEQ ID NO: 4599 - RNA, 23 nt, Pseudomonas aeruginosa PA01
uggaagauccgcugcgcuuccuu

SEQ ID NO: 4600 - RNA, 22 nt, Pseudomonas aeruginosa PA01
uggagcgcggcaacuggcgcgg

SEQ ID NO: 4601 - RNA, 22 nt, Pseudomonas aeruginosa PA01
uggagugcagaaaggcuucgac

SEQ ID NO: 4602 - RNA, 22 nt, Pseudomonas aeruginosa PA01
ugcccggcgacccgcgcggagg

SEQ ID NO: 4603 - RNA, 22 nt, Pseudomonas aeruginosa PA01
ugcccggcgaccucgcggcugc

SEQ ID NO: 4604 - RNA, 22 nt, Pseudomonas aeruginosa PA01
ugcccggcucgcgguucagccu

SEQ ID NO: 4605 - RNA, 22 nt, Pseudomonas aeruginosa PA01
ugccgaggaacagccaggcgug

SEQ ID NO: 4606 - RNA, 22 nt, Pseudomonas aeruginosa PA01
ugccgggaguagcgguucaccc

SEQ ID NO: 4607 - RNA, 22 nt, Pseudomonas aeruginosa PA01
ugccguccuaccuggagagcga

SEQ ID NO: 4608 - RNA, 22 nt, Pseudomonas aeruginosa PA01
ugcgcagcugcgagcugaucug

SEQ ID NO: 4609 - RNA, 22 nt, Pseudomonas aeruginosa PA01
ugcgcgcguagccgguauuccu

SEQ ID NO: 4610 - RNA, 22 nt, Pseudomonas aeruginosa PA01
ugcgcggccgguagccgaaggu

SEQ ID NO: 4611 - RNA, 22 nt, Pseudomonas aeruginosa PA01
ugcgcggcguuuccucgccgaa

SEQ ID NO: 4612 - RNA, 22 nt, Pseudomonas aeruginosa PA01
ugcgcugggcguggucggcgac

SEQ ID NO: 4613 - RNA, 22 nt, Pseudomonas aeruginosa PA01
ugcgcugguggucgagcagcac

SEQ ID NO: 4614 - RNA, 21 nt, Pseudomonas aeruginosa PA01
ugcggacgauaugcgugcccc

SEQ ID NO: 4615 - RNA, 22 nt, Pseudomonas aeruginosa PA01
ugcggauggucaucgaccuggc

SEQ ID NO: 4616 - RNA, 22 nt, Pseudomonas aeruginosa PA01
ugcggcccggcucggugagggu

SEQ ID NO: 4617 - RNA, 20 nt, Pseudomonas aeruginosa PA01
ugcggcggguaagcaggguc

SEQ ID NO: 4618 - RNA, 22 nt, Pseudomonas aeruginosa PA01
ugcggcucuucagcccggagag

SEQ ID NO: 4619 - RNA, 22 nt, Pseudomonas aeruginosa PA01
ugccgccgccgaggcuucgcug

SEQ ID NO: 4620 - RNA, 22 nt, Pseudomonas aeruginosa PA01
ugccgccguccgccgagcuggu

SEQ ID NO: 4621 - RNA, 22 nt, Pseudomonas aeruginosa PA01
ugccggagcgcgccgagggcag

SEQ ID NO: 4622 - RNA, 22 nt, Pseudomonas aeruginosa PA01
ugccggagucuucgccugguug

SEQ ID NO: 4623 - RNA, 22 nt, Pseudomonas aeruginosa PA01
ugccggccacaugcucgggggu

SEQ ID NO: 4624 - RNA, 22 nt, Pseudomonas aeruginosa PA01
ugccggccauggccuccacguc

SEQ ID NO: 4625 - RNA, 19 nt, Pseudomonas aeruginosa PA01
ugccggccgagcuguucga

SEQ ID NO: 4626 - RNA, 21 nt, Pseudomonas aeruginosa PA01
ugccggccgccaggugcagga

SEQ ID NO: 4627 - RNA, 22 nt, Pseudomonas aeruginosa PA01
ugccggccugacugucugccgg

SEQ ID NO: 4628 - RNA, 22 nt, Pseudomonas aeruginosa PA01
ugccggccugcucuggcgccug

SEQ ID NO: 4629 - RNA, 22 nt, Pseudomonas aeruginosa PA01
ugccggcgaggucggccaugac

SEQ ID NO: 4630 - RNA, 19 nt, Pseudomonas aeruginosa PA01
ugccggcgagucgaacaug

SEQ ID NO: 4631 - RNA, 22 nt, Pseudomonas aeruginosa PA01
ugccggcgcaguucgggcgcaa

SEQ ID NO: 4632 - RNA, 22 nt, Pseudomonas aeruginosa PA01
ugccggcgcccuggugaucugc

SEQ ID NO: 4633 - RNA, 22 nt, Pseudomonas aeruginosa PA01
ugccggcgccggagaggccgcu

SEQ ID NO: 4634 - RNA, 22 nt, Pseudomonas aeruginosa PA01
ugccggcgcggcgguugaggcc

SEQ ID NO: 4635 - RNA, 22 nt, Pseudomonas aeruginosa PA01
ugccggcggcagcggugccgug

SEQ ID NO: 4636 - RNA, 22 nt, Pseudomonas aeruginosa PA01
ugccggcggggcgcagcccuag

SEQ ID NO: 4637 - RNA, 22 nt, Pseudomonas aeruginosa PA01
ugcuucuuggcgcgcuugccgc

SEQ ID NO: 4638 - RNA, 19 nt, Pseudomonas aeruginosa PA01
ugcuugcagccaacugagc

SEQ ID NO: 4639 - RNA, 22 nt, Pseudomonas aeruginosa PA01
uggaaaucgccacgguggacua

SEQ ID NO: 4640 - RNA, 23 nt, Pseudomonas aeruginosa PA01
uggaagcgcgguucgccgcuggc

SEQ ID NO: 4641 - RNA, 22 nt, Pseudomonas aeruginosa PA01
uggaagcgcuggacgccuucuu

SEQ ID NO: 4642 - RNA, 22 nt, Pseudomonas aeruginosa PA01
ugcuccgggaaauccggcaggu

SEQ ID NO: 4643 - RNA, 18 nt, Pseudomonas aeruginosa PA01
ugcuccgggccuauucgc

SEQ ID NO: 4644 - RNA, 22 nt, Pseudomonas aeruginosa PA01
ugcgccccugguucucgaugaa

SEQ ID NO: 4645 - RNA, 22 nt, Pseudomonas aeruginosa PA01
ugcgccggcccuggcuagacug

SEQ ID NO: 4646 - RNA, 22 nt, Pseudomonas aeruginosa PA01
ugcgccgggguuuccggcgugc

SEQ ID NO: 4647 - RNA, 22 nt, Pseudomonas aeruginosa PA01
ugcgcgaacuggugcugggcuc

SEQ ID NO: 4648 - RNA, 22 nt, Pseudomonas aeruginosa PA01
ugcgcgaggugcugccgcagug

SEQ ID NO: 4649 - RNA, 22 nt, Pseudomonas aeruginosa PA01
ugcgguggaaccauggcggacg

SEQ ID NO: 4650 - RNA, 22 nt, Pseudomonas aeruginosa PA01
ugcgguggccccaccagagcug

SEQ ID NO: 4651 - RNA, 22 nt, Pseudomonas aeruginosa PA01
ugcgguggcgauaccggugaug

SEQ ID NO: 4652 - RNA, 22 nt, Pseudomonas aeruginosa PA01
ugcugaagagcgucgagaucca

SEQ ID NO: 4653 - RNA, 23 nt, Pseudomonas aeruginosa PA01
ugcuggaagaagcggcgaugauc

SEQ ID NO: 4654 - RNA, 22 nt, Pseudomonas aeruginosa PA01
ugcuggaagaugcgcugguugg

SEQ ID NO: 4655 - RNA, 22 nt, Pseudomonas aeruginosa PA01
ugcuggagaaggacggcgagcg

SEQ ID NO: 4656 - RNA, 22 nt, Pseudomonas aeruginosa PA01
ugcuggagaaugucgcggcugc

SEQ ID NO: 4657 - RNA, 22 nt, Pseudomonas aeruginosa PA01
ugcagcggaucgagcaggccga

SEQ ID NO: 4658 - RNA, 22 nt, Pseudomonas aeruginosa PA01
ugaugcggguuccgguagggga

SEQ ID NO: 4659 - RNA, 22 nt, Pseudomonas aeruginosa PA01
ugaggaagcgcacgcaggcguc

SEQ ID NO: 4660 - RNA, 19 nt, Pseudomonas aeruginosa PA01
ugauauaggcgguacgggc

SEQ ID NO: 4661 - RNA, 19 nt, Pseudomonas aeruginosa PA01
ugagcagccccaggacgau

SEQ ID NO: 4662 - RNA, 22 nt, Pseudomonas aeruginosa PA01
ugagcgccaggaccugcuccgg

SEQ ID NO: 4663 - RNA, 22 nt, Pseudomonas aeruginosa PA01
ugagcgccugcucgcggcugau

SEQ ID NO: 4664 - RNA, 22 nt, Pseudomonas aeruginosa PA01
ugagcgccugcugcgcaccacc

SEQ ID NO: 4665 - RNA, 22 nt, Pseudomonas aeruginosa PA01
ugagcguggccagccgcgccuc

SEQ ID NO: 4666 - RNA, 22 nt, Pseudomonas aeruginosa PA01
ugagcugcggacgcucgaagac

SEQ ID NO: 4667 - RNA, 22 nt, Pseudomonas aeruginosa PA01
ugaaguacugcagcaucuucuc

SEQ ID NO: 4668 - RNA, 22 nt, Pseudomonas aeruginosa PA01
ugaagauggccgagccggcgac

SEQ ID NO: 4669 - RNA, 22 nt, Pseudomonas aeruginosa PA01
ucucgucgcugcuggcaccgac

SEQ ID NO: 4670 - RNA, 22 nt, Pseudomonas aeruginosa PA01
ucucgucguccaugcucgcgcc

SEQ ID NO: 4671 - RNA, 20 nt, Pseudomonas aeruginosa PA01
ucuccggcgaagagcugcgc

SEQ ID NO: 4672 - RNA, 22 nt, Pseudomonas aeruginosa PA01
ucuccggcggccagcgccagcg

SEQ ID NO: 4673 - RNA, 22 nt, Pseudomonas aeruginosa PA01
ucuccgucgagcggauccaggc

SEQ ID NO: 4674 - RNA, 23 nt, Pseudomonas aeruginosa PA01
ucugcaggaagccuggcagcagc

SEQ ID NO: 4675 - RNA, 22 nt, Pseudomonas aeruginosa PA01
ucuggcucgccaccggccgggu

SEQ ID NO: 4676 - RNA, 23 nt, Pseudomonas aeruginosa PA01
ucuugcccuucuucucgacgguc

SEQ ID NO: 4677 - RNA, 22 nt, Pseudomonas aeruginosa PA01
uugcccgguugcagcggcacca

SEQ ID NO: 4678 - RNA, 22 nt, Pseudomonas aeruginosa PA01
uugcaugaacggcgugccguuc

SEQ ID NO: 4679 - RNA, 22 nt, Pseudomonas aeruginosa PA01
uuccgggcaaaaauucagccga

SEQ ID NO: 4680 - RNA, 22 nt, Pseudomonas aeruginosa PA01
uuccaggcagggccguccuccg

SEQ ID NO: 4681 - RNA, 22 nt, Pseudomonas aeruginosa PA01
uuccaguuggcggcguugcagc

SEQ ID NO: 4682 - RNA, 22 nt, Pseudomonas aeruginosa PA01
uucgccggcggcccgccugucc

SEQ ID NO: 4683 - RNA, 22 nt, Pseudomonas aeruginosa PA01
uucgcggcgaauuuccccggca

SEQ ID NO: 4684 - RNA, 22 nt, Pseudomonas aeruginosa PA01
uuccucggcgccagcgccggca

SEQ ID NO: 4685 - RNA, 22 nt, Pseudomonas aeruginosa PA01
uuccccggcgggcggcgcgacc

SEQ ID NO: 4686 - RNA, 22 nt, Pseudomonas aeruginosa PA01
uucccgccggaggugcgcgccc

SEQ ID NO: 4687 - RNA, 22 nt, Pseudomonas aeruginosa PA01
uucccgcuggcagauggcccug

SEQ ID NO: 4688 - RNA, 22 nt, Pseudomonas aeruginosa PA01
uucccggcaccggucuggcggu

SEQ ID NO: 4689 - RNA, 22 nt, Pseudomonas aeruginosa PA01
uucccgucgaugcggagcggau

SEQ ID NO: 4690 - RNA, 22 nt, Pseudomonas aeruginosa PA01
uuccacggucagcaccgccggc

SEQ ID NO: 4691 - RNA, 22 nt, Pseudomonas aeruginosa PA01
uugagaauggucuccuuggccu

SEQ ID NO: 4692 - RNA, 21 nt, Pseudomonas aeruginosa PA01
uucuucagccugcgcgccgug

SEQ ID NO: 4693 - RNA, 22 nt, Pseudomonas aeruginosa PA01
uucuucagcuugaucacgucga

SEQ ID NO: 4694 - RNA, 22 nt, Pseudomonas aeruginosa PA01
ugucggccuccugggaugccgc

SEQ ID NO: 4695 - RNA, 23 nt, Pseudomonas aeruginosa PA01
ugucuccagcgucuucgggcugu

SEQ ID NO: 4696 - RNA, 17 nt, Pseudomonas aeruginosa PA01
ugucccggcggcggggu

SEQ ID NO: 4697 - RNA, 19 nt, Pseudomonas aeruginosa PA01
uggucgaggggcuggaggc

SEQ ID NO: 4698 - RNA, 22 nt, Pseudomonas aeruginosa PA01
ugguccucggugccggcgacau

SEQ ID NO: 4699 - RNA, 22 nt, Pseudomonas aeruginosa PA01
ugguccugaccuacuucgucau

SEQ ID NO: 4700 - RNA, 22 nt, Pseudomonas aeruginosa PA01
ugguccuggcggagcugcccaa

SEQ ID NO: 4701 - RNA, 23 nt, Pseudomonas aeruginosa PA01
ugguccuggugaucgguuucgcc

SEQ ID NO: 4702 - RNA, 22 nt, Pseudomonas aeruginosa PA01
ugguccuguucgcccugacccu

SEQ ID NO: 4703 - RNA, 22 nt, Pseudomonas aeruginosa PA01
uguucaacgagcugcucgccga

SEQ ID NO: 4704 - RNA, 19 nt, Pseudomonas aeruginosa PA01
uuagaaauaggcauuaguc

SEQ ID NO: 4705 - RNA, 22 nt, Pseudomonas aeruginosa PA01
uuucgcggacgaacuggcggau

SEQ ID NO: 4706 - RNA, 22 nt, Pseudomonas aeruginosa PA01
uuuccucgaugucgccgcccuu

SEQ ID NO: 4707 - RNA, 22 nt, Pseudomonas aeruginosa PA01
uuucuucaaccagggcgagguc

SEQ ID NO: 4708 - RNA, 22 nt, Pseudomonas aeruginosa PA01
uuucuucagcagcccgaggcug

SEQ ID NO: 4709 - RNA, 22 nt, Pseudomonas aeruginosa PA01
uuuuucaagcggcuagaucagc

SEQ ID NO: 4710 - RNA, 22 nt, Pseudomonas aeruginosa PA01
caagcgccugcgcgccuuccug

SEQ ID NO: 4711 - RNA, 22 nt, Pseudomonas aeruginosa PA01
cagccgcgccaggccaggcgcu

SEQ ID NO: 4712 - RNA, 22 nt, Pseudomonas aeruginosa PA01
cagccggcgcaauggggaggac

SEQ ID NO: 4713 - RNA, 22 nt, Pseudomonas aeruginosa PA01
cagccugaaggacuggccggcg

SEQ ID NO: 4714 - RNA, 22 nt, Pseudomonas aeruginosa PA01
cagcgaccuggcgacgcgccug

SEQ ID NO: 4715 - RNA, 22 nt, Pseudomonas aeruginosa PA01
cagcgagcgggaguugcucgcc

SEQ ID NO: 4716 - RNA, 22 nt, Pseudomonas aeruginosa PA01
cagcgcagccaggacgaagagc

SEQ ID NO: 4717 - RNA, 22 nt, Pseudomonas aeruginosa PA01
cagcgccaccccgaggaucgcc

SEQ ID NO: 4718 - RNA, 22 nt, Pseudomonas aeruginosa PA01
cagcgccagcggaauccccgag

SEQ ID NO: 4719 - RNA, 22 nt, Pseudomonas aeruginosa PA01
cagcgccagcggccggcuccug

SEQ ID NO: 4720 - RNA, 22 nt, Pseudomonas aeruginosa PA01
cagcgccgccugggccgcgaca

SEQ ID NO: 4721 - RNA, 22 nt, Pseudomonas aeruginosa PA01
cagcgcgccgauacccaugccg

SEQ ID NO: 4722 - RNA, 22 nt, Pseudomonas aeruginosa PA01
cagcgcgcgagugagcaugggc

SEQ ID NO: 4723 - RNA, 22 nt, Pseudomonas aeruginosa PA01
cagcgcgguacucgacggcagc

SEQ ID NO: 4724 - RNA, 22 nt, Pseudomonas aeruginosa PA01
cagcgcguucuuggccugccag

SEQ ID NO: 4725 - RNA, 22 nt, Pseudomonas aeruginosa PA01
cagcgcuggugcgccgaggacu

SEQ ID NO: 4726 - RNA, 22 nt, Pseudomonas aeruginosa PA01
cagcggagagacuuuuucauua

SEQ ID NO: 4727 - RNA, 22 nt, Pseudomonas aeruginosa PA01
cagcggcaacuggcggaggcgg

SEQ ID NO: 4728 - RNA, 22 nt, Pseudomonas aeruginosa PA01
cagcuccagcagcccggcgccg

SEQ ID NO: 4729 - RNA, 22 nt, Pseudomonas aeruginosa PA01
cagcggugggccccacggcugc

SEQ ID NO: 4730 - RNA, 22 nt, Pseudomonas aeruginosa PA01
cagcgugccgucuucgaggcug

SEQ ID NO: 4731 - RNA, 22 nt, Pseudomonas aeruginosa PA01
cagcccgcugaagaugccgcgc

SEQ ID NO: 4732 - RNA, 22 nt, Pseudomonas aeruginosa PA01
cagcucggcaggcuuuccggca

SEQ ID NO: 4733 - RNA, 22 nt, Pseudomonas aeruginosa PA01
cagcucggggaaaugccggccc

SEQ ID NO: 4734 - RNA, 22 nt, Pseudomonas aeruginosa PA01
cagcuggaaggcgcgcuugccg

SEQ ID NO: 4735 - RNA, 22 nt, Pseudomonas aeruginosa PA01
cagcuggagcagaugaaagccu

SEQ ID NO: 4736 - RNA, 22 nt, Pseudomonas aeruginosa PA01
caggaugcccagcagggucggc

SEQ ID NO: 4737 - RNA, 22 nt, Pseudomonas aeruginosa PA01
caggaugcgcuccagcucgccg

SEQ ID NO: 4738 - RNA, 22 nt, Pseudomonas aeruginosa PA01
caggccaagcgccuggcgcagc

SEQ ID NO: 4739 - RNA, 22 nt, Pseudomonas aeruginosa PA01
caggcccagcugggucgcgguc

SEQ ID NO: 4740 - RNA, 22 nt, Pseudomonas aeruginosa PA01
caggccgaacucgcccugggcg

SEQ ID NO: 4741 - RNA, 22 nt, Pseudomonas aeruginosa PA01
caggccgaccaggaacgcggug

SEQ ID NO: 4742 - RNA, 22 nt, Pseudomonas aeruginosa PA01
caggccgaccgccucgcgcacu

SEQ ID NO: 4743 - RNA, 22 nt, Pseudomonas aeruginosa PA01
caggccgagaccgguguugccg

SEQ ID NO: 4744 - RNA, 22 nt, Pseudomonas aeruginosa PA01
caggccgagcgcgcccuggccg

SEQ ID NO: 4745 - RNA, 22 nt, Pseudomonas aeruginosa PA01
caggccgccggcgaccugccag

SEQ ID NO: 4746 - RNA, 22 nt, Pseudomonas aeruginosa PA01
caggccgcucagggucaacgga

SEQ ID NO: 4747 - RNA, 22 nt, Pseudomonas aeruginosa PA01
caggccggcgaggcguggccga

SEQ ID NO: 4748 - RNA, 23 nt, Pseudomonas aeruginosa PA01
caggccguugcuggcagcguggg

SEQ ID NO: 4749 - RNA, 22 nt, Pseudomonas aeruginosa PA01
caggccuguagcgccgaggcgg

SEQ ID NO: 4750 - RNA, 22 nt, Pseudomonas aeruginosa PA01
cagggccgccuuggccucgcgc

SEQ ID NO: 4751 - RNA, 22 nt, Pseudomonas aeruginosa PA01
cagggccggcauuuccccgagc

SEQ ID NO: 4752 - RNA, 22 nt, Pseudomonas aeruginosa PA01
cagggcgcuauucgcccuacgg

SEQ ID NO: 4753 - RNA, 22 nt, Pseudomonas aeruginosa PA01
caggggcaggcugucgcggaag

SEQ ID NO: 4754 - RNA, 22 nt, Pseudomonas aeruginosa PA01
caggcgcggaugcggcccagcg

SEQ ID NO: 4755 - RNA, 21 nt, Pseudomonas aeruginosa PA01
caggcgcgggcccauccaguu

SEQ ID NO: 4756 - RNA, 22 nt, Pseudomonas aeruginosa PA01
caggcgcguggcccagcaggag

SEQ ID NO: 4757 - RNA, 22 nt, Pseudomonas aeruginosa PA01
cagcuggaugcucgcgcucagc

SEQ ID NO: 4758 - RNA, 22 nt, Pseudomonas aeruginosa PA01
caggcuggcguugcccuugccg

SEQ ID NO: 4759 - RNA, 22 nt, Pseudomonas aeruginosa PA01
cacgcgcuuccggcacuuccac

SEQ ID NO: 4760 - RNA, 22 nt, Pseudomonas aeruginosa PA01
cacuggagcagcgccuggaucg

SEQ ID NO: 4761 - RNA, 22 nt, Pseudomonas aeruginosa PA01
caccagcaggcgcgaggcgauc

SEQ ID NO: 4762 - RNA, 22 nt, Pseudomonas aeruginosa PA01
caccagcuggcggugauggccg

SEQ ID NO: 4763 - RNA, 22 nt, Pseudomonas aeruginosa PA01
caccgucgccuggcccagcggc

SEQ ID NO: 4764 - RNA, 18 nt, Pseudomonas aeruginosa PA01
cagaccagcgccagcggc

SEQ ID NO: 4765 - RNA, 22 nt, Pseudomonas aeruginosa PA01
cagagccggucgaccgccuggc

SEQ ID NO: 4766 - RNA, 22 nt, Pseudomonas aeruginosa PA01
cagagcggccuguucggcgggc

SEQ ID NO: 4767 - RNA, 22 nt, Pseudomonas aeruginosa PA01
cagccagauggucggccucacg

SEQ ID NO: 4768 - RNA, 22 nt, Pseudomonas aeruginosa PA01
cagccagcccggcggucuccgc

SEQ ID NO: 4769 - RNA, 22 nt, Pseudomonas aeruginosa PA01
cagcagccgaucgucgcgcucg

SEQ ID NO: 4770 - RNA, 22 nt, Pseudomonas aeruginosa PA01
cagcagccuggccggcaguuuu

SEQ ID NO: 4771 - RNA, 22 nt, Pseudomonas aeruginosa PA01
cagcagcgccucggcgccgaac

SEQ ID NO: 4772 - RNA, 19 nt, Pseudomonas aeruginosa PA01
cagcagcgggccgcaccug

SEQ ID NO: 4773 - RNA, 22 nt, Pseudomonas aeruginosa PA01
cagcagcucgccgagacggccg

SEQ ID NO: 4774 - RNA, 22 nt, Pseudomonas aeruginosa PA01
ccaccggcaccggcgccgaggu

SEQ ID NO: 4775 - RNA, 22 nt, Pseudomonas aeruginosa PA01
ccaccuccuccccggugagcag

SEQ ID NO: 4776 - RNA, 22 nt, Pseudomonas aeruginosa PA01
ccacgaaggccaucugcauggu

SEQ ID NO: 4777 - RNA, 22 nt, Pseudomonas aeruginosa PA01
ccacgagccggagcuggccuuc

SEQ ID NO: 4778 - RNA, 22 nt, Pseudomonas aeruginosa PA01
ccagaacugcuuggagaucucg

SEQ ID NO: 4779 - RNA, 22 nt, Pseudomonas aeruginosa PA01
ccagcagcgaugcgcccagcag

SEQ ID NO: 4780 - RNA, 22 nt, Pseudomonas aeruginosa PA01
cauccggcggacagcccgcccc

SEQ ID NO: 4781 - RNA, 22 nt, Pseudomonas aeruginosa PA01
cagucucagugucugcggugcu

SEQ ID NO: 4782 - RNA, 22 nt, Pseudomonas aeruginosa PA01
caugcuugccgguuuguugcag

SEQ ID NO: 4783 - RNA, 22 nt, Pseudomonas aeruginosa PA01
ccaggcuccgcgcggugccgag

SEQ ID NO: 4784 - RNA, 22 nt, Pseudomonas aeruginosa PA01
ccaggcucgcggaugcgcgcag

SEQ ID NO: 4785 - RNA, 22 nt, Pseudomonas aeruginosa PA01
ccagggcacgcugggcgucggc

SEQ ID NO: 4786 - RNA, 22 nt, Pseudomonas aeruginosa PA01
ccagggcaucgagacuuccggc

SEQ ID NO: 4787 - RNA, 22 nt, Pseudomonas aeruginosa PA01
ccagggccggcagcagccagag

SEQ ID NO: 4788 - RNA, 22 nt, Pseudomonas aeruginosa PA01
ccagggccucgagacucugccg

SEQ ID NO: 4789 - RNA, 22 nt, Pseudomonas aeruginosa PA01
ccaggccgccagccguucggcc

SEQ ID NO: 4790 - RNA, 22 nt, Pseudomonas aeruginosa PA01
ccaggccgccgacguagcgauc

SEQ ID NO: 4791 - RNA, 22 nt, Pseudomonas aeruginosa PA01
ccaggccgcgcucuugccccac

SEQ ID NO: 4792 - RNA, 22 nt, Pseudomonas aeruginosa PA01
ccaggccggggcgaugaucgug

SEQ ID NO: 4793 - RNA, 22 nt, Pseudomonas aeruginosa PA01
ccaggccguccucgcggacgaa

SEQ ID NO: 4794 - RNA, 22 nt, Pseudomonas aeruginosa PA01
ccaggccgucgacggcgcucug

SEQ ID NO: 4795 - RNA, 22 nt, Pseudomonas aeruginosa PA01
ccaggcgcagguugagcaggaa

SEQ ID NO: 4796 - RNA, 22 nt, Pseudomonas aeruginosa PA01
ccagcaggaaccgcgcgcgguu

SEQ ID NO: 4797 - RNA, 22 nt, Pseudomonas aeruginosa PA01
ccagcagggucuucagcaguuc

SEQ ID NO: 4798 - RNA, 22 nt, Pseudomonas aeruginosa PA01
ccagccagccuucgccgaggcu

SEQ ID NO: 4799 - RNA, 22 nt, Pseudomonas aeruginosa PA01
ccagccggcgaggcuccagcgg

SEQ ID NO: 4800 - RNA, 22 nt, Pseudomonas aeruginosa PA01
ccagcgccagcaggcguugcag

SEQ ID NO: 4801 - RNA, 22 nt, Pseudomonas aeruginosa PA01
ccagcgccagucgcugcucgcc

SEQ ID NO: 4802 - RNA, 22 nt, Pseudomonas aeruginosa PA01
ccagcgccgacgggcucgacau

SEQ ID NO: 4803 - RNA, 22 nt, Pseudomonas aeruginosa PA01
ccagcgccuggaccuccaggcc

SEQ ID NO: 4804 - RNA, 22 nt, Pseudomonas aeruginosa PA01
ccagcgccuggccaucgugcgc

SEQ ID NO: 4805 - RNA, 22 nt, Pseudomonas aeruginosa PA01
ccagcgcggcggccaccaggcg

SEQ ID NO: 4806 - RNA, 20 nt, Pseudomonas aeruginosa PA01
ccagcgcguggucgcgcagc

SEQ ID NO: 4807 - RNA, 22 nt, Pseudomonas aeruginosa PA01
ccagcggccgcaaccagggcga

SEQ ID NO: 4808 - RNA, 21 nt, Pseudomonas aeruginosa PA01
ccaggcagugaccacaagggc

SEQ ID NO: 4809 - RNA, 22 nt, Pseudomonas aeruginosa PA01
ccaggccaacgaagccaacgaa

SEQ ID NO: 4810 - RNA, 22 nt, Pseudomonas aeruginosa PA01
ccagccugaccagccuggccac

SEQ ID NO: 4811 - RNA, 22 nt, Pseudomonas aeruginosa PA01
ccagccugcacggcggccagga

SEQ ID NO: 4812 - RNA, 22 nt, Pseudomonas aeruginosa PA01
cccacgaggcggccgaggcggc

SEQ ID NO: 4813 - RNA, 21 nt, Pseudomonas aeruginosa PA01
cccacggcuaccugaucgacc

SEQ ID NO: 4814 - RNA, 22 nt, Pseudomonas aeruginosa PA01
cccagcaguugcugcuggcggc

SEQ ID NO: 4815 - RNA, 22 nt, Pseudomonas aeruginosa PA01
cccagcucgacaucccggcgcu

SEQ ID NO: 4816 - RNA, 22 nt, Pseudomonas aeruginosa PA01
cccagggcgccuucgacgaccc

SEQ ID NO: 4817 - RNA, 22 nt, Pseudomonas aeruginosa PA01
ccccagggccgcggagcgcagg

SEQ ID NO: 4818 - RNA, 22 nt, Pseudomonas aeruginosa PA01
cccgagcugcucgaacuccacg

SEQ ID NO: 4819 - RNA, 19 nt, Pseudomonas aeruginosa PA01
cccgccgcgccggccugga

SEQ ID NO: 4820 - RNA, 22 nt, Pseudomonas aeruginosa PA01
cccgccgcugguggucgacguc

SEQ ID NO: 4821 - RNA, 22 nt, Pseudomonas aeruginosa PA01
cccgccugggugcccuggcuga

SEQ ID NO: 4822 - RNA, 22 nt, Pseudomonas aeruginosa PA01
cccgcgacuggaauccgcgaac

SEQ ID NO: 4823 - RNA, 22 nt, Pseudomonas aeruginosa PA01
cccgcgccacgaggaacgcgug

SEQ ID NO: 4824 - RNA, 22 nt, Pseudomonas aeruginosa PA01
cccuggaagaccugccggagaa

SEQ ID NO: 4825 - RNA, 22 nt, Pseudomonas aeruginosa PA01
ccccggcugcggcagcggcgga

SEQ ID NO: 4826 - RNA, 22 nt, Pseudomonas aeruginosa PA01
cccgcggcuggcugcgcuaccg

SEQ ID NO: 4827 - RNA, 22 nt, Pseudomonas aeruginosa PA01
cccgcuccguuggggccgagga

SEQ ID NO: 4828 - RNA, 22 nt, Pseudomonas aeruginosa PA01
cccggagcuggucaaccaggac

SEQ ID NO: 4829 - RNA, 21 nt, Pseudomonas aeruginosa PA01
cccggccgagagcgggcagga

SEQ ID NO: 4830 - RNA, 22 nt, Pseudomonas aeruginosa PA01
cccggccgccaccgucgagcag

SEQ ID NO: 4831 - RNA, 22 nt, Pseudomonas aeruginosa PA01
cccggccggcgaugcaguggag

SEQ ID NO: 4832 - RNA, 22 nt, Pseudomonas aeruginosa PA01
cccggccugccuggacgcgcug

SEQ ID NO: 4833 - RNA, 22 nt, Pseudomonas aeruginosa PA01
cccggcgcagaugcgcgucgau

SEQ ID NO: 4834 - RNA, 22 nt, Pseudomonas aeruginosa PA01
cccggcgggcaccuguguggcc

SEQ ID NO: 4835 - RNA, 22 nt, Pseudomonas aeruginosa PA01
cccggcguugaucccgcgggcg

SEQ ID NO: 4836 - RNA, 22 nt, Pseudomonas aeruginosa PA01
cccggcucguuggucacggcga

SEQ ID NO: 4837 - RNA, 22 nt, Pseudomonas aeruginosa PA01
cccggcucugcucggcgugggc

SEQ ID NO: 4838 - RNA, 22 nt, Pseudomonas aeruginosa PA01
cccggcuguucguugaucggcu

SEQ ID NO: 4839 - RNA, 22 nt, Pseudomonas aeruginosa PA01
cccggggacaugucguccagcc

SEQ ID NO: 4840 - RNA, 22 nt, Pseudomonas aeruginosa PA01
ccucgccgcgagcguggcacuc

SEQ ID NO: 4841 - RNA, 22 nt, Pseudomonas aeruginosa PA01
ccguccugccucguccgcgcag

SEQ ID NO: 4842 - RNA, 19 nt, Pseudomonas aeruginosa PA01
ccgucgccggcguuggucg

SEQ ID NO: 4843 - RNA, 22 nt, Pseudomonas aeruginosa PA01
ccgugcggaagacgccuuccaa

SEQ ID NO: 4844 - RNA, 22 nt, Pseudomonas aeruginosa PA01
ccgccccgccuccugggaccag

SEQ ID NO: 4845 - RNA, 22 nt, Pseudomonas aeruginosa PA01
ccgccccgcucugcgccaacgg

SEQ ID NO: 4846 - RNA, 22 nt, Pseudomonas aeruginosa PA01
ccgccccggcugcucagcgugc

SEQ ID NO: 4847 - RNA, 22 nt, Pseudomonas aeruginosa PA01
ccgggcgcccggacgugcagcg

SEQ ID NO: 4848 - RNA, 22 nt, Pseudomonas aeruginosa PA01
ccgggcgcuggucugcgcggug

SEQ ID NO: 4849 - RNA, 22 nt, Pseudomonas aeruginosa PA01
ccggucuccgccgggcgguggc

SEQ ID NO: 4850 - RNA, 22 nt, Pseudomonas aeruginosa PA01
ccgguucuccagcaccaggcgg

SEQ ID NO: 4851 - RNA, 22 nt, Pseudomonas aeruginosa PA01
ccgcuccgacaggggcaaggcg

SEQ ID NO: 4852 - RNA, 22 nt, Pseudomonas aeruginosa PA01
ccgcuggacggggccucguuga

SEQ ID NO: 4853 - RNA, 22 nt, Pseudomonas aeruginosa PA01
ccggaagcccugagccgcucug

SEQ ID NO: 4854 - RNA, 22 nt, Pseudomonas aeruginosa PA01
ccggagccggcuugccguggac

SEQ ID NO: 4855 - RNA, 22 nt, Pseudomonas aeruginosa PA01
ccggagccgguucgcaccuauc

SEQ ID NO: 4856 - RNA, 22 nt, Pseudomonas aeruginosa PA01
ccggagccguccgguaccacgu

SEQ ID NO: 4857 - RNA, 18 nt, Pseudomonas aeruginosa PA01
ccggagccugugucggcc

SEQ ID NO: 4858 - RNA, 22 nt, Pseudomonas aeruginosa PA01
ccggagcgcccgggccuucguc

SEQ ID NO: 4859 - RNA, 22 nt, Pseudomonas aeruginosa PA01
ccggagcggcgagcagggcgag

SEQ ID NO: 4860 - RNA, 22 nt, Pseudomonas aeruginosa PA01
ccggagcgggaggucagaccuu

SEQ ID NO: 4861 - RNA, 22 nt, Pseudomonas aeruginosa PA01
ccuggggcgccugcugcuacag

SEQ ID NO: 4862 - RNA, 22 nt, Pseudomonas aeruginosa PA01
ccugggcaagcucggcaagggc

SEQ ID NO: 4863 - RNA, 22 nt, Pseudomonas aeruginosa PA01
ccuuggucaucgggguggaucg

SEQ ID NO: 4864 - RNA, 22 nt, Pseudomonas aeruginosa PA01
ccguuggcggcgucggugguga

SEQ ID NO: 4865 - RNA, 22 nt, Pseudomonas aeruginosa PA01
ccucuccggcgacgaggccaag

SEQ ID NO: 4866 - RNA, 22 nt, Pseudomonas aeruginosa PA01
ccucuucuggcuggaggcgcgc

SEQ ID NO: 4867 - RNA, 22 nt, Pseudomonas aeruginosa PA01
ccugagcgucagcgacgacggu

SEQ ID NO: 4868 - RNA, 22 nt, Pseudomonas aeruginosa PA01
ccugccggcggcgcuggucgaa

SEQ ID NO: 4869 - RNA, 22 nt, Pseudomonas aeruginosa PA01
ccugcgaccagagcugggccag

SEQ ID NO: 4870 - RNA, 23 nt, Pseudomonas aeruginosa PA01
ccugcgacuaccugcaacgccuc

SEQ ID NO: 4871 - RNA, 22 nt, Pseudomonas aeruginosa PA01
ccugcgccugucggccggcgcc

SEQ ID NO: 4872 - RNA, 23 nt, Pseudomonas aeruginosa PA01
ccugcuccgcgauugccugggcg

SEQ ID NO: 4873 - RNA, 22 nt, Pseudomonas aeruginosa PA01
ccuggccggccacgaccugcuc

SEQ ID NO: 4874 - RNA, 22 nt, Pseudomonas aeruginosa PA01
ccuggaagugcuguuccuggac

SEQ ID NO: 4875 - RNA, 22 nt, Pseudomonas aeruginosa PA01
ccgcccuggccuauccgcugcu

SEQ ID NO: 4876 - RNA, 22 nt, Pseudomonas aeruginosa PA01
ccgcccugguccugcugccguu

SEQ ID NO: 4877 - RNA, 22 nt, Pseudomonas aeruginosa PA01
ccgccgccgaccaugaacaucg

SEQ ID NO: 4878 - RNA, 22 nt, Pseudomonas aeruginosa PA01
ccgccggcaucggccugcacac

SEQ ID NO: 4879 - RNA, 22 nt, Pseudomonas aeruginosa PA01
ccgccggguacguugcagcaac

SEQ ID NO: 4880 - RNA, 22 nt, Pseudomonas aeruginosa PA01
ccgccgggugguguccucagcg

SEQ ID NO: 4881 - RNA, 22 nt, Pseudomonas aeruginosa PA01
ccgccucgacgaagccgcgcag

SEQ ID NO: 4882 - RNA, 22 nt, Pseudomonas aeruginosa PA01
ccgccuggguagcuacguggcg

SEQ ID NO: 4883 - RNA, 22 nt, Pseudomonas aeruginosa PA01
ccgcgcagaucccccggcuggc

SEQ ID NO: 4884 - RNA, 21 nt, Pseudomonas aeruginosa PA01
ccgcgccuggaccgcgccggg

SEQ ID NO: 4885 - RNA, 22 nt, Pseudomonas aeruginosa PA01
ccgcggagcccggucgggcgcu

SEQ ID NO: 4886 - RNA, 22 nt, Pseudomonas aeruginosa PA01
ccgcggcauggugguggucuac

SEQ ID NO: 4887 - RNA, 23 nt, Pseudomonas aeruginosa PA01
ccgcggccugcaauucuuccagc

SEQ ID NO: 4888 - RNA, 22 nt, Pseudomonas aeruginosa PA01
ccgcggcuauggcgucgaggcg

SEQ ID NO: 4889 - RNA, 22 nt, Pseudomonas aeruginosa PA01
ccgagggcaagccgcgcuacac

SEQ ID NO: 4890 - RNA, 22 nt, Pseudomonas aeruginosa PA01
ccgagggcaucgacugccaggg

SEQ ID NO: 4891 - RNA, 22 nt, Pseudomonas aeruginosa PA01
ccgcacagccguaucggccugc

SEQ ID NO: 4892 - RNA, 22 nt, Pseudomonas aeruginosa PA01
ccgcagaggucccucggcgcuu

SEQ ID NO: 4893 - RNA, 22 nt, Pseudomonas aeruginosa PA01
ccgcagccacagcggccgggca

SEQ ID NO: 4894 - RNA, 22 nt, Pseudomonas aeruginosa PA01
ccgcagccuggcgaucgaagcg

SEQ ID NO: 4895 - RNA, 22 nt, Pseudomonas aeruginosa PA01
ccgccacccugagcgcgcugau

SEQ ID NO: 4896 - RNA, 22 nt, Pseudomonas aeruginosa PA01
ccgagcaggaagccuugcagcg

SEQ ID NO: 4897 - RNA, 21 nt, Pseudomonas aeruginosa PA01
ccgagcaguuucucgaggcgc

SEQ ID NO: 4898 - RNA, 19 nt, Pseudomonas aeruginosa PA01
ccgagccgccgacgugguu

SEQ ID NO: 4899 - RNA, 21 nt, Pseudomonas aeruginosa PA01
ccgagcgcaaggggcgcgagc

SEQ ID NO: 4900 - RNA, 22 nt, Pseudomonas aeruginosa PA01
ccgagcgcgcccucgaacugau

SEQ ID NO: 4901 - RNA, 22 nt, Pseudomonas aeruginosa PA01
ccgagcgcuucgcccaugucgg

SEQ ID NO: 4902 - RNA, 22 nt, Pseudomonas aeruginosa PA01
ccggcagccacugcgccugcug

SEQ ID NO: 4903 - RNA, 19 nt, Pseudomonas aeruginosa PA01
ccggcaucuuauggggcgu

SEQ ID NO: 4904 - RNA, 22 nt, Pseudomonas aeruginosa PA01
ccggcccgccgggugcggccug

SEQ ID NO: 4905 - RNA, 20 nt, Pseudomonas aeruginosa PA01
ccggccgaagugcucgcggu

SEQ ID NO: 4906 - RNA, 22 nt, Pseudomonas aeruginosa PA01
ccggccgaggcgccggaccagg

SEQ ID NO: 4907 - RNA, 22 nt, Pseudomonas aeruginosa PA01
ccggccggguuuccuggguaug

SEQ ID NO: 4908 - RNA, 22 nt, Pseudomonas aeruginosa PA01
ccggccugcggcgcuuccacga

SEQ ID NO: 4909 - RNA, 22 nt, Pseudomonas aeruginosa PA01
ccggccuggcgccggcuucggc

SEQ ID NO: 4910 - RNA, 22 nt, Pseudomonas aeruginosa PA01
ccggccugucuucugccggaca

SEQ ID NO: 4911 - RNA, 22 nt, Pseudomonas aeruginosa PA01
ccggccuuggccagcggcgcac

SEQ ID NO: 4912 - RNA, 22 nt, Pseudomonas aeruginosa PA01
ccggccuuggcguccggcuugc

SEQ ID NO: 4913 - RNA, 23 nt, Pseudomonas aeruginosa PA01
ccggcgacacccucuacgugguc

SEQ ID NO: 4914 - RNA, 22 nt, Pseudomonas aeruginosa PA01
ccggcgacgugcugcgccuucu

SEQ ID NO: 4915 - RNA, 22 nt, Pseudomonas aeruginosa PA01
ccggcgauuuccucgccggcgu

SEQ ID NO: 4916 - RNA, 22 nt, Pseudomonas aeruginosa PA01
ccggcgccgugaccccgguggc

SEQ ID NO: 4917 - RNA, 22 nt, Pseudomonas aeruginosa PA01
ccggcgcgaagaugucguguuc

SEQ ID NO: 4918 - RNA, 22 nt, Pseudomonas aeruginosa PA01
ccggcgcgccagaacucgaccg

SEQ ID NO: 4919 - RNA, 22 nt, Pseudomonas aeruginosa PA01
ccggcgcgcuccugcagacccg

SEQ ID NO: 4920 - RNA, 22 nt, Pseudomonas aeruginosa PA01
ccggcgcugcugaucgcuucgu

SEQ ID NO: 4921 - RNA, 22 nt, Pseudomonas aeruginosa PA01
ccggcggcaucaggcccugcac

SEQ ID NO: 4922 - RNA, 22 nt, Pseudomonas aeruginosa PA01
ccggcggccaguuggcgggcca

SEQ ID NO: 4923 - RNA, 23 nt, Pseudomonas aeruginosa PA01
ccggcggcgaccuggcgguucug

SEQ ID NO: 4924 - RNA, 22 nt, Pseudomonas aeruginosa PA01
ccggcggguggaagucuggguc

SEQ ID NO: 4925 - RNA, 22 nt, Pseudomonas aeruginosa PA01
ccggcgucaauggccucgaggc

SEQ ID NO: 4926 - RNA, 20 nt, Pseudomonas aeruginosa PA01
ccggcgucgaaguucggcag

SEQ ID NO: 4927 - RNA, 22 nt, Pseudomonas aeruginosa PA01
ccggcuaccagguuccggcgcg

SEQ ID NO: 4928 - RNA, 22 nt, Pseudomonas aeruginosa PA01
ccggcuccaccgaacuggaccg

SEQ ID NO: 4929 - RNA, 22 nt, Pseudomonas aeruginosa PA01
ccggcuccgccgguugcggcau

SEQ ID NO: 4930 - RNA, 22 nt, Pseudomonas aeruginosa PA01
ccggcucggcgacgccgaggua

SEQ ID NO: 4931 - RNA, 23 nt, Pseudomonas aeruginosa PA01
ccggcucgucucagucgagcuug

SEQ ID NO: 4932 - RNA, 22 nt, Pseudomonas aeruginosa PA01
ccggcugguagccggccggcag

SEQ ID NO: 4933 - RNA, 22 nt, Pseudomonas aeruginosa PA01
ccggcuuccucgaacugcucgg

SEQ ID NO: 4934 - RNA, 22 nt, Pseudomonas aeruginosa PA01
ccggcuucggcgucuucucgcu

SEQ ID NO: 4935 - RNA, 22 nt, Pseudomonas aeruginosa PA01
ccgggcaguucggccucggcug

SEQ ID NO: 4936 - RNA, 17 nt, Pseudomonas aeruginosa PA01
cgacgcaggucgccauc

SEQ ID NO: 4937 - RNA, 22 nt, Pseudomonas aeruginosa PA01
cgacgccccggugcucuucccg

SEQ ID NO: 4938 - RNA, 18 nt, Pseudomonas aeruginosa PA01
cgaccaggcguggcugua

SEQ ID NO: 4939 - RNA, 22 nt, Pseudomonas aeruginosa PA01
cgaccagggcgcggccggcgaa

SEQ ID NO: 4940 - RNA, 22 nt, Pseudomonas aeruginosa PA01
cgaccaggucguccugcgccga

SEQ ID NO: 4941 - RNA, 22 nt, Pseudomonas aeruginosa PA01
cgacccgccaggcgcugggcga

SEQ ID NO: 4942 - RNA, 22 nt, Pseudomonas aeruginosa PA01
cgacccggugauacacggcgaa

SEQ ID NO: 4943 - RNA, 22 nt, Pseudomonas aeruginosa PA01
cgaacagcagcagcggagcgac

SEQ ID NO: 4944 - RNA, 22 nt, Pseudomonas aeruginosa PA01
cgaaccagcgcaacggcgcguc

SEQ ID NO: 4945 - RNA, 22 nt, Pseudomonas aeruginosa PA01
cgaagcgccugggcugccgcca

SEQ ID NO: 4946 - RNA, 22 nt, Pseudomonas aeruginosa PA01
cgaagcgcugguucagggaggc

SEQ ID NO: 4947 - RNA, 22 nt, Pseudomonas aeruginosa PA01
cgagcuggcgcuccuggccgcu

SEQ ID NO: 4948 - RNA, 22 nt, Pseudomonas aeruginosa PA01
cgaggaacaugccgaugaucau

SEQ ID NO: 4949 - RNA, 22 nt, Pseudomonas aeruginosa PA01
cgaggaaguugaggauggcguu

SEQ ID NO: 4950 - RNA, 22 nt, Pseudomonas aeruginosa PA01
cgaggaggacgcucgcggucgc

SEQ ID NO: 4951 - RNA, 22 nt, Pseudomonas aeruginosa PA01
cgaggccggcguggcgaaguag

SEQ ID NO: 4952 - RNA, 22 nt, Pseudomonas aeruginosa PA01
cgaggccgggccgaagcaggug

SEQ ID NO: 4953 - RNA, 22 nt, Pseudomonas aeruginosa PA01
cgagcgcaggaacagggucagg

SEQ ID NO: 4954 - RNA, 22 nt, Pseudomonas aeruginosa PA01
cgagcgcgagcagcgccuggaa

SEQ ID NO: 4955 - RNA, 22 nt, Pseudomonas aeruginosa PA01
cgagcgcuuccugaggcgcgua

SEQ ID NO: 4956 - RNA, 22 nt, Pseudomonas aeruginosa PA01
cgagcggccagggccugcaccg

SEQ ID NO: 4957 - RNA, 22 nt, Pseudomonas aeruginosa PA01
cgagcagcaggcgcacaggaug

SEQ ID NO: 4958 - RNA, 22 nt, Pseudomonas aeruginosa PA01
cgagcagcucagugccuuccac

SEQ ID NO: 4959 - RNA, 23 nt, Pseudomonas aeruginosa PA01
cgagcagcucgccgagcugucgc

SEQ ID NO: 4960 - RNA, 22 nt, Pseudomonas aeruginosa PA01
cgagcagguguugcaggcgggu

SEQ ID NO: 4961 - RNA, 18 nt, Pseudomonas aeruginosa PA01
cgcagcagacgcaguugc

SEQ ID NO: 4962 - RNA, 22 nt, Pseudomonas aeruginosa PA01
cgcagcaggcgguacucggcgc

SEQ ID NO: 4963 - RNA, 22 nt, Pseudomonas aeruginosa PA01
cgcagcgccaggcgcugggcuu

SEQ ID NO: 4964 - RNA, 21 nt, Pseudomonas aeruginosa PA01
cgcagcugucgaggucggcga

SEQ ID NO: 4965 - RNA, 22 nt, Pseudomonas aeruginosa PA01
cgccaccacccgccgcugcauc

SEQ ID NO: 4966 - RNA, 21 nt, Pseudomonas aeruginosa PA01
cgccaccaguuguucgugacc

SEQ ID NO: 4967 - RNA, 22 nt, Pseudomonas aeruginosa PA01
cgccaccaugaucaagccuucc

SEQ ID NO: 4968 - RNA, 21 nt, Pseudomonas aeruginosa PA01
cgcaagcggcaucgccaucag

SEQ ID NO: 4969 - RNA, 22 nt, Pseudomonas aeruginosa PA01
cgaugcgggcgccacucucgau

SEQ ID NO: 4970 - RNA, 21 nt, Pseudomonas aeruginosa PA01
cgaugcgguccucgucccagc

SEQ ID NO: 4971 - RNA, 22 nt, Pseudomonas aeruginosa PA01
cgcacagcuccgcgacugggaa

SEQ ID NO: 4972 - RNA, 22 nt, Pseudomonas aeruginosa PA01
cgcacagggccggauccuugcu

SEQ ID NO: 4973 - RNA, 22 nt, Pseudomonas aeruginosa PA01
cgcaccagggucgggccgcgcu

SEQ ID NO: 4974 - RNA, 22 nt, Pseudomonas aeruginosa PA01
cgagggccugauggcgacgcug

SEQ ID NO: 4975 - RNA, 22 nt, Pseudomonas aeruginosa PA01
cgagggccuggcgccggagguc

SEQ ID NO: 4976 - RNA, 22 nt, Pseudomonas aeruginosa PA01
cgaucagguugaggcggcccgg

SEQ ID NO: 4977 - RNA, 22 nt, Pseudomonas aeruginosa PA01
cgauccgggcuggcugcaggug

SEQ ID NO: 4978 - RNA, 21 nt, Pseudomonas aeruginosa PA01
cgaucgcccaggcggcgggca

SEQ ID NO: 4979 - RNA, 22 nt, Pseudomonas aeruginosa PA01
cgaucgccuggcacgccacccg

SEQ ID NO: 4980 - RNA, 21 nt, Pseudomonas aeruginosa PA01
cgaucggcaggcugucgucgu

SEQ ID NO: 4981 - RNA, 22 nt, Pseudomonas aeruginosa PA01
cgccaccgauacgcagccgguu

SEQ ID NO: 4982 - RNA, 22 nt, Pseudomonas aeruginosa PA01
cgccaccuggcuggugccgcgc

SEQ ID NO: 4983 - RNA, 22 nt, Pseudomonas aeruginosa PA01
cgccagccgcgcucguagaacg

SEQ ID NO: 4984 - RNA, 17 nt, Pseudomonas aeruginosa PA01
cgccagcgccgacagcc

SEQ ID NO: 4985 - RNA, 22 nt, Pseudomonas aeruginosa PA01
cgccagagcccgguggcgaucc

SEQ ID NO: 4986 - RNA, 22 nt, Pseudomonas aeruginosa PA01
cgcccagcucggugccgauggc

SEQ ID NO: 4987 - RNA, 22 nt, Pseudomonas aeruginosa PA01
cgccccacuggcgccgcucgaa

SEQ ID NO: 4988 - RNA, 22 nt, Pseudomonas aeruginosa PA01
cgcccggcaugggcacucgcau

SEQ ID NO: 4989 - RNA, 22 nt, Pseudomonas aeruginosa PA01
cgccccagcucuucgcgcaggu

SEQ ID NO: 4990 - RNA, 22 nt, Pseudomonas aeruginosa PA01
cgccccagguccuggccgccga

SEQ ID NO: 4991 - RNA, 22 nt, Pseudomonas aeruginosa PA01
cgcccuggcggggccgcgacuu

SEQ ID NO: 4992 - RNA, 22 nt, Pseudomonas aeruginosa PA01
cgcccuggucgccgucaucgcg

SEQ ID NO: 4993 - RNA, 22 nt, Pseudomonas aeruginosa PA01
cgccgaccagcaggccgacgac

SEQ ID NO: 4994 - RNA, 22 nt, Pseudomonas aeruginosa PA01
cgccgacccgcaugcccagcga

SEQ ID NO: 4995 - RNA, 22 nt, Pseudomonas aeruginosa PA01
cgccgaccgccuccaggcaacg

SEQ ID NO: 4996 - RNA, 22 nt, Pseudomonas aeruginosa PA01
cgccgaccuuccauggcgcgcu

SEQ ID NO: 4997 - RNA, 22 nt, Pseudomonas aeruginosa PA01
cgccgagcugaagcuguaggau

SEQ ID NO: 4998 - RNA, 20 nt, Pseudomonas aeruginosa PA01
cgccgcagccgcuggacggc

SEQ ID NO: 4999 - RNA, 22 nt, Pseudomonas aeruginosa PA01
cgccgcccucuugcggcgaacc

SEQ ID NO: 5000 - RNA, 19 nt, Pseudomonas aeruginosa PA01
cgccgccgaauccuucgcc

SEQ ID NO: 5001 - RNA, 22 nt, Pseudomonas aeruginosa PA01
cgccgccgauacgcagccgguu

SEQ ID NO: 5002 - RNA, 22 nt, Pseudomonas aeruginosa PA01
cgccgccgccaucgagcagaac

SEQ ID NO: 5003 - RNA, 17 nt, Pseudomonas aeruginosa PA01
cgccgccggcgcagaag

SEQ ID NO: 5004 - RNA, 17 nt, Pseudomonas aeruginosa PA01
cgccgccggggcggaag

SEQ ID NO: 5005 - RNA, 22 nt, Pseudomonas aeruginosa PA01
cgccggccaucagcgcuaccgc

SEQ ID NO: 5006 - RNA, 22 nt, Pseudomonas aeruginosa PA01
cgccggccgccgaggucgccaa

SEQ ID NO: 5007 - RNA, 22 nt, Pseudomonas aeruginosa PA01
cgccggccggcuggguauucgc

SEQ ID NO: 5008 - RNA, 22 nt, Pseudomonas aeruginosa PA01
cgccggccgucguccucgaagu

SEQ ID NO: 5009 - RNA, 22 nt, Pseudomonas aeruginosa PA01
cgccggcgccgaggcaggcacc

SEQ ID NO: 5010 - RNA, 19 nt, Pseudomonas aeruginosa PA01
cgccggcgccgggcugauc

SEQ ID NO: 5011 - RNA, 22 nt, Pseudomonas aeruginosa PA01
cgccggcgcucaagggucgcua

SEQ ID NO: 5012 - RNA, 22 nt, Pseudomonas aeruginosa PA01
cgccggcgcuguuguccaggcu

SEQ ID NO: 5013 - RNA, 17 nt, Pseudomonas aeruginosa PA01
cgccggcggcgugcagg

SEQ ID NO: 5014 - RNA, 22 nt, Pseudomonas aeruginosa PA01
cgccggcuuccaccugcucgac

SEQ ID NO: 5015 - RNA, 22 nt, Pseudomonas aeruginosa PA01
cgcgcgcuggucgguccgggau

SEQ ID NO: 5016 - RNA, 22 nt, Pseudomonas aeruginosa PA01
cgcgcgguugcuggcggugcuc

SEQ ID NO: 5017 - RNA, 23 nt, Pseudomonas aeruginosa PA01
cgcgcuccagcaggucggccaug

SEQ ID NO: 5018 - RNA, 22 nt, Pseudomonas aeruginosa PA01
cgcgcucgcgguaagguaugcc

SEQ ID NO: 5019 - RNA, 22 nt, Pseudomonas aeruginosa PA01
cgcgcucggaacccgguuuggc

SEQ ID NO: 5020 - RNA, 22 nt, Pseudomonas aeruginosa PA01
cgcgcuggaacgacgucuaccu

SEQ ID NO: 5021 - RNA, 22 nt, Pseudomonas aeruginosa PA01
cgcggacagcugcgacgagcgg

SEQ ID NO: 5022 - RNA, 22 nt, Pseudomonas aeruginosa PA01
cgcggagcaggccgaccagcgg

SEQ ID NO: 5023 - RNA, 22 nt, Pseudomonas aeruginosa PA01
cgcggagccacucccuggcgcc

SEQ ID NO: 5024 - RNA, 22 nt, Pseudomonas aeruginosa PA01
cgcggaugagcccgcgaucgau

SEQ ID NO: 5025 - RNA, 17 nt, Pseudomonas aeruginosa PA01
cgcggcagccaggcggc

SEQ ID NO: 5026 - RNA, 22 nt, Pseudomonas aeruginosa PA01
cgcggcaggaggacggcagcgu

SEQ ID NO: 5027 - RNA, 22 nt, Pseudomonas aeruginosa PA01
cgcggcccucaccggcuucggc

SEQ ID NO: 5028 - RNA, 22 nt, Pseudomonas aeruginosa PA01
cgcggccgauggccgggcuggu

SEQ ID NO: 5029 - RNA, 19 nt, Pseudomonas aeruginosa PA01
cgcggccgggauccucggc

SEQ ID NO: 5030 - RNA, 22 nt, Pseudomonas aeruginosa PA01
cgcggccgugcccuucgagcug

SEQ ID NO: 5031 - RNA, 22 nt, Pseudomonas aeruginosa PA01
cgcggcgagggccagcaggugc

SEQ ID NO: 5032 - RNA, 23 nt, Pseudomonas aeruginosa PA01
cgcggcgaucgaggccgaggccc

SEQ ID NO: 5033 - RNA, 22 nt, Pseudomonas aeruginosa PA01
cgcggcgcucggcaucgaccau

SEQ ID NO: 5034 - RNA, 22 nt, Pseudomonas aeruginosa PA01
cgcggcucggauugccggcgga

SEQ ID NO: 5035 - RNA, 22 nt, Pseudomonas aeruginosa PA01
cgcgggcgucguccucggucau

SEQ ID NO: 5036 - RNA, 22 nt, Pseudomonas aeruginosa PA01
cgcggggcggagagccagccgg

SEQ ID NO: 5037 - RNA, 22 nt, Pseudomonas aeruginosa PA01
cgcggucgccgggguccagcug

SEQ ID NO: 5038 - RNA, 22 nt, Pseudomonas aeruginosa PA01
cgcggugcagcugcucgguggc

SEQ ID NO: 5039 - RNA, 22 nt, Pseudomonas aeruginosa PA01
cgcguacaucggugucggcgcg

SEQ ID NO: 5040 - RNA, 22 nt, Pseudomonas aeruginosa PA01
cgcgucagcgccaggaguuguc

SEQ ID NO: 5041 - RNA, 22 nt, Pseudomonas aeruginosa PA01
cgcgucggccggcaggcucucg

SEQ ID NO: 5042 - RNA, 22 nt, Pseudomonas aeruginosa PA01
cgcgaacauggacuggaaccgg

SEQ ID NO: 5043 - RNA, 22 nt, Pseudomonas aeruginosa PA01
cgcgagccacauccaguugcau

SEQ ID NO: 5044 - RNA, 22 nt, Pseudomonas aeruginosa PA01
cgcgagcgcggcugcuccaucc

SEQ ID NO: 5045 - RNA, 22 nt, Pseudomonas aeruginosa PA01
cgcgaggaaaccucgcuggccg

SEQ ID NO: 5046 - RNA, 22 nt, Pseudomonas aeruginosa PA01
cgcgcacguugauccgccggau

SEQ ID NO: 5047 - RNA, 22 nt, Pseudomonas aeruginosa PA01
cgcgcagcgccaaggauggccu

SEQ ID NO: 5048 - RNA, 22 nt, Pseudomonas aeruginosa PA01
cgcgcaggcgguacaggcggcu

SEQ ID NO: 5049 - RNA, 22 nt, Pseudomonas aeruginosa PA01
cgcgcagggcccgcucgcuggg

SEQ ID NO: 5050 - RNA, 22 nt, Pseudomonas aeruginosa PA01
cgcgcaguuuacccggagaacc

SEQ ID NO: 5051 - RNA, 22 nt, Pseudomonas aeruginosa PA01
cgcgccacccguugcgagagag

SEQ ID NO: 5052 - RNA, 22 nt, Pseudomonas aeruginosa PA01
cgcgccagcagguggcggaugg

SEQ ID NO: 5053 - RNA, 19 nt, Pseudomonas aeruginosa PA01
cgcgccagcgccgccuggg

SEQ ID NO: 5054 - RNA, 22 nt, Pseudomonas aeruginosa PA01
cgcgccggcaggaaaaagcccc

SEQ ID NO: 5055 - RNA, 22 nt, Pseudomonas aeruginosa PA01
cgcgccggugucagcgggccag

SEQ ID NO: 5056 - RNA, 22 nt, Pseudomonas aeruginosa PA01
cgcgcgccgggccuguucaggg

SEQ ID NO: 5057 - RNA, 23 nt, Pseudomonas aeruginosa PA01
cguccggacgacgacccggcguu

SEQ ID NO: 5058 - RNA, 22 nt, Pseudomonas aeruginosa PA01
cguccggcaucagggcguaguc

SEQ ID NO: 5059 - RNA, 22 nt, Pseudomonas aeruginosa PA01
cgucgagcagaccaaccgggcg

SEQ ID NO: 5060 - RNA, 22 nt, Pseudomonas aeruginosa PA01
cgucgagccgggcgagggacuc

SEQ ID NO: 5061 - RNA, 22 nt, Pseudomonas aeruginosa PA01
cgucgagcgccgcuucgucagg

SEQ ID NO: 5062 - RNA, 22 nt, Pseudomonas aeruginosa PA01
cgucggccaggaggugguacgc

SEQ ID NO: 5063 - RNA, 22 nt, Pseudomonas aeruginosa PA01
cgucggccaggcgcaugccgcc

SEQ ID NO: 5064 - RNA, 22 nt, Pseudomonas aeruginosa PA01
cgucggccucgcguugccagcg

SEQ ID NO: 5065 - RNA, 22 nt, Pseudomonas aeruginosa PA01
cgucggccuguggaucgccgcc

SEQ ID NO: 5066 - RNA, 22 nt, Pseudomonas aeruginosa PA01
cgucgugcagcaucgcggccau

SEQ ID NO: 5067 - RNA, 22 nt, Pseudomonas aeruginosa PA01
cguacggcacagcgccuugucc

SEQ ID NO: 5068 - RNA, 22 nt, Pseudomonas aeruginosa PA01
cguagcgcauuuccugggccuu

SEQ ID NO: 5069 - RNA, 22 nt, Pseudomonas aeruginosa PA01
cgugcagcgggugccggaaacc

SEQ ID NO: 5070 - RNA, 20 nt, Pseudomonas aeruginosa PA01
cgugccgggcgguccgcgac

SEQ ID NO: 5071 - RNA, 22 nt, Pseudomonas aeruginosa PA01
cgguccggcggaagcaggucgg

SEQ ID NO: 5072 - RNA, 22 nt, Pseudomonas aeruginosa PA01
cggucgcgcagggcagccggca

SEQ ID NO: 5073 - RNA, 20 nt, Pseudomonas aeruginosa PA01
cggucggcgaggcgccuggc

SEQ ID NO: 5074 - RNA, 22 nt, Pseudomonas aeruginosa PA01
cggucggcuggcuggcgcugcc

SEQ ID NO: 5075 - RNA, 22 nt, Pseudomonas aeruginosa PA01
cggucucuggugaucagcggcu

SEQ ID NO: 5076 - RNA, 22 nt, Pseudomonas aeruginosa PA01
cggugcaggcguuccgcgagcg

SEQ ID NO: 5077 - RNA, 22 nt, Pseudomonas aeruginosa PA01
cggugcgcaugaaggcgaggaa

SEQ ID NO: 5078 - RNA, 22 nt, Pseudomonas aeruginosa PA01
cggugcgccugccguuccugau

SEQ ID NO: 5079 - RNA, 23 nt, Pseudomonas aeruginosa PA01
cggugggcgccggccauggccuc

SEQ ID NO: 5080 - RNA, 20 nt, Pseudomonas aeruginosa PA01
cggugggcugcaucuuuucc

SEQ ID NO: 5081 - RNA, 22 nt, Pseudomonas aeruginosa PA01
cggugggcuggaagguccggcu

SEQ ID NO: 5082 - RNA, 22 nt, Pseudomonas aeruginosa PA01
cguggcagaaggccgaggcgcg

SEQ ID NO: 5083 - RNA, 22 nt, Pseudomonas aeruginosa PA01
cguggcccuggugacccugguc

SEQ ID NO: 5084 - RNA, 22 nt, Pseudomonas aeruginosa PA01
cguggcgagcaggcggucggcg

SEQ ID NO: 5085 - RNA, 22 nt, Pseudomonas aeruginosa PA01
cguggcgaugcccgcauccagc

SEQ ID NO: 5086 - RNA, 22 nt, Pseudomonas aeruginosa PA01
cguggcgaugucggcguggccg

SEQ ID NO: 5087 - RNA, 22 nt, Pseudomonas aeruginosa PA01
cucccggcgaaggcgcgaucgu

SEQ ID NO: 5088 - RNA, 20 nt, Pseudomonas aeruginosa PA01
cucaggccuggagccgagcg

SEQ ID NO: 5089 - RNA, 22 nt, Pseudomonas aeruginosa PA01
cucaggcuggcagcgacgcucc

SEQ ID NO: 5090 - RNA, 22 nt, Pseudomonas aeruginosa PA01
cuccggccaaccgccacggauc

SEQ ID NO: 5091 - RNA, 22 nt, Pseudomonas aeruginosa PA01
cuccggccuucugaaggcucuu

SEQ ID NO: 5092 - RNA, 22 nt, Pseudomonas aeruginosa PA01
cuccggcgugaucagggucucg

SEQ ID NO: 5093 - RNA, 22 nt, Pseudomonas aeruginosa PA01
cuccggcuucggcgagcagagc

SEQ ID NO: 5094 - RNA, 20 nt, Pseudomonas aeruginosa PA01
cuccccgggccauuuccugc

SEQ ID NO: 5095 - RNA, 22 nt, Pseudomonas aeruginosa PA01
cugaacuucgacgguaugauug

SEQ ID NO: 5096 - RNA, 23 nt, Pseudomonas aeruginosa PA01
cucugcuucggcuucuggcccgg

SEQ ID NO: 5097 - RNA, 22 nt, Pseudomonas aeruginosa PA01
cucuucuucguugaucggcgag

SEQ ID NO: 5098 - RNA, 22 nt, Pseudomonas aeruginosa PA01
cuccuucuaucuuggucuacac

SEQ ID NO: 5099 - RNA, 19 nt, Pseudomonas aeruginosa PA01
cucggcccgcuguggcucg

SEQ ID NO: 5100 - RNA, 22 nt, Pseudomonas aeruginosa PA01
cucggcccuggugauccucgcc

SEQ ID NO: 5101 - RNA, 22 nt, Pseudomonas aeruginosa PA01
cucggucagguagccgccuucc

SEQ ID NO: 5102 - RNA, 20 nt, Pseudomonas aeruginosa PA01
cucuacaucgccuucggcgc

SEQ ID NO: 5103 - RNA, 22 nt, Pseudomonas aeruginosa PA01
cucgccggccggacugauggug

SEQ ID NO: 5104 - RNA, 22 nt, Pseudomonas aeruginosa PA01
cucgccggcgccaugcagcagc

SEQ ID NO: 5105 - RNA, 22 nt, Pseudomonas aeruginosa PA01
cucgccggucaccgacgagcgc

SEQ ID NO: 5106 - RNA, 22 nt, Pseudomonas aeruginosa PA01
cuccguggugguggucuugccc

SEQ ID NO: 5107 - RNA, 22 nt, Pseudomonas aeruginosa PA01
cuccugcggcaugggugcguuc

SEQ ID NO: 5108 - RNA, 22 nt, Pseudomonas aeruginosa PA01
cggcugcugcgggucggccuug

SEQ ID NO: 5109 - RNA, 22 nt, Pseudomonas aeruginosa PA01
cggcuggaucucgcacuggcag

SEQ ID NO: 5110 - RNA, 22 nt, Pseudomonas aeruginosa PA01
cggcuguucgucgccggcggug

SEQ ID NO: 5111 - RNA, 22 nt, Pseudomonas aeruginosa PA01
cggcuguuguuucccaaggcgg

SEQ ID NO: 5112 - RNA, 22 nt, Pseudomonas aeruginosa PA01
cggcuucgcgcagggccgccag

SEQ ID NO: 5113 - RNA, 22 nt, Pseudomonas aeruginosa PA01
cggcucgucuuccgggcccugc

SEQ ID NO: 5114 - RNA, 22 nt, Pseudomonas aeruginosa PA01
cggcucguucaucgccaucugc

SEQ ID NO: 5115 - RNA, 22 nt, Pseudomonas aeruginosa PA01
cggcucuggcuaagcucgaccu

SEQ ID NO: 5116 - RNA, 22 nt, Pseudomonas aeruginosa PA01
cgggagcaacgcuaugcccggc

SEQ ID NO: 5117 - RNA, 22 nt, Pseudomonas aeruginosa PA01
cgggagcggaccgccugcucgg

SEQ ID NO: 5118 - RNA, 22 nt, Pseudomonas aeruginosa PA01
cgggauggucgcucggcggcaa

SEQ ID NO: 5119 - RNA, 22 nt, Pseudomonas aeruginosa PA01
cgggcagcaccucgccagccgg

SEQ ID NO: 5120 - RNA, 22 nt, Pseudomonas aeruginosa PA01
cgggcagcgcauccgacagcgc

SEQ ID NO: 5121 - RNA, 22 nt, Pseudomonas aeruginosa PA01
cggcuccauggccagggcgcgg

SEQ ID NO: 5122 - RNA, 22 nt, Pseudomonas aeruginosa PA01
cggcucccggcuggccgcugaa

SEQ ID NO: 5123 - RNA, 22 nt, Pseudomonas aeruginosa PA01
cgggccaggcacuacgugcucu

SEQ ID NO: 5124 - RNA, 22 nt, Pseudomonas aeruginosa PA01
cgggccaguuggaccaggaucg

SEQ ID NO: 5125 - RNA, 22 nt, Pseudomonas aeruginosa PA01
cgggcgaggguaccgggagcua

SEQ ID NO: 5126 - RNA, 22 nt, Pseudomonas aeruginosa PA01
cgggcgccgggugcucccgguc

SEQ ID NO: 5127 - RNA, 22 nt, Pseudomonas aeruginosa PA01
cgggcgccguggaucagccgcg

SEQ ID NO: 5128 - RNA, 22 nt, Pseudomonas aeruginosa PA01
cggggcaagcuguccggaccgc

SEQ ID NO: 5129 - RNA, 22 nt, Pseudomonas aeruginosa PA01
cggggccacgugccagcaggag

SEQ ID NO: 5130 - RNA, 22 nt, Pseudomonas aeruginosa PA01
cggggagccucgucgacgaggc

SEQ ID NO: 5131 - RNA, 22 nt, Pseudomonas aeruginosa PA01
cggguggucuucgagcguccgc

SEQ ID NO: 5132 - RNA, 22 nt, Pseudomonas aeruginosa PA01
cgguagcgguccgugcccagcc

SEQ ID NO: 5133 - RNA, 22 nt, Pseudomonas aeruginosa PA01
cggcgaacgggaaggugccgac

SEQ ID NO: 5134 - RNA, 22 nt, Pseudomonas aeruginosa PA01
cggcgaccacguugggguucuc

SEQ ID NO: 5135 - RNA, 23 nt, Pseudomonas aeruginosa PA01
cggcgaccagcgccgccaggcag

SEQ ID NO: 5136 - RNA, 22 nt, Pseudomonas aeruginosa PA01
cggcgaccugcgcgugcaguuc

SEQ ID NO: 5137 - RNA, 22 nt, Pseudomonas aeruginosa PA01
cggcgacgaucaucuucggcuu

SEQ ID NO: 5138 - RNA, 22 nt, Pseudomonas aeruginosa PA01
cggcgagcaacgccaggugcag

SEQ ID NO: 5139 - RNA, 22 nt, Pseudomonas aeruginosa PA01
cggcgagccguccuugcgcaga

SEQ ID NO: 5140 - RNA, 22 nt, Pseudomonas aeruginosa PA01
cggcgagcugcuccgcguggcu

SEQ ID NO: 5141 - RNA, 22 nt, Pseudomonas aeruginosa PA01
cggcgaggaucugcguggucgc

SEQ ID NO: 5142 - RNA, 22 nt, Pseudomonas aeruginosa PA01
cggcgaucugcucggcgagggc

SEQ ID NO: 5143 - RNA, 22 nt, Pseudomonas aeruginosa PA01
cggcgcaggaaagggaucugcg

SEQ ID NO: 5144 - RNA, 22 nt, Pseudomonas aeruginosa PA01
cggcgcaggaugggcguggacg

SEQ ID NO: 5145 - RNA, 22 nt, Pseudomonas aeruginosa PA01
cggcgcaggguauggcgguuca

SEQ ID NO: 5146 - RNA, 22 nt, Pseudomonas aeruginosa PA01
cggcgccaacgaggcggcgaug

SEQ ID NO: 5147 - RNA, 22 nt, Pseudomonas aeruginosa PA01
cggcgccgacaucgcgcagguc

SEQ ID NO: 5148 - RNA, 22 nt, Pseudomonas aeruginosa PA01
cggcgcgccagaccaccugguc

SEQ ID NO: 5149 - RNA, 22 nt, Pseudomonas aeruginosa PA01
cggcgcgccgaaggcgauaugg

SEQ ID NO: 5150 - RNA, 20 nt, Pseudomonas aeruginosa PA01
cggcgcgcuggcuaccggcc

SEQ ID NO: 5151 - RNA, 22 nt, Pseudomonas aeruginosa PA01
cggcgcgcuggugaucggcugg

SEQ ID NO: 5152 - RNA, 23 nt, Pseudomonas aeruginosa PA01
cggcgcuuccugcaccuggcgcc

SEQ ID NO: 5153 - RNA, 22 nt, Pseudomonas aeruginosa PA01
cggcggcacaggcggccugcac

SEQ ID NO: 5154 - RNA, 22 nt, Pseudomonas aeruginosa PA01
cggcggcagguuuucucgacgc

SEQ ID NO: 5155 - RNA, 22 nt, Pseudomonas aeruginosa PA01
cggcggccuugccgcucugcuc

SEQ ID NO: 5156 - RNA, 22 nt, Pseudomonas aeruginosa PA01
cggcgggcauagccgagcagcg

SEQ ID NO: 5157 - RNA, 22 nt, Pseudomonas aeruginosa PA01
cggcgggcugcuggugagccag

SEQ ID NO: 5158 - RNA, 22 nt, Pseudomonas aeruginosa PA01
cggcguacgcuggaggcgaugc

SEQ ID NO: 5159 - RNA, 22 nt, Pseudomonas aeruginosa PA01
cggcguccuggaucagcgccug

SEQ ID NO: 5160 - RNA, 22 nt, Pseudomonas aeruginosa PA01
cggcguccuggucccggugcuc

SEQ ID NO: 5161 - RNA, 22 nt, Pseudomonas aeruginosa PA01
cggcuacccuggaguccgggcc

SEQ ID NO: 5162 - RNA, 22 nt, Pseudomonas aeruginosa PA01
cggcuacgccuacgugcccggc

SEQ ID NO: 5163 - RNA, 22 nt, Pseudomonas aeruginosa PA01
cggccagccaggcccgcaccag

SEQ ID NO: 5164 - RNA, 22 nt, Pseudomonas aeruginosa PA01
cggccaggccccggucgauggc

SEQ ID NO: 5165 - RNA, 22 nt, Pseudomonas aeruginosa PA01
cggccagggcaaugucgaagcc

SEQ ID NO: 5166 - RNA, 22 nt, Pseudomonas aeruginosa PA01
cggcauccuggcgguucugggu

SEQ ID NO: 5167 - RNA, 22 nt, Pseudomonas aeruginosa PA01
cggcauccagcagggucuggua

SEQ ID NO: 5168 - RNA, 22 nt, Pseudomonas aeruginosa PA01
cggcccgccguaggccugcgcu

SEQ ID NO: 5169 - RNA, 22 nt, Pseudomonas aeruginosa PA01
cggcccggcauggaccccggcg

SEQ ID NO: 5170 - RNA, 21 nt, Pseudomonas aeruginosa PA01
cggccgagcgcugguaccgcg

SEQ ID NO: 5171 - RNA, 22 nt, Pseudomonas aeruginosa PA01
cggccgaggaaauagcccuggc

SEQ ID NO: 5172 - RNA, 22 nt, Pseudomonas aeruginosa PA01
cggccgcgccuuuggcauggcc

SEQ ID NO: 5173 - RNA, 22 nt, Pseudomonas aeruginosa PA01
cggccggacgcucgccgggcag

SEQ ID NO: 5174 - RNA, 20 nt, Pseudomonas aeruginosa PA01
cggccggcaggugaucgaac

SEQ ID NO: 5175 - RNA, 21 nt, Pseudomonas aeruginosa PA01
cggccgggagcgccuggaugc

SEQ ID NO: 5176 - RNA, 22 nt, Pseudomonas aeruginosa PA01
cggccuggccauggcgguggac

SEQ ID NO: 5177 - RNA, 22 nt, Pseudomonas aeruginosa PA01
cggccuggcugaacgacagcgu

SEQ ID NO: 5178 - RNA, 22 nt, Pseudomonas aeruginosa PA01
cggcagcagcgccggcgaggag

SEQ ID NO: 5179 - RNA, 22 nt, Pseudomonas aeruginosa PA01
cggcagcgccucgccacgcucc

SEQ ID NO: 5180 - RNA, 22 nt, Pseudomonas aeruginosa PA01
cggcagcggcgggccguugacc

SEQ ID NO: 5181 - RNA, 22 nt, Pseudomonas aeruginosa PA01
cggaggcguggguuucgcauuc

SEQ ID NO: 5182 - RNA, 22 nt, Pseudomonas aeruginosa PA01
cggaucuucuccaucgccgcuu

SEQ ID NO: 5183 - RNA, 22 nt, Pseudomonas aeruginosa PA01
cggcacagaggccgggcccuga

SEQ ID NO: 5184 - RNA, 22 nt, Pseudomonas aeruginosa PA01
cggcaccgcugaagccggcgac

SEQ ID NO: 5185 - RNA, 22 nt, Pseudomonas aeruginosa PA01
cggagcgcccuugagcuugggu

SEQ ID NO: 5186 - RNA, 22 nt, Pseudomonas aeruginosa PA01
cggagcgugccggcgagggucg

SEQ ID NO: 5187 - RNA, 22 nt, Pseudomonas aeruginosa PA01
cggagcugaacgccgagcgcuu

SEQ ID NO: 5188 - RNA, 22 nt, Pseudomonas aeruginosa PA01
cggaggaagccaccggacucga

SEQ ID NO: 5189 - RNA, 22 nt, Pseudomonas aeruginosa PA01
cggaacagcgagccgacgccgg

SEQ ID NO: 5190 - RNA, 20 nt, Pseudomonas aeruginosa PA01
cggaagugguggucgccggg

SEQ ID NO: 5191 - RNA, 22 nt, Pseudomonas aeruginosa PA01
cggacgccagcgugcccggcua

SEQ ID NO: 5192 - RNA, 22 nt, Pseudomonas aeruginosa PA01
cggacgcccgguguaggugcug

SEQ ID NO: 5193 - RNA, 22 nt, Pseudomonas aeruginosa PA01
cggacgcggauuggccgccucg

SEQ ID NO: 5194 - RNA, 22 nt, Pseudomonas aeruginosa PA01
cgcugccgacccggaggauuuc

SEQ ID NO: 5195 - RNA, 22 nt, Pseudomonas aeruginosa PA01
cgcugcgcgguguccucggcga

SEQ ID NO: 5196 - RNA, 22 nt, Pseudomonas aeruginosa PA01
cgcuggagacccuggauuucgc

SEQ ID NO: 5197 - RNA, 22 nt, Pseudomonas aeruginosa PA01
cgcuggagagugccucccaggg

SEQ ID NO: 5198 - RNA, 22 nt, Pseudomonas aeruginosa PA01
cgcuggaguuggccaacgccag

SEQ ID NO: 5199 - RNA, 22 nt, Pseudomonas aeruginosa PA01
cgcuggcgcaccagcuugccga

SEQ ID NO: 5200 - RNA, 22 nt, Pseudomonas aeruginosa PA01
cgcuggcgccgguggcggugga

SEQ ID NO: 5201 - RNA, 22 nt, Pseudomonas aeruginosa PA01
cgccugggcgaacucgccccgc

SEQ ID NO: 5202 - RNA, 22 nt, Pseudomonas aeruginosa PA01
cgccugggcgcgguguaccagc

SEQ ID NO: 5203 - RNA, 18 nt, Pseudomonas aeruginosa PA01
cgccucgccgcugcgguc

SEQ ID NO: 5204 - RNA, 22 nt, Pseudomonas aeruginosa PA01
cgcugcagaccgagcccggcca

SEQ ID NO: 5205 - RNA, 22 nt, Pseudomonas aeruginosa PA01
cgcugcagccacucggccaggu

SEQ ID NO: 5206 - RNA, 22 nt, Pseudomonas aeruginosa PA01
cgcugcagccgcagauggccuu

SEQ ID NO: 5207 - RNA, 22 nt, Pseudomonas aeruginosa PA01
cgcugcaggaucaguucguggu

SEQ ID NO: 5208 - RNA, 22 nt, Pseudomonas aeruginosa PA01
cgcugcagguauucggugccug

SEQ ID NO: 5209 - RNA, 22 nt, Pseudomonas aeruginosa PA01
cgcuccgggucgaucugcuggc

SEQ ID NO: 5210 - RNA, 19 nt, Pseudomonas aeruginosa PA01
cgcuccucugcccgguggc

SEQ ID NO: 5211 - RNA, 22 nt, Pseudomonas aeruginosa PA01
auggcgcguuguccucgccgcc

SEQ ID NO: 5212 - RNA, 22 nt, Pseudomonas aeruginosa PA01
augccgaaggcgaucgaggcga

SEQ ID NO: 5213 - RNA, 22 nt, Pseudomonas aeruginosa PA01
augccgaggaaaccgccgcacc

SEQ ID NO: 5214 - RNA, 22 nt, Pseudomonas aeruginosa PA01
augccggccaccggagccggcg

SEQ ID NO: 5215 - RNA, 22 nt, Pseudomonas aeruginosa PA01
augccggcgaugggcgacuucg

SEQ ID NO: 5216 - RNA, 22 nt, Pseudomonas aeruginosa PA01
augccggcgccaacggugccgu

SEQ ID NO: 5217 - RNA, 22 nt, Pseudomonas aeruginosa PA01
augccgucucagccagcgcagg

SEQ ID NO: 5218 - RNA, 22 nt, Pseudomonas aeruginosa PA01
augcgcccugcccgucugcugg

SEQ ID NO: 5219 - RNA, 19 nt, Pseudomonas aeruginosa PA01
augcggaugccguggcggc

SEQ ID NO: 5220 - RNA, 22 nt, Pseudomonas aeruginosa PA01
augcggcagguggcgaagaccg

SEQ ID NO: 5221 - RNA, 20 nt, Pseudomonas aeruginosa PA01
augcugaauucgccgccggc

SEQ ID NO: 5222 - RNA, 22 nt, Pseudomonas aeruginosa PA01
aucaggccgcaggcguggcccu

SEQ ID NO: 5223 - RNA, 22 nt, Pseudomonas aeruginosa PA01
aucacaccggaauacaucggcg

SEQ ID NO: 5224 - RNA, 22 nt, Pseudomonas aeruginosa PA01
aucagcccggcgaucccgccug

SEQ ID NO: 5225 - RNA, 22 nt, Pseudomonas aeruginosa PA01
aucagcgggaucagcaugccgc

SEQ ID NO: 5226 - RNA, 22 nt, Pseudomonas aeruginosa PA01
auccccggauugcucaggcggu

SEQ ID NO: 5227 - RNA, 22 nt, Pseudomonas aeruginosa PA01
aucccggccucgaugccgcgug

SEQ ID NO: 5228 - RNA, 22 nt, Pseudomonas aeruginosa PA01
auccgucgcgccgcuaccaucc

SEQ ID NO: 5229 - RNA, 22 nt, Pseudomonas aeruginosa PA01
aucgagcgggcgccucggcgug

SEQ ID NO: 5230 - RNA, 22 nt, Pseudomonas aeruginosa PA01
aucuggagcaacaggucgcggg

SEQ ID NO: 5231 - RNA, 22 nt, Pseudomonas aeruginosa PA01
aucggcccucugcggcaggcgg

SEQ ID NO: 5232 - RNA, 22 nt, Pseudomonas aeruginosa PA01
auaggagaaguccgaggcgauu

SEQ ID NO: 5233 - RNA, 22 nt, Pseudomonas aeruginosa PA01
aggauccgccagggugucgcgc

SEQ ID NO: 5234 - RNA, 22 nt, Pseudomonas aeruginosa PA01
aggcagcgaauccccagugaug

SEQ ID NO: 5235 - RNA, 22 nt, Pseudomonas aeruginosa PA01
aggaugaguuccagcgccuuca

SEQ ID NO: 5236 - RNA, 22 nt, Pseudomonas aeruginosa PA01
aggcagugggcgaggaugucgg

SEQ ID NO: 5237 - RNA, 22 nt, Pseudomonas aeruginosa PA01
aggcuuccuucaacuugucgcc

SEQ ID NO: 5238 - RNA, 22 nt, Pseudomonas aeruginosa PA01
agggcgaggccguucgccucgu

SEQ ID NO: 5239 - RNA, 22 nt, Pseudomonas aeruginosa PA01
agggcgaggucagcguggacgc

SEQ ID NO: 5240 - RNA, 22 nt, Pseudomonas aeruginosa PA01
agggcgcggucgccgucgaaca

SEQ ID NO: 5241 - RNA, 22 nt, Pseudomonas aeruginosa PA01
agggcgcguaacugguggucga

SEQ ID NO: 5242 - RNA, 22 nt, Pseudomonas aeruginosa PA01
agggcgggaacugcgcgcgcag

SEQ ID NO: 5243 - RNA, 22 nt, Pseudomonas aeruginosa PA01
agguggagcguugcggcgccgg

SEQ ID NO: 5244 - RNA, 22 nt, Pseudomonas aeruginosa PA01
agguugauguacaucauggcgu

SEQ ID NO: 5245 - RNA, 23 nt, Pseudomonas aeruginosa PA01
agucgcgcgcccuggucggcccg

SEQ ID NO: 5246 - RNA, 22 nt, Pseudomonas aeruginosa PA01
agucgcugaugaaguucaccgc

SEQ ID NO: 5247 - RNA, 22 nt, Pseudomonas aeruginosa PA01
aggagcgcgcggugaucgcccu

SEQ ID NO: 5248 - RNA, 22 nt, Pseudomonas aeruginosa PA01
aggaggaagcgcgccagcaguu

SEQ ID NO: 5249 - RNA, 22 nt, Pseudomonas aeruginosa PA01
aggaggcgucggcgucgcccgc

SEQ ID NO: 5250 - RNA, 22 nt, Pseudomonas aeruginosa PA01
agccgugcuguccggagcggau

SEQ ID NO: 5251 - RNA, 22 nt, Pseudomonas aeruginosa PA01
aggaacaguucgacgcccaggu

SEQ ID NO: 5252 - RNA, 22 nt, Pseudomonas aeruginosa PA01
aggccagcggacgcgacgccuu

SEQ ID NO: 5253 - RNA, 22 nt, Pseudomonas aeruginosa PA01
aggccagcgggucgcgccacag

SEQ ID NO: 5254 - RNA, 22 nt, Pseudomonas aeruginosa PA01
aggccgaagcgcugcgccagca

SEQ ID NO: 5255 - RNA, 22 nt, Pseudomonas aeruginosa PA01
aggccgaccugcagcgccgccg

SEQ ID NO: 5256 - RNA, 22 nt, Pseudomonas aeruginosa PA01
aggccgagcgcgaagccuuguc

SEQ ID NO: 5257 - RNA, 22 nt, Pseudomonas aeruginosa PA01
aggccgaguugcgccaggacga

SEQ ID NO: 5258 - RNA, 22 nt, Pseudomonas aeruginosa PA01
aggccgcacgccuggucgggcu

SEQ ID NO: 5259 - RNA, 22 nt, Pseudomonas aeruginosa PA01
aggccgcgcuuuccggcuccag

SEQ ID NO: 5260 - RNA, 22 nt, Pseudomonas aeruginosa PA01
aggccggcgccgaggccagugc

SEQ ID NO: 5261 - RNA, 22 nt, Pseudomonas aeruginosa PA01
aggccggcuaccucgaaggcgg

SEQ ID NO: 5262 - RNA, 22 nt, Pseudomonas aeruginosa PA01
aggccggcuuucagcgcggcca

SEQ ID NO: 5263 - RNA, 22 nt, Pseudomonas aeruginosa PA01
aggccggggugaccaagccggu

SEQ ID NO: 5264 - RNA, 22 nt, Pseudomonas aeruginosa PA01
aggccggguagcgccucgcugg

SEQ ID NO: 5265 - RNA, 22 nt, Pseudomonas aeruginosa PA01
aggccggguugauggccaggau

SEQ ID NO: 5266 - RNA, 22 nt, Pseudomonas aeruginosa PA01
aggcgcaggcgcaacuggcaga

SEQ ID NO: 5267 - RNA, 22 nt, Pseudomonas aeruginosa PA01
aggcgccgcuugaugguuucgg

SEQ ID NO: 5268 - RNA, 22 nt, Pseudomonas aeruginosa PA01
aggcgccgcuugauguucugca

SEQ ID NO: 5269 - RNA, 22 nt, Pseudomonas aeruginosa PA01
aggcgccguugcgcgaggcuuu

SEQ ID NO: 5270 - RNA, 22 nt, Pseudomonas aeruginosa PA01
aggcgcgccaggucggacaggu

SEQ ID NO: 5271 - RNA, 22 nt, Pseudomonas aeruginosa PA01
aggcggcgcaggccgagaccga

SEQ ID NO: 5272 - RNA, 22 nt, Pseudomonas aeruginosa PA01
aggcuacgaccgauuucagccg

SEQ ID NO: 5273 - RNA, 22 nt, Pseudomonas aeruginosa PA01
aggcucaggcaggccgccggca

SEQ ID NO: 5274 - RNA, 19 nt, Pseudomonas aeruginosa PA01
agcuggcgcagcagggugc

SEQ ID NO: 5275 - RNA, 22 nt, Pseudomonas aeruginosa PA01
agcuccggcuugaucaggucgg

SEQ ID NO: 5276 - RNA, 19 nt, Pseudomonas aeruginosa PA01
agcucgcgguugccggcau

SEQ ID NO: 5277 - RNA, 18 nt, Pseudomonas aeruginosa PA01
agcugcgacggcuggugg

SEQ ID NO: 5278 - RNA, 22 nt, Pseudomonas aeruginosa PA01
agcugcgcgaaggcgauacgcu

SEQ ID NO: 5279 - RNA, 22 nt, Pseudomonas aeruginosa PA01
agcugcgcgacgaggucggcca

SEQ ID NO: 5280 - RNA, 22 nt, Pseudomonas aeruginosa PA01
agcuggaagaucaccuguucga

SEQ ID NO: 5281 - RNA, 22 nt, Pseudomonas aeruginosa PA01
agcuggaaggccagcucgcggc

SEQ ID NO: 5282 - RNA, 22 nt, Pseudomonas aeruginosa PA01
agcuggagcgugaguucgccgc

SEQ ID NO: 5283 - RNA, 23 nt, Pseudomonas aeruginosa PA01
agcuggauggccgccugcuguuc

SEQ ID NO: 5284 - RNA, 22 nt, Pseudomonas aeruginosa PA01
agccguccagcuugagguaggc

SEQ ID NO: 5285 - RNA, 22 nt, Pseudomonas aeruginosa PA01
agccggaguugaccccgccguu

SEQ ID NO: 5286 - RNA, 22 nt, Pseudomonas aeruginosa PA01
agccggcgccaugcgucauggc

SEQ ID NO: 5287 - RNA, 22 nt, Pseudomonas aeruginosa PA01
agccggcggccucggcggccuc

SEQ ID NO: 5288 - RNA, 20 nt, Pseudomonas aeruginosa PA01
agcgacccuugagcgccggc

SEQ ID NO: 5289 - RNA, 22 nt, Pseudomonas aeruginosa PA01
agcgaccgguguagcgccggcu

SEQ ID NO: 5290 - RNA, 22 nt, Pseudomonas aeruginosa PA01
agcgaggcgucuggcacggcga

SEQ ID NO: 5291 - RNA, 22 nt, Pseudomonas aeruginosa PA01
agcgcagcaaugccaccgugca

SEQ ID NO: 5292 - RNA, 22 nt, Pseudomonas aeruginosa PA01
agcgcagcaggcaggccuggua

SEQ ID NO: 5293 - RNA, 22 nt, Pseudomonas aeruginosa PA01
agcgcagcgagcgcaaucuccu

SEQ ID NO: 5294 - RNA, 22 nt, Pseudomonas aeruginosa PA01
agcgccacgguggcgccgguga

SEQ ID NO: 5295 - RNA, 22 nt, Pseudomonas aeruginosa PA01
agcgcccgcgcaacugggaaag

SEQ ID NO: 5296 - RNA, 22 nt, Pseudomonas aeruginosa PA01
agcgccgcguccagcuccaggc

SEQ ID NO: 5297 - RNA, 22 nt, Pseudomonas aeruginosa PA01
agcgccucgcgcucggcaugac

SEQ ID NO: 5298 - RNA, 22 nt, Pseudomonas aeruginosa PA01
agcgcgaggccagccagcaacu

SEQ ID NO: 5299 - RNA, 22 nt, Pseudomonas aeruginosa PA01
agcgcgcacgcacacccagcuc

SEQ ID NO: 5300 - RNA, 22 nt, Pseudomonas aeruginosa PA01
agcgcgccaucaggcgguucga

SEQ ID NO: 5301 - RNA, 22 nt, Pseudomonas aeruginosa PA01
agcgcgcccuggagcacaaggu

SEQ ID NO: 5302 - RNA, 22 nt, Pseudomonas aeruginosa PA01
agcgcgcgcugaaugccgugga

SEQ ID NO: 5303 - RNA, 22 nt, Pseudomonas aeruginosa PA01
agcgcgcggaagcugucgucca

SEQ ID NO: 5304 - RNA, 22 nt, Pseudomonas aeruginosa PA01
agcgcgcggacuaccggguggc

SEQ ID NO: 5305 - RNA, 22 nt, Pseudomonas aeruginosa PA01
agcgcggcaagauguucggcuu

SEQ ID NO: 5306 - RNA, 22 nt, Pseudomonas aeruginosa PA01
agcgcggccggcucgacgaggu

SEQ ID NO: 5307 - RNA, 21 nt, Pseudomonas aeruginosa PA01
agcgcggcgccgaauaucggg

SEQ ID NO: 5308 - RNA, 22 nt, Pseudomonas aeruginosa PA01
agcgcggcggguauugcgacau

SEQ ID NO: 5309 - RNA, 22 nt, Pseudomonas aeruginosa PA01
agcgcgugguucagcagcacau

SEQ ID NO: 5310 - RNA, 22 nt, Pseudomonas aeruginosa PA01
agcggcagcaacgccagucccu

SEQ ID NO: 5311 - RNA, 22 nt, Pseudomonas aeruginosa PA01
agcggccggaugagccagggca

SEQ ID NO: 5312 - RNA, 22 nt, Pseudomonas aeruginosa PA01
agcggcgccagcaggugaugga

SEQ ID NO: 5313 - RNA, 22 nt, Pseudomonas aeruginosa PA01
agcggcgccuucaagcgucuca

SEQ ID NO: 5314 - RNA, 22 nt, Pseudomonas aeruginosa PA01
agcggcgcgacaccgagcagug

SEQ ID NO: 5315 - RNA, 22 nt, Pseudomonas aeruginosa PA01
agcggcgcggugguuggcgugc

SEQ ID NO: 5316 - RNA, 22 nt, Pseudomonas aeruginosa PA01
agcggcggccccggcaacagcg

SEQ ID NO: 5317 - RNA, 22 nt, Pseudomonas aeruginosa PA01
agcggcgggugcugcuggaccu

SEQ ID NO: 5318 - RNA, 22 nt, Pseudomonas aeruginosa PA01
agcggcggugccugaacuggag

SEQ ID NO: 5319 - RNA, 22 nt, Pseudomonas aeruginosa PA01
agcggcgugcgcagcucguggg

SEQ ID NO: 5320 - RNA, 22 nt, Pseudomonas aeruginosa PA01
agcgggagaucgccaguugaug

SEQ ID NO: 5321 - RNA, 22 nt, Pseudomonas aeruginosa PA01
agcgggcguuugcggcgaccug

SEQ ID NO: 5322 - RNA, 22 nt, Pseudomonas aeruginosa PA01
agcguggccuucuccucggaca

SEQ ID NO: 5323 - RNA, 22 nt, Pseudomonas aeruginosa PA01
agcguggcuggcggucaccggg

SEQ ID NO: 5324 - RNA, 22 nt, Pseudomonas aeruginosa PA01
agccagcccugggcgucgcuca

SEQ ID NO: 5325 - RNA, 22 nt, Pseudomonas aeruginosa PA01
agcaggucagcggcaugccgcu

SEQ ID NO: 5326 - RNA, 22 nt, Pseudomonas aeruginosa PA01
agcagguccuucgagcgacccg

SEQ ID NO: 5327 - RNA, 22 nt, Pseudomonas aeruginosa PA01
agcaggucguggccggccaggg

SEQ ID NO: 5328 - RNA, 22 nt, Pseudomonas aeruginosa PA01
agcagcgccugaaggaagucga

SEQ ID NO: 5329 - RNA, 22 nt, Pseudomonas aeruginosa PA01
agcagcggguggccaugggccg

SEQ ID NO: 5330 - RNA, 22 nt, Pseudomonas aeruginosa PA01
agcagcaggccgcccagggucg

SEQ ID NO: 5331 - RNA, 22 nt, Pseudomonas aeruginosa PA01
agcaggccggcgauggcgucgc

SEQ ID NO: 5332 - RNA, 22 nt, Pseudomonas aeruginosa PA01
agcaggcgaucgagcaugccgc

SEQ ID NO: 5333 - RNA, 22 nt, Pseudomonas aeruginosa PA01
agcaggcggcgguccagcucgc

SEQ ID NO: 5334 - RNA, 22 nt, Pseudomonas aeruginosa PA01
accacgagaccgaccagcaggc

SEQ ID NO: 5335 - RNA, 22 nt, Pseudomonas aeruginosa PA01
accacgagcgcgagcugucgac

SEQ ID NO: 5336 - RNA, 22 nt, Pseudomonas aeruginosa PA01
accagcgcgaacaggccgggau

SEQ ID NO: 5337 - RNA, 22 nt, Pseudomonas aeruginosa PA01
accaggccgccgccuuccucgu

SEQ ID NO: 5338 - RNA, 22 nt, Pseudomonas aeruginosa PA01
accaguccgccagggccgccgg

SEQ ID NO: 5339 - RNA, 23 nt, Pseudomonas aeruginosa PA01
accagcaggacagcuucgacuuc

SEQ ID NO: 5340 - RNA, 22 nt, Pseudomonas aeruginosa PA01
acagccuggaaggcgcggaaga

SEQ ID NO: 5341 - RNA, 22 nt, Pseudomonas aeruginosa PA01
acagcgcguggagguucuccag

SEQ ID NO: 5342 - RNA, 22 nt, Pseudomonas aeruginosa PA01
acgccggccuggagggcgcucg

SEQ ID NO: 5343 - RNA, 22 nt, Pseudomonas aeruginosa PA01
acgcgcgcaaccgacggcaggg

SEQ ID NO: 5344 - RNA, 22 nt, Pseudomonas aeruginosa PA01
acgcagcgcaugcucguagccg

SEQ ID NO: 5345 - RNA, 22 nt, Pseudomonas aeruginosa PA01
acgaugcgcuccgaguagccgc

SEQ ID NO: 5346 - RNA, 22 nt, Pseudomonas aeruginosa PA01
acgucggcggcaugcugcgcuc

SEQ ID NO: 5347 - RNA, 23 nt, Pseudomonas aeruginosa PA01
acgucggcugggagcguucgcgc

SEQ ID NO: 5348 - RNA, 22 nt, Pseudomonas aeruginosa PA01
acggaagcgauccgugccuggu

SEQ ID NO: 5349 - RNA, 22 nt, Pseudomonas aeruginosa PA01
acggaagcggaagaaccaggcc

SEQ ID NO: 5350 - RNA, 22 nt, Pseudomonas aeruginosa PA01
acggcagccugcggcugcuggu

SEQ ID NO: 5351 - RNA, 22 nt, Pseudomonas aeruginosa PA01
acggcucccaagcucagcgacg

SEQ ID NO: 5352 - RNA, 22 nt, Pseudomonas aeruginosa PA01
accggcagaccaucggcggcua

SEQ ID NO: 5353 - RNA, 22 nt, Pseudomonas aeruginosa PA01
acccggaccgaggucaaguaag

SEQ ID NO: 5354 - RNA, 22 nt, Pseudomonas aeruginosa PA01
accccgggcacccugacggcuu

SEQ ID NO: 5355 - RNA, 22 nt, Pseudomonas aeruginosa PA01
accgucggccuggccgcugcgc

SEQ ID NO: 5356 - RNA, 22 nt, Pseudomonas aeruginosa PA01
accuggagcuggaggccuugcc

SEQ ID NO: 5357 - RNA, 22 nt, Pseudomonas aeruginosa PA01
accugagcgucggcggcgcggu

SEQ ID NO: 5358 - RNA, 22 nt, Pseudomonas aeruginosa PA01
acccuggaauugcagggcuacc

SEQ ID NO: 5359 - RNA, 22 nt, Pseudomonas aeruginosa PA01
agaucuggaacgacuuccuguu

SEQ ID NO: 5360 - RNA, 22 nt, Pseudomonas aeruginosa PA01
agaggccgcgcucgccgagcau

SEQ ID NO: 5361 - RNA, 22 nt, Pseudomonas aeruginosa PA01
agcaccccgccgaccagcauca

SEQ ID NO: 5362 - RNA, 22 nt, Pseudomonas aeruginosa PA01
agcaccagguaggacagcgccu

SEQ ID NO: 5363 - RNA, 22 nt, Pseudomonas aeruginosa PA01
agcacgcgcucguagccgaugu

SEQ ID NO: 5364 - RNA, 22 nt, Pseudomonas aeruginosa PA01
agagcgaggccaggcgccugga

SEQ ID NO: 5365 - RNA, 22 nt, Pseudomonas aeruginosa PA01
agagcgccgccagcgucacagu

SEQ ID NO: 5366 - RNA, 19 nt, Pseudomonas aeruginosa PA01
agagcgcggugaucgagcc

SEQ ID NO: 5367 - RNA, 22 nt, Pseudomonas aeruginosa PA01
agagcggccugcgcuucggcga

SEQ ID NO: 5368 - RNA, 22 nt, Pseudomonas aeruginosa PA01
agagcggcuugcuggucggcgc

SEQ ID NO: 5369 - RNA, 22 nt, Pseudomonas aeruginosa PA01
agaccaggccggacagguacca

SEQ ID NO: 5370 - RNA, 22 nt, Pseudomonas aeruginosa PA01
agacccagcuccggggucucug

SEQ ID NO: 5371 - RNA, 22 nt, Pseudomonas aeruginosa PA01
acugggaucggccagcuugcgg

SEQ ID NO: 5372 - RNA, 22 nt, Pseudomonas aeruginosa PA01
acuccggccgccgcacgccagg

SEQ ID NO: 5373 - RNA, 22 nt, Pseudomonas aeruginosa PA01
aaguggcguucggcgaacgcgg

SEQ ID NO: 5374 - RNA, 20 nt, Pseudomonas aeruginosa PA01
aaggcauggguuuuucgucg

SEQ ID NO: 5375 - RNA, 22 nt, Pseudomonas aeruginosa PA01
aaggaugcgccagcggcaacca

SEQ ID NO: 5376 - RNA, 22 nt, Pseudomonas aeruginosa PA01
aauagcggcuuuucgaugcgca

SEQ ID NO: 5377 - RNA, 22 nt, Pseudomonas aeruginosa PA01
acaacugcguggacggcgugga

SEQ ID NO: 5378 - RNA, 22 nt, Pseudomonas aeruginosa PA01
aacuggaggacauccagguccu

SEQ ID NO: 5379 - RNA, 22 nt, Pseudomonas aeruginosa PA01
aacugagucucggcaaucauag

SEQ ID NO: 5380 - RNA, 22 nt, Pseudomonas aeruginosa PA01
aacgcgagguggugcggcucgg

SEQ ID NO: 5381 - RNA, 22 nt, Pseudomonas aeruginosa PA01
aacggcagcgccuccggcagcu

SEQ ID NO: 5382 - RNA, 22 nt, Pseudomonas aeruginosa PA01
aagcgaucggcgcggcugaucg

SEQ ID NO: 5383 - RNA, 22 nt, Pseudomonas aeruginosa PA01
aagagugcgccguuggggugaa

SEQ ID NO: 5384 - RNA, 22 nt, Pseudomonas aeruginosa PA01
aaacugcaugagcggcucgacc

SEQ ID NO: 5385 - RNA, 22 nt, Pseudomonas aeruginosa PA01
guacucgcgggcaagcuuggcg

SEQ ID NO: 5386 - RNA, 22 nt, Pseudomonas aeruginosa PA01
guagcccuggccgagguccggg

SEQ ID NO: 5387 - RNA, 21 nt, Pseudomonas aeruginosa PA01
guagccguggaccuggcagcc

SEQ ID NO: 5388 - RNA, 22 nt, Pseudomonas aeruginosa PA01
gguugcgguugugguugagcag

SEQ ID NO: 5389 - RNA, 22 nt, Pseudomonas aeruginosa PA01
guacaucgucgucgcccugguc

SEQ ID NO: 5390 - RNA, 22 nt, Pseudomonas aeruginosa PA01
gucaggccgaagaucgcgccgc

SEQ ID NO: 5391 - RNA, 22 nt, Pseudomonas aeruginosa PA01
ggucggccaguuguccuucgag

SEQ ID NO: 5392 - RNA, 22 nt, Pseudomonas aeruginosa PA01
ggucgggaugcgcaggcggccg

SEQ ID NO: 5393 - RNA, 22 nt, Pseudomonas aeruginosa PA01
gguccugcaacugaaacgggug

SEQ ID NO: 5394 - RNA, 22 nt, Pseudomonas aeruginosa PA01
gggucagcagcagguguuccuu

SEQ ID NO: 5395 - RNA, 22 nt, Pseudomonas aeruginosa PA01
gggucuguucgaccaacugcgg

SEQ ID NO: 5396 - RNA, 22 nt, Pseudomonas aeruginosa PA01
ggugggauugcccugcaaggcu

SEQ ID NO: 5397 - RNA, 22 nt, Pseudomonas aeruginosa PA01
ggugggcgaugcgcgaggucag

SEQ ID NO: 5398 - RNA, 22 nt, Pseudomonas aeruginosa PA01
gguguaccggugaaggaacugu

SEQ ID NO: 5399 - RNA, 19 nt, Pseudomonas aeruginosa PA01
gguuccgucggccuugccg

SEQ ID NO: 5400 - RNA, 22 nt, Pseudomonas aeruginosa PA01
gguggcaggaugcgcagacugg

SEQ ID NO: 5401 - RNA, 22 nt, Pseudomonas aeruginosa PA01
ggugccagauccaguaggcggc

SEQ ID NO: 5402 - RNA, 22 nt, Pseudomonas aeruginosa PA01
ggugccagggcuacagcgagcc

SEQ ID NO: 5403 - RNA, 22 nt, Pseudomonas aeruginosa PA01
ggugccggcgccggcccuggcg

SEQ ID NO: 5404 - RNA, 22 nt, Pseudomonas aeruginosa PA01
ggugcgcaccgcccugcgcgag

SEQ ID NO: 5405 - RNA, 22 nt, Pseudomonas aeruginosa PA01
ggugcgcaccgucgagggcgag

SEQ ID NO: 5406 - RNA, 22 nt, Pseudomonas aeruginosa PA01
ggugcgcgcccuucugcgagua

SEQ ID NO: 5407 - RNA, 22 nt, Pseudomonas aeruginosa PA01
ggugcggaagaaggcgcgcgua

SEQ ID NO: 5408 - RNA, 22 nt, Pseudomonas aeruginosa PA01
ggcgagcuuggcggcgauggcg

SEQ ID NO: 5409 - RNA, 22 nt, Pseudomonas aeruginosa PA01
ggcgaggaacacgcagccgagc

SEQ ID NO: 5410 - RNA, 22 nt, Pseudomonas aeruginosa PA01
ggcgaggaagucgcagugcucg

SEQ ID NO: 5411 - RNA, 22 nt, Pseudomonas aeruginosa PA01
ggcgaggaggaucgccgcgauc

SEQ ID NO: 5412 - RNA, 22 nt, Pseudomonas aeruginosa PA01
ggcgaggaggguuuccgcgugc

SEQ ID NO: 5413 - RNA, 22 nt, Pseudomonas aeruginosa PA01
ggcgaggccaauggcugaggcg

SEQ ID NO: 5414 - RNA, 22 nt, Pseudomonas aeruginosa PA01
ggcgagguagcgcagcacgccg

SEQ ID NO: 5415 - RNA, 22 nt, Pseudomonas aeruginosa PA01
ggcgagguugaccgacagcggg

SEQ ID NO: 5416 - RNA, 22 nt, Pseudomonas aeruginosa PA01
ggcgaugaagaucgucggcgua

SEQ ID NO: 5417 - RNA, 22 nt, Pseudomonas aeruginosa PA01
ggcgccaccgcagagugccgaa

SEQ ID NO: 5418 - RNA, 22 nt, Pseudomonas aeruginosa PA01
ggcgcgggucgagcguggccag

SEQ ID NO: 5419 - RNA, 22 nt, Pseudomonas aeruginosa PA01
ggcgcugcuggccgugcagguc

SEQ ID NO: 5420 - RNA, 22 nt, Pseudomonas aeruginosa PA01
ggcgcugcuguuccaguacgcg

SEQ ID NO: 5421 - RNA, 22 nt, Pseudomonas aeruginosa PA01
ggcgcuggcgcaaccggccaac

SEQ ID NO: 5422 - RNA, 22 nt, Pseudomonas aeruginosa PA01
ggcgcuggcgcaacgcaccgaa

SEQ ID NO: 5423 - RNA, 22 nt, Pseudomonas aeruginosa PA01
ggcgcugggcuugaccccggcg

SEQ ID NO: 5424 - RNA, 22 nt, Pseudomonas aeruginosa PA01
ggcgcugguggucgauccgggc

SEQ ID NO: 5425 - RNA, 22 nt, Pseudomonas aeruginosa PA01
ggcggcaguuccggcggauggu

SEQ ID NO: 5426 - RNA, 23 nt, Pseudomonas aeruginosa PA01
ggcggccgcccuccucaugugcc

SEQ ID NO: 5427 - RNA, 18 nt, Pseudomonas aeruginosa PA01
ggcggccggcugaacgcc

SEQ ID NO: 5428 - RNA, 22 nt, Pseudomonas aeruginosa PA01
ggcggccguucauguaccagau

SEQ ID NO: 5429 - RNA, 19 nt, Pseudomonas aeruginosa PA01
ggcgagcagcagggcgcgg

SEQ ID NO: 5430 - RNA, 22 nt, Pseudomonas aeruginosa PA01
ggcgagcagcggcaggcugucg

SEQ ID NO: 5431 - RNA, 22 nt, Pseudomonas aeruginosa PA01
ggcgagcgguucgcgggaaagg

SEQ ID NO: 5432 - RNA, 22 nt, Pseudomonas aeruginosa PA01
ggcgagcugccgcugccggucu

SEQ ID NO: 5433 - RNA, 22 nt, Pseudomonas aeruginosa PA01
ggcggcgccguucggcaggcug

SEQ ID NO: 5434 - RNA, 18 nt, Pseudomonas aeruginosa PA01
ggcggcgcgagccaggcg

SEQ ID NO: 5435 - RNA, 22 nt, Pseudomonas aeruginosa PA01
ggcggcgcuccucgaaggggaa

SEQ ID NO: 5436 - RNA, 22 nt, Pseudomonas aeruginosa PA01
ggcggcgcugcaggucggccug

SEQ ID NO: 5437 - RNA, 21 nt, Pseudomonas aeruginosa PA01
ggcggcugguagcucaaggga

SEQ ID NO: 5438 - RNA, 22 nt, Pseudomonas aeruginosa PA01
ggcgggcguuuccgcgcugacg

SEQ ID NO: 5439 - RNA, 22 nt, Pseudomonas aeruginosa PA01
ggcgggugacgccguugucgau

SEQ ID NO: 5440 - RNA, 22 nt, Pseudomonas aeruginosa PA01
ggcgggugcucggagcgcuugc

SEQ ID NO: 5441 - RNA, 22 nt, Pseudomonas aeruginosa PA01
ggcgggugcugcuggaggaccu

SEQ ID NO: 5442 - RNA, 22 nt, Pseudomonas aeruginosa PA01
ggcgucuuccucguccucggcg

SEQ ID NO: 5443 - RNA, 22 nt, Pseudomonas aeruginosa PA01
ggcucgcgagcgccagggcaac

SEQ ID NO: 5444 - RNA, 22 nt, Pseudomonas aeruginosa PA01
ggcucgcgcgcuggccacccug

SEQ ID NO: 5445 - RNA, 22 nt, Pseudomonas aeruginosa PA01
ggcucgcgcgggcugaccccgc

SEQ ID NO: 5446 - RNA, 22 nt, Pseudomonas aeruginosa PA01
ggcucgcggcagucucggcuag

SEQ ID NO: 5447 - RNA, 22 nt, Pseudomonas aeruginosa PA01
ggcucgcucaugucgucgccuu

SEQ ID NO: 5448 - RNA, 22 nt, Pseudomonas aeruginosa PA01
ggcucgcugccagcgccagggg

SEQ ID NO: 5449 - RNA, 22 nt, Pseudomonas aeruginosa PA01
ggcuccgccgccucagcggggc

SEQ ID NO: 5450 - RNA, 22 nt, Pseudomonas aeruginosa PA01
ggcuccgcgaacgcuuccccca

SEQ ID NO: 5451 - RNA, 22 nt, Pseudomonas aeruginosa PA01
ggcuccugguugccgggagcgg

SEQ ID NO: 5452 - RNA, 22 nt, Pseudomonas aeruginosa PA01
ggcugccgaccugccccggacg

SEQ ID NO: 5453 - RNA, 22 nt, Pseudomonas aeruginosa PA01
ggcugccgccgauggccuugga

SEQ ID NO: 5454 - RNA, 19 nt, Pseudomonas aeruginosa PA01
ggcugccgguaacgggguc

SEQ ID NO: 5455 - RNA, 22 nt, Pseudomonas aeruginosa PA01
ggcucuacggcccguuccugcg

SEQ ID NO: 5456 - RNA, 22 nt, Pseudomonas aeruginosa PA01
ggcucuucagcgucuggaugua

SEQ ID NO: 5457 - RNA, 22 nt, Pseudomonas aeruginosa PA01
ggcugagcgcccgcggcgugac

SEQ ID NO: 5458 - RNA, 22 nt, Pseudomonas aeruginosa PA01
ggcuuccggcggccucccgcgg

SEQ ID NO: 5459 - RNA, 22 nt, Pseudomonas aeruginosa PA01
ggcuucggcuccccagccggac

SEQ ID NO: 5460 - RNA, 22 nt, Pseudomonas aeruginosa PA01
ggcuucgucgagggaggcgguc

SEQ ID NO: 5461 - RNA, 22 nt, Pseudomonas aeruginosa PA01
ggcuggaggcgccggguugccu

SEQ ID NO: 5462 - RNA, 22 nt, Pseudomonas aeruginosa PA01
ggcugcgucgugacgcccgcgg

SEQ ID NO: 5463 - RNA, 22 nt, Pseudomonas aeruginosa PA01
ggcugcgugccuggcggcaccc

SEQ ID NO: 5464 - RNA, 22 nt, Pseudomonas aeruginosa PA01
ggcugcuggagcgccugggcca

SEQ ID NO: 5465 - RNA, 22 nt, Pseudomonas aeruginosa PA01
ggcugcugggccuggccguucu

SEQ ID NO: 5466 - RNA, 22 nt, Pseudomonas aeruginosa PA01
ggcugcuguccgguggccuugu

SEQ ID NO: 5467 - RNA, 22 nt, Pseudomonas aeruginosa PA01
gggcagcggcguggagugguag

SEQ ID NO: 5468 - RNA, 22 nt, Pseudomonas aeruginosa PA01
gggcagcucgaggucuucgucg

SEQ ID NO: 5469 - RNA, 22 nt, Pseudomonas aeruginosa PA01
gggcagcuucagcaagcgcucg

SEQ ID NO: 5470 - RNA, 22 nt, Pseudomonas aeruginosa PA01
gggcaggcucauggcagcucgg

SEQ ID NO: 5471 - RNA, 22 nt, Pseudomonas aeruginosa PA01
gggcgaccugaacugggccggc

SEQ ID NO: 5472 - RNA, 22 nt, Pseudomonas aeruginosa PA01
gggcgacggcgaucagcgucua

SEQ ID NO: 5473 - RNA, 22 nt, Pseudomonas aeruginosa PA01
gggcgagccacucgccgaggaa

SEQ ID NO: 5474 - RNA, 22 nt, Pseudomonas aeruginosa PA01
gggcgagcccugcugggcgaag

SEQ ID NO: 5475 - RNA, 22 nt, Pseudomonas aeruginosa PA01
gggcgaggaagccgccggcguc

SEQ ID NO: 5476 - RNA, 22 nt, Pseudomonas aeruginosa PA01
gggcgaggucgacaacggcguc

SEQ ID NO: 5477 - RNA, 22 nt, Pseudomonas aeruginosa PA01
gggcgcggucgaggaucagcuc

SEQ ID NO: 5478 - RNA, 21 nt, Pseudomonas aeruginosa PA01
gggcgcgucccgccuggcggc

SEQ ID NO: 5479 - RNA, 20 nt, Pseudomonas aeruginosa PA01
gggcgcuggcauaggcgccc

SEQ ID NO: 5480 - RNA, 22 nt, Pseudomonas aeruginosa PA01
ggcuuucucguuaccgccggcu

SEQ ID NO: 5481 - RNA, 22 nt, Pseudomonas aeruginosa PA01
gggaagcgcgccugcugcuuga

SEQ ID NO: 5482 - RNA, 21 nt, Pseudomonas aeruginosa PA01
gggaagcucgaggcgucgggu

SEQ ID NO: 5483 - RNA, 22 nt, Pseudomonas aeruginosa PA01
gggcuccgacuaucacucgaug

SEQ ID NO: 5484 - RNA, 23 nt, Pseudomonas aeruginosa PA01
gggcaugcugguccccggcaccc

SEQ ID NO: 5485 - RNA, 22 nt, Pseudomonas aeruginosa PA01
gggcggcuugcaggaaggcuuc

SEQ ID NO: 5486 - RNA, 22 nt, Pseudomonas aeruginosa PA01
gggccccuuccacggaccgcug

SEQ ID NO: 5487 - RNA, 22 nt, Pseudomonas aeruginosa PA01
gggccgcccggcgggaucuugc

SEQ ID NO: 5488 - RNA, 22 nt, Pseudomonas aeruginosa PA01
gggccgggcgacgaacuggacg

SEQ ID NO: 5489 - RNA, 22 nt, Pseudomonas aeruginosa PA01
gggccgggcuucagcaucgacg

SEQ ID NO: 5490 - RNA, 22 nt, Pseudomonas aeruginosa PA01
ggggcgccggaccugcaggagc

SEQ ID NO: 5491 - RNA, 22 nt, Pseudomonas aeruginosa PA01
ggggcgcgccuccaggcgacgg

SEQ ID NO: 5492 - RNA, 22 nt, Pseudomonas aeruginosa PA01
ggggcggcuuguugcgcccgcg

SEQ ID NO: 5493 - RNA, 22 nt, Pseudomonas aeruginosa PA01
ggggcucgccgaucaccccggu

SEQ ID NO: 5494 - RNA, 22 nt, Pseudomonas aeruginosa PA01
gggggcaggucacuugccccgc

SEQ ID NO: 5495 - RNA, 22 nt, Pseudomonas aeruginosa PA01
ggggucaggucgcugagcaggg

SEQ ID NO: 5496 - RNA, 22 nt, Pseudomonas aeruginosa PA01
guggcgcggggcgagcugguuc

SEQ ID NO: 5497 - RNA, 22 nt, Pseudomonas aeruginosa PA01
guggccggcgcgauggcgucca

SEQ ID NO: 5498 - RNA, 22 nt, Pseudomonas aeruginosa PA01
guggcgagaaucaggucgaucc

SEQ ID NO: 5499 - RNA, 22 nt, Pseudomonas aeruginosa PA01
gugggcgcgaccucggcugcgg

SEQ ID NO: 5500 - RNA, 22 nt, Pseudomonas aeruginosa PA01
gugggcggucaacgccagcacc

SEQ ID NO: 5501 - RNA, 22 nt, Pseudomonas aeruginosa PA01
guugaugucguagcucaccagc

SEQ ID NO: 5502 - RNA, 22 nt, Pseudomonas aeruginosa PA01
guugcggaucgucguagccgag

SEQ ID NO: 5503 - RNA, 22 nt, Pseudomonas aeruginosa PA01
gugaggcgccggacagcgcccg

SEQ ID NO: 5504 - RNA, 18 nt, Pseudomonas aeruginosa PA01
gugcgcaggccaggcggg

SEQ ID NO: 5505 - RNA, 22 nt, Pseudomonas aeruginosa PA01
gugcgcaggccgagcgguccga

SEQ ID NO: 5506 - RNA, 22 nt, Pseudomonas aeruginosa PA01
gugcgcccagcgcgcggucaug

SEQ ID NO: 5507 - RNA, 22 nt, Pseudomonas aeruginosa PA01
guggaaguggucgaggccccgg

SEQ ID NO: 5508 - RNA, 22 nt, Pseudomonas aeruginosa PA01
gugccggccaaggacccgcgcg

SEQ ID NO: 5509 - RNA, 22 nt, Pseudomonas aeruginosa PA01
gugccggcgcggcguaccguuc

SEQ ID NO: 5510 - RNA, 22 nt, Pseudomonas aeruginosa PA01
gugccggcgggugcugcgcgag

SEQ ID NO: 5511 - RNA, 22 nt, Pseudomonas aeruginosa PA01
gugccugccucggcgccggcgg

SEQ ID NO: 5512 - RNA, 22 nt, Pseudomonas aeruginosa PA01
guccaugaucgcgaacugcggc

SEQ ID NO: 5513 - RNA, 22 nt, Pseudomonas aeruginosa PA01
guccggccaggcgggcuugccg

SEQ ID NO: 5514 - RNA, 22 nt, Pseudomonas aeruginosa PA01
guccggcgaccagcggcgcgug

SEQ ID NO: 5515 - RNA, 22 nt, Pseudomonas aeruginosa PA01
guccggcgcgaggcccggcguu

SEQ ID NO: 5516 - RNA, 22 nt, Pseudomonas aeruginosa PA01
guccggcuuguacugguggugg

SEQ ID NO: 5517 - RNA, 22 nt, Pseudomonas aeruginosa PA01
guccgggagcgauggcguugac

SEQ ID NO: 5518 - RNA, 22 nt, Pseudomonas aeruginosa PA01
guccgggaucaccccgucgcug

SEQ ID NO: 5519 - RNA, 22 nt, Pseudomonas aeruginosa PA01
guccagcgcagcaccagcucgc

SEQ ID NO: 5520 - RNA, 22 nt, Pseudomonas aeruginosa PA01
guccagcgccaggccgaacucu

SEQ ID NO: 5521 - RNA, 22 nt, Pseudomonas aeruginosa PA01
guccagcgcgugcgccugccac

SEQ ID NO: 5522 - RNA, 22 nt, Pseudomonas aeruginosa PA01
gucgcgccaugacccuggaggc

SEQ ID NO: 5523 - RNA, 22 nt, Pseudomonas aeruginosa PA01
gucgacccagggccgggcgcgc

SEQ ID NO: 5524 - RNA, 22 nt, Pseudomonas aeruginosa PA01
gucgacccguccgggcagcucg

SEQ ID NO: 5525 - RNA, 22 nt, Pseudomonas aeruginosa PA01
gucgacuacgcgcugauggagc

SEQ ID NO: 5526 - RNA, 22 nt, Pseudomonas aeruginosa PA01
guccugcgcgcugcgcaggguc

SEQ ID NO: 5527 - RNA, 22 nt, Pseudomonas aeruginosa PA01
gucggccaggugcgcgguggcc

SEQ ID NO: 5528 - RNA, 22 nt, Pseudomonas aeruginosa PA01
gucggcccauuccggguggucu

SEQ ID NO: 5529 - RNA, 22 nt, Pseudomonas aeruginosa PA01
gucggccugaccuggggcgaga

SEQ ID NO: 5530 - RNA, 19 nt, Pseudomonas aeruginosa PA01
gucggccuggaaggccuga

SEQ ID NO: 5531 - RNA, 22 nt, Pseudomonas aeruginosa PA01
gucggcgaaguccugcacgaac

SEQ ID NO: 5532 - RNA, 22 nt, Pseudomonas aeruginosa PA01
gucggcgaguuccgcggagauc

SEQ ID NO: 5533 - RNA, 22 nt, Pseudomonas aeruginosa PA01
gucggcgauggccagcagcgcg

SEQ ID NO: 5534 - RNA, 22 nt, Pseudomonas aeruginosa PA01
gucggcgccgaaguugaugcgg

SEQ ID NO: 5535 - RNA, 22 nt, Pseudomonas aeruginosa PA01
gugagcgccgaggagcagacca

SEQ ID NO: 5536 - RNA, 22 nt, Pseudomonas aeruginosa PA01
gucucuuccaucaccgagcgca

SEQ ID NO: 5537 - RNA, 22 nt, Pseudomonas aeruginosa PA01
gucuuuccagguaugcgggcug

SEQ ID NO: 5538 - RNA, 22 nt, Pseudomonas aeruginosa PA01
gucuuucccggauggauggaga

SEQ ID NO: 5539 - RNA, 22 nt, Pseudomonas aeruginosa PA01
ucaccggccugggcggcgagug

SEQ ID NO: 5540 - RNA, 22 nt, Pseudomonas aeruginosa PA01
ucaccggcggcuggaacgggcu

SEQ ID NO: 5541 - RNA, 22 nt, Pseudomonas aeruginosa PA01
ucaccggcuacgaccugggcau

SEQ ID NO: 5542 - RNA, 22 nt, Pseudomonas aeruginosa PA01
ucagccuguucucgcggcgccc

SEQ ID NO: 5543 - RNA, 22 nt, Pseudomonas aeruginosa PA01
ucagcgcccacuucggcugcuc

SEQ ID NO: 5544 - RNA, 22 nt, Pseudomonas aeruginosa PA01
ucagcgccggaucgugcaguug

SEQ ID NO: 5545 - RNA, 22 nt, Pseudomonas aeruginosa PA01
ucagcgccggcuggcagcggau

SEQ ID NO: 5546 - RNA, 22 nt, Pseudomonas aeruginosa PA01
uccaugacguacuugucgccca

SEQ ID NO: 5547 - RNA, 20 nt, Pseudomonas aeruginosa PA01
ucaggccgucgaugccgggc

SEQ ID NO: 5548 - RNA, 22 nt, Pseudomonas aeruginosa PA01
ucaggcucggugguuccgcuga

SEQ ID NO: 5549 - RNA, 22 nt, Pseudomonas aeruginosa PA01
ucaggcccauuucguugcggac

SEQ ID NO: 5550 - RNA, 22 nt, Pseudomonas aeruginosa PA01
ucaggccggcgcccagggaguc

SEQ ID NO: 5551 - RNA, 22 nt, Pseudomonas aeruginosa PA01
ucaggccggcugccgccacucg

SEQ ID NO: 5552 - RNA, 19 nt, Pseudomonas aeruginosa PA01
ucgcugcaacacgucaagc

SEQ ID NO: 5553 - RNA, 22 nt, Pseudomonas aeruginosa PA01
ucggccuccuucagcuuggcca

SEQ ID NO: 5554 - RNA, 22 nt, Pseudomonas aeruginosa PA01
ucggccggcagcucguaggcau

SEQ ID NO: 5555 - RNA, 22 nt, Pseudomonas aeruginosa PA01
ucggcgccgcccacgccuggca

SEQ ID NO: 5556 - RNA, 22 nt, Pseudomonas aeruginosa PA01
ucggcgccuugcuggcgggcca

SEQ ID NO: 5557 - RNA, 18 nt, Pseudomonas aeruginosa PA01
ucggcgcgcacucggugg

SEQ ID NO: 5558 - RNA, 22 nt, Pseudomonas aeruginosa PA01
ucggcgcgcugacccgcugggu

SEQ ID NO: 5559 - RNA, 22 nt, Pseudomonas aeruginosa PA01
ucggcgcgcugcuguucgucga

SEQ ID NO: 5560 - RNA, 23 nt, Pseudomonas aeruginosa PA01
ucggcgcgggacuugagggucgc

SEQ ID NO: 5561 - RNA, 22 nt, Pseudomonas aeruginosa PA01
ucgcccugggcgcggcggaagc

SEQ ID NO: 5562 - RNA, 22 nt, Pseudomonas aeruginosa PA01
ucgccgccagcaggcggccgag

SEQ ID NO: 5563 - RNA, 22 nt, Pseudomonas aeruginosa PA01
ucgccgccgcuacguccuacuu

SEQ ID NO: 5564 - RNA, 19 nt, Pseudomonas aeruginosa PA01
ucgccgccuucgccgcacc

SEQ ID NO: 5565 - RNA, 22 nt, Pseudomonas aeruginosa PA01
ucgccggcaaagucgagggcuu

SEQ ID NO: 5566 - RNA, 22 nt, Pseudomonas aeruginosa PA01
ucgccggcaucugggaggccua

SEQ ID NO: 5567 - RNA, 22 nt, Pseudomonas aeruginosa PA01
ucgccggccugcugaccuuccu

SEQ ID NO: 5568 - RNA, 22 nt, Pseudomonas aeruginosa PA01
ucgccggcgcccuggcgccugg

SEQ ID NO: 5569 - RNA, 22 nt, Pseudomonas aeruginosa PA01
ucgccgggaaucggcgugcagc

SEQ ID NO: 5570 - RNA, 22 nt, Pseudomonas aeruginosa PA01
ucgccgggcgccgcugggagug

SEQ ID NO: 5571 - RNA, 22 nt, Pseudomonas aeruginosa PA01
ucgccgggcuucaggcucaggg

SEQ ID NO: 5572 - RNA, 22 nt, Pseudomonas aeruginosa PA01
ucgccggguuggucagccaggc

SEQ ID NO: 5573 - RNA, 22 nt, Pseudomonas aeruginosa PA01
ucgcgcagcaacaggggccggu

SEQ ID NO: 5574 - RNA, 22 nt, Pseudomonas aeruginosa PA01
ucgcgcaggucggcgcggguga

SEQ ID NO: 5575 - RNA, 22 nt, Pseudomonas aeruginosa PA01
ucgcgccgaagcgccgggaaug

SEQ ID NO: 5576 - RNA, 21 nt, Pseudomonas aeruginosa PA01
ucgcggaacuggcgggcgucc

SEQ ID NO: 5577 - RNA, 22 nt, Pseudomonas aeruginosa PA01
ucgcggagcagggcgcggcuga

SEQ ID NO: 5578 - RNA, 22 nt, Pseudomonas aeruginosa PA01
ucgcggcuucgccgugguggcc

SEQ ID NO: 5579 - RNA, 22 nt, Pseudomonas aeruginosa PA01
ucggucgguugcgccggguagu

SEQ ID NO: 5580 - RNA, 22 nt, Pseudomonas aeruginosa PA01
ucggucucgaccagcaacuggc

SEQ ID NO: 5581 - RNA, 22 nt, Pseudomonas aeruginosa PA01
ucggucucguaggcguagaagc

SEQ ID NO: 5582 - RNA, 22 nt, Pseudomonas aeruginosa PA01
ucgucggcccgcugcaacugcc

SEQ ID NO: 5583 - RNA, 22 nt, Pseudomonas aeruginosa PA01
ucgucggccucguucucgauga

SEQ ID NO: 5584 - RNA, 22 nt, Pseudomonas aeruginosa PA01
ucgucggccuucaacgccgccg

SEQ ID NO: 5585 - RNA, 22 nt, Pseudomonas aeruginosa PA01
ucgucggcgaaaugccggucgc

SEQ ID NO: 5586 - RNA, 22 nt, Pseudomonas aeruginosa PA01
ucgucggcgaacuccgagcgca

SEQ ID NO: 5587 - RNA, 22 nt, Pseudomonas aeruginosa PA01
ucgucggcgccaacgaccuggu

SEQ ID NO: 5588 - RNA, 20 nt, Pseudomonas aeruginosa PA01
ucgucggcgcccuggugauc

SEQ ID NO: 5589 - RNA, 22 nt, Pseudomonas aeruginosa PA01
uccuugagguugaucguccagu

SEQ ID NO: 5590 - RNA, 22 nt, Pseudomonas aeruginosa PA01
ucgagcgcuugcgcugaugcag

SEQ ID NO: 5591 - RNA, 22 nt, Pseudomonas aeruginosa PA01
ucgacccggcuuuccgccucgg

SEQ ID NO: 5592 - RNA, 22 nt, Pseudomonas aeruginosa PA01
uccgggucgcggucggccugga

SEQ ID NO: 5593 - RNA, 22 nt, Pseudomonas aeruginosa PA01
uccgucgacggcccgcuggcgg

SEQ ID NO: 5594 - RNA, 22 nt, Pseudomonas aeruginosa PA01
uccucggcgaucacccggcgcu

SEQ ID NO: 5595 - RNA, 22 nt, Pseudomonas aeruginosa PA01
uccugcagaccgccaucgccga

SEQ ID NO: 5596 - RNA, 22 nt, Pseudomonas aeruginosa PA01
uccugcucgaucacggccuggu

SEQ ID NO: 5597 - RNA, 22 nt, Pseudomonas aeruginosa PA01
uccugcggcgggccgucaugca

SEQ ID NO: 5598 - RNA, 22 nt, Pseudomonas aeruginosa PA01
ucccgcgcucggugggccaggu

SEQ ID NO: 5599 - RNA, 22 nt, Pseudomonas aeruginosa PA01
ucccggacgaugucggcacuga

SEQ ID NO: 5600 - RNA, 22 nt, Pseudomonas aeruginosa PA01
ucccggcgcgguccaggcgcgg

SEQ ID NO: 5601 - RNA, 22 nt, Pseudomonas aeruginosa PA01
uccccggucgaugcggaagcuc

SEQ ID NO: 5602 - RNA, 22 nt, Pseudomonas aeruginosa PA01
uccaggcuggcggcgucgaucc

SEQ ID NO: 5603 - RNA, 22 nt, Pseudomonas aeruginosa PA01
uccagguagcgcucgaggaagg

SEQ ID NO: 5604 - RNA, 22 nt, Pseudomonas aeruginosa PA01
ucccaggcggucagucgcgagc

SEQ ID NO: 5605 - RNA, 22 nt, Pseudomonas aeruginosa PA01
uccggcgggcagccgcugugga

SEQ ID NO: 5606 - RNA, 22 nt, Pseudomonas aeruginosa PA01
uccggcucgacgccggcgaggu

SEQ ID NO: 5607 - RNA, 22 nt, Pseudomonas aeruginosa PA01
ucccugggcagccccuugaguu

SEQ ID NO: 5608 - RNA, 22 nt, Pseudomonas aeruginosa PA01
uccgaggacgggcagagguggu

SEQ ID NO: 5609 - RNA, 22 nt, Pseudomonas aeruginosa PA01
uccgaucggccugcgccacgau

SEQ ID NO: 5610 - RNA, 22 nt, Pseudomonas aeruginosa PA01
uccgccgcguuccacuccagcg

SEQ ID NO: 5611 - RNA, 22 nt, Pseudomonas aeruginosa PA01
uccgccggcgacagcaguucgg

SEQ ID NO: 5612 - RNA, 22 nt, Pseudomonas aeruginosa PA01
uccgccgggugcacagcgaggg

SEQ ID NO: 5613 - RNA, 22 nt, Pseudomonas aeruginosa PA01
uacccggccugccuugccgucg

SEQ ID NO: 5614 - RNA, 22 nt, Pseudomonas aeruginosa PA01
uacaacuucggccaggaccuga

SEQ ID NO: 5615 - RNA, 22 nt, Pseudomonas aeruginosa PA01
uacugaccacgucuuccaggcu

SEQ ID NO: 5616 - RNA, 22 nt, Pseudomonas aeruginosa PA01
uagcccugguucgugcccugca

SEQ ID NO: 5617 - RNA, 22 nt, Pseudomonas aeruginosa PA01
uagcgcgcauucggaucgcccg

SEQ ID NO: 5618 - RNA, 22 nt, Pseudomonas aeruginosa PA01
uagcgggagaacucgcggccgc

SEQ ID NO: 5619 - RNA, 22 nt, Pseudomonas aeruginosa PA01
uagcuccagccgaagccuucga

SEQ ID NO: 5620 - RNA, 22 nt, Pseudomonas aeruginosa PA01
uauugacacugaacgagccgga

SEQ ID NO: 5621 - RNA, 19 nt, Pseudomonas aeruginosa PA01
uauuuccagcgcuacaucc

SEQ ID NO: 5622 - RNA, 21 nt, Pseudomonas aeruginosa PA01
gccgcacgcugcccuccaggc

SEQ ID NO: 5623 - RNA, 20 nt, Pseudomonas aeruginosa PA01
gccgaccggcggcccaggcg

SEQ ID NO: 5624 - RNA, 22 nt, Pseudomonas aeruginosa PA01
gccgagcgagaacguuccgccg

SEQ ID NO: 5625 - RNA, 21 nt, Pseudomonas aeruginosa PA01
gccgagcgauucggcgggagg

SEQ ID NO: 5626 - RNA, 22 nt, Pseudomonas aeruginosa PA01
gccgaggaauuuccccgcgaac

SEQ ID NO: 5627 - RNA, 22 nt, Pseudomonas aeruginosa PA01
gccgaggagaccuggcggguac

SEQ ID NO: 5628 - RNA, 22 nt, Pseudomonas aeruginosa PA01
gccgaggaguuccggcucugag

SEQ ID NO: 5629 - RNA, 22 nt, Pseudomonas aeruginosa PA01
gccgcacacgcccagcagcgau

SEQ ID NO: 5630 - RNA, 22 nt, Pseudomonas aeruginosa PA01
gcccaggcccuggcgcgggcuc

SEQ ID NO: 5631 - RNA, 22 nt, Pseudomonas aeruginosa PA01
gcccagggacagcccgggcgua

SEQ ID NO: 5632 - RNA, 22 nt, Pseudomonas aeruginosa PA01
gcccauggcgaaagcgccgccg

SEQ ID NO: 5633 - RNA, 22 nt, Pseudomonas aeruginosa PA01
gccccgcgcagguugaucacgc

SEQ ID NO: 5634 - RNA, 22 nt, Pseudomonas aeruginosa PA01
gccccgcgggaggacggcugcu

SEQ ID NO: 5635 - RNA, 22 nt, Pseudomonas aeruginosa PA01
gccccucgcggaucucggcgau

SEQ ID NO: 5636 - RNA, 20 nt, Pseudomonas aeruginosa PA01
gcccggccgcuguggcugcg

SEQ ID NO: 5637 - RNA, 22 nt, Pseudomonas aeruginosa PA01
gcccggcgaagucucgcggccg

SEQ ID NO: 5638 - RNA, 22 nt, Pseudomonas aeruginosa PA01
gcccggcggcacgcugggccug

SEQ ID NO: 5639 - RNA, 18 nt, Pseudomonas aeruginosa PA01
gcccggcguaguccagca

SEQ ID NO: 5640 - RNA, 22 nt, Pseudomonas aeruginosa PA01
gcccggcucgaagagcgugcgc

SEQ ID NO: 5641 - RNA, 22 nt, Pseudomonas aeruginosa PA01
gcccggcuggcgcucggccugg

SEQ ID NO: 5642 - RNA, 22 nt, Pseudomonas aeruginosa PA01
gcccggcuguccaggcggccgg

SEQ ID NO: 5643 - RNA, 22 nt, Pseudomonas aeruginosa PA01
gcccggcuucccggcggaaagu

SEQ ID NO: 5644 - RNA, 22 nt, Pseudomonas aeruginosa PA01
gcccgucguagccggcggcgug

SEQ ID NO: 5645 - RNA, 22 nt, Pseudomonas aeruginosa PA01
gcccucgccgacgaccugcgcc

SEQ ID NO: 5646 - RNA, 22 nt, Pseudomonas aeruginosa PA01
gcccuggagguuguccggcaag

SEQ ID NO: 5647 - RNA, 22 nt, Pseudomonas aeruginosa PA01
gcccuggugcagcgcaaggccg

SEQ ID NO: 5648 - RNA, 22 nt, Pseudomonas aeruginosa PA01
gccgccccggcuuccucauccg

SEQ ID NO: 5649 - RNA, 22 nt, Pseudomonas aeruginosa PA01
gccgccgaccugggcugcggca

SEQ ID NO: 5650 - RNA, 22 nt, Pseudomonas aeruginosa PA01
gccgccgaggcugaugcgcugc

SEQ ID NO: 5651 - RNA, 17 nt, Pseudomonas aeruginosa PA01
gccgccgaggucggcga

SEQ ID NO: 5652 - RNA, 22 nt, Pseudomonas aeruginosa PA01
gccgccgagucccuggagcgug

SEQ ID NO: 5653 - RNA, 22 nt, Pseudomonas aeruginosa PA01
gccgccgccagaucgaucaucg

SEQ ID NO: 5654 - RNA, 22 nt, Pseudomonas aeruginosa PA01
gccgccggauugaugaugauga

SEQ ID NO: 5655 - RNA, 22 nt, Pseudomonas aeruginosa PA01
gccgccuggaagccgccggcuu

SEQ ID NO: 5656 - RNA, 22 nt, Pseudomonas aeruginosa PA01
gccgcgccccucggcuuccuug

SEQ ID NO: 5657 - RNA, 22 nt, Pseudomonas aeruginosa PA01
gccgcuggaacuggggucgcug

SEQ ID NO: 5658 - RNA, 22 nt, Pseudomonas aeruginosa PA01
gccggacguaccagccggcggc

SEQ ID NO: 5659 - RNA, 22 nt, Pseudomonas aeruginosa PA01
gccggagacgauggcgacguuc

SEQ ID NO: 5660 - RNA, 22 nt, Pseudomonas aeruginosa PA01
gccggagaucaccgagccgucc

SEQ ID NO: 5661 - RNA, 22 nt, Pseudomonas aeruginosa PA01
gccggagcugccggccgaccug

SEQ ID NO: 5662 - RNA, 22 nt, Pseudomonas aeruginosa PA01
gccggcagcacaccgggcaguc

SEQ ID NO: 5663 - RNA, 22 nt, Pseudomonas aeruginosa PA01
gccggcagccucaagcaggugg

SEQ ID NO: 5664 - RNA, 22 nt, Pseudomonas aeruginosa PA01
gccggcagguuggcgcgcaggu

SEQ ID NO: 5665 - RNA, 22 nt, Pseudomonas aeruginosa PA01
gccggccaguucaccggcgcgc

SEQ ID NO: 5666 - RNA, 22 nt, Pseudomonas aeruginosa PA01
gccggccccgcaauucggucug

SEQ ID NO: 5667 - RNA, 22 nt, Pseudomonas aeruginosa PA01
gccggccccggcgccauguuga

SEQ ID NO: 5668 - RNA, 22 nt, Pseudomonas aeruginosa PA01
gccggcccugucgggcaggccg

SEQ ID NO: 5669 - RNA, 22 nt, Pseudomonas aeruginosa PA01
gccggccgacgccuggauggcc

SEQ ID NO: 5670 - RNA, 22 nt, Pseudomonas aeruginosa PA01
gccggccgagaaggucgcguag

SEQ ID NO: 5671 - RNA, 22 nt, Pseudomonas aeruginosa PA01
gccggccgcccucgucgaguuc

SEQ ID NO: 5672 - RNA, 22 nt, Pseudomonas aeruginosa PA01
gccggccguagggaaucgaacg

SEQ ID NO: 5673 - RNA, 22 nt, Pseudomonas aeruginosa PA01
gccggccguugcaauggcugua

SEQ ID NO: 5674 - RNA, 22 nt, Pseudomonas aeruginosa PA01
gccggccuggagcgccugggcg

SEQ ID NO: 5675 - RNA, 22 nt, Pseudomonas aeruginosa PA01
gccggcgacggcucgcuccuga

SEQ ID NO: 5676 - RNA, 22 nt, Pseudomonas aeruginosa PA01
gccggcgagcaguuggcgaugu

SEQ ID NO: 5677 - RNA, 22 nt, Pseudomonas aeruginosa PA01
gccggcgaggaaaucgccggag

SEQ ID NO: 5678 - RNA, 22 nt, Pseudomonas aeruginosa PA01
gccggcgaugguguagcggucc

SEQ ID NO: 5679 - RNA, 21 nt, Pseudomonas aeruginosa PA01
gccggcgccgcagagcuggcc

SEQ ID NO: 5680 - RNA, 22 nt, Pseudomonas aeruginosa PA01
gccggcgcggacuuccuggauc

SEQ ID NO: 5681 - RNA, 22 nt, Pseudomonas aeruginosa PA01
gccggcucaucagcacccgcug

SEQ ID NO: 5682 - RNA, 22 nt, Pseudomonas aeruginosa PA01
gccgggaggaagucauugcccg

SEQ ID NO: 5683 - RNA, 22 nt, Pseudomonas aeruginosa PA01
gccgggagugaagaaggcgaug

SEQ ID NO: 5684 - RNA, 22 nt, Pseudomonas aeruginosa PA01
gccgggauggaggagcaucucg

SEQ ID NO: 5685 - RNA, 22 nt, Pseudomonas aeruginosa PA01
gccgggauuuccugcaacugcg

SEQ ID NO: 5686 - RNA, 22 nt, Pseudomonas aeruginosa PA01
gccgggcgauagccggggagau

SEQ ID NO: 5687 - RNA, 22 nt, Pseudomonas aeruginosa PA01
gccggggccgcuucggcuuccg

SEQ ID NO: 5688 - RNA, 22 nt, Pseudomonas aeruginosa PA01
gccggggccggcgaucuugcug

SEQ ID NO: 5689 - RNA, 22 nt, Pseudomonas aeruginosa PA01
gccggggcgcucgaccuggagg

SEQ ID NO: 5690 - RNA, 21 nt, Pseudomonas aeruginosa PA01
gccggggcguucuucuucgcu

SEQ ID NO: 5691 - RNA, 22 nt, Pseudomonas aeruginosa PA01
gccgggggugaggccgguccac

SEQ ID NO: 5692 - RNA, 22 nt, Pseudomonas aeruginosa PA01
gccggugacccuggcgaucggc

SEQ ID NO: 5693 - RNA, 22 nt, Pseudomonas aeruginosa PA01
gccggugagcuucgacgugucg

SEQ ID NO: 5694 - RNA, 22 nt, Pseudomonas aeruginosa PA01
gccgucgauccucgccgcguuc

SEQ ID NO: 5695 - RNA, 22 nt, Pseudomonas aeruginosa PA01
gccgucggccauuaccagguga

SEQ ID NO: 5696 - RNA, 22 nt, Pseudomonas aeruginosa PA01
gccgucggcgaccacgauggcc

SEQ ID NO: 5697 - RNA, 22 nt, Pseudomonas aeruginosa PA01
gccguggaagcucgccacgccg

SEQ ID NO: 5698 - RNA, 22 nt, Pseudomonas aeruginosa PA01
gcgaggaacuggccggcggcgc

SEQ ID NO: 5699 - RNA, 22 nt, Pseudomonas aeruginosa PA01
gcgaggaaggcggccaggucag

SEQ ID NO: 5700 - RNA, 22 nt, Pseudomonas aeruginosa PA01
gcgaggaauucgccuugcugcg

SEQ ID NO: 5701 - RNA, 22 nt, Pseudomonas aeruginosa PA01
gcgaggagccgcuggacugguc

SEQ ID NO: 5702 - RNA, 21 nt, Pseudomonas aeruginosa PA01
gcgaggccaccagcccgguga

SEQ ID NO: 5703 - RNA, 22 nt, Pseudomonas aeruginosa PA01
gcgaggccaucgagcaggccgc

SEQ ID NO: 5704 - RNA, 22 nt, Pseudomonas aeruginosa PA01
gcgagggcuucgccgaggcguu

SEQ ID NO: 5705 - RNA, 22 nt, Pseudomonas aeruginosa PA01
gcgacgcccagggccgcuggcu

SEQ ID NO: 5706 - RNA, 22 nt, Pseudomonas aeruginosa PA01
gcgacgccgaggcgacgcaggg

SEQ ID NO: 5707 - RNA, 22 nt, Pseudomonas aeruginosa PA01
gcgacggagucaacgacguacc

SEQ ID NO: 5708 - RNA, 22 nt, Pseudomonas aeruginosa PA01
gcgacggcaggcgcuccagcaa

SEQ ID NO: 5709 - RNA, 22 nt, Pseudomonas aeruginosa PA01
gcgagagggcgcggcgaaugau

SEQ ID NO: 5710 - RNA, 17 nt, Pseudomonas aeruginosa PA01
gcgagcagcuugccgcc

SEQ ID NO: 5711 - RNA, 23 nt, Pseudomonas aeruginosa PA01
gcgagcagcuugccgccacgguu

SEQ ID NO: 5712 - RNA, 22 nt, Pseudomonas aeruginosa PA01
gcgagccgaugcaacgggcgac

SEQ ID NO: 5713 - RNA, 22 nt, Pseudomonas aeruginosa PA01
gcgagccgcuggagaaggcggu

SEQ ID NO: 5714 - RNA, 22 nt, Pseudomonas aeruginosa PA01
gcgcagccgggacucuggcugg

SEQ ID NO: 5715 - RNA, 22 nt, Pseudomonas aeruginosa PA01
gcgcagcgaauccaggggcgcc

SEQ ID NO: 5716 - RNA, 22 nt, Pseudomonas aeruginosa PA01
gcgcagcgaccugccgcaacug

SEQ ID NO: 5717 - RNA, 22 nt, Pseudomonas aeruginosa PA01
gcgcagcgcccuggaaggcucg

SEQ ID NO: 5718 - RNA, 23 nt, Pseudomonas aeruginosa PA01
gcgcaggcccaugaacagcaugc

SEQ ID NO: 5719 - RNA, 22 nt, Pseudomonas aeruginosa PA01
gcgcaggccugccggaugaucg

SEQ ID NO: 5720 - RNA, 22 nt, Pseudomonas aeruginosa PA01
gcgcaucgaccugcguggccug

SEQ ID NO: 5721 - RNA, 22 nt, Pseudomonas aeruginosa PA01
gcgccaccucgcuguaugccuc

SEQ ID NO: 5722 - RNA, 22 nt, Pseudomonas aeruginosa PA01
gcgccacgguuaucgcccaguu

SEQ ID NO: 5723 - RNA, 22 nt, Pseudomonas aeruginosa PA01
gcgaacagcagaugcucgccau

SEQ ID NO: 5724 - RNA, 22 nt, Pseudomonas aeruginosa PA01
gcgaagcggccgucggccuuga

SEQ ID NO: 5725 - RNA, 22 nt, Pseudomonas aeruginosa PA01
gcgaccagccuucgcgcuugcc

SEQ ID NO: 5726 - RNA, 22 nt, Pseudomonas aeruginosa PA01
gcgaccaguucggcugggccgg

SEQ ID NO: 5727 - RNA, 22 nt, Pseudomonas aeruginosa PA01
gcgaccgccgcuggcuggcguu

SEQ ID NO: 5728 - RNA, 22 nt, Pseudomonas aeruginosa PA01
gcgaccgguggucgggcgcugc

SEQ ID NO: 5729 - RNA, 22 nt, Pseudomonas aeruginosa PA01
gcgaugcgcgccuccagcgucu

SEQ ID NO: 5730 - RNA, 22 nt, Pseudomonas aeruginosa PA01
gcgaugcggugaccucccugcg

SEQ ID NO: 5731 - RNA, 22 nt, Pseudomonas aeruginosa PA01
gcgcaagcucgacgagaacggc

SEQ ID NO: 5732 - RNA, 22 nt, Pseudomonas aeruginosa PA01
gccuccccggacaccguggcaa

SEQ ID NO: 5733 - RNA, 22 nt, Pseudomonas aeruginosa PA01
gccuggagaauaucgucggcga

SEQ ID NO: 5734 - RNA, 22 nt, Pseudomonas aeruginosa PA01
gccuggagaucgagcagucccc

SEQ ID NO: 5735 - RNA, 22 nt, Pseudomonas aeruginosa PA01
gccuggagggucacgcugucgu

SEQ ID NO: 5736 - RNA, 22 nt, Pseudomonas aeruginosa PA01
gccuggagguccaggcgcuggc

SEQ ID NO: 5737 - RNA, 22 nt, Pseudomonas aeruginosa PA01
gccugcgauuuccugcgcguuc

SEQ ID NO: 5738 - RNA, 22 nt, Pseudomonas aeruginosa PA01
gccugcgcaacuggccgcgcug

SEQ ID NO: 5739 - RNA, 22 nt, Pseudomonas aeruginosa PA01
gccuuggucgccgcgaucaccc

SEQ ID NO: 5740 - RNA, 22 nt, Pseudomonas aeruginosa PA01
gccuuggugcacgaggcgcagg

SEQ ID NO: 5741 - RNA, 22 nt, Pseudomonas aeruginosa PA01
gccugucccgcgaacuggagaa

SEQ ID NO: 5742 - RNA, 22 nt, Pseudomonas aeruginosa PA01
gccugggcgaugcccgcgucga

SEQ ID NO: 5743 - RNA, 22 nt, Pseudomonas aeruginosa PA01
gccugggguagggagggcgaca

SEQ ID NO: 5744 - RNA, 22 nt, Pseudomonas aeruginosa PA01
gccugagcgagacucaggacac

SEQ ID NO: 5745 - RNA, 22 nt, Pseudomonas aeruginosa PA01
gccugcagaaggucggcggcga

SEQ ID NO: 5746 - RNA, 22 nt, Pseudomonas aeruginosa PA01
gccuucuucauguccggaguuu

SEQ ID NO: 5747 - RNA, 22 nt, Pseudomonas aeruginosa PA01
gcgccgcggaaagcagccuggc

SEQ ID NO: 5748 - RNA, 22 nt, Pseudomonas aeruginosa PA01
gcgccagcgaacaacugggcga

SEQ ID NO: 5749 - RNA, 22 nt, Pseudomonas aeruginosa PA01
gcgccagcgcaccgccaugggc

SEQ ID NO: 5750 - RNA, 22 nt, Pseudomonas aeruginosa PA01
gcgcccacuccaaccaccugca

SEQ ID NO: 5751 - RNA, 22 nt, Pseudomonas aeruginosa PA01
gcgccccggugccgccguggaa

SEQ ID NO: 5752 - RNA, 22 nt, Pseudomonas aeruginosa PA01
gcgccccucuugcccaucgagg

SEQ ID NO: 5753 - RNA, 22 nt, Pseudomonas aeruginosa PA01
gcgccccuggaagagccgccgg

SEQ ID NO: 5754 - RNA, 22 nt, Pseudomonas aeruginosa PA01
gcgccccugguccagcggcagc

SEQ ID NO: 5755 - RNA, 22 nt, Pseudomonas aeruginosa PA01
gcgcccgcgacuacccgcugga

SEQ ID NO: 5756 - RNA, 22 nt, Pseudomonas aeruginosa PA01
gcgcccggccgagcgccaucug

SEQ ID NO: 5757 - RNA, 22 nt, Pseudomonas aeruginosa PA01
gcgcccggugugccggcuggcg

SEQ ID NO: 5758 - RNA, 22 nt, Pseudomonas aeruginosa PA01
gcgccgagcaauucggcgagca

SEQ ID NO: 5759 - RNA, 22 nt, Pseudomonas aeruginosa PA01
gcgccgaggcaggcguggaccu

SEQ ID NO: 5760 - RNA, 22 nt, Pseudomonas aeruginosa PA01
gcgccgccgccgggguguccag

SEQ ID NO: 5761 - RNA, 22 nt, Pseudomonas aeruginosa PA01
gcgccggcaggcccugggccuc

SEQ ID NO: 5762 - RNA, 18 nt, Pseudomonas aeruginosa PA01
gcgccgggcugcccuggg

SEQ ID NO: 5763 - RNA, 22 nt, Pseudomonas aeruginosa PA01
gcgccggggaugaucggcgagc

SEQ ID NO: 5764 - RNA, 22 nt, Pseudomonas aeruginosa PA01
gcgccggguuucaucgucgcca

SEQ ID NO: 5765 - RNA, 20 nt, Pseudomonas aeruginosa PA01
gcgccuggugcagcggaucc

SEQ ID NO: 5766 - RNA, 22 nt, Pseudomonas aeruginosa PA01
gcgcgaaggacggccgcggguu

SEQ ID NO: 5767 - RNA, 22 nt, Pseudomonas aeruginosa PA01
gcgcgacagugguagcggcgac

SEQ ID NO: 5768 - RNA, 22 nt, Pseudomonas aeruginosa PA01
gcgcgacgcggggauggacgug

SEQ ID NO: 5769 - RNA, 22 nt, Pseudomonas aeruginosa PA01
gcgcgacgcuguugcuggcggg

SEQ ID NO: 5770 - RNA, 22 nt, Pseudomonas aeruginosa PA01
gcgcgagcgccugggucggcag

SEQ ID NO: 5771 - RNA, 22 nt, Pseudomonas aeruginosa PA01
gcgcgaggaacuggccggcgag

SEQ ID NO: 5772 - RNA, 22 nt, Pseudomonas aeruginosa PA01
gcgcgaggugcuggcgccgagg

SEQ ID NO: 5773 - RNA, 22 nt, Pseudomonas aeruginosa PA01
gcgcgcaccuggaccgcaacaa

SEQ ID NO: 5774 - RNA, 22 nt, Pseudomonas aeruginosa PA01
gcgcgcaccuggcgccguuccu

SEQ ID NO: 5775 - RNA, 17 nt, Pseudomonas aeruginosa PA01
gcgcgcacgacaggcgc

SEQ ID NO: 5776 - RNA, 22 nt, Pseudomonas aeruginosa PA01
gcgcgcagcaguggcuggcguu

SEQ ID NO: 5777 - RNA, 22 nt, Pseudomonas aeruginosa PA01
gcgcgcagcgagacgguggugc

SEQ ID NO: 5778 - RNA, 22 nt, Pseudomonas aeruginosa PA01
gcgcgcaggagcccggcaccgg

SEQ ID NO: 5779 - RNA, 20 nt, Pseudomonas aeruginosa PA01
gcgcgcaggccaccuucgac

SEQ ID NO: 5780 - RNA, 23 nt, Pseudomonas aeruginosa PA01
gcgcgcaggccaucggcaucguc

SEQ ID NO: 5781 - RNA, 22 nt, Pseudomonas aeruginosa PA01
gcgcgccagcaggcugccgggu

SEQ ID NO: 5782 - RNA, 22 nt, Pseudomonas aeruginosa PA01
gcgcgccgaaucccugggucgg

SEQ ID NO: 5783 - RNA, 22 nt, Pseudomonas aeruginosa PA01
gcgcgccgaccagucgcgagga

SEQ ID NO: 5784 - RNA, 22 nt, Pseudomonas aeruginosa PA01
gcgcgccggcaucaagagagua

SEQ ID NO: 5785 - RNA, 22 nt, Pseudomonas aeruginosa PA01
gcgcgccucuuccagcagccag

SEQ ID NO: 5786 - RNA, 22 nt, Pseudomonas aeruginosa PA01
gcgcgccuucaagagcgucggc

SEQ ID NO: 5787 - RNA, 22 nt, Pseudomonas aeruginosa PA01
gcgcgcgagaaagcggucggug

SEQ ID NO: 5788 - RNA, 22 nt, Pseudomonas aeruginosa PA01
gcgcgcggcuagaggaagaguc

SEQ ID NO: 5789 - RNA, 22 nt, Pseudomonas aeruginosa PA01
gcgcgcgguucucgauggagcc

SEQ ID NO: 5790 - RNA, 22 nt, Pseudomonas aeruginosa PA01
gcgcgcucggggugggcuuguu

SEQ ID NO: 5791 - RNA, 22 nt, Pseudomonas aeruginosa PA01
gcgcgcucuggggcaaggucug

SEQ ID NO: 5792 - RNA, 22 nt, Pseudomonas aeruginosa PA01
gcgcgcuggugcgacaagggcu

SEQ ID NO: 5793 - RNA, 16 nt, Pseudomonas aeruginosa PA01
gcgcggacgccgcgaa

SEQ ID NO: 5794 - RNA, 22 nt, Pseudomonas aeruginosa PA01
gcgcggcaccugccgggcagcc

SEQ ID NO: 5795 - RNA, 22 nt, Pseudomonas aeruginosa PA01
gcgcggccgaaggccagguucu

SEQ ID NO: 5796 - RNA, 22 nt, Pseudomonas aeruginosa PA01
gcgcggcgaacuucacccaugc

SEQ ID NO: 5797 - RNA, 22 nt, Pseudomonas aeruginosa PA01
gcgcggcgccucguccucgacc

SEQ ID NO: 5798 - RNA, 22 nt, Pseudomonas aeruginosa PA01
gcgcggcggaacagguggcgca

SEQ ID NO: 5799 - RNA, 22 nt, Pseudomonas aeruginosa PA01
gcgcggcgugucguacuccucc

SEQ ID NO: 5800 - RNA, 23 nt, Pseudomonas aeruginosa PA01
gcgcgggagcugguggugcccug

SEQ ID NO: 5801 - RNA, 21 nt, Pseudomonas aeruginosa PA01
gcgcgggcgagggcguagguc

SEQ ID NO: 5802 - RNA, 19 nt, Pseudomonas aeruginosa PA01
gcgcggggugcggaugcug

SEQ ID NO: 5803 - RNA, 22 nt, Pseudomonas aeruginosa PA01
gcgcgguggucuucaggccggc

SEQ ID NO: 5804 - RNA, 21 nt, Pseudomonas aeruginosa PA01
gcgcggugucgccaucgcgac

SEQ ID NO: 5805 - RNA, 22 nt, Pseudomonas aeruginosa PA01
gcgcguccauggcggcgucgag

SEQ ID NO: 5806 - RNA, 22 nt, Pseudomonas aeruginosa PA01
gcgcgucgacguagcugcaggc

SEQ ID NO: 5807 - RNA, 22 nt, Pseudomonas aeruginosa PA01
gcgcgucgcccugggugacgcg

SEQ ID NO: 5808 - RNA, 22 nt, Pseudomonas aeruginosa PA01
gcgcgugcauuggcuggccggc

SEQ ID NO: 5809 - RNA, 22 nt, Pseudomonas aeruginosa PA01
gcgcguggccgaacuggccgcc

SEQ ID NO: 5810 - RNA, 22 nt, Pseudomonas aeruginosa PA01
gcgcuccagcacuucguccagc

SEQ ID NO: 5811 - RNA, 22 nt, Pseudomonas aeruginosa PA01
gcgcuggagguguuccgccgcg

SEQ ID NO: 5812 - RNA, 16 nt, Pseudomonas aeruginosa PA01
gcgcuggauacggcgg

SEQ ID NO: 5813 - RNA, 22 nt, Pseudomonas aeruginosa PA01
gcgcuggcgcaacggcucguca

SEQ ID NO: 5814 - RNA, 22 nt, Pseudomonas aeruginosa PA01
gcgcuggcguucgacgagcugg

SEQ ID NO: 5815 - RNA, 22 nt, Pseudomonas aeruginosa PA01
gcgcuggcugcgaucggcuggc

SEQ ID NO: 5816 - RNA, 22 nt, Pseudomonas aeruginosa PA01
gcgcuucuacaagcgacgccgg

SEQ ID NO: 5817 - RNA, 22 nt, Pseudomonas aeruginosa PA01
gcggucaccccgcccugcuccu

SEQ ID NO: 5818 - RNA, 22 nt, Pseudomonas aeruginosa PA01
gcggucaccggccagccggucu

SEQ ID NO: 5819 - RNA, 22 nt, Pseudomonas aeruginosa PA01
gcgguggccuacgaggccgaau

SEQ ID NO: 5820 - RNA, 22 nt, Pseudomonas aeruginosa PA01
gcgguggcgauccagcccggcg

SEQ ID NO: 5821 - RNA, 22 nt, Pseudomonas aeruginosa PA01
gcggaagaacucgaugacgccc

SEQ ID NO: 5822 - RNA, 22 nt, Pseudomonas aeruginosa PA01
gcggaagcgcugcgggucgucc

SEQ ID NO: 5823 - RNA, 22 nt, Pseudomonas aeruginosa PA01
gcggaauggcugucgccccaac

SEQ ID NO: 5824 - RNA, 22 nt, Pseudomonas aeruginosa PA01
gcggacgccuggcccguccugg

SEQ ID NO: 5825 - RNA, 22 nt, Pseudomonas aeruginosa PA01
gcggacgcucuucggugaagcg

SEQ ID NO: 5826 - RNA, 22 nt, Pseudomonas aeruginosa PA01
gcggagcgcuggucgcuguucc

SEQ ID NO: 5827 - RNA, 22 nt, Pseudomonas aeruginosa PA01
gcggauagcgcuggggcgcuau

SEQ ID NO: 5828 - RNA, 22 nt, Pseudomonas aeruginosa PA01
gcggcagcccgggcaacggcag

SEQ ID NO: 5829 - RNA, 22 nt, Pseudomonas aeruginosa PA01
gcggcagcgagcgccaggagga

SEQ ID NO: 5830 - RNA, 18 nt, Pseudomonas aeruginosa PA01
gcggccgguucgggaagu

SEQ ID NO: 5831 - RNA, 18 nt, Pseudomonas aeruginosa PA01
gcggcgccgggccagcag

SEQ ID NO: 5832 - RNA, 22 nt, Pseudomonas aeruginosa PA01
gcggcgcgggucuggcugagca

SEQ ID NO: 5833 - RNA, 22 nt, Pseudomonas aeruginosa PA01
gcggcgcguccaggcgaucgag

SEQ ID NO: 5834 - RNA, 18 nt, Pseudomonas aeruginosa PA01
gcggcgcguuggcgaucg

SEQ ID NO: 5835 - RNA, 22 nt, Pseudomonas aeruginosa PA01
gcggcggccucugguauggcaa

SEQ ID NO: 5836 - RNA, 22 nt, Pseudomonas aeruginosa PA01
gcggcggccugccccuggcgag

SEQ ID NO: 5837 - RNA, 22 nt, Pseudomonas aeruginosa PA01
gcggcggcgaacugggcgaagc

SEQ ID NO: 5838 - RNA, 22 nt, Pseudomonas aeruginosa PA01
gcggcggcgucucgugggccug

SEQ ID NO: 5839 - RNA, 22 nt, Pseudomonas aeruginosa PA01
gcggcggguaagcgcaagcggu

SEQ ID NO: 5840 - RNA, 22 nt, Pseudomonas aeruginosa PA01
gcggcgugacccuguccggcga

SEQ ID NO: 5841 - RNA, 22 nt, Pseudomonas aeruginosa PA01
gcggcgugccagaggcagaguu

SEQ ID NO: 5842 - RNA, 22 nt, Pseudomonas aeruginosa PA01
gcggcucgcugaaagccgagcc

SEQ ID NO: 5843 - RNA, 22 nt, Pseudomonas aeruginosa PA01
gcggcugcgccuggaacggcuc

SEQ ID NO: 5844 - RNA, 22 nt, Pseudomonas aeruginosa PA01
gcggcugguugaucucgugggc

SEQ ID NO: 5845 - RNA, 22 nt, Pseudomonas aeruginosa PA01
gcgggagccgcaggcgccccau

SEQ ID NO: 5846 - RNA, 22 nt, Pseudomonas aeruginosa PA01
gcgggaggaucgaauugcaggc

SEQ ID NO: 5847 - RNA, 22 nt, Pseudomonas aeruginosa PA01
gcgggaggcccuggauaccaug

SEQ ID NO: 5848 - RNA, 22 nt, Pseudomonas aeruginosa PA01
gcgggcagggccuugucagccc

SEQ ID NO: 5849 - RNA, 22 nt, Pseudomonas aeruginosa PA01
gcgggccggcgaacaaugcgug

SEQ ID NO: 5850 - RNA, 22 nt, Pseudomonas aeruginosa PA01
gcgggcgcccugccgaggcugg

SEQ ID NO: 5851 - RNA, 22 nt, Pseudomonas aeruginosa PA01
gcgggcgcgggucgucguugcc

SEQ ID NO: 5852 - RNA, 22 nt, Pseudomonas aeruginosa PA01
gcgggcgggugcuggaacugac

SEQ ID NO: 5853 - RNA, 22 nt, Pseudomonas aeruginosa PA01
gcggggcaucgcuggcccagcg

SEQ ID NO: 5854 - RNA, 22 nt, Pseudomonas aeruginosa PA01
gcguccggaaaaggucucggcc

SEQ ID NO: 5855 - RNA, 22 nt, Pseudomonas aeruginosa PA01
gcguccgggguuuccugcuggc

SEQ ID NO: 5856 - RNA, 22 nt, Pseudomonas aeruginosa PA01
gcgucgcggacuaccugcaggg

SEQ ID NO: 5857 - RNA, 22 nt, Pseudomonas aeruginosa PA01
gcgucggccgcagaugaacucg

SEQ ID NO: 5858 - RNA, 22 nt, Pseudomonas aeruginosa PA01
gcgucggcugcaucgcacgacc

SEQ ID NO: 5859 - RNA, 19 nt, Pseudomonas aeruginosa PA01
gcgucggcuuccuugacga

SEQ ID NO: 5860 - RNA, 21 nt, Pseudomonas aeruginosa PA01
gcgugcagcucgcccucagcc

SEQ ID NO: 5861 - RNA, 22 nt, Pseudomonas aeruginosa PA01
gcgugccggacuggguggugag

SEQ ID NO: 5862 - RNA, 22 nt, Pseudomonas aeruginosa PA01
gcgugccgucggucagcgguac

SEQ ID NO: 5863 - RNA, 22 nt, Pseudomonas aeruginosa PA01
gcgugccgucuuccagggugcc

SEQ ID NO: 5864 - RNA, 22 nt, Pseudomonas aeruginosa PA01
gcucgcgguacggagccggccc

SEQ ID NO: 5865 - RNA, 22 nt, Pseudomonas aeruginosa PA01
gcucgcucaucaucacgaaauc

SEQ ID NO: 5866 - RNA, 17 nt, Pseudomonas aeruginosa PA01
gcucgcucggcggcagc

SEQ ID NO: 5867 - RNA, 22 nt, Pseudomonas aeruginosa PA01
gcucgcugggguccagccagag

SEQ ID NO: 5868 - RNA, 22 nt, Pseudomonas aeruginosa PA01
gcucggcguggcguugccgggc

SEQ ID NO: 5869 - RNA, 22 nt, Pseudomonas aeruginosa PA01
gcucgggcaguugcgccgcugu

SEQ ID NO: 5870 - RNA, 22 nt, Pseudomonas aeruginosa PA01
gcucgguccuguugcuggccca

SEQ ID NO: 5871 - RNA, 18 nt, Pseudomonas aeruginosa PA01
gcucggucugugccgggu

SEQ ID NO: 5872 - RNA, 22 nt, Pseudomonas aeruginosa PA01
gcucgucggugaccggcgagac

SEQ ID NO: 5873 - RNA, 22 nt, Pseudomonas aeruginosa PA01
gcuccauuuauccaggggcaga

SEQ ID NO: 5874 - RNA, 22 nt, Pseudomonas aeruginosa PA01
gcucccguccacgcggcaacgg

SEQ ID NO: 5875 - RNA, 22 nt, Pseudomonas aeruginosa PA01
gcuccgccuucuugucguugug

SEQ ID NO: 5876 - RNA, 22 nt, Pseudomonas aeruginosa PA01
gcuccgcucuuggcgccgccca

SEQ ID NO: 5877 - RNA, 22 nt, Pseudomonas aeruginosa PA01
gcuccggcaggugaucguaguc

SEQ ID NO: 5878 - RNA, 21 nt, Pseudomonas aeruginosa PA01
gcuccggcugaucgucggcau

SEQ ID NO: 5879 - RNA, 22 nt, Pseudomonas aeruginosa PA01
gcuccucuggaaccguucgaac

SEQ ID NO: 5880 - RNA, 22 nt, Pseudomonas aeruginosa PA01
gcuccugcgcgagcgccuggag

SEQ ID NO: 5881 - RNA, 22 nt, Pseudomonas aeruginosa PA01
gcucgccgacgucgccagcgac

SEQ ID NO: 5882 - RNA, 22 nt, Pseudomonas aeruginosa PA01
gcucgccuggcugcgcagcgag

SEQ ID NO: 5883 - RNA, 22 nt, Pseudomonas aeruginosa PA01
gcucgcgauugccguccagcca

SEQ ID NO: 5884 - RNA, 22 nt, Pseudomonas aeruginosa PA01
ggagguccgucaugccgcucga

SEQ ID NO: 5885 - RNA, 22 nt, Pseudomonas aeruginosa PA01
ggagucgcccucgaccaggaac

SEQ ID NO: 5886 - RNA, 22 nt, Pseudomonas aeruginosa PA01
ggaggaaggcggugcggaccuu

SEQ ID NO: 5887 - RNA, 22 nt, Pseudomonas aeruginosa PA01
ggaggcgccgcgcuggaagcug

SEQ ID NO: 5888 - RNA, 22 nt, Pseudomonas aeruginosa PA01
ggagggcgaguuccugguggau

SEQ ID NO: 5889 - RNA, 22 nt, Pseudomonas aeruginosa PA01
ggagggcgccagcgaggugccg

SEQ ID NO: 5890 - RNA, 22 nt, Pseudomonas aeruginosa PA01
ggaucggaaaagugcuggcgag

SEQ ID NO: 5891 - RNA, 22 nt, Pseudomonas aeruginosa PA01
ggcaccagcaggcgcgaggcga

SEQ ID NO: 5892 - RNA, 20 nt, Pseudomonas aeruginosa PA01
ggcagaugcgauccagcucc

SEQ ID NO: 5893 - RNA, 21 nt, Pseudomonas aeruginosa PA01
ggaugccggcauguucggcgg

SEQ ID NO: 5894 - RNA, 22 nt, Pseudomonas aeruginosa PA01
ggaugcgcaggucggcgugcuc

SEQ ID NO: 5895 - RNA, 23 nt, Pseudomonas aeruginosa PA01
ggaugcugucgacccgcucgcgc

SEQ ID NO: 5896 - RNA, 23 nt, Pseudomonas aeruginosa PA01
ggccacacaggugcccgccggga

SEQ ID NO: 5897 - RNA, 22 nt, Pseudomonas aeruginosa PA01
ggccagcaggaugcgcccggcg

SEQ ID NO: 5898 - RNA, 22 nt, Pseudomonas aeruginosa PA01
ggcagcuucgaccgcccguucg

SEQ ID NO: 5899 - RNA, 22 nt, Pseudomonas aeruginosa PA01
ggcaggaagcuuuccggcaguu

SEQ ID NO: 5900 - RNA, 22 nt, Pseudomonas aeruginosa PA01
ggcagcagguguggaaggccuc

SEQ ID NO: 5901 - RNA, 22 nt, Pseudomonas aeruginosa PA01
ggcagccgcgaggucgccgggc

SEQ ID NO: 5902 - RNA, 22 nt, Pseudomonas aeruginosa PA01
ggccgcgcuggcggaggaggaa

SEQ ID NO: 5903 - RNA, 22 nt, Pseudomonas aeruginosa PA01
ggccgcucugcugcagggccug

SEQ ID NO: 5904 - RNA, 22 nt, Pseudomonas aeruginosa PA01
ggccggcaccgaugucaccgcg

SEQ ID NO: 5905 - RNA, 22 nt, Pseudomonas aeruginosa PA01
ggccggcgaaccuggcaacugg

SEQ ID NO: 5906 - RNA, 22 nt, Pseudomonas aeruginosa PA01
ggccggcgaacucgcggucggu

SEQ ID NO: 5907 - RNA, 22 nt, Pseudomonas aeruginosa PA01
ggccggcgacgguggccgaggu

SEQ ID NO: 5908 - RNA, 22 nt, Pseudomonas aeruginosa PA01
ggccggcgccuguccgaccugc

SEQ ID NO: 5909 - RNA, 22 nt, Pseudomonas aeruginosa PA01
ggccggcgguguccuuggcgaa

SEQ ID NO: 5910 - RNA, 22 nt, Pseudomonas aeruginosa PA01
ggccgggaagucuucgucggcc

SEQ ID NO: 5911 - RNA, 22 nt, Pseudomonas aeruginosa PA01
ggccgggacgaagccggggaaa

SEQ ID NO: 5912 - RNA, 23 nt, Pseudomonas aeruginosa PA01
ggccgggaucgagcaacuggcgc

SEQ ID NO: 5913 - RNA, 22 nt, Pseudomonas aeruginosa PA01
ggccgggucgauacgcaggcug

SEQ ID NO: 5914 - RNA, 22 nt, Pseudomonas aeruginosa PA01
ggccgccgagccaggccucgcg

SEQ ID NO: 5915 - RNA, 22 nt, Pseudomonas aeruginosa PA01
ggccgccgaugcugaccucggc

SEQ ID NO: 5916 - RNA, 22 nt, Pseudomonas aeruginosa PA01
ggccgccgccgacuugucggug

SEQ ID NO: 5917 - RNA, 22 nt, Pseudomonas aeruginosa PA01
ggccgccgcguggcgucggagu

SEQ ID NO: 5918 - RNA, 23 nt, Pseudomonas aeruginosa PA01
ggccgccggcgauacgcuccugg

SEQ ID NO: 5919 - RNA, 22 nt, Pseudomonas aeruginosa PA01
ggccgccguagccgcugaucag

SEQ ID NO: 5920 - RNA, 22 nt, Pseudomonas aeruginosa PA01
ggccgcgaagugacguaggcca

SEQ ID NO: 5921 - RNA, 22 nt, Pseudomonas aeruginosa PA01
ggccgcgccgggagagcggaca

SEQ ID NO: 5922 - RNA, 22 nt, Pseudomonas aeruginosa PA01
ggccgagcacgucggcuucgag

SEQ ID NO: 5923 - RNA, 19 nt, Pseudomonas aeruginosa PA01
ggccgaggccgagaguuuc

SEQ ID NO: 5924 - RNA, 22 nt, Pseudomonas aeruginosa PA01
ggccgcaggccuggagugccug

SEQ ID NO: 5925 - RNA, 16 nt, Pseudomonas aeruginosa PA01
ggccgcagggccaggc

SEQ ID NO: 5926 - RNA, 22 nt, Pseudomonas aeruginosa PA01
ggcccgggugauccuccagcau

SEQ ID NO: 5927 - RNA, 22 nt, Pseudomonas aeruginosa PA01
ggcccgucgccgcgccugaggc

SEQ ID NO: 5928 - RNA, 22 nt, Pseudomonas aeruginosa PA01
ggcccuggaucucgcccugcca

SEQ ID NO: 5929 - RNA, 22 nt, Pseudomonas aeruginosa PA01
ggcccuggcgaugcgcuggcug

SEQ ID NO: 5930 - RNA, 22 nt, Pseudomonas aeruginosa PA01
ggccccucggcggccuggcugc

SEQ ID NO: 5931 - RNA, 22 nt, Pseudomonas aeruginosa PA01
ggccagcucgcgcagggcaugg

SEQ ID NO: 5932 - RNA, 22 nt, Pseudomonas aeruginosa PA01
ggccagggcgaccgcgagcggg

SEQ ID NO: 5933 - RNA, 22 nt, Pseudomonas aeruginosa PA01
ggccuggagcgcggccaggccu

SEQ ID NO: 5934 - RNA, 22 nt, Pseudomonas aeruginosa PA01
ggccugggccuggaagacguag

SEQ ID NO: 5935 - RNA, 22 nt, Pseudomonas aeruginosa PA01
ggccugggcggccaggacuaca

SEQ ID NO: 5936 - RNA, 20 nt, Pseudomonas aeruginosa PA01
ggccuggggcgacgaugcgc

SEQ ID NO: 5937 - RNA, 22 nt, Pseudomonas aeruginosa PA01
ggccggguugccgcugacgccg

SEQ ID NO: 5938 - RNA, 22 nt, Pseudomonas aeruginosa PA01
ggccgugggccggcgaagccug

SEQ ID NO: 5939 - RNA, 17 nt, Pseudomonas aeruginosa PA01
ggcgaccaggucggcgu

SEQ ID NO: 5940 - RNA, 22 nt, Pseudomonas aeruginosa PA01
ggcgacccggacuucgccggcg

SEQ ID NO: 5941 - RNA, 22 nt, Pseudomonas aeruginosa PA01
ggcgacgccggcggcacccagu

SEQ ID NO: 5942 - RNA, 22 nt, Pseudomonas aeruginosa PA01
ggcgccacggugcuggagcacg

SEQ ID NO: 5943 - RNA, 22 nt, Pseudomonas aeruginosa PA01
ggcgccagggaguggcuccgcg

SEQ ID NO: 5944 - RNA, 22 nt, Pseudomonas aeruginosa PA01
ggcgcccagcgucgccaggcuc

SEQ ID NO: 5945 - RNA, 22 nt, Pseudomonas aeruginosa PA01
ggcgcccggcgaacagcuugcg

SEQ ID NO: 5946 - RNA, 22 nt, Pseudomonas aeruginosa PA01
ggcgccggcagguccaggcgcu

SEQ ID NO: 5947 - RNA, 22 nt, Pseudomonas aeruginosa PA01
ggcgcgaguugcugcgcgucua

SEQ ID NO: 5948 - RNA, 22 nt, Pseudomonas aeruginosa PA01
ggcgcgcaccgcgugggacagg

SEQ ID NO: 5949 - RNA, 22 nt, Pseudomonas aeruginosa PA01
ggcgcgcaggcgcagaacaccu

SEQ ID NO: 5950 - RNA, 22 nt, Pseudomonas aeruginosa PA01
ggcgcgcaggcugaagaaggcg

SEQ ID NO: 5951 - RNA, 22 nt, Pseudomonas aeruginosa PA01
ggcgcgcaucgcggaccugcuc

SEQ ID NO: 5952 - RNA, 22 nt, Pseudomonas aeruginosa PA01
ggcgcgccagcaggcuccagcc

SEQ ID NO: 5953 - RNA, 19 nt, Pseudomonas aeruginosa PA01
ggcgcgccaggucuggcug

SEQ ID NO: 5954 - RNA, 22 nt, Pseudomonas aeruginosa PA01
ggcgcgccaguucggccacgag

SEQ ID NO: 5955 - RNA, 22 nt, Pseudomonas aeruginosa PA01
ggcgcggcucguggaucagcgc

SEQ ID NO: 5956 - RNA, 22 nt, Pseudomonas aeruginosa PA01
gcuguucuucaagcacgccgaa

SEQ ID NO: 5957 - RNA, 22 nt, Pseudomonas aeruginosa PA01
gcugguggugcagcccaggcaa

SEQ ID NO: 5958 - RNA, 21 nt, Pseudomonas aeruginosa PA01
ggaaaucagcucggugagguu

SEQ ID NO: 5959 - RNA, 22 nt, Pseudomonas aeruginosa PA01
gcuuccggcgaagcuccagcga

SEQ ID NO: 5960 - RNA, 23 nt, Pseudomonas aeruginosa PA01
gcuucggccuggucgguuuccgc

SEQ ID NO: 5961 - RNA, 19 nt, Pseudomonas aeruginosa PA01
gcuucgucacccuggaggc

SEQ ID NO: 5962 - RNA, 22 nt, Pseudomonas aeruginosa PA01
gcuucguccgcgugguggcgcg

SEQ ID NO: 5963 - RNA, 22 nt, Pseudomonas aeruginosa PA01
gcuucuucgagcagggcaaggg

SEQ ID NO: 5964 - RNA, 22 nt, Pseudomonas aeruginosa PA01
gcuucuucgccacccuggugca

SEQ ID NO: 5965 - RNA, 22 nt, Pseudomonas aeruginosa PA01
ggaagcggaacagcgcgccaug

SEQ ID NO: 5966 - RNA, 20 nt, Pseudomonas aeruginosa PA01
ggaagugaacacgcggacgg

SEQ ID NO: 5967 - RNA, 22 nt, Pseudomonas aeruginosa PA01
ggaagugaaggucggcgaccug

SEQ ID NO: 5968 - RNA, 22 nt, Pseudomonas aeruginosa PA01
gcuuucccccgccgcgcucuuc

SEQ ID NO: 5969 - RNA, 22 nt, Pseudomonas aeruginosa PA01
ggaaccauggucgagagccucg

SEQ ID NO: 5970 - RNA, 22 nt, Pseudomonas aeruginosa PA01
ggacgccgaggaccaggcgcgc

SEQ ID NO: 5971 - RNA, 22 nt, Pseudomonas aeruginosa PA01
ggacgcgcagugccggcaccgc

SEQ ID NO: 5972 - RNA, 22 nt, Pseudomonas aeruginosa PA01
ggagccguccucgccggccugg

SEQ ID NO: 5973 - RNA, 22 nt, Pseudomonas aeruginosa PA01
ggagccguugcagugguagcac

SEQ ID NO: 5974 - RNA, 22 nt, Pseudomonas aeruginosa PA01
ggagcgccugugggaucguccc

SEQ ID NO: 5975 - RNA, 22 nt, Pseudomonas aeruginosa PA01
ggagcgcgugaccggcuacggu

SEQ ID NO: 5976 - RNA, 22 nt, Pseudomonas aeruginosa PA01
ggagcgggccuuagcccaggug

SEQ ID NO: 5977 - RNA, 22 nt, Pseudomonas aeruginosa PA01
ggaccgcgcgaggagacgccgg

SEQ ID NO: 5978 - RNA, 22 nt, Pseudomonas aeruginosa PA01
ggagcacgcgguggcggcugug

SEQ ID NO: 5979 - RNA, 22 nt, Pseudomonas aeruginosa PA01
ggagcagccggagaucgcugcg

SEQ ID NO: 5980 - RNA, 22 nt, Pseudomonas aeruginosa PA01
gcugcagucggcaacuggcucu

SEQ ID NO: 5981 - RNA, 22 nt, Pseudomonas aeruginosa PA01
gcugcggccgcgguacaggcug

SEQ ID NO: 5982 - RNA, 22 nt, Pseudomonas aeruginosa PA01
gcugcggcuauugcggcucagc

SEQ ID NO: 5983 - RNA, 22 nt, Pseudomonas aeruginosa PA01
gcugccggcgaucgucgaggcg

SEQ ID NO: 5984 - RNA, 23 nt, Pseudomonas aeruginosa PA01
gcugccggcggcgucguugucgu

SEQ ID NO: 5985 - RNA, 22 nt, Pseudomonas aeruginosa PA01
gcugcgcaaguaccuggcgcgu

SEQ ID NO: 5986 - RNA, 21 nt, Pseudomonas aeruginosa PA01
gcugcgcaucuccgcggccgg

SEQ ID NO: 5987 - RNA, 22 nt, Pseudomonas aeruginosa PA01
gcugcgcgagcguggcugggac

SEQ ID NO: 5988 - RNA, 22 nt, Pseudomonas aeruginosa PA01
gcugcgcgccgaccagcggguc

SEQ ID NO: 5989 - RNA, 22 nt, Pseudomonas aeruginosa PA01
gcugcgcggcauuuucagggcg

SEQ ID NO: 5990 - RNA, 22 nt, Pseudomonas aeruginosa PA01
gcugcgcggccugggcgucguc

SEQ ID NO: 5991 - RNA, 22 nt, Pseudomonas aeruginosa PA01
gcugcggcaacgacaucgccca

SEQ ID NO: 5992 - RNA, 22 nt, Pseudomonas aeruginosa PA01
gcugaggcguuccgccggcccg

SEQ ID NO: 5993 - RNA, 22 nt, Pseudomonas aeruginosa PA01
gcugaagggcuccgcgcugucc

SEQ ID NO: 5994 - RNA, 22 nt, Pseudomonas aeruginosa PA01
gcucaggcccaggccgagcgcg

SEQ ID NO: 5995 - RNA, 22 nt, Pseudomonas aeruginosa PA01
gcucaggcgaugccugcuugcu

SEQ ID NO: 5996 - RNA, 22 nt, Pseudomonas aeruginosa PA01
gcguggugcugaugaucggcgg

SEQ ID NO: 5997 - RNA, 22 nt, Pseudomonas aeruginosa PA01
gcucuugcggaucgccuucggc

SEQ ID NO: 5998 - RNA, 22 nt, Pseudomonas aeruginosa PA01
gcuggaggcgcgcaucgcucga

SEQ ID NO: 5999 - RNA, 22 nt, Pseudomonas aeruginosa PA01
gcuggcgcugaccgucugccug

SEQ ID NO: 6000 - RNA, 22 nt, Pseudomonas aeruginosa PA01
gcuggcggagaagugcggguug

SEQ ID NO: 6001 - RNA, 22 nt, Pseudomonas aeruginosa PA01
gcuggcgggcauccgcgugcgg

SEQ ID NO: 6002 - RNA, 22 nt, Pseudomonas aeruginosa PA01
gcugguaguggucgagcaucau

SEQ ID NO: 6003 - RNA, 22 nt, Pseudomonas aeruginosa PA01
gcugggggaagcguucgcggag

SEQ ID NO: 6004 - RNA, 22 nt, Pseudomonas aeruginosa PA01
gcugcuggccaguucggagcgc

SEQ ID NO: 6005 - RNA, 22 nt, Pseudomonas aeruginosa PA01
gcugcuggcgguauucggccac

SEQ ID NO: 6006 - RNA, 22 nt, Pseudomonas aeruginosa PA01
gcugcuggugccgcgcgcccau

SEQ ID NO: 6007 - RNA, 22 nt, Pseudomonas aeruginosa PA01
gcuggaaacccucggcgugguc

SEQ ID NO: 6008 - RNA, 22 nt, Pseudomonas aeruginosa PA01
gcuggaagcccaggcgugcgua

SEQ ID NO: 6009 - RNA, 22 nt, Pseudomonas aeruginosa PA01
gcuggccgaguuccgccgacag

SEQ ID NO: 6010 - RNA, 22 nt, Pseudomonas aeruginosa PA01
gcuggccgauuucgccgagcgc

SEQ ID NO: 6011 - RNA, 22 nt, Pseudomonas aeruginosa PA01
gcuggccgcugccggacagcca

SEQ ID NO: 6012 - RNA, 22 nt, Pseudomonas aeruginosa PA01
gcuggccggcuccgcgcugguc

SEQ ID NO: 6013 - RNA, 22 nt, Pseudomonas aeruginosa PA01
gcuggccgggucgcggcgccac

SEQ ID NO: 6014 - RNA, 22 nt, Pseudomonas aeruginosa PA01
cugggcggcugugccgcggugg

SEQ ID NO: 6015 - RNA, 22 nt, Pseudomonas aeruginosa PA01
cugggcgaucagcggccgcagg

SEQ ID NO: 6016 - RNA, 22 nt, Pseudomonas aeruginosa PA01
cuuguguuuuuacugucgaaau

SEQ ID NO: 6017 - RNA, 22 nt, Pseudomonas aeruginosa PA01
cuucggccuuggcguccuguag

SEQ ID NO: 6018 - RNA, 22 nt, Pseudomonas aeruginosa PA01
cuuccauggugacgccggucug

SEQ ID NO: 6019 - RNA, 22 nt, Pseudomonas aeruginosa PA01
cuggacgcccaugcggacgccc

SEQ ID NO: 6020 - RNA, 22 nt, Pseudomonas aeruginosa PA01
cuggaagcgcuggugccgccau

SEQ ID NO: 6021 - RNA, 22 nt, Pseudomonas aeruginosa PA01
cuggaaggcgagcaucuucaug

SEQ ID NO: 6022 - RNA, 22 nt, Pseudomonas aeruginosa PA01
cuggaagucggcguggugcaug

SEQ ID NO: 6023 - RNA, 22 nt, Pseudomonas aeruginosa PA01
cuggauuuuuugccggaaagcc

SEQ ID NO: 6024 - RNA, 22 nt, Pseudomonas aeruginosa PA01
cuggcggccguagccgagguug

SEQ ID NO: 6025 - RNA, 18 nt, Pseudomonas aeruginosa PA01
cuggccggaggcgaucga

SEQ ID NO: 6026 - RNA, 22 nt, Pseudomonas aeruginosa PA01
cugcuucaaggagcacuagacu

SEQ ID NO: 6027 - RNA, 22 nt, Pseudomonas aeruginosa PA01
cugcuuucgaagcgcucgcgcc

SEQ ID NO: 6028 - RNA, 22 nt, Pseudomonas aeruginosa PA01
cugcgaggcgauccauccgggc

SEQ ID NO: 6029 - RNA, 22 nt, Pseudomonas aeruginosa PA01
cugcgcgccaauggcgauccga

SEQ ID NO: 6030 - RNA, 22 nt, Pseudomonas aeruginosa PA01
cugcggcggaugggccggcuga

SEQ ID NO: 6031 - RNA, 22 nt, Pseudomonas aeruginosa PA01
cugcccgggagcggugcgcucg

SEQ ID NO: 6032 - RNA, 22 nt, Pseudomonas aeruginosa PA01
cugccggcaacucggcgauccc

SEQ ID NO: 6033 - RNA, 22 nt, Pseudomonas aeruginosa PA01
cugccggcaccggccuugacca

SEQ ID NO: 6034 - RNA, 22 nt, Pseudomonas aeruginosa PA01
cugccggccaggcggguguuca

SEQ ID NO: 6035 - RNA, 22 nt, Pseudomonas aeruginosa PA01
cugccggcccugguggcggcgg

SEQ ID NO: 6036 - RNA, 22 nt, Pseudomonas aeruginosa PA01
cugccggcgcaguccugcaugg

SEQ ID NO: 6037 - RNA, 22 nt, Pseudomonas aeruginosa PA01
cugccggcggauggcggguugc

SEQ ID NO: 6038 - RNA, 22 nt, Pseudomonas aeruginosa PA01
cugcaucacccgcucguggucc

SEQ ID NO: 6039 - RNA, 22 nt, Pseudomonas aeruginosa PA01
cugccccggcgcggcugagcau

SEQ ID NO: 6040 - RNA, 22 nt, Pseudomonas aeruginosa PA01
cugcaggccgaucucgcggauc

SEQ ID NO: 6041 - RNA, 22 nt, Pseudomonas aeruginosa PA01
gaccaggccgggcaacugcgcg

SEQ ID NO: 6042 - RNA, 22 nt, Pseudomonas aeruginosa PA01
gaccaggccggugaguccgccc

SEQ ID NO: 6043 - RNA, 22 nt, Pseudomonas aeruginosa PA01
gaccaggcguacguauagcagg

SEQ ID NO: 6044 - RNA, 22 nt, Pseudomonas aeruginosa PA01
gaccagccugcacgagggcauu

SEQ ID NO: 6045 - RNA, 22 nt, Pseudomonas aeruginosa PA01
gacgagcugauggucagccgca

SEQ ID NO: 6046 - RNA, 22 nt, Pseudomonas aeruginosa PA01
gacgaggacgaggaugucgagg

SEQ ID NO: 6047 - RNA, 22 nt, Pseudomonas aeruginosa PA01
gacccgccgacgccguucagca

SEQ ID NO: 6048 - RNA, 22 nt, Pseudomonas aeruginosa PA01
gacccgccgcgaugcgcuggua

SEQ ID NO: 6049 - RNA, 22 nt, Pseudomonas aeruginosa PA01
gacccggacaucauccuggucg

SEQ ID NO: 6050 - RNA, 23 nt, Pseudomonas aeruginosa PA01
gacccggcggccuuccgcaucgc

SEQ ID NO: 6051 - RNA, 22 nt, Pseudomonas aeruginosa PA01
gaccgcccagaugaggggaaga

SEQ ID NO: 6052 - RNA, 22 nt, Pseudomonas aeruginosa PA01
gacagcgccuggcgcgcggauu

SEQ ID NO: 6053 - RNA, 22 nt, Pseudomonas aeruginosa PA01
gacagcggacgauaggcgagca

SEQ ID NO: 6054 - RNA, 23 nt, Pseudomonas aeruginosa PA01
gacagcuggaucgcgcccagcgc

SEQ ID NO: 6055 - RNA, 22 nt, Pseudomonas aeruginosa PA01
gacgcaggcaugcgggcgcugc

SEQ ID NO: 6056 - RNA, 22 nt, Pseudomonas aeruginosa PA01
gacgcgcgccuggcgcaguggg

SEQ ID NO: 6057 - RNA, 22 nt, Pseudomonas aeruginosa PA01
gacugcgggaucgccagccgca

SEQ ID NO: 6058 - RNA, 22 nt, Pseudomonas aeruginosa PA01
gagagcgccaugccacugccca

SEQ ID NO: 6059 - RNA, 22 nt, Pseudomonas aeruginosa PA01
gaagugggcugggccguugguc

SEQ ID NO: 6060 - RNA, 22 nt, Pseudomonas aeruginosa PA01
gaagagcgccaacgucgagggc

SEQ ID NO: 6061 - RNA, 22 nt, Pseudomonas aeruginosa PA01
gaagaugcccuucaucuucaag

SEQ ID NO: 6062 - RNA, 22 nt, Pseudomonas aeruginosa PA01
gaagaugcugcccuccaccgcg

SEQ ID NO: 6063 - RNA, 22 nt, Pseudomonas aeruginosa PA01
gaagcgagugucgccgccgacg

SEQ ID NO: 6064 - RNA, 22 nt, Pseudomonas aeruginosa PA01
gauggcggauguugccgacgcu

SEQ ID NO: 6065 - RNA, 22 nt, Pseudomonas aeruginosa PA01
gauggcggccagggccaguggc

SEQ ID NO: 6066 - RNA, 22 nt, Pseudomonas aeruginosa PA01
gaugguccgggugcggucguug

SEQ ID NO: 6067 - RNA, 22 nt, Pseudomonas aeruginosa PA01
gaugcggaugcgcuugucgcgg

SEQ ID NO: 6068 - RNA, 22 nt, Pseudomonas aeruginosa PA01
gaugcguacgccgggcgagaug

SEQ ID NO: 6069 - RNA, 22 nt, Pseudomonas aeruginosa PA01
gaugcugaugaccgccgccggc

SEQ ID NO: 6070 - RNA, 22 nt, Pseudomonas aeruginosa PA01
gaugcuggcgaaguagccgcug

SEQ ID NO: 6071 - RNA, 22 nt, Pseudomonas aeruginosa PA01
gaugcuggucgcgcggagucac

SEQ ID NO: 6072 - RNA, 22 nt, Pseudomonas aeruginosa PA01
gauggagcaggugcgcgauggc

SEQ ID NO: 6073 - RNA, 22 nt, Pseudomonas aeruginosa PA01
gaggugacacuucuccagcauu

SEQ ID NO: 6074 - RNA, 22 nt, Pseudomonas aeruginosa PA01
gaugccgacgaucagccggagc

SEQ ID NO: 6075 - RNA, 22 nt, Pseudomonas aeruginosa PA01
gaugccggcggcuuccagcaag

SEQ ID NO: 6076 - RNA, 20 nt, Pseudomonas aeruginosa PA01
gagccggccgcggucgucgc

SEQ ID NO: 6077 - RNA, 22 nt, Pseudomonas aeruginosa PA01
gagccgggagcuggugcguggc

SEQ ID NO: 6078 - RNA, 22 nt, Pseudomonas aeruginosa PA01
gagcgagccgguuguucgaggc

SEQ ID NO: 6079 - RNA, 22 nt, Pseudomonas aeruginosa PA01
gagcgccaggugauccucggca

SEQ ID NO: 6080 - RNA, 22 nt, Pseudomonas aeruginosa PA01
gagcgccaugcgccaggcggcc

SEQ ID NO: 6081 - RNA, 22 nt, Pseudomonas aeruginosa PA01
gagcgccgagcaggaaugcgau

SEQ ID NO: 6082 - RNA, 22 nt, Pseudomonas aeruginosa PA01
gagcgccugcaggcgccgcugg

SEQ ID NO: 6083 - RNA, 22 nt, Pseudomonas aeruginosa PA01
gagcgcgaaggccuggugguga

SEQ ID NO: 6084 - RNA, 22 nt, Pseudomonas aeruginosa PA01
gagcgcgagguggagcgggucg

SEQ ID NO: 6085 - RNA, 22 nt, Pseudomonas aeruginosa PA01
gagcgcgccaccgccagcuuca

SEQ ID NO: 6086 - RNA, 22 nt, Pseudomonas aeruginosa PA01
gagcgcugcaagccggcgaguc

SEQ ID NO: 6087 - RNA, 22 nt, Pseudomonas aeruginosa PA01
gagcggcccucgauccgcuggu

SEQ ID NO: 6088 - RNA, 22 nt, Pseudomonas aeruginosa PA01
gagcggccggacuucggcgaga

SEQ ID NO: 6089 - RNA, 22 nt, Pseudomonas aeruginosa PA01
gagcggcgcaucgcgguggaga

SEQ ID NO: 6090 - RNA, 22 nt, Pseudomonas aeruginosa PA01
gagcaggccgcucuccucgccg

SEQ ID NO: 6091 - RNA, 22 nt, Pseudomonas aeruginosa PA01
gagcaggccguugccggacagu

SEQ ID NO: 6092 - RNA, 22 nt, Pseudomonas aeruginosa PA01
gagcagguagucgccgcgcccg

SEQ ID NO: 6093 - RNA, 22 nt, Pseudomonas aeruginosa PA01
gagcacuacacgaagcggcgcc

SEQ ID NO: 6094 - RNA, 22 nt, Pseudomonas aeruginosa PA01
gaggccccgggccggcggaacg

SEQ ID NO: 6095 - RNA, 22 nt, Pseudomonas aeruginosa PA01
gaggcgccacucggcagccugc

SEQ ID NO: 6096 - RNA, 22 nt, Pseudomonas aeruginosa PA01
gaggcgccggaaugggucgccg

SEQ ID NO: 6097 - RNA, 22 nt, Pseudomonas aeruginosa PA01
gaggcgcgcgggcugcucaacc

SEQ ID NO: 6098 - RNA, 22 nt, Pseudomonas aeruginosa PA01
gaggcgcggaucgaguucauca

SEQ ID NO: 6099 - RNA, 22 nt, Pseudomonas aeruginosa PA01
gaggaaguggccagcgcgcugg

SEQ ID NO: 6100 - RNA, 22 nt, Pseudomonas aeruginosa PA01
gaggaugcgcugcggcuucucg

SEQ ID NO: 6101 - RNA, 22 nt, Pseudomonas aeruginosa PA01
gaggcaguucaccuggcgguug

SEQ ID NO: 6102 - RNA, 22 nt, Pseudomonas aeruginosa PA01
gagggccgggugaucagcgucg

SEQ ID NO: 6103 - RNA, 22 nt, Pseudomonas aeruginosa PA01
gaggguaagugucgcuaaaggu

SEQ ID NO: 6104 - RNA, 22 nt, Pseudomonas aeruginosa PA01
gaggaacgucaggacacgcagg

SEQ ID NO: 6105 - RNA, 22 nt, Pseudomonas aeruginosa PA01
gagcucccaggcgucgccuggc

SEQ ID NO: 6106 - RNA, 22 nt, Pseudomonas aeruginosa PA01
gagcucgcucuggaugcgcguc

SEQ ID NO: 6107 - RNA, 22 nt, Pseudomonas aeruginosa PA01
gagcauccggcacaggcgcagg

SEQ ID NO: 6108 - RNA, 22 nt, Pseudomonas aeruginosa PA01
gagcauggcgcgcgagcugggg

SEQ ID NO: 6109 - RNA, 21 nt, Pseudomonas aeruginosa PA01
gagcagcucgggcggcgcgac

SEQ ID NO: 6110 - RNA, 22 nt, Pseudomonas aeruginosa PA01
gagcagcuggaucgggcgccgc

SEQ ID NO: 6111 - RNA, 22 nt, Pseudomonas aeruginosa PA01
gagcuggagaaccucggccugc

SEQ ID NO: 6112 - RNA, 22 nt, Pseudomonas aeruginosa PA01
gagcuggaguugcggauuggca

SEQ ID NO: 6113 - RNA, 22 nt, Pseudomonas aeruginosa PA01
gagcuggaugccgcgcagugcc

SEQ ID NO: 6114 - RNA, 22 nt, Pseudomonas aeruginosa PA01
gagcugcgcgaagcgcuggacg

SEQ ID NO: 6115 - RNA, 22 nt, Pseudomonas aeruginosa PA01
gagcuggaagcugcgcuggucg

SEQ ID NO: 6116 - RNA, 22 nt, Pseudomonas aeruginosa PA01
gagcuggaagugcucgcggugc

SEQ ID NO: 6117 - RNA, 18 nt, Pseudomonas aeruginosa PA01
gccagcagcgguucggcc

SEQ ID NO: 6118 - RNA, 22 nt, Pseudomonas aeruginosa PA01
gccacuccucguuccaggcuga

SEQ ID NO: 6119 - RNA, 22 nt, Pseudomonas aeruginosa PA01
gcaucgcgaccuuccgcgugga

SEQ ID NO: 6120 - RNA, 22 nt, Pseudomonas aeruginosa PA01
gccaggccaccgcgcucaacca

SEQ ID NO: 6121 - RNA, 22 nt, Pseudomonas aeruginosa PA01
gccaggccuaugccgcguacca

SEQ ID NO: 6122 - RNA, 22 nt, Pseudomonas aeruginosa PA01
gccagccugcucgcuggcgagc

SEQ ID NO: 6123 - RNA, 22 nt, Pseudomonas aeruginosa PA01
gccagcgccgccugaaccaggc

SEQ ID NO: 6124 - RNA, 22 nt, Pseudomonas aeruginosa PA01
gccagcgcguccgggucauggg

SEQ ID NO: 6125 - RNA, 22 nt, Pseudomonas aeruginosa PA01
gccagcagcucggcgccggcca

SEQ ID NO: 6126 - RNA, 22 nt, Pseudomonas aeruginosa PA01
gccagcaguucgcgggcacggg

SEQ ID NO: 6127 - RNA, 22 nt, Pseudomonas aeruginosa PA01
gccagccagaucggcgccggcc

SEQ ID NO: 6128 - RNA, 22 nt, Pseudomonas aeruginosa PA01
gccagccgaccgacucgccgcu

SEQ ID NO: 6129 - RNA, 17 nt, Pseudomonas aeruginosa PA01
gccagccgaucugcggc

SEQ ID NO: 6130 - RNA, 22 nt, Pseudomonas aeruginosa PA01
gccaggggcugcgccgcucagg

SEQ ID NO: 6131 - RNA, 22 nt, Pseudomonas aeruginosa PA01
gccaggccugcuacccgcuggc

SEQ ID NO: 6132 - RNA, 22 nt, Pseudomonas aeruginosa PA01
gccaggccugcucguguuccgg

SEQ ID NO: 6133 - RNA, 21 nt, Pseudomonas aeruginosa PA01
gccauccguucucgcggcgcu

SEQ ID NO: 6134 - RNA, 22 nt, Pseudomonas aeruginosa PA01
gcccacggcgcugccacagaag

SEQ ID NO: 6135 - RNA, 22 nt, Pseudomonas aeruginosa PA01
gcagcaggcgucggcgggccuc

SEQ ID NO: 6136 - RNA, 22 nt, Pseudomonas aeruginosa PA01
gcagcagggcgaggaucgcccg

SEQ ID NO: 6137 - RNA, 22 nt, Pseudomonas aeruginosa PA01
gcagcucgaccaggccgggcag

SEQ ID NO: 6138 - RNA, 22 nt, Pseudomonas aeruginosa PA01
gcagcuggaaguugucaacgaa

SEQ ID NO: 6139 - RNA, 22 nt, Pseudomonas aeruginosa PA01
gcagcuggcgccgaucuccgcg

SEQ ID NO: 6140 - RNA, 22 nt, Pseudomonas aeruginosa PA01
gcaggaagccggcgagcgcuug

SEQ ID NO: 6141 - RNA, 22 nt, Pseudomonas aeruginosa PA01
gcagcccguuccagccgccggu

SEQ ID NO: 6142 - RNA, 22 nt, Pseudomonas aeruginosa PA01
gcagcgaguagccgauccccgg

SEQ ID NO: 6143 - RNA, 22 nt, Pseudomonas aeruginosa PA01
gcagcgccacccgcggaucgaa

SEQ ID NO: 6144 - RNA, 22 nt, Pseudomonas aeruginosa PA01
gcagcgccaguugcuggacacc

SEQ ID NO: 6145 - RNA, 22 nt, Pseudomonas aeruginosa PA01
gcagcgcugcgcgagcagggug

SEQ ID NO: 6146 - RNA, 19 nt, Pseudomonas aeruginosa PA01
gcagcgucggcgugcccgg

SEQ ID NO: 6147 - RNA, 19 nt, Pseudomonas aeruginosa PA01
gcaguucagcgacaacccg

SEQ ID NO: 6148 - RNA, 22 nt, Pseudomonas aeruginosa PA01
gcagucuucagcaugccgcguc

SEQ ID NO: 6149 - RNA, 22 nt, Pseudomonas aeruginosa PA01
gcagggcgugcgcccggcgaau

SEQ ID NO: 6150 - RNA, 22 nt, Pseudomonas aeruginosa PA01
gcaggccgaacaucaucaccgg

SEQ ID NO: 6151 - RNA, 22 nt, Pseudomonas aeruginosa PA01
gcaggccgaccaguucgcugau

SEQ ID NO: 6152 - RNA, 22 nt, Pseudomonas aeruginosa PA01
gcaggccgcccuggucgagcag

SEQ ID NO: 6153 - RNA, 22 nt, Pseudomonas aeruginosa PA01
gcaggccggcgagguuggcggu

SEQ ID NO: 6154 - RNA, 22 nt, Pseudomonas aeruginosa PA01
gcaggcgauccuggagcggcgc

SEQ ID NO: 6155 - RNA, 22 nt, Pseudomonas aeruginosa PA01
gcaggcgcaguuggacgcccgc

SEQ ID NO: 6156 - RNA, 22 nt, Pseudomonas aeruginosa PA01
gcaggcgcgccaggugcagcga

SEQ ID NO: 6157 - RNA, 22 nt, Pseudomonas aeruginosa PA01
gcaggcgcgccgggcccugcuc

SEQ ID NO: 6158 - RNA, 22 nt, Pseudomonas aeruginosa PA01
gcaggcugagcacgccggcggc

SEQ ID NO: 6159 - RNA, 22 nt, Pseudomonas aeruginosa PA01
gcaggcuggcgucuuccagggc

SEQ ID NO: 6160 - RNA, 22 nt, Pseudomonas aeruginosa PA01
gcacccucccgcugcucgaacu

SEQ ID NO: 6161 - RNA, 19 nt, Pseudomonas aeruginosa PA01
gaugggcgaggcggaagcc

SEQ ID NO: 6162 - RNA, 22 nt, Pseudomonas aeruginosa PA01
gcagcagcuugccguccggguu

SEQ ID NO: 6163 - RNA, 20 nt, Pseudomonas aeruginosa PA01
gcagcaaggccaggccgaug

SEQ ID NO: 6164 - RNA, 22 nt, Pseudomonas aeruginosa PA01
gcacuggaauggccggccgcgc

SEQ ID NO: 6165 - RNA, 22 nt, Pseudomonas aeruginosa PA01
gcagaugguugucggccugggc

SEQ ID NO: 6166 - RNA, 22 nt, Staphylococcus aureus subsp. aureus Mu50
gcaacaauuguaaaguuugaaa

SEQ ID NO: 6167 - RNA, 22 nt, Staphylococcus aureus subsp. aureus Mu50
gcaaauguuacaccuguuucuu

SEQ ID NO: 6168 - RNA, 22 nt, Staphylococcus aureus subsp. aureus Mu50
gagauuuucgaagcacguaacc

SEQ ID NO: 6169 - RNA, 22 nt, Staphylococcus aureus subsp. aureus Mu50
gagauauugguaaagcuuuugc

SEQ ID NO: 6170 - RNA, 21 nt, Staphylococcus aureus subsp. aureus Mu50
gaugggaauuucgacagugca

SEQ ID NO: 6171 - RNA, 22 nt, Staphylococcus aureus subsp. aureus Mu50
cuuuuucacauaucauaggucu

SEQ ID NO: 6172 - RNA, 22 nt, Staphylococcus aureus subsp. aureus Mu50
gaaaaaaucgauuggcguggcu

SEQ ID NO: 6173 - RNA, 22 nt, Staphylococcus aureus subsp. aureus Mu50
gaaaagaaagcauaugcaacuu

SEQ ID NO: 6174 - RNA, 22 nt, Staphylococcus aureus subsp. aureus Mu50
gaaaagcuccaaucaaaguuga

SEQ ID NO: 6175 - RNA, 22 nt, Staphylococcus aureus subsp. aureus Mu50
gacguauuuuuuaucacauuga

SEQ ID NO: 6176 - RNA, 22 nt, Staphylococcus aureus subsp. aureus Mu50
gacauauuuuaauagugaauau

SEQ ID NO: 6177 - RNA, 22 nt, Staphylococcus aureus subsp. aureus Mu50
cuucaguagcaggcgguugcau

SEQ ID NO: 6178 - RNA, 22 nt, Staphylococcus aureus subsp. aureus Mu50
cuuuccaaguuaaagauuuacc

SEQ ID NO: 6179 - RNA, 22 nt, Staphylococcus aureus subsp. aureus Mu50
cuguaucacauuagaagcuuuu

SEQ ID NO: 6180 - RNA, 22 nt, Staphylococcus aureus subsp. aureus Mu50
gcugaaaugguaauaucuuuau

SEQ ID NO: 6181 - RNA, 22 nt, Staphylococcus aureus subsp. aureus Mu50
gcuuuauugaugaugucuuuau

SEQ ID NO: 6182 - RNA, 22 nt, Staphylococcus aureus subsp. aureus Mu50
gcuucaaugcuuuuagccauuu

SEQ ID NO: 6183 - RNA, 22 nt, Staphylococcus aureus subsp. aureus Mu50
ggaugccgacaguauuccgauu

SEQ ID NO: 6184 - RNA, 20 nt, Staphylococcus aureus subsp. aureus Mu50
uauuucaauugcuguugcug

SEQ ID NO: 6185 - RNA, 22 nt, Staphylococcus aureus subsp. aureus Mu50
ucaaauuacgugcuaaagcuug

SEQ ID NO: 6186 - RNA, 22 nt, Staphylococcus aureus subsp. aureus Mu50
uaucuccagaguauacaguauc

SEQ ID NO: 6187 - RNA, 22 nt, Staphylococcus aureus subsp. aureus Mu50
uaucaaacauugaaugcacgcg

SEQ ID NO: 6188 - RNA, 22 nt, Staphylococcus aureus subsp. aureus Mu50
uauaaauagagaagagcaguaa

SEQ ID NO: 6189 - RNA, 22 nt, Staphylococcus aureus subsp. aureus Mu50
uauaugagacggggucauuucu

SEQ ID NO: 6190 - RNA, 22 nt, Staphylococcus aureus subsp. aureus Mu50
uagaaacagcaguaagaugauu

SEQ ID NO: 6191 - RNA, 22 nt, Staphylococcus aureus subsp. aureus Mu50
uagugguauugaaucugcugua

SEQ ID NO: 6192 - RNA, 22 nt, Staphylococcus aureus subsp. aureus Mu50
uaauugcacuaccaaugauuau

SEQ ID NO: 6193 - RNA, 22 nt, Staphylococcus aureus subsp. aureus Mu50
uaaugauuuugguacgauacug

SEQ ID NO: 6194 - RNA, 22 nt, Staphylococcus aureus subsp. aureus Mu50
uacauuuugugacuaauagcgu

SEQ ID NO: 6195 - RNA, 22 nt, Staphylococcus aureus subsp. aureus Mu50
uaauauucgcacucauuauucc

SEQ ID NO: 6196 - RNA, 22 nt, Staphylococcus aureus subsp. aureus Mu50
uaaguggauuguaauuauauua

SEQ ID NO: 6197 - RNA, 22 nt, Staphylococcus aureus subsp. aureus Mu50
ucggucuaauuuuauagaaggu

SEQ ID NO: 6198 - RNA, 22 nt, Staphylococcus aureus subsp. aureus Mu50
ucgcugcaucguauaguuguug

SEQ ID NO: 6199 - RNA, 22 nt, Staphylococcus aureus subsp. aureus Mu50
ucauuaaugucuacguaugaau

SEQ ID NO: 6200 - RNA, 22 nt, Staphylococcus aureus subsp. aureus Mu50
ucauaauagauucuauuuuuaa

SEQ ID NO: 6201 - RNA, 22 nt, Staphylococcus aureus subsp. aureus Mu50
ucacuagagcuaugaaacuugg

SEQ ID NO: 6202 - RNA, 22 nt, Staphylococcus aureus subsp. aureus Mu50
ucaaaaaugaagacauaguuaa

SEQ ID NO: 6203 - RNA, 22 nt, Staphylococcus aureus subsp. aureus Mu50
gugaaaaugaacguauugaugc

SEQ ID NO: 6204 - RNA, 22 nt, Staphylococcus aureus subsp. aureus Mu50
gugcuacacguucaucaccauu

SEQ ID NO: 6205 - RNA, 22 nt, Staphylococcus aureus subsp. aureus Mu50
gugaguugaaguagcuugucau

SEQ ID NO: 6206 - RNA, 22 nt, Staphylococcus aureus subsp. aureus Mu50
guugauguugcuaacuucuuaa

SEQ ID NO: 6207 - RNA, 22 nt, Staphylococcus aureus subsp. aureus Mu50
uaaaagcuucuaacaugauacg

SEQ ID NO: 6208 - RNA, 22 nt, Staphylococcus aureus subsp. aureus Mu50
uaaaauuauggauacacugauu

SEQ ID NO: 6209 - RNA, 20 nt, Staphylococcus aureus subsp. aureus Mu50
uaaagacuacuuacagcgua

SEQ ID NO: 6210 - RNA, 22 nt, Staphylococcus aureus subsp. aureus Mu50
gugugggauugcauuguucacu

SEQ ID NO: 6211 - RNA, 22 nt, Staphylococcus aureus subsp. aureus Mu50
guaguugacugaacgaaaaugc

SEQ ID NO: 6212 - RNA, 22 nt, Staphylococcus aureus subsp. aureus Mu50
guaaaaccuguugauacaacug

SEQ ID NO: 6213 - RNA, 22 nt, Staphylococcus aureus subsp. aureus Mu50
aaacugcuaauguagucaugag

SEQ ID NO: 6214 - RNA, 22 nt, Staphylococcus aureus subsp. aureus Mu50
aaagcucucuucauaaucaugu

SEQ ID NO: 6215 - RNA, 22 nt, Staphylococcus aureus subsp. aureus Mu50
aaauacuuuccauguauggugu

SEQ ID NO: 6216 - RNA, 22 nt, Staphylococcus aureus subsp. aureus Mu50
aaaaugaugauaaacuaguaua

SEQ ID NO: 6217 - RNA, 22 nt, Staphylococcus aureus subsp. aureus Mu50
aaaaauguccuccuguucauca

SEQ ID NO: 6218 - RNA, 22 nt, Staphylococcus aureus subsp. aureus Mu50
aagcgauuuuacuugaagauac

SEQ ID NO: 6219 - RNA, 22 nt, Staphylococcus aureus subsp. aureus Mu50
aacaauuaaugaucuuacagaa

SEQ ID NO: 6220 - RNA, 22 nt, Staphylococcus aureus subsp. aureus Mu50
aacauuuucaauaauugauucg

SEQ ID NO: 6221 - RNA, 22 nt, Staphylococcus aureus subsp. aureus Mu50
aauuuuaguagggacaacauug

SEQ ID NO: 6222 - RNA, 22 nt, Staphylococcus aureus subsp. aureus Mu50
aauuuuuguacguucaauauca

SEQ ID NO: 6223 - RNA, 22 nt, Staphylococcus aureus subsp. aureus Mu50
aauuuaaauuuagauccuguag

SEQ ID NO: 6224 - RNA, 22 nt, Staphylococcus aureus subsp. aureus Mu50
aauuccaaaagccagaagguac

SEQ ID NO: 6225 - RNA, 22 nt, Staphylococcus aureus subsp. aureus Mu50
aauucuacaucaauccuacagg

SEQ ID NO: 6226 - RNA, 22 nt, Staphylococcus aureus subsp. aureus Mu50
aauugaggcggaauuagcgcgu

SEQ ID NO: 6227 - RNA, 22 nt, Staphylococcus aureus subsp. aureus Mu50
aauuacuuuagccauugcuacc

SEQ ID NO: 6228 - RNA, 22 nt, Staphylococcus aureus subsp. aureus Mu50
aauuucagcacgacgauuaaau

SEQ ID NO: 6229 - RNA, 22 nt, Staphylococcus aureus subsp. aureus Mu50
aaugaaaugaagauugcacuca

SEQ ID NO: 6230 - RNA, 22 nt, Staphylococcus aureus subsp. aureus Mu50
aaucaaauuauauugagccguu

SEQ ID NO: 6231 - RNA, 22 nt, Staphylococcus aureus subsp. aureus Mu50
aauacacuaaucgcacguacuc

SEQ ID NO: 6232 - RNA, 22 nt, Staphylococcus aureus subsp. aureus Mu50
aauuaacuuuguuaauagaguu

SEQ ID NO: 6233 - RNA, 22 nt, Staphylococcus aureus subsp. aureus Mu50
aaugagagcccccuuuaccaca

SEQ ID NO: 6234 - RNA, 22 nt, Staphylococcus aureus subsp. aureus Mu50
aaugauaagcgacaguuaauaa

SEQ ID NO: 6235 - RNA, 22 nt, Staphylococcus aureus subsp. aureus Mu50
aaugggagugggacagaaauga

SEQ ID NO: 6236 - RNA, 22 nt, Staphylococcus aureus subsp. aureus Mu50
aaugggguaaucaugaugugcu

SEQ ID NO: 6237 - RNA, 22 nt, Staphylococcus aureus subsp. aureus Mu50
aauaguuguaccgacagcgccu

SEQ ID NO: 6238 - RNA, 22 nt, Staphylococcus aureus subsp. aureus Mu50
aauagagaacagcaguaagacg

SEQ ID NO: 6239 - RNA, 22 nt, Staphylococcus aureus subsp. aureus Mu50
aauaaaguuauucauguagauu

SEQ ID NO: 6240 - RNA, 21 nt, Staphylococcus aureus subsp. aureus Mu50
aauaacaguuacaaaugcuga

SEQ ID NO: 6241 - RNA, 22 nt, Staphylococcus aureus subsp. aureus Mu50
aauaaucuauauuaucuuucgu

SEQ ID NO: 6242 - RNA, 22 nt, Staphylococcus aureus subsp. aureus Mu50
aagcuuuuuucaauucuaguca

SEQ ID NO: 6243 - RNA, 22 nt, Staphylococcus aureus subsp. aureus Mu50
acuccgucaaauugcacagcga

SEQ ID NO: 6244 - RNA, 22 nt, Staphylococcus aureus subsp. aureus Mu50
acuauuuguuaauaaauccauu

SEQ ID NO: 6245 - RNA, 19 nt, Staphylococcus aureus subsp. aureus Mu50
acuuugaagggagcauuuc

SEQ ID NO: 6246 - RNA, 22 nt, Staphylococcus aureus subsp. aureus Mu50
agaagacuuauuuacugcguuu

SEQ ID NO: 6247 - RNA, 22 nt, Staphylococcus aureus subsp. aureus Mu50
agaaagugcgguuauuuauaca

SEQ ID NO: 6248 - RNA, 22 nt, Staphylococcus aureus subsp. aureus Mu50
agaaaacagcaguaaaaucauu

SEQ ID NO: 6249 - RNA, 22 nt, Staphylococcus aureus subsp. aureus Mu50
acuuuugagaugcacauuauca

SEQ ID NO: 6250 - RNA, 23 nt, Staphylococcus aureus subsp. aureus Mu50
agacauuuaaugauaaauacuga

SEQ ID NO: 6251 - RNA, 22 nt, Staphylococcus aureus subsp. aureus Mu50
agagauaaaauaaagagguacu

SEQ ID NO: 6252 - RNA, 22 nt, Staphylococcus aureus subsp. aureus Mu50
agagacaaguuuagauugccau

SEQ ID NO: 6253 - RNA, 22 nt, Staphylococcus aureus subsp. aureus Mu50
agauauccauuaugauguagau

SEQ ID NO: 6254 - RNA, 22 nt, Staphylococcus aureus subsp. aureus Mu50
agauauuguugauauggcauuu

SEQ ID NO: 6255 - RNA, 22 nt, Staphylococcus aureus subsp. aureus Mu50
acuagguaaucgucugagugaa

SEQ ID NO: 6256 - RNA, 22 nt, Staphylococcus aureus subsp. aureus Mu50
acguuucagcguuccauucagc

SEQ ID NO: 6257 - RNA, 22 nt, Staphylococcus aureus subsp. aureus Mu50
acagcuggugagauagguguca

SEQ ID NO: 6258 - RNA, 22 nt, Staphylococcus aureus subsp. aureus Mu50
acaguuuagugcgcaaauuaau

SEQ ID NO: 6259 - RNA, 22 nt, Staphylococcus aureus subsp. aureus Mu50
acagaaauaugauguaauuguu

SEQ ID NO: 6260 - RNA, 22 nt, Staphylococcus aureus subsp. aureus Mu50
acagaaauguagcuaacauuuu

SEQ ID NO: 6261 - RNA, 22 nt, Staphylococcus aureus subsp. aureus Mu50
acaucuaacaguaaacauuuag

SEQ ID NO: 6262 - RNA, 22 nt, Staphylococcus aureus subsp. aureus Mu50
acauugggcauaaucacagcua

SEQ ID NO: 6263 - RNA, 22 nt, Staphylococcus aureus subsp. aureus Mu50
acauuuauuugggcuguaacga

SEQ ID NO: 6264 - RNA, 22 nt, Staphylococcus aureus subsp. aureus Mu50
agcaugauacucaauaaaauug

SEQ ID NO: 6265 - RNA, 22 nt, Staphylococcus aureus subsp. aureus Mu50
agccuguauacguuugaguggu

SEQ ID NO: 6266 - RNA, 22 nt, Staphylococcus aureus subsp. aureus Mu50
aguuauaacgaaguuauuaugc

SEQ ID NO: 6267 - RNA, 22 nt, Staphylococcus aureus subsp. aureus Mu50
aguuugaaugauaacucauugc

SEQ ID NO: 6268 - RNA, 22 nt, Staphylococcus aureus subsp. aureus Mu50
auaaacauguuguuucugaaac

SEQ ID NO: 6269 - RNA, 22 nt, Staphylococcus aureus subsp. aureus Mu50
agguuuaacauuauuacaaauc

SEQ ID NO: 6270 - RNA, 18 nt, Staphylococcus aureus subsp. aureus Mu50
aguggcaauguauuagca

SEQ ID NO: 6271 - RNA, 22 nt, Staphylococcus aureus subsp. aureus Mu50
auaaugaugcacaucgcguacu

SEQ ID NO: 6272 - RNA, 22 nt, Staphylococcus aureus subsp. aureus Mu50
auaaaguauauggaaauuuuac

SEQ ID NO: 6273 - RNA, 22 nt, Staphylococcus aureus subsp. aureus Mu50
auacauuagugucgauucguuu

SEQ ID NO: 6274 - RNA, 22 nt, Staphylococcus aureus subsp. aureus Mu50
auauaaguuuuggugacugaau

SEQ ID NO: 6275 - RNA, 22 nt, Staphylococcus aureus subsp. aureus Mu50
auauagauuaaaccgcacuucu

SEQ ID NO: 6276 - RNA, 22 nt, Staphylococcus aureus subsp. aureus Mu50
auagugaguuuguuacauauug

SEQ ID NO: 6277 - RNA, 22 nt, Staphylococcus aureus subsp. aureus Mu50
auaugaaacuacucauuugaag

SEQ ID NO: 6278 - RNA, 22 nt, Staphylococcus aureus subsp. aureus Mu50
auauuuaauguuaaggauguug

SEQ ID NO: 6279 - RNA, 22 nt, Staphylococcus aureus subsp. aureus Mu50
auauuugcuaaaaauacuuuga

SEQ ID NO: 6280 - RNA, 22 nt, Staphylococcus aureus subsp. aureus Mu50
aucuagaaucgcaugauaauuu

SEQ ID NO: 6281 - RNA, 22 nt, Staphylococcus aureus subsp. aureus Mu50
aucaugacuuaugugugaguga

SEQ ID NO: 6282 - RNA, 22 nt, Staphylococcus aureus subsp. aureus Mu50
augauggaagguaaauggcaaa

SEQ ID NO: 6283 - RNA, 22 nt, Staphylococcus aureus subsp. aureus Mu50
auguaaaaaagcugauuucuau

SEQ ID NO: 6284 - RNA, 21 nt, Staphylococcus aureus subsp. aureus Mu50
augcaucuuucugugcuuggu

SEQ ID NO: 6285 - RNA, 22 nt, Staphylococcus aureus subsp. aureus Mu50
augcacauuuauuaguuuuaga

SEQ ID NO: 6286 - RNA, 22 nt, Staphylococcus aureus subsp. aureus Mu50
augacguuguugaauuaucuuc

SEQ ID NO: 6287 - RNA, 22 nt, Staphylococcus aureus subsp. aureus Mu50
cucgcggccuuuuuuauuguaa

SEQ ID NO: 6288 - RNA, 22 nt, Staphylococcus aureus subsp. aureus Mu50
cuauaaauacaagugcauaugg

SEQ ID NO: 6289 - RNA, 22 nt, Staphylococcus aureus subsp. aureus Mu50
cuaauaauugugaauaugcaag

SEQ ID NO: 6290 - RNA, 22 nt, Staphylococcus aureus subsp. aureus Mu50
cauauaaagcgugcgugcuuuu

SEQ ID NO: 6291 - RNA, 20 nt, Staphylococcus aureus subsp. aureus Mu50
caucaguuuuuuuauacgag

SEQ ID NO: 6292 - RNA, 20 nt, Staphylococcus aureus subsp. aureus Mu50
ccagaugguuaugguuuuuu

SEQ ID NO: 6293 - RNA, 22 nt, Staphylococcus aureus subsp. aureus Mu50
cagaugcugcagaugaauuaga

SEQ ID NO: 6294 - RNA, 20 nt, Staphylococcus aureus subsp. aureus Mu50
cacggcucgaacaagucuuu

SEQ ID NO: 6295 - RNA, 22 nt, Staphylococcus aureus subsp. aureus Mu50
cagcuaaauuacuaccuucagu

SEQ ID NO: 6296 - RNA, 22 nt, Staphylococcus aureus subsp. aureus Mu50
caacuuuagguaaugucauguu

SEQ ID NO: 6297 - RNA, 22 nt, Staphylococcus aureus subsp. aureus Mu50
caaaugcugucgucuacuuuua

SEQ ID NO: 6298 - RNA, 22 nt, Staphylococcus aureus subsp. aureus Mu50
auuuugaugagcgugcaauacu

SEQ ID NO: 6299 - RNA, 22 nt, Staphylococcus aureus subsp. aureus Mu50
caaaagcauugaauaaaacugu

SEQ ID NO: 6300 - RNA, 18 nt, Staphylococcus aureus subsp. aureus Mu50
auuucugucccacuccca

SEQ ID NO: 6301 - RNA, 19 nt, Staphylococcus aureus subsp. aureus Mu50
auuucugucccacucccac

SEQ ID NO: 6302 - RNA, 22 nt, Staphylococcus aureus subsp. aureus Mu50
auuucugucccacucccauugg

SEQ ID NO: 6303 - RNA, 22 nt, Staphylococcus aureus subsp. aureus Mu50
auuugaaaggagccgauaaugg

SEQ ID NO: 6304 - RNA, 22 nt, Staphylococcus aureus subsp. aureus Mu50
auuuuauauaaaaagaagaucc

SEQ ID NO: 6305 - RNA, 22 nt, Staphylococcus aureus subsp. aureus Mu50
auguucaucuacaguauuaugu

SEQ ID NO: 6306 - RNA, 22 nt, Staphylococcus aureus subsp. aureus Mu50
auuaaaugauucuuuauuggua

SEQ ID NO: 6307 - RNA, 21 nt, Staphylococcus aureus subsp. aureus Mu50
auuauuggcgucguuucgagu

SEQ ID NO: 6308 - RNA, 22 nt, Staphylococcus aureus subsp. aureus Mu50
auuauuuaccacuuaaacaagc

SEQ ID NO: 6309 - RNA, 22 nt, Staphylococcus aureus subsp. aureus Mu50
uuuuagaaauugucaaugauga

SEQ ID NO: 6310 - RNA, 22 nt, Staphylococcus aureus subsp. aureus Mu50
uuuuaugauaaagaaggauaua

SEQ ID NO: 6311 - RNA, 22 nt, Staphylococcus aureus subsp. aureus Mu50
uuuuauugaucgacacgguaag

SEQ ID NO: 6312 - RNA, 22 nt, Staphylococcus aureus subsp. aureus Mu50
uuuuccaacuucucaguaaauu

SEQ ID NO: 6313 - RNA, 19 nt, Staphylococcus aureus subsp. aureus Mu50
uuugaacuuguauuuguag

SEQ ID NO: 6314 - RNA, 22 nt, Staphylococcus aureus subsp. aureus Mu50
uuugauucagucaguaaagaag

SEQ ID NO: 6315 - RNA, 22 nt, Staphylococcus aureus subsp. aureus Mu50
uuucaucagauugguacgaagc

SEQ ID NO: 6316 - RNA, 22 nt, Staphylococcus aureus subsp. aureus Mu50
uuucacauaguuaacaauugcu

SEQ ID NO: 6317 - RNA, 22 nt, Staphylococcus aureus subsp. aureus Mu50
uuucacauuuggauauuuacga

SEQ ID NO: 6318 - RNA, 22 nt, Staphylococcus aureus subsp. aureus Mu50
uuuauuugaagcgguauauggu

SEQ ID NO: 6319 - RNA, 22 nt, Staphylococcus aureus subsp. aureus Mu50
uuuaccaauaaugaugaacauu

SEQ ID NO: 6320 - RNA, 22 nt, Staphylococcus aureus subsp. aureus Mu50
uuaaaagucacaauacacauga

SEQ ID NO: 6321 - RNA, 22 nt, Staphylococcus aureus subsp. aureus Mu50
uuaaugaagcuguaaacuuauu

SEQ ID NO: 6322 - RNA, 22 nt, Staphylococcus aureus subsp. aureus Mu50
uuaaugauguaaugaaauuagu

SEQ ID NO: 6323 - RNA, 22 nt, Staphylococcus aureus subsp. aureus Mu50
uuaaaaaagcagugaaucauuu

SEQ ID NO: 6324 - RNA, 17 nt, Staphylococcus aureus subsp. aureus Mu50
uucauaucauuacuuug

SEQ ID NO: 6325 - RNA, 20 nt, Staphylococcus aureus subsp. aureus Mu50
uuauugauaguacucagcaa

SEQ ID NO: 6326 - RNA, 22 nt, Staphylococcus aureus subsp. aureus Mu50
uuauaugaaacaagaacuugga

SEQ ID NO: 6327 - RNA, 23 nt, Staphylococcus aureus subsp. aureus Mu50
ugugccauuugaaaauguuauga

SEQ ID NO: 6328 - RNA, 22 nt, Staphylococcus aureus subsp. aureus Mu50
uugauaaggggaguguaguauu

SEQ ID NO: 6329 - RNA, 22 nt, Staphylococcus aureus subsp. aureus Mu50
uugauacagcugguacauuagu

SEQ ID NO: 6330 - RNA, 22 nt, Staphylococcus aureus subsp. aureus Mu50
uugacauuacgacagcacuugu

SEQ ID NO: 6331 - RNA, 23 nt, Staphylococcus aureus subsp. aureus Mu50
uuccaauuccaaaugcaauagca

SEQ ID NO: 6332 - RNA, 22 nt, Staphylococcus aureus subsp. aureus Mu50
uugaauggaguauaucagcuug

SEQ ID NO: 6333 - RNA, 22 nt, Staphylococcus aureus subsp. aureus Mu50
uugcagcacgugauucuggugc

SEQ ID NO: 6334 - RNA, 22 nt, Staphylococcus aureus subsp. aureus Mu50
uuggaggcuaguauguugaaca

SEQ ID NO: 6335 - RNA, 22 nt, Staphylococcus aureus subsp. aureus Mu50
uugggcaucgcuuaaaugguuu

SEQ ID NO: 6336 - RNA, 22 nt, Staphylococcus aureus subsp. aureus Mu50
uugugaaauauucggcgguacu

SEQ ID NO: 6337 - RNA, 22 nt, Staphylococcus aureus subsp. aureus Mu50
uuuaauugcugugcuuggugga

SEQ ID NO: 6338 - RNA, 20 nt, Staphylococcus aureus subsp. aureus Mu50
ucuucaagcuguuucaucuc

SEQ ID NO: 6339 - RNA, 22 nt, Staphylococcus aureus subsp. aureus Mu50
ucuuuuaaucgaccuugagaaa

SEQ ID NO: 6340 - RNA, 22 nt, Staphylococcus aureus subsp. aureus Mu50
ugaacaaccgggcagaaugaaa

SEQ ID NO: 6341 - RNA, 22 nt, Staphylococcus aureus subsp. aureus Mu50
ugaaauauaaaauuguuugagg

SEQ ID NO: 6342 - RNA, 22 nt, Staphylococcus aureus subsp. aureus Mu50
ugaaauacuaacauugacuucu

SEQ ID NO: 6343 - RNA, 22 nt, Staphylococcus aureus subsp. aureus Mu50
ugaaaguguugacgguaugauu

SEQ ID NO: 6344 - RNA, 22 nt, Staphylococcus aureus subsp. aureus Mu50
ugaaagcauuuaucgaacauug

SEQ ID NO: 6345 - RNA, 22 nt, Staphylococcus aureus subsp. aureus Mu50
ugcagaagugaaauuccuguga

SEQ ID NO: 6346 - RNA, 23 nt, Staphylococcus aureus subsp. aureus Mu50
ugcaaauguugagcgcauauuug

SEQ ID NO: 6347 - RNA, 22 nt, Staphylococcus aureus subsp. aureus Mu50
ugauugguggguuuuucuucaa

SEQ ID NO: 6348 - RNA, 22 nt, Staphylococcus aureus subsp. aureus Mu50
ugcuacaaacgcuugugcauua

SEQ ID NO: 6349 - RNA, 22 nt, Staphylococcus aureus subsp. aureus Mu50
ugcauguggcaucucuuguguu

SEQ ID NO: 6350 - RNA, 22 nt, Staphylococcus aureus subsp. aureus Mu50
ugcaucauuuaaagcugcuuca

SEQ ID NO: 6351 - RNA, 23 nt, Staphylococcus aureus subsp. aureus Mu50
uggcuccguuucauuacguaaua

SEQ ID NO: 6352 - RNA, 22 nt, Streptococcus pneumoniae TIGR4
uggagccuuaacagcuguuuuu

SEQ ID NO: 6353 - RNA, 20 nt, Streptococcus pneumoniae TIGR4
uggauugcucucaacugcac

SEQ ID NO: 6354 - RNA, 22 nt, Streptococcus pneumoniae TIGR4
uggaaguauuugccagagaugg

SEQ ID NO: 6355 - RNA, 22 nt, Streptococcus pneumoniae TIGR4
uggaagaagcagauguuaucgu

SEQ ID NO: 6356 - RNA, 22 nt, Streptococcus pneumoniae TIGR4
ugagcugggaagccugucaagg

SEQ ID NO: 6357 - RNA, 22 nt, Streptococcus pneumoniae TIGR4
ugacggaagaagagcgacaggu

SEQ ID NO: 6358 - RNA, 22 nt, Streptococcus pneumoniae TIGR4
uuuaaaaagaauacuggugucg

SEQ ID NO: 6359 - RNA, 22 nt, Streptococcus pneumoniae TIGR4
uuuaaaaagccuauuguaucaa

SEQ ID NO: 6360 - RNA, 22 nt, Streptococcus pneumoniae TIGR4
uugggaugucuuacagccgguu

SEQ ID NO: 6361 - RNA, 22 nt, Streptococcus pneumoniae TIGR4
uugagguuguagauagaacuga

SEQ ID NO: 6362 - RNA, 22 nt, Streptococcus pneumoniae TIGR4
uguggcgacaaacugaugcgaa

SEQ ID NO: 6363 - RNA, 22 nt, Streptococcus pneumoniae TIGR4
uguuauaggcgaaauaggcugc

SEQ ID NO: 6364 - RNA, 22 nt, Streptococcus pneumoniae TIGR4
uuuauugaguauaagaggucuu

SEQ ID NO: 6365 - RNA, 22 nt, Streptococcus pneumoniae TIGR4
caacagcuguguuguuuggaga

SEQ ID NO: 6366 - RNA, 22 nt, Streptococcus pneumoniae TIGR4
cagcuggauagagcauucgccu

SEQ ID NO: 6367 - RNA, 20 nt, Streptococcus pneumoniae TIGR4
cagaagcgaccauggcucac

SEQ ID NO: 6368 - RNA, 22 nt, Streptococcus pneumoniae TIGR4
cauuuuacuugaaagugauuug

SEQ ID NO: 6369 - RNA, 22 nt, Streptococcus pneumoniae TIGR4
ccacacuugcuucagcuggagc

SEQ ID NO: 6370 - RNA, 22 nt, Streptococcus pneumoniae TIGR4
caggugaggacuuggcuuauag

SEQ ID NO: 6371 - RNA, 20 nt, Streptococcus pneumoniae TIGR4
caugcggaaauuauggcuau

SEQ ID NO: 6372 - RNA, 22 nt, Streptococcus pneumoniae TIGR4
cccuacucagcguaagauuucu

SEQ ID NO: 6373 - RNA, 22 nt, Streptococcus pneumoniae TIGR4
cgcugaggcugacgcacuggua

SEQ ID NO: 6374 - RNA, 22 nt, Streptococcus pneumoniae TIGR4
augauauugcacguuuaucagg

SEQ ID NO: 6375 - RNA, 22 nt, Streptococcus pneumoniae TIGR4
agggcagcuucaccugucaaaa

SEQ ID NO: 6376 - RNA, 20 nt, Streptococcus pneumoniae TIGR4
aggggcagaaugauauuucc

SEQ ID NO: 6377 - RNA, 22 nt, Streptococcus pneumoniae TIGR4
aggucacuugauagcuauauuu

SEQ ID NO: 6378 - RNA, 22 nt, Streptococcus pneumoniae TIGR4
agcuagaacaguaucgagaacu

SEQ ID NO: 6379 - RNA, 22 nt, Streptococcus pneumoniae TIGR4
agcugcagaguugaugcuuuua

SEQ ID NO: 6380 - RNA, 22 nt, Streptococcus pneumoniae TIGR4
agccguccauugaaaucauuga

SEQ ID NO: 6381 - RNA, 22 nt, Streptococcus pneumoniae TIGR4
acaauaacccacaaugaggcug

SEQ ID NO: 6382 - RNA, 22 nt, Streptococcus pneumoniae TIGR4
acagcugguuugaggccuugaa

SEQ ID NO: 6383 - RNA, 22 nt, Streptococcus pneumoniae TIGR4
acuaggaagcucguuuaagguu

SEQ ID NO: 6384 - RNA, 22 nt, Streptococcus pneumoniae TIGR4
accccccaccuuucuuaggauc

SEQ ID NO: 6385 - RNA, 22 nt, Streptococcus pneumoniae TIGR4
agaagccuuuaaucuccuuuau

SEQ ID NO: 6386 - RNA, 22 nt, Streptococcus pneumoniae TIGR4
agaaucauuuggcuuuaaaggu

SEQ ID NO: 6387 - RNA, 22 nt, Streptococcus pneumoniae TIGR4
acuauauuucucaggauaagcc

SEQ ID NO: 6388 - RNA, 22 nt, Streptococcus pneumoniae TIGR4
aacuagaaaagguuuuccuuau

SEQ ID NO: 6389 - RNA, 22 nt, Streptococcus pneumoniae TIGR4
aagcgaugcagcuccccccugu

SEQ ID NO: 6390 - RNA, 22 nt, Streptococcus pneumoniae TIGR4
aagauuacuaccaaguagaaac

SEQ ID NO: 6391 - RNA, 22 nt, Streptococcus pneumoniae TIGR4
aaaaaaacuccguagucucuag

SEQ ID NO: 6392 - RNA, 22 nt, Streptococcus pneumoniae TIGR4
aaagauguucaguauagauuag

SEQ ID NO: 6393 - RNA, 20 nt, Streptococcus pneumoniae TIGR4
aacaacaauugacugcuauu

SEQ ID NO: 6394 - RNA, 22 nt, Streptococcus pneumoniae TIGR4
gucauagaagucuuuuuaauua

SEQ ID NO: 6395 - RNA, 22 nt, Streptococcus pneumoniae TIGR4
ggguagcuauacaggcuugcga

SEQ ID NO: 6396 - RNA, 23 nt, Streptococcus pneumoniae TIGR4
gggagcgcacuucgucauacuca

SEQ ID NO: 6397 - RNA, 22 nt, Streptococcus pneumoniae TIGR4
gggaugaguaucuauucuauau

SEQ ID NO: 6398 - RNA, 22 nt, Streptococcus pneumoniae TIGR4
gggaugguggauccggauaagg

SEQ ID NO: 6399 - RNA, 22 nt, Streptococcus pneumoniae TIGR4
gggcaggcuuuggaggagcugu

SEQ ID NO: 6400 - RNA, 21 nt, Streptococcus pneumoniae TIGR4
ggcugcuuugacacggcauuu

SEQ ID NO: 6401 - RNA, 22 nt, Streptococcus pneumoniae TIGR4
ggcucuaccaacuuuuucugag

SEQ ID NO: 6402 - RNA, 22 nt, Streptococcus pneumoniae TIGR4
ggcuaggcaacugugguacuug

SEQ ID NO: 6403 - RNA, 22 nt, Streptococcus pneumoniae TIGR4
ucauugaggacaaucugaagca

SEQ ID NO: 6404 - RNA, 22 nt, Streptococcus pneumoniae TIGR4
ucauauaaucguaccaauccau

SEQ ID NO: 6405 - RNA, 22 nt, Streptococcus pneumoniae TIGR4
ucagucacauauauaauccaag

SEQ ID NO: 6406 - RNA, 22 nt, Streptococcus pneumoniae TIGR4
uccugcaguugcuugcggugca

SEQ ID NO: 6407 - RNA, 16 nt, Streptococcus pneumoniae TIGR4
uaaguucagcaagcuu

SEQ ID NO: 6408 - RNA, 22 nt, Streptococcus pneumoniae TIGR4
uacagacuuaaaagaaacagcu

SEQ ID NO: 6409 - RNA, 22 nt, Streptococcus pneumoniae TIGR4
uauaaguuuugcuacuguugau

SEQ ID NO: 6410 - RNA, 22 nt, Streptococcus pneumoniae TIGR4
gcggcccagggcggagucguaa

SEQ ID NO: 6411 - RNA, 22 nt, Streptococcus pneumoniae TIGR4
cuuuacaucgguuuagguuuuc

SEQ ID NO: 6412 - RNA, 22 nt, Streptococcus pneumoniae TIGR4
gaacucuauuuucagacuugag

SEQ ID NO: 6413 - RNA, 22 nt, Streptococcus pneumoniae TIGR4
gauagaguucuuuuggucggcc

SEQ ID NO: 6414 - RNA, 22 nt, Streptococcus pneumoniae TIGR4
gcaguuggcaugcuugcuccua

SEQ ID NO: 6415 - RNA, 22 nt, Streptococcus pyogenes M1 GAS
gcaacaaacaguagucgguuag

SEQ ID NO: 6416 - RNA, 22 nt, Streptococcus pyogenes M1 GAS
gagcugggcuagcugguucuga

SEQ ID NO: 6417 - RNA, 22 nt, Streptococcus pyogenes M1 GAS
gcuaucuuuuggaaagccugcc

SEQ ID NO: 6418 - RNA, 22 nt, Streptococcus pyogenes M1 GAS
gccugugugauuuugcaagcua

SEQ ID NO: 6419 - RNA, 22 nt, Streptococcus pyogenes M1 GAS
gcugaauuagguggcugggagg

SEQ ID NO: 6420 - RNA, 22 nt, Streptococcus pyogenes M1 GAS
ucucagaagcuauggagcgugu

SEQ ID NO: 6421 - RNA, 22 nt, Streptococcus pyogenes M1 GAS
aaaaugguccagcagauuuggu

SEQ ID NO: 6422 - RNA, 22 nt, Streptococcus pyogenes M1 GAS
aagugucaacuaaaacagcuua

SEQ ID NO: 6423 - RNA, 22 nt, Streptococcus pyogenes M1 GAS
agcuggguaggcuggcgucaga

SEQ ID NO: 6424 - RNA, 22 nt, Streptococcus pyogenes M1 GAS
cucaggcaucuuacauuuugcc

SEQ ID NO: 6425 - RNA, 22 nt, Streptococcus pyogenes M1 GAS
ccuagucugucauuauggguuu

SEQ ID NO: 6426 - RNA, 22 nt, Streptococcus pyogenes M1 GAS
uuugauugguaugaucuagcau

SEQ ID NO: 6427 - RNA, 22 nt, Streptococcus pyogenes M1 GAS
uugggaagggauuugcuagccu

SEQ ID NO: 6428 - RNA, 22 nt, Streptococcus pyogenes M1 GAS
uuggagugauugcacugcuguu

SEQ ID NO: 6429 - RNA, 21 nt, Streptococcus pyogenes M1 GAS
uugauugaugaugcaaguaca

SEQ ID NO: 6430 - RNA, 22 nt, Streptococcus pyogenes M1 GAS
ugagagagcuuguugagcugga

SEQ ID NO: 6431 - RNA, 21 nt, Streptococcus pyogenes M1 GAS
ugagacagaucuggcuugacu

SEQ ID NO: 6432 - RNA, 22 nt, Streptococcus pyogenes M1 GAS
ucugggaaagguuuucagggcu

SEQ ID NO: 6433 - RNA, 21 nt, Streptococcus pyogenes M1 GAS
uggcagaaaccuucucggcuc

SEQ ID NO: 6434 - RNA, 22 nt, Treponema pallidum subsp. pallidum str. Nichols
ugcuggugagaguuuucaagcg

SEQ ID NO: 6435 - RNA, 22 nt, Treponema pallidum subsp. pallidum str. Nichols
uugauucgguuuuguacguucc

SEQ ID NO: 6436 - RNA, 22 nt, Treponema pallidum subsp. pallidum str. Nichols
uugagggucguuugacgcaacu

SEQ ID NO: 6437 - RNA, 22 nt, Treponema pallidum subsp. pallidum str. Nichols
cccccauggagacugcaccuga

SEQ ID NO: 6438 - RNA, 22 nt, Treponema pallidum subsp. pallidum str. Nichols
cauaaucagcgcuaaaggaaau

SEQ ID NO: 6439 - RNA, 22 nt, Treponema pallidum subsp. pallidum str. Nichols
auuuuaaugcagcgucuugcgc

SEQ ID NO: 6440 - RNA, 22 nt, Treponema pallidum subsp. pallidum str. Nichols
auuccauuuuuggaucguaggc

SEQ ID NO: 6441 - RNA, 22 nt, Treponema pallidum subsp. pallidum str. Nichols
aguguauucaaccauuugcuuu

SEQ ID NO: 6442 - RNA, 22 nt, Treponema pallidum subsp. pallidum str. Nichols
auguauguuuuaguucugugga

SEQ ID NO: 6443 - RNA, 22 nt, Treponema pallidum subsp. pallidum str. Nichols
aucaaugucgcggcagagaacu

SEQ ID NO: 6444 - RNA, 22 nt, Treponema pallidum subsp. pallidum str. Nichols
aacaagcaaucguuacucuuuu

SEQ ID NO: 6445 - RNA, 22 nt, Treponema pallidum subsp. pallidum str. Nichols
aagaacuaggagucugugucgc

SEQ ID NO: 6446 - RNA, 22 nt, Treponema pallidum subsp. pallidum str. Nichols
agaaaugaaaggacgcaucauu

SEQ ID NO: 6447 - RNA, 22 nt, Treponema pallidum subsp. pallidum str. Nichols
acgaagacgccucacggaagcu

SEQ ID NO: 6448 - RNA, 20 nt, Treponema pallidum subsp. pallidum str. Nichols
uccugcuccaacugacggug

SEQ ID NO: 6449 - RNA, 22 nt, Treponema pallidum subsp. pallidum str. Nichols
guggcaguuuggauuugaacca

SEQ ID NO: 6450 - RNA, 22 nt, Treponema pallidum subsp. pallidum str. Nichols
gugaugcacgugauuuugugcu

SEQ ID NO: 6451 - RNA, 18 nt, Treponema pallidum subsp. pallidum str. Nichols
guccuuuccggugaacuc

SEQ ID NO: 6452 - RNA, 22 nt, Treponema pallidum subsp. pallidum str. Nichols
gcuguauccgaaauaccauuuu

SEQ ID NO: 6453 - RNA, 22 nt, Treponema pallidum subsp. pallidum str. Nichols
gccugaaagcugcacauacccg

SEQ ID NO: 6454 - RNA, 22 nt, Treponema pallidum subsp. pallidum str. Nichols
gcucuggaaaagauucgcuuca

SEQ ID NO: 6455 - RNA, 22 nt, Treponema pallidum subsp. pallidum str. Nichols
gaggaugaagcguaagguucau

SEQ ID NO: 6456 - RNA, 22 nt, Treponema pallidum subsp. pallidum str. Nichols
cugugguuccaucggacccuuc

SEQ ID NO: 6457 - RNA, 22 nt, Bordetella pertussis
aagcaggggguugccgacgggg

SEQ ID NO: 6458 - RNA, 22 nt, Bordetella pertussis
aagggcagcgugcuggccauca

SEQ ID NO: 6459 - RNA, 22 nt, Bordetella pertussis
acagcaggaugucggcggccau

SEQ ID NO: 6460 - RNA, 19 nt, Bordetella pertussis
acaucucgugcaccagccc

SEQ ID NO: 6461 - RNA, 22 nt, Bordetella pertussis
aagaacaagggcgucaacaggg

SEQ ID NO: 6462 - RNA, 22 nt, Bordetella pertussis
aagccgugaaggcaaucgcgcc

SEQ ID NO: 6463 - RNA, 22 nt, Bordetella pertussis
aaggcagcgccucgaucaccuc

SEQ ID NO: 6464 - RNA, 22 nt, Bordetella pertussis
accgugggcagcuggucguagu

SEQ ID NO: 6465 - RNA, 22 nt, Bordetella pertussis
acgaucuggccgccgagcuggc

SEQ ID NO: 6466 - RNA, 22 nt, Bordetella pertussis
acgaccaggaagaggcgcuguc

SEQ ID NO: 6467 - RNA, 22 nt, Bordetella pertussis
acuguaaaccuuuuagaagugc

SEQ ID NO: 6468 - RNA, 22 nt, Bordetella pertussis
acuuucaugcccggccaguuau

SEQ ID NO: 6469 - RNA, 22 nt, Bordetella pertussis
agggccugcguuucgcuggcau

SEQ ID NO: 6470 - RNA, 19 nt, Bordetella pertussis
agggccuggggcccgagca

SEQ ID NO: 6471 - RNA, 22 nt, Bordetella pertussis
aggugcaggccgcccucggcgc

SEQ ID NO: 6472 - RNA, 22 nt, Bordetella pertussis
agguugaucgcccaugugccau

SEQ ID NO: 6473 - RNA, 22 nt, Bordetella pertussis
agccagcaguugcagcggcugg

SEQ ID NO: 6474 - RNA, 22 nt, Bordetella pertussis
aggaugaggucggcgcgcucga

SEQ ID NO: 6475 - RNA, 22 nt, Bordetella pertussis
auggggccgagcgcccagucgc

SEQ ID NO: 6476 - RNA, 22 nt, Bordetella pertussis
augugcagcgccaccaggcugg

SEQ ID NO: 6477 - RNA, 22 nt, Bordetella pertussis
caccagauacugcgccuggccc

SEQ ID NO: 6478 - RNA, 22 nt, Bordetella pertussis
cagcagggccagcaccgagcca

SEQ ID NO: 6479 - RNA, 22 nt, Bordetella pertussis
cagggcagcgcgcaggaccuga

SEQ ID NO: 6480 - RNA, 22 nt, Bordetella pertussis
caggugaaccuggacuggcugg

SEQ ID NO: 6481 - RNA, 22 nt, Bordetella pertussis
ccagcaggugcggcgucagguu

SEQ ID NO: 6482 - RNA, 22 nt, Bordetella pertussis
ccaguuggucaccucguagccc

SEQ ID NO: 6483 - RNA, 22 nt, Bordetella pertussis
ccgccgugagccacagaaugcc

SEQ ID NO: 6484 - RNA, 20 nt, Bordetella pertussis
ccgugggcacgcugaccuug

SEQ ID NO: 6485 - RNA, 22 nt, Bordetella pertussis
ccgugggcagcgucgugcuggg

SEQ ID NO: 6486 - RNA, 21 nt, Bordetella pertussis
ccgugggcgaguaccuugugc

SEQ ID NO: 6487 - RNA, 22 nt, Bordetella pertussis
ccugaaugauggcgguuccgug

SEQ ID NO: 6488 - RNA, 22 nt, Bordetella pertussis
ccugauggaccacuggcagccg

SEQ ID NO: 6489 - RNA, 22 nt, Bordetella pertussis
cgaagggcgcguuggugaugua

SEQ ID NO: 6490 - RNA, 22 nt, Bordetella pertussis
cgaccagaucaugcgcuugggu

SEQ ID NO: 6491 - RNA, 21 nt, Bordetella pertussis
cgaagaauacgcugacgucgu

SEQ ID NO: 6492 - RNA, 22 nt, Bordetella pertussis
cgacggcaccgacagcaaggag

SEQ ID NO: 6493 - RNA, 22 nt, Bordetella pertussis
cgcagcaagcggcugagcugaa

SEQ ID NO: 6494 - RNA, 22 nt, Bordetella pertussis
cgcagcucgugcgagacguugg

SEQ ID NO: 6495 - RNA, 22 nt, Bordetella pertussis
cgcuccaguagaacgccucgag

SEQ ID NO: 6496 - RNA, 22 nt, Bordetella pertussis
cggcaucagcgccugcaggcgc

SEQ ID NO: 6497 - RNA, 22 nt, Bordetella pertussis
cgggacggcccugcaggaacuc

SEQ ID NO: 6498 - RNA, 22 nt, Bordetella pertussis
cgggccuggcccgccauccgcg

SEQ ID NO: 6499 - RNA, 22 nt, Bordetella pertussis
cguggaugauggccucggcgcg

SEQ ID NO: 6500 - RNA, 22 nt, Bordetella pertussis
cgugugggccguggccgguacg

SEQ ID NO: 6501 - RNA, 22 nt, Bordetella pertussis
gacggcacggcacaggucgacg

SEQ ID NO: 6502 - RNA, 22 nt, Bordetella pertussis
gagaaauaugcugcuaugaagc

SEQ ID NO: 6503 - RNA, 17 nt, Bordetella pertussis
gcaggugcgccugaagg

SEQ ID NO: 6504 - RNA, 22 nt, Bordetella pertussis
gcgccagccugcgcaaccugcu

SEQ ID NO: 6505 - RNA, 22 nt, Bordetella pertussis
gcgugggcacgcaaucgcuuuc

SEQ ID NO: 6506 - RNA, 22 nt, Bordetella pertussis
gcuagcuccugucgugggucgc

SEQ ID NO: 6507 - RNA, 22 nt, Bordetella pertussis
gcucugggcggagucgauaugc

SEQ ID NO: 6508 - RNA, 22 nt, Bordetella pertussis
gcugcugguggucgacggucag

SEQ ID NO: 6509 - RNA, 22 nt, Bordetella pertussis
ggauggaguucagcagcucgca

SEQ ID NO: 6510 - RNA, 22 nt, Bordetella pertussis
ggcagccucgccgagaccguca

SEQ ID NO: 6511 - RNA, 23 nt, Bordetella pertussis
ggcagcaggaacaccgccggcgg

SEQ ID NO: 6512 - RNA, 22 nt, Bordetella pertussis
ggcauccugcacaguccggacg

SEQ ID NO: 6513 - RNA, 22 nt, Bordetella pertussis
gggcaaggucgccguggcagcg

SEQ ID NO: 6514 - RNA, 22 nt, Bordetella pertussis
gggccugaccgugcugggcgcu

SEQ ID NO: 6515 - RNA, 22 nt, Bordetella pertussis
gugcagcgcuugcagccggcgu

SEQ ID NO: 6516 - RNA, 22 nt, Bordetella pertussis
gugcaggccaugaacgaccgcu

SEQ ID NO: 6517 - RNA, 22 nt, Bordetella pertussis
gugccuguccccgcauggggga

SEQ ID NO: 6518 - RNA, 22 nt, Bordetella pertussis
ugaaaauuccuugagcgcccgg

SEQ ID NO: 6519 - RNA, 22 nt, Bordetella pertussis
ugcaggaacacgagauccggcc

SEQ ID NO: 6520 - RNA, 22 nt, Bordetella pertussis
uggcagcagaucgacuacggcu

SEQ ID NO: 6521 - RNA, 23 nt, Bordetella pertussis
uggcauccgacgccgugcucgcg

SEQ ID NO: 6522 - RNA, 22 nt, Bordetella pertussis
ugggcagcgaauucuggcacgg

SEQ ID NO: 6523 - RNA, 22 nt, Bordetella pertussis
uugcagcacgugccguaucgag

SEQ ID NO: 6524 - RNA, 23 nt, Bordetella pertussis
agugggcagggugcaugcgcgcc

SEQ ID NO: 6525 - RNA, 22 nt, Bordetella pertussis
aguuccagcccuucgauggugu

SEQ ID NO: 6526 - RNA, 22 nt, Bordetella pertussis
auagacuuuggcgcuugauucc

SEQ ID NO: 6527 - RNA, 22 nt, Bordetella pertussis
aucaacuuccagaucaugggca

SEQ ID NO: 6528 - RNA, 22 nt, Bordetella pertussis
auccagcccggcggccuggcgc

SEQ ID NO: 6529 - RNA, 22 nt, Bordetella pertussis
auccagccguucgguucgcaag

SEQ ID NO: 6530 - RNA, 22 nt, Bordetella pertussis
auguagcucgccagcagcguca

SEQ ID NO: 6531 - RNA, 22 nt, Bordetella pertussis
cagcaggguggguuugauguug

SEQ ID NO: 6532 - RNA, 22 nt, Bordetella pertussis
caggaacucguggcugacgccu

SEQ ID NO: 6533 - RNA, 22 nt, Bordetella pertussis
ccagcaggcgcuugcgcgucag

SEQ ID NO: 6534 - RNA, 22 nt, Bordetella pertussis
ccagcagguccagcgccugcug

SEQ ID NO: 6535 - RNA, 22 nt, Bordetella pertussis
ccagcaggugcgugucggcaaa

SEQ ID NO: 6536 - RNA, 22 nt, Bordetella pertussis
ccagggacgggagggugccgaa

SEQ ID NO: 6537 - RNA, 22 nt, Bordetella pertussis
ccggcacaggaagcgccagcaa

SEQ ID NO: 6538 - RNA, 22 nt, Bordetella pertussis
ccuguauggcgcugauggccgg

SEQ ID NO: 6539 - RNA, 22 nt, Bordetella pertussis
cgagggcaggccguggcagguu

SEQ ID NO: 6540 - RNA, 20 nt, Bordetella pertussis
cgaucugcugccaugccggu

SEQ ID NO: 6541 - RNA, 22 nt, Bordetella pertussis
cgccgugguggcggccgacaua

SEQ ID NO: 6542 - RNA, 22 nt, Bordetella pertussis
cggcagcaggaacagcgacacg

SEQ ID NO: 6543 - RNA, 22 nt, Bordetella pertussis
cggcagcaucgucagcggcgug

SEQ ID NO: 6544 - RNA, 22 nt, Bordetella pertussis
cggcauccccguggucagcgac

SEQ ID NO: 6545 - RNA, 22 nt, Bordetella pertussis
cggccuguccagcgagaacgug

SEQ ID NO: 6546 - RNA, 22 nt, Bordetella pertussis
cggccuguccaucaugugcuuc

SEQ ID NO: 6547 - RNA, 16 nt, Bordetella pertussis
cgggccuguucgccag

SEQ ID NO: 6548 - RNA, 22 nt, Bordetella pertussis
cuacaacaugaagcugccgcca

SEQ ID NO: 6549 - RNA, 22 nt, Bordetella pertussis
cuggaugacgcgaugcguggaa

SEQ ID NO: 6550 - RNA, 22 nt, Bordetella pertussis
gaacagauuguccgggccgggg

SEQ ID NO: 6551 - RNA, 22 nt, Bordetella pertussis
gaacucuuccgcaaagcggucg

SEQ ID NO: 6552 - RNA, 22 nt, Bordetella pertussis
gacagcacgcgccgcaagggca

SEQ ID NO: 6553 - RNA, 22 nt, Bordetella pertussis
gcagcaggcacccggccagcgu

SEQ ID NO: 6554 - RNA, 22 nt, Bordetella pertussis
gccagccgcugggggguaccca

SEQ ID NO: 6555 - RNA, 22 nt, Bordetella pertussis
gccagccggcccacgaaggcga

SEQ ID NO: 6556 - RNA, 22 nt, Bordetella pertussis
gccagccggugccggccgacca

SEQ ID NO: 6557 - RNA, 22 nt, Bordetella pertussis
gccgugugcuugaugaauggag

SEQ ID NO: 6558 - RNA, 22 nt, Bordetella pertussis
gcgugggcauuuugcugcgccc

SEQ ID NO: 6559 - RNA, 22 nt, Bordetella pertussis
gcgugggccgggcccggcacug

SEQ ID NO: 6560 - RNA, 23 nt, Bordetella pertussis
gcucuggguggccgaggucuggc

SEQ ID NO: 6561 - RNA, 22 nt, Bordetella pertussis
gcuguagcugaagccgucggcc

SEQ ID NO: 6562 - RNA, 22 nt, Bordetella pertussis
ggcagcacgccgaagccgucga

SEQ ID NO: 6563 - RNA, 22 nt, Bordetella pertussis
ggcagcaggauguugcggcgaa

SEQ ID NO: 6564 - RNA, 22 nt, Bordetella pertussis
ggcagcucggccucgggcgcca

SEQ ID NO: 6565 - RNA, 22 nt, Bordetella pertussis
ggccgugggcgccgacgugcgu

SEQ ID NO: 6566 - RNA, 22 nt, Bordetella pertussis
gggcgaagucaccgucagcauc

SEQ ID NO: 6567 - RNA, 22 nt, Bordetella pertussis
guccagccauucgagcagggcc

SEQ ID NO: 6568 - RNA, 22 nt, Bordetella pertussis
gugcgagccgcucaggcccgcg

SEQ ID NO: 6569 - RNA, 22 nt, Bordetella pertussis
uauuacgugcggcugcuggccg

SEQ ID NO: 6570 - RNA, 22 nt, Bordetella pertussis
ucagauggucgagcacauuguc

SEQ ID NO: 6571 - RNA, 22 nt, Bordetella pertussis
ugaaugccagcgcgaccucgca

SEQ ID NO: 6572 - RNA, 22 nt, Bordetella pertussis
ugcacagggucgcccuggcgcc

SEQ ID NO: 6573 - RNA, 22 nt, Bordetella pertussis
ugcagcagcgcggcaucgaccg

SEQ ID NO: 6574 - RNA, 19 nt, Bordetella pertussis
ugcagcaggaucugcuggu

SEQ ID NO: 6575 - RNA, 23 nt, Bordetella pertussis
uggacaaggcgcgcgagguggug

SEQ ID NO: 6576 - RNA, 22 nt, Bordetella pertussis
uggaccagcucgcgggcgcgau

SEQ ID NO: 6577 - RNA, 22 nt, Bordetella pertussis
ugggccugaacgguggcggcca

SEQ ID NO: 6578 - RNA, 22 nt, Bordetella pertussis
ugggccugcugggcaaccuggu

SEQ ID NO: 6579 - RNA, 22 nt, Bordetella pertussis
ugggccuggauggcgccgcauu

SEQ ID NO: 6580 - RNA, 22 nt, Bordetella pertussis
uggugcagcucgucguugucgg

SEQ ID NO: 6581 - RNA, 22 nt, Bordetella pertussis
uggugcaggagcgccugcuguu

SEQ ID NO: 6582 - RNA, 22 nt, Bordetella pertussis
uguggauguucucccugguggu

SEQ ID NO: 6583 - RNA, 22 nt, Bordetella pertussis
uguuccauugccuucugaaccg

SEQ ID NO: 6584 - RNA, 22 nt, Bordetella pertussis
uuggggccguggccggcgcugu

SEQ ID NO: 6585 - RNA, 18 nt, Homo sapiens
uggacagugauuauccau

SEQ ID NO: 6586 - RNA, 23 nt, Homo sapiens
agagugcaauggugccaucucgg

SEQ ID NO: 6587 - RNA, 22 nt, Homo sapiens
aaauugcauugagcugcuuauu

SEQ ID NO: 6588 - RNA, 22 nt, Homo sapiens
uauuucaguugugcagguaguu

SEQ ID NO: 6589 - RNA, 22 nt, Homo sapiens
aauaucacaggguguacacuca

SEQ ID NO: 6590 - RNA, 18 nt, Homo sapiens
gacaguguggcaauuccu

SEQ ID NO: 6591 - RNA, 22 nt, Homo sapiens
aaggaacuggaauauuuugaac

SEQ ID NO: 6592 - RNA, 22 nt, Homo sapiens
uuucauagaucaugcuuuugga

SEQ ID NO: 6593 - RNA, 23 nt, Homo sapiens
uuuguguccccacccaaaucuca

SEQ ID NO: 6594 - RNA, 22 nt, Homo sapiens
uugauauucugagaagcugaag

SEQ ID NO: 6595 - RNA, 22 nt, Homo sapiens
auuaucacaguuuugcauaugg

SEQ ID NO: 6596 - RNA, 22 nt, Homo sapiens
aaauugcaguuaggaugauggu

SEQ ID NO: 6597 - RNA, 22 nt, Homo sapiens
ucagaaccuccuagcaguguuc

SEQ ID NO: 6598 - RNA, 22 nt, Homo sapiens
acagaaccauucacuccccugg

SEQ ID NO: 6599 - RNA, 22 nt, Homo sapiens
uggguaggaccagaaaugcacu

SEQ ID NO: 6600 - RNA, 22 nt, Homo sapiens
aaguggaauguuuguggcacaa

SEQ ID NO: 6601 - RNA, 20 nt, Homo sapiens
ucaaauucuuggccuccagc

SEQ ID NO: 6602 - RNA, 22 nt, Homo sapiens
ucaugucuuguuguauuuauuu

SEQ ID NO: 6603 - RNA, 22 nt, Homo sapiens
ggaagaauauuaggggauuucg

SEQ ID NO: 6604 - RNA, 22 nt, Homo sapiens
aucagagugaugguuuaaguau

SEQ ID NO: 6605 - RNA, 22 nt, Homo sapiens
uuuaguucauuaaggaaucucc

SEQ ID NO: 6606 - RNA, 22 nt, Homo sapiens
uugagaucaugcuacugcacuc

SEQ ID NO: 6607 - RNA, 22 nt, Homo sapiens
ugaacugagacuagacuuguuc

SEQ ID NO: 6608 - RNA, 22 nt, Homo sapiens
gagauauuuagaaauguguucu

SEQ ID NO: 6609 - RNA, 22 nt, Homo sapiens
ccacauuaccuugcuugcucca

SEQ ID NO: 6610 - RNA, 17 nt, Homo sapiens
auaugaauuuuggagau

SEQ ID NO: 6611 - RNA, 22 nt, Homo sapiens
uauuacauccauaggcucugcu

SEQ ID NO: 6612 - RNA, 22 nt, Homo sapiens
acccuuaagcacuaguucagcu

SEQ ID NO: 6613 - RNA, 22 nt, Homo sapiens
gugggaagcuggaacucccucc

SEQ ID NO: 6614 - RNA, 21 nt, Homo sapiens
uuugaucauuaaaagugaauc

SEQ ID NO: 6615 - RNA, 22 nt, Homo sapiens
aauuggcagugcucuugccaca

SEQ ID NO: 6616 - RNA, 18 nt, Homo sapiens
gacaguguggcgauuccu

SEQ ID NO: 6617 - RNA, 22 nt, Homo sapiens
auggacagacacuggccuucug

SEQ ID NO: 6618 - RNA, 22 nt, Homo sapiens
uuuaguccucugaaaaucuaua

SEQ ID NO: 6619 - RNA, 22 nt, Homo sapiens
augugacuugugaaaaguucag

SEQ ID NO: 6620 - RNA, 22 nt, Homo sapiens
uagcaagaugaauuugugcaaa

SEQ ID NO: 6621 - RNA, 22 nt, Homo sapiens
augaguauguucuguauuuuca

SEQ ID NO: 6622 - RNA, 22 nt, Homo sapiens
gcaguguggguagagggcaaga

SEQ ID NO: 6623 - RNA, 22 nt, Homo sapiens
ggugcagcacaccaacauggca

SEQ ID NO: 6624 - RNA, 22 nt, Homo sapiens
uugacaaugcacugugcuaagu

SEQ ID NO: 6625 - RNA, 22 nt, Homo sapiens
ugagauauugggaguaauguca

SEQ ID NO: 6626 - RNA, 20 nt, Homo sapiens
uugacaguggguuguuaaag

SEQ ID NO: 6627 - RNA, 22 nt, Homo sapiens
uuggaaagagguguuuaugacu

SEQ ID NO: 6628 - RNA, 18 nt, Homo sapiens
gacaguguggugauuccu

SEQ ID NO: 6629 - RNA, 21 nt, Homo sapiens
aaucacugucuguuuccccuu

SEQ ID NO: 6630 - RNA, 23 nt, Homo sapiens
ucagugaaggaacaacuaaauag

SEQ ID NO: 6631 - RNA, 22 nt, Homo sapiens
gagaaccauuuggagaaaaagu

SEQ ID NO: 6632 - RNA, 22 nt, Homo sapiens
uggaaaguaguucuaaucuaag

SEQ ID NO: 6633 - RNA, 22 nt, Homo sapiens
uggaaauuaacagggauugucc

SEQ ID NO: 6634 - RNA, 22 nt, Homo sapiens
auuuggguuuuacaucaggcua

SEQ ID NO: 6635 - RNA, 22 nt, Homo sapiens
uggaaaguacugagguccaccu

SEQ ID NO: 6636 - RNA, 22 nt, Homo sapiens
ucauaggucugagaagaaaaua

SEQ ID NO: 6637 - RNA, 22 nt, Homo sapiens
auaaggaguaucauauuaaaac

SEQ ID NO: 6638 - RNA, 18 nt, Homo sapiens
uagaauauaggucauucu

SEQ ID NO: 6639 - RNA, 22 nt, Homo sapiens
aguggauguuguggccugggag

SEQ ID NO: 6640 - RNA, 22 nt, Homo sapiens
ugagcagaaagcugcaaggucg

SEQ ID NO: 6641 - RNA, 22 nt, Homo sapiens
uagaauggaagguugagaagaa

SEQ ID NO: 6642 - RNA, 22 nt, Homo sapiens
uuacuugagauggggugucacu

SEQ ID NO: 6643 - RNA, 22 nt, Homo sapiens
acugcacuuauccuccaauguu

SEQ ID NO: 6644 - RNA, 22 nt, Homo sapiens
guaaauaccaguuucuggaaca

SEQ ID NO: 6645 - RNA, 22 nt, Homo sapiens
aauugcaccaucuagaucaaga

SEQ ID NO: 6646 - RNA, 22 nt, Homo sapiens
uauugaauuugagcugucucuu

SEQ ID NO: 6647 - RNA, 22 nt, Homo sapiens
uggauaguuuacugaagagugg

SEQ ID NO: 6648 - RNA, 22 nt, Homo sapiens
ggccuguaggguauugguaggg

SEQ ID NO: 6649 - RNA, 22 nt, Homo sapiens
auugaaucuaaaaugagucucu

SEQ ID NO: 6650 - RNA, 22 nt, Homo sapiens
ugugucuuuuaucacacaaugu

SEQ ID NO: 6651 - RNA, 20 nt, Homo sapiens
uuugcagaaucuaagaagag

SEQ ID NO: 6652 - RNA, 18 nt, Homo sapiens
guauuccagccugaguga

SEQ ID NO: 6653 - RNA, 18 nt, Homo sapiens
auucuacaggccuuuuga

SEQ ID NO: 6654 - RNA, 22 nt, Homo sapiens
uggaaaguacuugaguuuguau

SEQ ID NO: 6655 - RNA, 22 nt, Homo sapiens
auauuacagagaggaccuggga

SEQ ID NO: 6656 - RNA, 20 nt, Homo sapiens
cagucaugaagaacugugag

SEQ ID NO: 6657 - RNA, 21 nt, Homo sapiens
auggaaagacugccucuucaa

SEQ ID NO: 6658 - RNA, 22 nt, Homo sapiens
ugagaguauaaauugaugcagc

SEQ ID NO: 6659 - RNA, 22 nt, Homo sapiens
uaaugugaauagugcuguaaug

SEQ ID NO: 6660 - RNA, 22 nt, Homo sapiens
agcaagauuguucccauuuucu

SEQ ID NO: 6661 - RNA, 22 nt, Homo sapiens
aggcagcuguuauauacugagu

SEQ ID NO: 6662 - RNA, 22 nt, Homo sapiens
uaucacaguugcauauuuaagg

SEQ ID NO: 6663 - RNA, 20 nt, Homo sapiens
uggaaaguaagucaugauau

SEQ ID NO: 6664 - RNA, 22 nt, Homo sapiens
gacagugugauacuuagucuca

SEQ ID NO: 6665 - RNA, 22 nt, Homo sapiens
uggaaaguccaagccaaccggg

SEQ ID NO: 6666 - RNA, 22 nt, Homo sapiens
uuugacuuuuagaauaugaguu

SEQ ID NO: 6667 - RNA, 22 nt, Homo sapiens
uuucauagccuuugucgucuga

SEQ ID NO: 6668 - RNA, 22 nt, Homo sapiens
gacaguguggcgauuccucaag

SEQ ID NO: 6669 - RNA, 22 nt, Homo sapiens
gauagguucuaagcagguguug

SEQ ID NO: 6670 - RNA, 22 nt, Homo sapiens
auuacccuuagacuccagagug

SEQ ID NO: 6671 - RNA, 20 nt, Homo sapiens
uggaccagagagguggggac

SEQ ID NO: 6672 - RNA, 22 nt, Homo sapiens
ugaaaugaucaguuugguuacu

SEQ ID NO: 6673 - RNA, 22 nt, Homo sapiens
auacaucugccauguuggugug

SEQ ID NO: 6674 - RNA, 22 nt, Homo sapiens
cugaaucauugcauuaucaagg

SEQ ID NO: 6675 - RNA, 22 nt, Homo sapiens
auaaauucauuuaagcuccuua

SEQ ID NO: 6676 - RNA, 22 nt, Homo sapiens
uugagagaaaaggccaugccuu

SEQ ID NO: 6677 - RNA, 22 nt, Homo sapiens
ucagaaccucugauuuauacuu

SEQ ID NO: 6678 - RNA, 18 nt, Homo sapiens
gugagaaugacuguucug

SEQ ID NO: 6679 - RNA, 22 nt, Homo sapiens
aaauugcacaaguggugauuug

SEQ ID NO: 6680 - RNA, 22 nt, Homo sapiens
ugacggaggcauuggaagcuug

SEQ ID NO: 6681 - RNA, 22 nt, Homo sapiens
ugagagacagacauuaucuuau

SEQ ID NO: 6682 - RNA, 16 nt, Homo sapiens
uguccaaauaaauaca

SEQ ID NO: 6683 - RNA, 22 nt, Homo sapiens
ugagaugagagaaugcuugccu

SEQ ID NO: 6684 - RNA, 22 nt, Homo sapiens
ugauguguuuuguaguucaacu

SEQ ID NO: 6685 - RNA, 22 nt, Homo sapiens
ggaagaauaaugggccuuagag

SEQ ID NO: 6686 - RNA, 22 nt, Homo sapiens
ucaaauuccaagucuagguagg

SEQ ID NO: 6687 - RNA, 22 nt, Homo sapiens
auagguuuucacuguagauucu

SEQ ID NO: 6688 - RNA, 22 nt, Homo sapiens
uaaguaguauaagguuuuuuga

SEQ ID NO: 6689 - RNA, 22 nt, Homo sapiens
uguggaaauaaaagaaagguua

SEQ ID NO: 6690 - RNA, 18 nt, Homo sapiens
uggauaguuguuggcaga

SEQ ID NO: 6691 - RNA, 22 nt, Homo sapiens
gauauguaguaguugaaaaaga

SEQ ID NO: 6692 - RNA, 20 nt, Homo sapiens
uucagugcagguaacaaucc

SEQ ID NO: 6693 - RNA, 20 nt, Homo sapiens
uggaaauuaaccuuucaggu

SEQ ID NO: 6694 - RNA, 16 nt, Homo sapiens
uacauuuguuacaugg

SEQ ID NO: 6695 - RNA, 22 nt, Homo sapiens
ggcagcucaggccccgcgcuga

SEQ ID NO: 6696 - RNA, 22 nt, Homo sapiens
gccuguagaagaguagaugacc

SEQ ID NO: 6697 - RNA, 18 nt, Homo sapiens
acaguguguaaggguucu

SEQ ID NO: 6698 - RNA, 22 nt, Homo sapiens
ccuguagcauccaagaagcugc

SEQ ID NO: 6699 - RNA, 22 nt, Homo sapiens
gccaagaagugucuaagcagga

SEQ ID NO: 6700 - RNA, 22 nt, Homo sapiens
gugaaagauuaaaccagugugu

SEQ ID NO: 6701 - RNA, 22 nt, Homo sapiens
cugaaagagcauuugaaugggu

SEQ ID NO: 6702 - RNA, 22 nt, Homo sapiens
aucauauccuagauauaacuuc

SEQ ID NO: 6703 - RNA, 22 nt, Homo sapiens
acuuuuugauggggagaacauu

SEQ ID NO: 6704 - RNA, 22 nt, Homo sapiens
aaaguggacuaagugaauauga

SEQ ID NO: 6705 - RNA, 22 nt, Homo sapiens
aaagucuagaggaucaugugug

SEQ ID NO: 6706 - RNA, 22 nt, Homo sapiens
cuguagcuuuuauaugcuuagc

SEQ ID NO: 6707 - RNA, 22 nt, Homo sapiens
acagccauuccagccaaauacu

SEQ ID NO: 6708 - RNA, 22 nt, Homo sapiens
cuagacacugacguuccuccga

SEQ ID NO: 6709 - RNA, 22 nt, Homo sapiens
uuauucauuaacagggaccaaa

SEQ ID NO: 6710 - RNA, 23 nt, Homo sapiens
uuugagugugauaaacacuguca

SEQ ID NO: 6711 - RNA, 22 nt, Homo sapiens
ugucauagaugauuuuuuucgg

SEQ ID NO: 6712 - RNA, 22 nt, Homo sapiens
gugagaacugugucuuauaaac

SEQ ID NO: 6713 - RNA, 22 nt, Homo sapiens
uagauuauuggcugauuugauc

SEQ ID NO: 6714 - RNA, 22 nt, Homo sapiens
ugacauggagguggaggaagau

SEQ ID NO: 6715 - RNA, 22 nt, Homo sapiens
uuauucauuaauugcuaagguu

SEQ ID NO: 6716 - RNA, 22 nt, Homo sapiens
uucaguaaauguucuuacuaua

SEQ ID NO: 6717 - RNA, 18 nt, Homo sapiens
gacagugugaagauuccu

SEQ ID NO: 6718 - RNA, 22 nt, Homo sapiens
ggacagugaaugccacuccucc

SEQ ID NO: 6719 - RNA, 22 nt, Homo sapiens
uauuacuugucugugucucaau

SEQ ID NO: 6720 - RNA, 22 nt, Homo sapiens
ugugaugaagaguccaagaaca

SEQ ID NO: 6721 - RNA, 22 nt, Homo sapiens
auggacagaaaaaaauagaugu

SEQ ID NO: 6722 - RNA, 20 nt, Homo sapiens
ugacuuguccgagguccccc

SEQ ID NO: 6723 - RNA, 22 nt, Homo sapiens
aauuacauggcaauugggaaau

SEQ ID NO: 6724 - RNA, 22 nt, Homo sapiens
uaagcuauagugaauaaauugc

SEQ ID NO: 6725 - RNA, 22 nt, Homo sapiens
ugaaagacugaaagcuuuucuu

SEQ ID NO: 6726 - RNA, 22 nt, Homo sapiens
uauuuguccccuccaaaaguca

SEQ ID NO: 6727 - RNA, 22 nt, Homo sapiens
auuccaguuugugagaagcugu

SEQ ID NO: 6728 - RNA, 22 nt, Homo sapiens
agcuuuuugggcagcuauugac

SEQ ID NO: 6729 - RNA, 19 nt, Homo sapiens
uuuugcucuuuauaccuau

SEQ ID NO: 6730 - RNA, 22 nt, Homo sapiens
ugucuugagagaggacaugacu

SEQ ID NO: 6731 - RNA, 22 nt, Homo sapiens
auuccagguggcgccauucaca

SEQ ID NO: 6732 - RNA, 21 nt, Homo sapiens
gaaauacugccuuaggagcug

SEQ ID NO: 6733 - RNA, 18 nt, Homo sapiens
acauucagcuugaagaua

SEQ ID NO: 6734 - RNA, 22 nt, Homo sapiens
aggaauguuaguacuucuuagu

SEQ ID NO: 6735 - RNA, 22 nt, Homo sapiens
acaguguguguguucaccuaga

SEQ ID NO: 6736 - RNA, 19 nt, Homo sapiens
ugcagcaauguaaaagaca

SEQ ID NO: 6737 - RNA, 22 nt, Homo sapiens
uuucauagccuucuaaugaguu

SEQ ID NO: 6738 - RNA, 22 nt, Homo sapiens
uuugagaaugcuaccagagaag

SEQ ID NO: 6739 - RNA, 22 nt, Homo sapiens
caggugcauuggcugacaccug

SEQ ID NO: 6740 - RNA, 22 nt, Homo sapiens
ugagcagagaagugcccugcgc

SEQ ID NO: 6741 - RNA, 19 nt, Homo sapiens
ugccaagaaagucagcuua

SEQ ID NO: 6742 - RNA, 22 nt, Homo sapiens
uuucauaguuugcauagggcau

SEQ ID NO: 6743 - RNA, 22 nt, Homo sapiens
uaaggaacucugauaucuggaa

SEQ ID NO: 6744 - RNA, 22 nt, Homo sapiens
agaaccaaucccacauggauac

SEQ ID NO: 6745 - RNA, 22 nt, Homo sapiens
uauuucaguugcguuucccgag

SEQ ID NO: 6746 - RNA, 22 nt, Homo sapiens
auugcauaaacacauuucuuau

SEQ ID NO: 6747 - RNA, 22 nt, Homo sapiens
agagguuuaauugauucacagu

SEQ ID NO: 6748 - RNA, 22 nt, Homo sapiens
uaaguucauucaugaaacuuag

SEQ ID NO: 6749 - RNA, 22 nt, Homo sapiens
guguaaaacaauuagaggauuu

SEQ ID NO: 6750 - RNA, 22 nt, Homo sapiens
ugaauauguuucuaaaagugca

SEQ ID NO: 6751 - RNA, 23 nt, Homo sapiens
uaugucuauucuaaugccagcac

SEQ ID NO: 6752 - RNA, 22 nt, Homo sapiens
ucagggacuuacaaaccagaag

SEQ ID NO: 6753 - RNA, 22 nt, Homo sapiens
gaucacauuguuucauacauau

SEQ ID NO: 6754 - RNA, 22 nt, Homo sapiens
ucauaggucacuguaaccucgu

SEQ ID NO: 6755 - RNA, 22 nt, Homo sapiens
ugauuugucugcaggaauagug

SEQ ID NO: 6756 - RNA, 22 nt, Homo sapiens
cacaguguucauagccaucagg

SEQ ID NO: 6757 - RNA, 22 nt, Homo sapiens
uuggaaaguuguuguaguuauu

SEQ ID NO: 6758 - RNA, 22 nt, Homo sapiens
ucauaucauuagaucuacugua

SEQ ID NO: 6759 - RNA, 22 nt, Homo sapiens
cauagguugggcguuugauuuu

SEQ ID NO: 6760 - RNA, 22 nt, Homo sapiens
aaauucaucaaaugguuuguau

SEQ ID NO: 6761 - RNA, 22 nt, Homo sapiens
auucauagugcuaagguguauc

SEQ ID NO: 6762 - RNA, 22 nt, Homo sapiens
ugaugugucaucugagagagug

SEQ ID NO: 6763 - RNA, 22 nt, Homo sapiens
uuccaugagaugcaucaaagcu

SEQ ID NO: 6764 - RNA, 22 nt, Homo sapiens
uaaguagugugcauguauguau

SEQ ID NO: 6765 - RNA, 22 nt, Homo sapiens
auccugaagcuuuacugaauuc

SEQ ID NO: 6766 - RNA, 22 nt, Homo sapiens
uaucauugccucaaucuguauu

SEQ ID NO: 6767 - RNA, 22 nt, Homo sapiens
ggccuguaaacuagagacccug

SEQ ID NO: 6768 - RNA, 22 nt, Chlamydia trachomatis
uagaagaagacccuucguuugu

SEQ ID NO: 6769 - RNA, 22 nt, Chlamydia trachomatis
guauauuuauauugcccuucuu

SEQ ID NO: 6770 - RNA, 22 nt, Chlamydia trachomatis
gauucucugguauuaacugguu

SEQ ID NO: 6771 - RNA, 22 nt, Chlamydia trachomatis
uugauuaucccgaagauauaac

SEQ ID NO: 6772 - RNA, 22 nt, Chlamydia trachomatis
uggaaguaucgaggaucucugg

SEQ ID NO: 6773 - RNA, 22 nt, Homo sapiens
auagaauguauuaguaaauuug

SEQ ID NO: 6774 - RNA, 22 nt, Homo sapiens
augagaugcaagauuagauggg

SEQ ID NO: 6775 - RNA, 22 nt, Homo sapiens
augagaugaggaauggcccucc

SEQ ID NO: 6776 - RNA, 22 nt, Homo sapiens
uuugcuugaggucuagcuaccc

SEQ ID NO: 6777 - RNA, 22 nt, Homo sapiens
cuuuggagaaaaguucuugggc

SEQ ID NO: 6778 - RNA, 22 nt, Homo sapiens
uuugcagagucuuucgcugggc

SEQ ID NO: 6779 - RNA, 17 nt, Homo sapiens
uuaugagacuucuuagc

SEQ ID NO: 6780 - RNA, 22 nt, Homo sapiens
uaucaagaugacaaacuuugcu

SEQ ID NO: 6781 - RNA, 22 nt, Homo sapiens
ugagaucugucuuuauaguauu

SEQ ID NO: 6782 - RNA, 22 nt, Homo sapiens
augaagaucucugccuuguguc

SEQ ID NO: 6783 - RNA, 22 nt, Homo sapiens
augagaauguaaguuaaugaaa

SEQ ID NO: 6784 - RNA, 22 nt, Homo sapiens
uugaauagaaguguugaaagug

SEQ ID NO: 6785 - RNA, 22 nt, Homo sapiens
ugaguagaacuccuggagaugu

SEQ ID NO: 6786 - RNA, 22 nt, Homo sapiens
gcuuguguuuacuguaguuacu

SEQ ID NO: 6787 - RNA, 22 nt, Homo sapiens
uguaugaguuguuuauaaauuu

SEQ ID NO: 6788 - RNA, 18 nt, Homo sapiens
gcuguugucagagcacau

SEQ ID NO: 6789 - RNA, 22 nt, Homo sapiens
ugaguauguuuagaaguaaagg

SEQ ID NO: 6790 - RNA, 22 nt, Homo sapiens
cuuuaugagguuggauggaucu

SEQ ID NO: 6791 - RNA, 22 nt, Homo sapiens
augaagauguugccuuuuuaau

SEQ ID NO: 6792 - RNA, 22 nt, Homo sapiens
augaguaguugcuaaauauuga

SEQ ID NO: 6793 - RNA, 22 nt, Homo sapiens
augagauauuuuauaagaucau

SEQ ID NO: 6794 - RNA, 22 nt, Homo sapiens
augaggugaguaaauaaaugaa

SEQ ID NO: 6795 - RNA, 22 nt, Homo sapiens
augcuguuuuguagcucccucu

SEQ ID NO: 6796 - RNA, 22 nt, Homo sapiens
ugagacugguuaauugauaaag

SEQ ID NO: 6797 - RNA, 22 nt, Homo sapiens
uggauaguaaagucagauuccc

SEQ ID NO: 6798 - RNA, 22 nt, Homo sapiens
uguaugagagugaaagcauuuc

SEQ ID NO: 6799 - RNA, 22 nt, Homo sapiens
ugagaugauagauauguuaauu

SEQ ID NO: 6800 - RNA, 20 nt, Homo sapiens
uggaguuugaguucuuggag

SEQ ID NO: 6801 - RNA, 22 nt, Homo sapiens
acacaaugguaaguguuugugu

SEQ ID NO: 6802 - RNA, 22 nt, Homo sapiens
gaagauucaaccaaaccagaac

SEQ ID NO: 6803 - RNA, 22 nt, Homo sapiens
uaguaguuuuguguauaauaau

SEQ ID NO: 6804 - RNA, 22 nt, Homo sapiens
augagauauguuaaaaguuaaa

SEQ ID NO: 6805 - RNA, 22 nt, Homo sapiens
uguaugagagacauggcugcuu

SEQ ID NO: 6806 - RNA, 22 nt, Homo sapiens
aguagguguugguagagguuuc

SEQ ID NO: 6807 - RNA, 22 nt, Homo sapiens
aagcuggauuuaguguggagca

SEQ ID NO: 6808 - RNA, 22 nt, Homo sapiens
ucuugcuuguuguucccuucau

SEQ ID NO: 6809 - RNA, 22 nt, Homo sapiens
ugaguagagaauucagcuaagg

SEQ ID NO: 6810 - RNA, 20 nt, Homo sapiens
augguaguagcaccuuuaca

SEQ ID NO: 6811 - RNA, 22 nt, Homo sapiens
uauugcuugaggaaaugguaau

SEQ ID NO: 6812 - RNA, 22 nt, Homo sapiens
agcuuguuuuauagaaagucaa

SEQ ID NO: 6813 - RNA, 22 nt, Homo sapiens
uuccuugugacuaguagugacc

SEQ ID NO: 6814 - RNA, 22 nt, Homo sapiens
ugaauaguuugacagaacucuu

SEQ ID NO: 6815 - RNA, 22 nt, Homo sapiens
augagauacuacaaaugaguuu

SEQ ID NO: 6816 - RNA, 22 nt, Homo sapiens
augagaacauaucaagugauug

SEQ ID NO: 6817 - RNA, 18 nt, Homo sapiens
uggauaguuguuggcaga

SEQ ID NO: 6818 - RNA, 22 nt, Homo sapiens
augagaacugucaaugagagcu

SEQ ID NO: 6819 - RNA, 22 nt, Homo sapiens
aggaagacugaaauugcuguuc

SEQ ID NO: 6820 - RNA, 22 nt, Homo sapiens
augagaugaauaccgacgaugu

SEQ ID NO: 6821 - RNA, 22 nt, Homo sapiens
ugaaaugccuuuaaugaauuua

SEQ ID NO: 6822 - RNA, 22 nt, Homo sapiens
ugagaugcuuguaaauucauuu

SEQ ID NO: 6823 - RNA, 22 nt, Homo sapiens
uggauguacagucaguauuugu

SEQ ID NO: 6824 - RNA, 22 nt, Homo sapiens
gaaagauuuuaacugggagacu

SEQ ID NO: 6825 - RNA, 22 nt, Chlamydophila pneumoniae AR39
uagaaguauuaagccaagauuu

SEQ ID NO: 6826 - RNA, 22 nt, Chlamydophila pneumoniae AR39
aucuauaaaacaucaguugcuu

SEQ ID NO: 6827 - RNA, 22 nt, Chlamydophila pneumoniae AR39
auauauuuagccucuccugauu

SEQ ID NO: 6828 - RNA, 22 nt, Chlamydophila pneumoniae AR39
cuuuauauacccucgcucuuaa

SEQ ID NO: 6829 - RNA, 21 nt, Chlamydophila pneumoniae AR39
auaguaaguucaugcuuguua

SEQ ID NO: 6830 - RNA, 22 nt, Chlamydophila pneumoniae AR39
agcuuuuggauauccuuccuua

SEQ ID NO: 6831 - RNA, 22 nt, Chlamydophila pneumoniae AR39
aagaagaagaauccguggauga

SEQ ID NO: 6832 - RNA, 22 nt, Homo sapiens
augagaacauaucaagugauug

SEQ ID NO: 6833 - RNA, 22 nt, Homo sapiens
aggaagacugaaauugcuguuc

SEQ ID NO: 6834 - RNA, 22 nt, Homo sapiens
augagaugaggaauggcccucc

SEQ ID NO: 6835 - RNA, 22 nt, Homo sapiens
ugaaaugccuuuaaugaauuua

SEQ ID NO: 6836 - RNA, 22 nt, Homo sapiens
ugagaugauagauauguuaauu

SEQ ID NO: 6837 - RNA, 22 nt, Homo sapiens
uuugcuugaggucuagcuaccc

SEQ ID NO: 6838 - RNA, 22 nt, Homo sapiens
uggauaguaaagucagauuccc

SEQ ID NO: 6839 - RNA, 22 nt, Homo sapiens
uggauguacagucaguauuugu

SEQ ID NO: 6840 - RNA, 22 nt, Homo sapiens
acacaaugguaaguguuugugu

SEQ ID NO: 6841 - RNA, 22 nt, Homo sapiens
aagcuggauuuaguguggagca

SEQ ID NO: 6842 - RNA, 22 nt, Homo sapiens
augagaugaauaccgacgaugu

SEQ ID NO: 6843 - RNA, 22 nt, Homo sapiens
uguaugagagacauggcugcuu

SEQ ID NO: 6844 - RNA, 22 nt, Homo sapiens
augaggugaguaaauaaaugaa

SEQ ID NO: 6845 - RNA, 22 nt, Homo sapiens
uuugcagagucuuucgcugggc

SEQ ID NO: 6846 - RNA, 22 nt, Homo sapiens
cuuuaugagguuggauggaucu

SEQ ID NO: 6847 - RNA, 22 nt, Homo sapiens
ugaguagagaauucagcuaagg

SEQ ID NO: 6848 - RNA, 22 nt, Homo sapiens
augagauauguuaaaaguuaaa

SEQ ID NO: 6849 - RNA, 22 nt, Homo sapiens
uaucaagaugacaaacuuugcu

SEQ ID NO: 6850 - RNA, 20 nt, Homo sapiens
augguaguagcaccuuuaca

SEQ ID NO: 6851 - RNA, 22 nt, Homo sapiens
ugagaucugucuuuauaguauu

SEQ ID NO: 6852 - RNA, 22 nt, Homo sapiens
uguaugagagugaaagcauuuc

SEQ ID NO: 6853 - RNA, 22 nt, Homo sapiens
uuccuugugacuaguagugacc

SEQ ID NO: 6854 - RNA, 22 nt, Homo sapiens
gaagauucaaccaaaccagaac

SEQ ID NO: 6855 - RNA, 22 nt, Homo sapiens
augagauacuacaaaugaguuu

SEQ ID NO: 6856 - RNA, 22 nt, Homo sapiens
augaagauguugccuuuuuaau

SEQ ID NO: 6857 - RNA, 22 nt, Homo sapiens
aguagguguugguagagguuuc

SEQ ID NO: 6858 - RNA, 22 nt, Homo sapiens
uaguaguuuuguguauaauaau

SEQ ID NO: 6859 - RNA, 22 nt, Homo sapiens
augagaacugucaaugagagcu

SEQ ID NO: 6860 - RNA, 22 nt, Homo sapiens
gaaagauuuuaacugggagacu

SEQ ID NO: 6861 - RNA, 22 nt, Homo sapiens
augaagaucucugccuuguguc

SEQ ID NO: 6862 - RNA, 22 nt, Homo sapiens
augcuguuuuguagcucccucu

SEQ ID NO: 6863 - RNA, 22 nt, Homo sapiens
agcuuguuuuauagaaagucaa

SEQ ID NO: 6864 - RNA, 22 nt, Homo sapiens
uauugcuugaggaaaugguaau

SEQ ID NO: 6865 - RNA, 22 nt, Homo sapiens
ugagaugcuuguaaauucauuu

SEQ ID NO: 6866 - RNA, 22 nt, Homo sapiens
auagaauguauuaguaaauuug

SEQ ID NO: 6867 - RNA, 22 nt, Homo sapiens
augaguaguugcuaaauauuga

SEQ ID NO: 6868 - RNA, 20 nt, Homo sapiens
uggaguuugaguucuuggag

SEQ ID NO: 6869 - RNA, 22 nt, Homo sapiens
uguaugaguuguuuauaaauuu

SEQ ID NO: 6870 - RNA, 18 nt, Homo sapiens
uggauaguuguuggcaga

SEQ ID NO: 6871 - RNA, 22 nt, Homo sapiens
uugaauagaaguguugaaagug

SEQ ID NO: 6872 - RNA, 22 nt, Homo sapiens
ugaguagaacuccuggagaugu

SEQ ID NO: 6873 - RNA, 22 nt, Homo sapiens
gcuuguguuuacuguaguuacu

SEQ ID NO: 6874 - RNA, 22 nt, Homo sapiens
augagaugcaagauuagauggg

SEQ ID NO: 6875 - RNA, 22 nt, Homo sapiens
ugaauaguuugacagaacucuu

SEQ ID NO: 6876 - RNA, 22 nt, Homo sapiens
ucuugcuuguuguucccuucau

SEQ ID NO: 6877 - RNA, 18 nt, Homo sapiens
gcuguugucagagcacau

SEQ ID NO: 6878 - RNA, 22 nt, Homo sapiens
cuuuggagaaaaguucuugggc

SEQ ID NO: 6879 - RNA, 17 nt, Homo sapiens
uuaugagacuucuuagc

SEQ ID NO: 6880 - RNA, 22 nt, Homo sapiens
ugagacugguuaauugauaaag

SEQ ID NO: 6881 - RNA, 22 nt, Homo sapiens
ugaguauguuuagaaguaaagg

SEQ ID NO: 6882 - RNA, 22 nt, Homo sapiens
augagauauuuuauaagaucau

SEQ ID NO: 6883 - RNA, 22 nt, Homo sapiens
augagaauguaaguuaaugaaa

SEQ ID NO: 6884 - RNA, 22 nt, Chlamydophila pneumoniae CWL029
uguaugaguuucucuucaucca

SEQ ID NO: 6885 - RNA, 22 nt, Chlamydophila pneumoniae CWL029
ucuuuaauuuucugaaagauua

SEQ ID NO: 6886 - RNA, 22 nt, Homo sapiens
ugaauaguuugacagaacucuu

SEQ ID NO: 6887 - RNA, 22 nt, Homo sapiens
ucuugcuuguuguucccuucau

SEQ ID NO: 6888 - RNA, 22 nt, Homo sapiens
uguaugagagugaaagcauuuc

SEQ ID NO: 6889 - RNA, 22 nt, Homo sapiens
augaggugaguaaauaaaugaa

SEQ ID NO: 6890 - RNA, 22 nt, Homo sapiens
uggauguacagucaguauuugu

SEQ ID NO: 6891 - RNA, 22 nt, Homo sapiens
augagaauguaaguuaaugaaa

SEQ ID NO: 6892 - RNA, 22 nt, Homo sapiens
ugagaugauagauauguuaauu

SEQ ID NO: 6893 - RNA, 22 nt, Homo sapiens
ugaguagaacuccuggagaugu

SEQ ID NO: 6894 - RNA, 22 nt, Homo sapiens
ugagacugguuaauugauaaag

SEQ ID NO: 6895 - RNA, 22 nt, Homo sapiens
cuuuggagaaaaguucuugggc

SEQ ID NO: 6896 - RNA, 22 nt, Homo sapiens
augcuguuuuguagcucccucu

SEQ ID NO: 6897 - RNA, 22 nt, Homo sapiens
augagaacugucaaugagagcu

SEQ ID NO: 6898 - RNA, 17 nt, Homo sapiens
uuaugagacuucuuagc

SEQ ID NO: 6899 - RNA, 20 nt, Homo sapiens
uggaguuugaguucuuggag

SEQ ID NO: 6900 - RNA, 22 nt, Homo sapiens
uguaugagagacauggcugcuu

SEQ ID NO: 6901 - RNA, 22 nt, Homo sapiens
auagaauguauuaguaaauuug

SEQ ID NO: 6902 - RNA, 18 nt, Homo sapiens
gcuguugucagagcacau

SEQ ID NO: 6903 - RNA, 22 nt, Homo sapiens
uguaugaguuguuuauaaauuu

SEQ ID NO: 6904 - RNA, 22 nt, Homo sapiens
aagcuggauuuaguguggagca

SEQ ID NO: 6905 - RNA, 18 nt, Homo sapiens
uggauaguuguuggcaga

SEQ ID NO: 6906 - RNA, 22 nt, Homo sapiens
uauugcuugaggaaaugguaau

SEQ ID NO: 6907 - RNA, 22 nt, Homo sapiens
ugaaaugccuuuaaugaauuua

SEQ ID NO: 6908 - RNA, 22 nt, Homo sapiens
augaagaucucugccuuguguc

SEQ ID NO: 6909 - RNA, 22 nt, Homo sapiens
cuuuaugagguuggauggaucu

SEQ ID NO: 6910 - RNA, 22 nt, Homo sapiens
ugagaucugucuuuauaguauu

SEQ ID NO: 6911 - RNA, 22 nt, Homo sapiens
augaguaguugcuaaauauuga

SEQ ID NO: 6912 - RNA, 22 nt, Homo sapiens
agcuuguuuuauagaaagucaa

SEQ ID NO: 6913 - RNA, 22 nt, Homo sapiens
uuugcuugaggucuagcuaccc

SEQ ID NO: 6914 - RNA, 22 nt, Homo sapiens
uaguaguuuuguguauaauaau

SEQ ID NO: 6915 - RNA, 22 nt, Homo sapiens
ugagaugcuuguaaauucauuu

SEQ ID NO: 6916 - RNA, 22 nt, Homo sapiens
augagaugcaagauuagauggg

SEQ ID NO: 6917 - RNA, 22 nt, Homo sapiens
augaagauguugccuuuuuaau

SEQ ID NO: 6918 - RNA, 22 nt, Homo sapiens
uaucaagaugacaaacuuugcu

SEQ ID NO: 6919 - RNA, 22 nt, Homo sapiens
gaagauucaaccaaaccagaac

SEQ ID NO: 6920 - RNA, 22 nt, Homo sapiens
aggaagacugaaauugcuguuc

SEQ ID NO: 6921 - RNA, 22 nt, Homo sapiens
augagauauuuuauaagaucau

SEQ ID NO: 6922 - RNA, 22 nt, Homo sapiens
gcuuguguuuacuguaguuacu

SEQ ID NO: 6923 - RNA, 22 nt, Homo sapiens
augagaugaggaauggcccucc

SEQ ID NO: 6924 - RNA, 22 nt, Homo sapiens
aguagguguugguagagguuuc

SEQ ID NO: 6925 - RNA, 22 nt, Homo sapiens
augagauauguuaaaaguuaaa

SEQ ID NO: 6926 - RNA, 22 nt, Homo sapiens
augagauacuacaaaugaguuu

SEQ ID NO: 6927 - RNA, 22 nt, Homo sapiens
gaaagauuuuaacugggagacu

SEQ ID NO: 6928 - RNA, 22 nt, Homo sapiens
ugaguagagaauucagcuaagg

SEQ ID NO: 6929 - RNA, 22 nt, Homo sapiens
ugaguauguuuagaaguaaagg

SEQ ID NO: 6930 - RNA, 22 nt, Homo sapiens
uugaauagaaguguugaaagug

SEQ ID NO: 6931 - RNA, 22 nt, Homo sapiens
augagaugaauaccgacgaugu

SEQ ID NO: 6932 - RNA, 20 nt, Homo sapiens
augguaguagcaccuuuaca

SEQ ID NO: 6933 - RNA, 22 nt, Homo sapiens
acacaaugguaaguguuugugu

SEQ ID NO: 6934 - RNA, 22 nt, Homo sapiens
uggauaguaaagucagauuccc

SEQ ID NO: 6935 - RNA, 22 nt, Homo sapiens
uuugcagagucuuucgcugggc

SEQ ID NO: 6936 - RNA, 22 nt, Homo sapiens
augagaacauaucaagugauug

SEQ ID NO: 6937 - RNA, 22 nt, Homo sapiens
uuccuugugacuaguagugacc

SEQ ID NO: 6938 - RNA, 22 nt, Chlamydophila pneumoniae J138
uuuguuauuacuaguugucuga

SEQ ID NO: 6939 - RNA, 22 nt, Chlamydophila pneumoniae J138
gcagaacuuagagcuucaauau

SEQ ID NO: 6940 - RNA, 20 nt, Homo sapiens
uggaguuugaguucuuggag

SEQ ID NO: 6941 - RNA, 22 nt, Homo sapiens
ugaguagagaauucagcuaagg

SEQ ID NO: 6942 - RNA, 22 nt, Homo sapiens
uuccuugugacuaguagugacc

SEQ ID NO: 6943 - RNA, 22 nt, Homo sapiens
uuugcagagucuuucgcugggc

SEQ ID NO: 6944 - RNA, 22 nt, Homo sapiens
ucuugcuuguuguucccuucau

SEQ ID NO: 6945 - RNA, 22 nt, Homo sapiens
ugagaucugucuuuauaguauu

SEQ ID NO: 6946 - RNA, 22 nt, Homo sapiens
augagauauguuaaaaguuaaa

SEQ ID NO: 6947 - RNA, 22 nt, Homo sapiens
aguagguguugguagagguuuc

SEQ ID NO: 6948 - RNA, 22 nt, Homo sapiens
gcuuguguuuacuguaguuacu

SEQ ID NO: 6949 - RNA, 22 nt, Homo sapiens
ugaauaguuugacagaacucuu

SEQ ID NO: 6950 - RNA, 22 nt, Homo sapiens
uggauaguaaagucagauuccc

SEQ ID NO: 6951 - RNA, 22 nt, Homo sapiens
augagaugaggaauggcccucc

SEQ ID NO: 6952 - RNA, 22 nt, Homo sapiens
gaagauucaaccaaaccagaac

SEQ ID NO: 6953 - RNA, 22 nt, Homo sapiens
acacaaugguaaguguuugugu

SEQ ID NO: 6954 - RNA, 22 nt, Homo sapiens
augagaugcaagauuagauggg

SEQ ID NO: 6955 - RNA, 22 nt, Homo sapiens
augagaugaauaccgacgaugu

SEQ ID NO: 6956 - RNA, 22 nt, Homo sapiens
uggauguacagucaguauuugu

SEQ ID NO: 6957 - RNA, 22 nt, Homo sapiens
augagaacauaucaagugauug

SEQ ID NO: 6958 - RNA, 22 nt, Homo sapiens
uguaugagagacauggcugcuu

SEQ ID NO: 6959 - RNA, 22 nt, Homo sapiens
ugagacugguuaauugauaaag

SEQ ID NO: 6960 - RNA, 22 nt, Homo sapiens
augagauauuuuauaagaucau

SEQ ID NO: 6961 - RNA, 17 nt, Homo sapiens
uuaugagacuucuuagc

SEQ ID NO: 6962 - RNA, 22 nt, Homo sapiens
cuuuggagaaaaguucuugggc

SEQ ID NO: 6963 - RNA, 22 nt, Homo sapiens
ugaguagaacuccuggagaugu

SEQ ID NO: 6964 - RNA, 22 nt, Homo sapiens
uugaauagaaguguugaaagug

SEQ ID NO: 6965 - RNA, 22 nt, Homo sapiens
ugaguauguuuagaaguaaagg

SEQ ID NO: 6966 - RNA, 22 nt, Homo sapiens
uaguaguuuuguguauaauaau

SEQ ID NO: 6967 - RNA, 22 nt, Homo sapiens
augagaauguaaguuaaugaaa

SEQ ID NO: 6968 - RNA, 22 nt, Homo sapiens
cuuuaugagguuggauggaucu

SEQ ID NO: 6969 - RNA, 22 nt, Homo sapiens
uguaugaguuguuuauaaauuu

SEQ ID NO: 6970 - RNA, 18 nt, Homo sapiens
gcuguugucagagcacau

SEQ ID NO: 6971 - RNA, 22 nt, Homo sapiens
uaucaagaugacaaacuuugcu

SEQ ID NO: 6972 - RNA, 22 nt, Homo sapiens
ugagaugauagauauguuaauu

SEQ ID NO: 6973 - RNA, 18 nt, Homo sapiens
uggauaguuguuggcaga

SEQ ID NO: 6974 - RNA, 22 nt, Homo sapiens
auagaauguauuaguaaauuug

SEQ ID NO: 6975 - RNA, 22 nt, Homo sapiens
uguaugagagugaaagcauuuc

SEQ ID NO: 6976 - RNA, 22 nt, Homo sapiens
uuugcuugaggucuagcuaccc

SEQ ID NO: 6977 - RNA, 22 nt, Homo sapiens
augaggugaguaaauaaaugaa

SEQ ID NO: 6978 - RNA, 22 nt, Homo sapiens
agcuuguuuuauagaaagucaa

SEQ ID NO: 6979 - RNA, 22 nt, Homo sapiens
augagauacuacaaaugaguuu

SEQ ID NO: 6980 - RNA, 22 nt, Homo sapiens
aggaagacugaaauugcuguuc

SEQ ID NO: 6981 - RNA, 22 nt, Homo sapiens
ugaaaugccuuuaaugaauuua

SEQ ID NO: 6982 - RNA, 22 nt, Homo sapiens
uauugcuugaggaaaugguaau

SEQ ID NO: 6983 - RNA, 22 nt, Homo sapiens
augaagaucucugccuuguguc

SEQ ID NO: 6984 - RNA, 20 nt, Homo sapiens
augguaguagcaccuuuaca

SEQ ID NO: 6985 - RNA, 22 nt, Homo sapiens
augcuguuuuguagcucccucu

SEQ ID NO: 6986 - RNA, 22 nt, Homo sapiens
augaguaguugcuaaauauuga

SEQ ID NO: 6987 - RNA, 22 nt, Homo sapiens
ugagaugcuuguaaauucauuu

SEQ ID NO: 6988 - RNA, 22 nt, Homo sapiens
aagcuggauuuaguguggagca

SEQ ID NO: 6989 - RNA, 22 nt, Homo sapiens
augagaacugucaaugagagcu

SEQ ID NO: 6990 - RNA, 22 nt, Homo sapiens
gaaagauuuuaacugggagacu

SEQ ID NO: 6991 - RNA, 22 nt, Homo sapiens
augaagauguugccuuuuuaau

SEQ ID NO: 6992 - RNA, 17 nt, Homo sapiens
uuaugagacuucuuagc

SEQ ID NO: 6993 - RNA, 22 nt, Homo sapiens
uugaauagaaguguugaaagug

SEQ ID NO: 6994 - RNA, 22 nt, Homo sapiens
augagaugaggaauggcccucc

SEQ ID NO: 6995 - RNA, 22 nt, Homo sapiens
ugagacugguuaauugauaaag

SEQ ID NO: 6996 - RNA, 22 nt, Homo sapiens
cuuuggagaaaaguucuugggc

SEQ ID NO: 6997 - RNA, 22 nt, Homo sapiens
ugaguauguuuagaaguaaagg

SEQ ID NO: 6998 - RNA, 18 nt, Homo sapiens
gcuguugucagagcacau

SEQ ID NO: 6999 - RNA, 22 nt, Homo sapiens
augagaacauaucaagugauug

SEQ ID NO: 7000 - RNA, 22 nt, Homo sapiens
uggauaguaaagucagauuccc

SEQ ID NO: 7001 - RNA, 22 nt, Homo sapiens
ugaaaugccuuuaaugaauuua

SEQ ID NO: 7002 - RNA, 22 nt, Homo sapiens
augaggugaguaaauaaaugaa

SEQ ID NO: 7003 - RNA, 22 nt, Homo sapiens
uuugcuugaggucuagcuaccc

SEQ ID NO: 7004 - RNA, 22 nt, Homo sapiens
uggauguacagucaguauuugu

SEQ ID NO: 7005 - RNA, 22 nt, Homo sapiens
uguaugagagugaaagcauuuc

SEQ ID NO: 7006 - RNA, 22 nt, Homo sapiens
cuuuaugagguuggauggaucu

SEQ ID NO: 7007 - RNA, 22 nt, Homo sapiens
augagauauuuuauaagaucau

SEQ ID NO: 7008 - RNA, 22 nt, Homo sapiens
uaucaagaugacaaacuuugcu

SEQ ID NO: 7009 - RNA, 22 nt, Homo sapiens
ugagaugauagauauguuaauu

SEQ ID NO: 7010 - RNA, 22 nt, Homo sapiens
augagaauguaaguuaaugaaa

SEQ ID NO: 7011 - RNA, 22 nt, Homo sapiens
aggaagacugaaauugcuguuc

SEQ ID NO: 7012 - RNA, 20 nt, Homo sapiens
augguaguagcaccuuuaca

SEQ ID NO: 7013 - RNA, 22 nt, Homo sapiens
agcuuguuuuauagaaagucaa

SEQ ID NO: 7014 - RNA, 22 nt, Homo sapiens
augagauauguuaaaaguuaaa

SEQ ID NO: 7015 - RNA, 22 nt, Homo sapiens
aagcuggauuuaguguggagca

SEQ ID NO: 7016 - RNA, 22 nt, Homo sapiens
ugaguagagaauucagcuaagg

SEQ ID NO: 7017 - RNA, 22 nt, Homo sapiens
gaaagauuuuaacugggagacu

SEQ ID NO: 7018 - RNA, 22 nt, Homo sapiens
augagaacugucaaugagagcu

SEQ ID NO: 7019 - RNA, 22 nt, Homo sapiens
uaguaguuuuguguauaauaau

SEQ ID NO: 7020 - RNA, 22 nt, Homo sapiens
augagauacuacaaaugaguuu

SEQ ID NO: 7021 - RNA, 22 nt, Homo sapiens
ugagaucugucuuuauaguauu

SEQ ID NO: 7022 - RNA, 22 nt, Homo sapiens
uuugcagagucuuucgcugggc

SEQ ID NO: 7023 - RNA, 22 nt, Homo sapiens
uauugcuugaggaaaugguaau

SEQ ID NO: 7024 - RNA, 22 nt, Homo sapiens
aguagguguugguagagguuuc

SEQ ID NO: 7025 - RNA, 22 nt, Homo sapiens
uguaugaguuguuuauaaauuu

SEQ ID NO: 7026 - RNA, 22 nt, Homo sapiens
augcuguuuuguagcucccucu

SEQ ID NO: 7027 - RNA, 22 nt, Homo sapiens
uuccuugugacuaguagugacc

SEQ ID NO: 7028 - RNA, 22 nt, Homo sapiens
acacaaugguaaguguuugugu

SEQ ID NO: 7029 - RNA, 22 nt, Homo sapiens
auagaauguauuaguaaauuug

SEQ ID NO: 7030 - RNA, 22 nt, Homo sapiens
augagaugaauaccgacgaugu

SEQ ID NO: 7031 - RNA, 18 nt, Homo sapiens
uggauaguuguuggcaga

SEQ ID NO: 7032 - RNA, 22 nt, Homo sapiens
uguaugagagacauggcugcuu

SEQ ID NO: 7033 - RNA, 22 nt, Homo sapiens
augaguaguugcuaaauauuga

SEQ ID NO: 7034 - RNA, 22 nt, Homo sapiens
ugaauaguuugacagaacucuu

SEQ ID NO: 7035 - RNA, 20 nt, Homo sapiens
uggaguuugaguucuuggag

SEQ ID NO: 7036 - RNA, 22 nt, Homo sapiens
augagaugcaagauuagauggg

SEQ ID NO: 7037 - RNA, 22 nt, Homo sapiens
augaagaucucugccuuguguc

SEQ ID NO: 7038 - RNA, 22 nt, Homo sapiens
ucuugcuuguuguucccuucau

SEQ ID NO: 7039 - RNA, 22 nt, Homo sapiens
gcuuguguuuacuguaguuacu

SEQ ID NO: 7040 - RNA, 22 nt, Homo sapiens
gaagauucaaccaaaccagaac

SEQ ID NO: 7041 - RNA, 22 nt, Homo sapiens
augaagauguugccuuuuuaau

SEQ ID NO: 7042 - RNA, 22 nt, Homo sapiens
ugagaugcuuguaaauucauuu

SEQ ID NO: 7043 - RNA, 22 nt, Homo sapiens
ugaguagaacuccuggagaugu

SEQ ID NO: 7044 - RNA, 22 nt, Escherichia coli CFT073
uugguaucguugggcugguguu

SEQ ID NO: 7045 - RNA, 22 nt, Escherichia coli CFT073
uuguuguucauguaugcauguu

SEQ ID NO: 7046 - RNA, 22 nt, Escherichia coli CFT073
uuguaaauuuccucuuugcuaa

SEQ ID NO: 7047 - RNA, 22 nt, Escherichia coli CFT073
uuuaaguuaaucgaccauacug

SEQ ID NO: 7048 - RNA, 21 nt, Escherichia coli CFT073
uugaccugguugcagcacagc

SEQ ID NO: 7049 - RNA, 20 nt, Escherichia coli CFT073
uugaugaauuugcuguaaga

SEQ ID NO: 7050 - RNA, 22 nt, Escherichia coli CFT073
uuucaaaaugauaacuucgcaa

SEQ ID NO: 7051 - RNA, 22 nt, Escherichia coli CFT073
uuucaauacuuaucgauuccuu

SEQ ID NO: 7052 - RNA, 22 nt, Escherichia coli CFT073
uuuguaacguugcaggaugucg

SEQ ID NO: 7053 - RNA, 22 nt, Escherichia coli CFT073
uuuuauacucuaagaaaucagg

SEQ ID NO: 7054 - RNA, 22 nt, Escherichia coli CFT073
uuuugguguugcagccguggca

SEQ ID NO: 7055 - RNA, 21 nt, Escherichia coli CFT073
uuaaaaaccggaggcaacaug

SEQ ID NO: 7056 - RNA, 22 nt, Escherichia coli CFT073
uuaccauaaugauuuucaugug

SEQ ID NO: 7057 - RNA, 22 nt, Escherichia coli CFT073
uuaaauaucacccuguuugcca

SEQ ID NO: 7058 - RNA, 22 nt, Escherichia coli CFT073
uuaagcuuugcacuccauuuau

SEQ ID NO: 7059 - RNA, 22 nt, Escherichia coli CFT073
uucaaaauggugcggaauuuua

SEQ ID NO: 7060 - RNA, 22 nt, Escherichia coli CFT073
uuccggguccaggagcaucauu

SEQ ID NO: 7061 - RNA, 22 nt, Escherichia coli CFT073
uucucucugccugccgaggcca

SEQ ID NO: 7062 - RNA, 20 nt, Escherichia coli CFT073
uucuggauuuugccaucaau

SEQ ID NO: 7063 - RNA, 22 nt, Escherichia coli CFT073
uucuucaaucugacgcaucagg

SEQ ID NO: 7064 - RNA, 22 nt, Escherichia coli CFT073
ugugguguaagcacaguaguag

SEQ ID NO: 7065 - RNA, 22 nt, Escherichia coli CFT073
uguaauuaaaaccuggcucaua

SEQ ID NO: 7066 - RNA, 22 nt, Escherichia coli CFT073
uggggauguuaagcuggaguug

SEQ ID NO: 7067 - RNA, 22 nt, Escherichia coli CFT073
uggauagccaggcaggguugua

SEQ ID NO: 7068 - RNA, 20 nt, Escherichia coli CFT073
uggcaugguaagcgaagcgc

SEQ ID NO: 7069 - RNA, 20 nt, Escherichia coli CFT073
uggccuguggcuguaugcgc

SEQ ID NO: 7070 - RNA, 22 nt, Escherichia coli CFT073
ugcugggauuaaccuucuuuuc

SEQ ID NO: 7071 - RNA, 22 nt, Escherichia coli CFT073
ugcuggggaaaacauggucgau

SEQ ID NO: 7072 - RNA, 22 nt, Escherichia coli CFT073
ugcagcaugucaucugcauuuu

SEQ ID NO: 7073 - RNA, 18 nt, Escherichia coli CFT073
ugcauaauccuucugagc

SEQ ID NO: 7074 - RNA, 22 nt, Escherichia coli CFT073
ugccaucacgucgauuaucgcc

SEQ ID NO: 7075 - RNA, 22 nt, Escherichia coli CFT073
ugauuaucgcuggucugcugcc

SEQ ID NO: 7076 - RNA, 22 nt, Escherichia coli CFT073
ugcaacuggaguuaauuucguu

SEQ ID NO: 7077 - RNA, 22 nt, Escherichia coli CFT073
ugaggcugcgcagcagucgcca

SEQ ID NO: 7078 - RNA, 23 nt, Escherichia coli CFT073
ugaaauccuuaugaaacaaagua

SEQ ID NO: 7079 - RNA, 22 nt, Escherichia coli CFT073
ugaagagcguucaagcgccguu

SEQ ID NO: 7080 - RNA, 22 nt, Escherichia coli CFT073
ugaagcagguauggcccaucac

SEQ ID NO: 7081 - RNA, 22 nt, Escherichia coli CFT073
ugaauaaaccaucaugauuuuu

SEQ ID NO: 7082 - RNA, 22 nt, Escherichia coli CFT073
ugaaaaacggcugcggaauuag

SEQ ID NO: 7083 - RNA, 22 nt, Escherichia coli CFT073
ugaaaaguaaaguguuagauga

SEQ ID NO: 7084 - RNA, 22 nt, Escherichia coli CFT073
ugaaagagcuggggaugcauuc

SEQ ID NO: 7085 - RNA, 18 nt, Escherichia coli CFT073
ucugaaagcugacaaugc

SEQ ID NO: 7086 - RNA, 22 nt, Escherichia coli CFT073
ucuccugcggccacagcaguaa

SEQ ID NO: 7087 - RNA, 22 nt, Escherichia coli CFT073
ucuggcggcacucucugucccu

SEQ ID NO: 7088 - RNA, 22 nt, Escherichia coli CFT073
ucuggcggcgguagaccgagag

SEQ ID NO: 7089 - RNA, 22 nt, Escherichia coli CFT073
ucuuauuucaucgguucaugug

SEQ ID NO: 7090 - RNA, 22 nt, Escherichia coli CFT073
gcacgggcgacauuuggcaggc

SEQ ID NO: 7091 - RNA, 22 nt, Escherichia coli CFT073
gcagggcauugauugggcgcac

SEQ ID NO: 7092 - RNA, 22 nt, Escherichia coli CFT073
gccaagucgagcaacguuuuac

SEQ ID NO: 7093 - RNA, 21 nt, Escherichia coli CFT073
gcauggcuguuaucaucuucc

SEQ ID NO: 7094 - RNA, 22 nt, Escherichia coli CFT073
gcauguacaugcagcugauaau

SEQ ID NO: 7095 - RNA, 22 nt, Escherichia coli CFT073
gccagccauaacccgauggauu

SEQ ID NO: 7096 - RNA, 22 nt, Escherichia coli CFT073
gacuucauggagucgaguugca

SEQ ID NO: 7097 - RNA, 23 nt, Escherichia coli CFT073
gaacugaauaccaaugaggagac

SEQ ID NO: 7098 - RNA, 22 nt, Escherichia coli CFT073
gaaguggcagcgcagcagguuu

SEQ ID NO: 7099 - RNA, 22 nt, Escherichia coli CFT073
gaagugggcucgccaggaagga

SEQ ID NO: 7100 - RNA, 22 nt, Escherichia coli CFT073
gacacauuucuucccggcuccg

SEQ ID NO: 7101 - RNA, 22 nt, Escherichia coli CFT073
gacauugaggaacacuuccaga

SEQ ID NO: 7102 - RNA, 19 nt, Escherichia coli CFT073
gacauugauggucccacug

SEQ ID NO: 7103 - RNA, 22 nt, Escherichia coli CFT073
gacccagugcuaacaaauguuc

SEQ ID NO: 7104 - RNA, 22 nt, Escherichia coli CFT073
gauauuuauacaucccaauaaa

SEQ ID NO: 7105 - RNA, 22 nt, Escherichia coli CFT073
gauguacagcgcguuacuccug

SEQ ID NO: 7106 - RNA, 22 nt, Escherichia coli CFT073
gcaaaaauggcccggaagagau

SEQ ID NO: 7107 - RNA, 22 nt, Escherichia coli CFT073
gcgcaggcaggguaaucgggga

SEQ ID NO: 7108 - RNA, 22 nt, Escherichia coli CFT073
gccaugucggaucgaugcgcuc

SEQ ID NO: 7109 - RNA, 22 nt, Escherichia coli CFT073
gugcuggucaggaugccggacc

SEQ ID NO: 7110 - RNA, 22 nt, Escherichia coli CFT073
guggcaggaucugucuccucau

SEQ ID NO: 7111 - RNA, 22 nt, Escherichia coli CFT073
uaaacacugcacuguguauuca

SEQ ID NO: 7112 - RNA, 22 nt, Escherichia coli CFT073
uaaagugaucuucuaagcccgc

SEQ ID NO: 7113 - RNA, 22 nt, Escherichia coli CFT073
gugauuauggaugaaccgacuu

SEQ ID NO: 7114 - RNA, 22 nt, Escherichia coli CFT073
gugaaagccugcgcgcuggcga

SEQ ID NO: 7115 - RNA, 22 nt, Escherichia coli CFT073
gugaaagguuuuggucucgaug

SEQ ID NO: 7116 - RNA, 19 nt, Escherichia coli CFT073
gucugguggugcgcggauc

SEQ ID NO: 7117 - RNA, 22 nt, Escherichia coli CFT073
gguaaaggaguucgagaaaaau

SEQ ID NO: 7118 - RNA, 22 nt, Escherichia coli CFT073
ggucagauugucuauaugaacu

SEQ ID NO: 7119 - RNA, 22 nt, Escherichia coli CFT073
ggugagaaugugguggccauca

SEQ ID NO: 7120 - RNA, 23 nt, Escherichia coli CFT073
ggucuuccagcucaaucacuucc

SEQ ID NO: 7121 - RNA, 22 nt, Escherichia coli CFT073
guaaauaguccggaagaugcgc

SEQ ID NO: 7122 - RNA, 22 nt, Escherichia coli CFT073
guauuuccguacgucauaaccc

SEQ ID NO: 7123 - RNA, 22 nt, Escherichia coli CFT073
gggaaucaauaucggauugauu

SEQ ID NO: 7124 - RNA, 22 nt, Escherichia coli CFT073
gggacguagaagcugacgacgu

SEQ ID NO: 7125 - RNA, 22 nt, Escherichia coli CFT073
ggcucagccacugacgccaggc

SEQ ID NO: 7126 - RNA, 22 nt, Escherichia coli CFT073
ggcuggagcuggcgguaaucuc

SEQ ID NO: 7127 - RNA, 22 nt, Escherichia coli CFT073
ggcauccucaauauucaccagc

SEQ ID NO: 7128 - RNA, 19 nt, Escherichia coli CFT073
ggcagcugucaggugugcg

SEQ ID NO: 7129 - RNA, 23 nt, Escherichia coli CFT073
ggcagaagccgguugcagugccg

SEQ ID NO: 7130 - RNA, 22 nt, Escherichia coli CFT073
gcuggcgagaucuuccggugua

SEQ ID NO: 7131 - RNA, 22 nt, Escherichia coli CFT073
gcugguauuuucaaucgguacg

SEQ ID NO: 7132 - RNA, 22 nt, Escherichia coli CFT073
gcugguuaucggaagagaugaa

SEQ ID NO: 7133 - RNA, 22 nt, Escherichia coli CFT073
ggaauagaaagcaggcagcuaa

SEQ ID NO: 7134 - RNA, 22 nt, Escherichia coli CFT073
uuuuacuggcgaugaaguacac

SEQ ID NO: 7135 - RNA, 22 nt, Escherichia coli CFT073
uuuuauauuagccaggaacuuu

SEQ ID NO: 7136 - RNA, 22 nt, Escherichia coli CFT073
uuuggcuucagcguuuugcagg

SEQ ID NO: 7137 - RNA, 20 nt, Escherichia coli CFT073
uuuugaccaacagugcuggc

SEQ ID NO: 7138 - RNA, 20 nt, Escherichia coli CFT073
agugaaauccaacaguagcc

SEQ ID NO: 7139 - RNA, 22 nt, Escherichia coli CFT073
aguaaaagugcgcaguuauggc

SEQ ID NO: 7140 - RNA, 21 nt, Escherichia coli CFT073
uuuauagagcgaggccaguga

SEQ ID NO: 7141 - RNA, 22 nt, Escherichia coli CFT073
uuuaugaugugugaaaaguuag

SEQ ID NO: 7142 - RNA, 22 nt, Escherichia coli CFT073
uuuaugcucauuuguaggucgg

SEQ ID NO: 7143 - RNA, 22 nt, Escherichia coli CFT073
uuucacggucggccaguauuug

SEQ ID NO: 7144 - RNA, 22 nt, Escherichia coli CFT073
uuugcaggccugauaagcguag

SEQ ID NO: 7145 - RNA, 22 nt, Escherichia coli CFT073
ugguuuggcgcugacgucauua

SEQ ID NO: 7146 - RNA, 22 nt, Escherichia coli CFT073
uguagcagcugccagcgaagcg

SEQ ID NO: 7147 - RNA, 22 nt, Escherichia coli CFT073
uguggcauauguucgcgcaugg

SEQ ID NO: 7148 - RNA, 22 nt, Escherichia coli CFT073
uuaaauuguuuaaugguauuga

SEQ ID NO: 7149 - RNA, 22 nt, Escherichia coli CFT073
uuauuucugccgcguugcaaac

SEQ ID NO: 7150 - RNA, 22 nt, Escherichia coli CFT073
uucaaaaccggcuuuuugcaau

SEQ ID NO: 7151 - RNA, 22 nt, Escherichia coli CFT073
uucagaauuuggcgaucugaaa

SEQ ID NO: 7152 - RNA, 22 nt, Escherichia coli CFT073
uuauauguauuccagagguuua

SEQ ID NO: 7153 - RNA, 22 nt, Escherichia coli CFT073
uucccugugacaaugauacagu

SEQ ID NO: 7154 - RNA, 22 nt, Escherichia coli CFT073
uuccuguucgcgcugcucuuca

SEQ ID NO: 7155 - RNA, 22 nt, Escherichia coli CFT073
uuccuguuuauaaaaggagagg

SEQ ID NO: 7156 - RNA, 22 nt, Escherichia coli CFT073
uucuucauuuuguaaggcgaac

SEQ ID NO: 7157 - RNA, 22 nt, Escherichia coli CFT073
uucuucugguuauuaugccugc

SEQ ID NO: 7158 - RNA, 20 nt, Escherichia coli CFT073
aucaaaaggcagauaacguc

SEQ ID NO: 7159 - RNA, 22 nt, Escherichia coli CFT073
auagcaccgagaacaguaccgc

SEQ ID NO: 7160 - RNA, 22 nt, Escherichia coli CFT073
auagcagcgugcuugucccugu

SEQ ID NO: 7161 - RNA, 22 nt, Escherichia coli CFT073
aguuccuuauaauauucaauga

SEQ ID NO: 7162 - RNA, 21 nt, Escherichia coli CFT073
aucauucaccuguuguaacuc

SEQ ID NO: 7163 - RNA, 22 nt, Escherichia coli CFT073
auccuucccgaaaaauauguau

SEQ ID NO: 7164 - RNA, 22 nt, Escherichia coli CFT073
augaaaacucugcggcauggcg

SEQ ID NO: 7165 - RNA, 22 nt, Escherichia coli CFT073
augacaaucgacggcuuuagau

SEQ ID NO: 7166 - RNA, 22 nt, Escherichia coli CFT073
auggcaauugccgguucgcugg

SEQ ID NO: 7167 - RNA, 22 nt, Escherichia coli CFT073
auggcgauauagucuuucacgc

SEQ ID NO: 7168 - RNA, 22 nt, Escherichia coli CFT073
cagccaguuaacgcuggcgcag

SEQ ID NO: 7169 - RNA, 22 nt, Escherichia coli CFT073
cagcagcaguaugcagacgcug

SEQ ID NO: 7170 - RNA, 22 nt, Escherichia coli CFT073
auguuuuaagcucugugagcga

SEQ ID NO: 7171 - RNA, 22 nt, Escherichia coli CFT073
auuaauuugcuggaaauauuua

SEQ ID NO: 7172 - RNA, 22 nt, Escherichia coli CFT073
auuaucaacggcgaagugcccg

SEQ ID NO: 7173 - RNA, 22 nt, Escherichia coli CFT073
auuguaucccugauuauucaga

SEQ ID NO: 7174 - RNA, 17 nt, Escherichia coli CFT073
auuucugcucauccagc

SEQ ID NO: 7175 - RNA, 22 nt, Escherichia coli CFT073
cacacagggcugaugauguucc

SEQ ID NO: 7176 - RNA, 22 nt, Escherichia coli CFT073
cacacgauccgcucgguuccga

SEQ ID NO: 7177 - RNA, 22 nt, Escherichia coli CFT073
caccaaaaugacgcacuuugcc

SEQ ID NO: 7178 - RNA, 22 nt, Escherichia coli CFT073
ugaauacacagugcaguguuua

SEQ ID NO: 7179 - RNA, 22 nt, Escherichia coli CFT073
ugaauauggcguggagucgcug

SEQ ID NO: 7180 - RNA, 22 nt, Escherichia coli CFT073
ugaaugacagcgccgggcaugc

SEQ ID NO: 7181 - RNA, 22 nt, Escherichia coli CFT073
ugcaucacaaaccugaaaagaa

SEQ ID NO: 7182 - RNA, 22 nt, Escherichia coli CFT073
ugaggcugccgggaaaguuuug

SEQ ID NO: 7183 - RNA, 22 nt, Escherichia coli CFT073
ugaucacaguauuaucaaugac

SEQ ID NO: 7184 - RNA, 22 nt, Escherichia coli CFT073
ugaugccuggcagccacuucaa

SEQ ID NO: 7185 - RNA, 22 nt, Escherichia coli CFT073
ugcuaucuggugagagugucgg

SEQ ID NO: 7186 - RNA, 22 nt, Escherichia coli CFT073
ugcugaaacagaaacaguaugc

SEQ ID NO: 7187 - RNA, 22 nt, Escherichia coli CFT073
uggaauaucucggcagcuucug

SEQ ID NO: 7188 - RNA, 21 nt, Escherichia coli CFT073
uggaggacgagguauugacca

SEQ ID NO: 7189 - RNA, 20 nt, Escherichia coli CFT073
ugcugcagcaagguaaaggc

SEQ ID NO: 7190 - RNA, 22 nt, Escherichia coli CFT073
ugcuggagucugccggacugga

SEQ ID NO: 7191 - RNA, 22 nt, Escherichia coli CFT073
uggcaggccauuggguugagaa

SEQ ID NO: 7192 - RNA, 22 nt, Escherichia coli CFT073
uggcgauaagucucuuccuggu

SEQ ID NO: 7193 - RNA, 22 nt, Escherichia coli CFT073
uggccuuggaacgauguauccu

SEQ ID NO: 7194 - RNA, 22 nt, Escherichia coli CFT073
uggucugucauacuuuguuacc

SEQ ID NO: 7195 - RNA, 17 nt, Escherichia coli CFT073
uggugaacuggaaagcc

SEQ ID NO: 7196 - RNA, 23 nt, Escherichia coli CFT073
ugguggcagagauugccgaucgg

SEQ ID NO: 7197 - RNA, 22 nt, Escherichia coli CFT073
uagcaugugauucaauguaagc

SEQ ID NO: 7198 - RNA, 22 nt, Escherichia coli CFT073
uagcggacgucgacuacuggaa

SEQ ID NO: 7199 - RNA, 22 nt, Escherichia coli CFT073
uaaaucaugcuguaauaaaugg

SEQ ID NO: 7200 - RNA, 22 nt, Escherichia coli CFT073
uaaaucugcgcuuuguugauau

SEQ ID NO: 7201 - RNA, 18 nt, Escherichia coli CFT073
uaagugaagggaguguga

SEQ ID NO: 7202 - RNA, 22 nt, Escherichia coli CFT073
uacaaucuuagugcuaaauggc

SEQ ID NO: 7203 - RNA, 22 nt, Escherichia coli CFT073
uacagaaaaaguuuggcaucuu

SEQ ID NO: 7204 - RNA, 22 nt, Escherichia coli CFT073
uaugcaaaacugcggcgcauua

SEQ ID NO: 7205 - RNA, 22 nt, Escherichia coli CFT073
uaugcauaaaaagcagcggcug

SEQ ID NO: 7206 - RNA, 22 nt, Escherichia coli CFT073
uauggcaaucaucgacaaacgu

SEQ ID NO: 7207 - RNA, 22 nt, Escherichia coli CFT073
uauguacaauaauaagcgaaau

SEQ ID NO: 7208 - RNA, 22 nt, Escherichia coli CFT073
uauuaaauaugaaaaguuauga

SEQ ID NO: 7209 - RNA, 22 nt, Escherichia coli CFT073
uauuauguguuggguauacguc

SEQ ID NO: 7210 - RNA, 22 nt, Escherichia coli CFT073
uauucccauaaacucagaucua

SEQ ID NO: 7211 - RNA, 22 nt, Escherichia coli CFT073
uaucaauuuaucgaccugcagc

SEQ ID NO: 7212 - RNA, 22 nt, Escherichia coli CFT073
uaucugggaagugccuggcggu

SEQ ID NO: 7213 - RNA, 19 nt, Escherichia coli CFT073
uauuucuccggauuuuuga

SEQ ID NO: 7214 - RNA, 21 nt, Escherichia coli CFT073
ucaaugauggugccucgcugu

SEQ ID NO: 7215 - RNA, 22 nt, Escherichia coli CFT073
ucaccagucccugaaugucucc

SEQ ID NO: 7216 - RNA, 22 nt, Escherichia coli CFT073
ucaggaugccgaaguggaugau

SEQ ID NO: 7217 - RNA, 19 nt, Escherichia coli CFT073
ugaaaggcgcuggaugacg

SEQ ID NO: 7218 - RNA, 22 nt, Escherichia coli CFT073
ugaaaggguuagcaguauauga

SEQ ID NO: 7219 - RNA, 22 nt, Escherichia coli CFT073
ucuucuuuagccgcuucaauau

SEQ ID NO: 7220 - RNA, 22 nt, Escherichia coli CFT073
ucugguggcgaugucccugugg

SEQ ID NO: 7221 - RNA, 22 nt, Escherichia coli CFT073
ucugacauaagggcacugcuga

SEQ ID NO: 7222 - RNA, 16 nt, Escherichia coli CFT073
uccugggaggcagagc

SEQ ID NO: 7223 - RNA, 21 nt, Escherichia coli CFT073
ucggcaauuccacgcuccagc

SEQ ID NO: 7224 - RNA, 22 nt, Escherichia coli CFT073
gaaaccuggauggugcauauuu

SEQ ID NO: 7225 - RNA, 19 nt, Escherichia coli CFT073
cuguuuauucuguuugccc

SEQ ID NO: 7226 - RNA, 23 nt, Escherichia coli CFT073
cuucagaguuccggcugcgucag

SEQ ID NO: 7227 - RNA, 22 nt, Escherichia coli CFT073
cuucucuucaaucgggauuauc

SEQ ID NO: 7228 - RNA, 22 nt, Escherichia coli CFT073
gaaguaaggggacaucauguca

SEQ ID NO: 7229 - RNA, 22 nt, Escherichia coli CFT073
cugggauacugguugcucauug

SEQ ID NO: 7230 - RNA, 22 nt, Escherichia coli CFT073
cugagaggcucuuugcuaagug

SEQ ID NO: 7231 - RNA, 22 nt, Escherichia coli CFT073
cggaggacagccgugcauggug

SEQ ID NO: 7232 - RNA, 22 nt, Escherichia coli CFT073
gauauuuuacgcgcaauaacug

SEQ ID NO: 7233 - RNA, 22 nt, Escherichia coli CFT073
gaucauuuucgcuauuuugccu

SEQ ID NO: 7234 - RNA, 22 nt, Escherichia coli CFT073
gaugauuauguuguugauaucc

SEQ ID NO: 7235 - RNA, 23 nt, Escherichia coli CFT073
gaugcgcagauggcauacagcgg

SEQ ID NO: 7236 - RNA, 22 nt, Escherichia coli CFT073
gacuuuauuaaacugcuggagg

SEQ ID NO: 7237 - RNA, 21 nt, Escherichia coli CFT073
gagauucagcaucucuuucug

SEQ ID NO: 7238 - RNA, 22 nt, Escherichia coli CFT073
gaggaagaaucccgguguauuc

SEQ ID NO: 7239 - RNA, 22 nt, Escherichia coli CFT073
gccaguuugcuggacucugcca

SEQ ID NO: 7240 - RNA, 22 nt, Escherichia coli CFT073
gcccuuuuuuacuuaguagaga

SEQ ID NO: 7241 - RNA, 22 nt, Escherichia coli CFT073
gcagcagcgccuguucaagcgc

SEQ ID NO: 7242 - RNA, 22 nt, Escherichia coli CFT073
gcagaauuuuguccgauagugg

SEQ ID NO: 7243 - RNA, 21 nt, Escherichia coli CFT073
gcaggcagcgaccggaguagg

SEQ ID NO: 7244 - RNA, 22 nt, Escherichia coli CFT073
gcauggcaugcagggaacgccg

SEQ ID NO: 7245 - RNA, 22 nt, Escherichia coli CFT073
cggcccagcuuuucccucucuc

SEQ ID NO: 7246 - RNA, 22 nt, Escherichia coli CFT073
cgagcuggaaaccuuccugcug

SEQ ID NO: 7247 - RNA, 21 nt, Escherichia coli CFT073
ccucgcuggucguuauccugc

SEQ ID NO: 7248 - RNA, 22 nt, Escherichia coli CFT073
ccugggaagauguaagccgcca

SEQ ID NO: 7249 - RNA, 22 nt, Escherichia coli CFT073
ccguaaaacgcaaucaaaauga

SEQ ID NO: 7250 - RNA, 22 nt, Escherichia coli CFT073
cccaguccaacaccagcgggcg

SEQ ID NO: 7251 - RNA, 22 nt, Escherichia coli CFT073
ccccccuauaguauauugcaug

SEQ ID NO: 7252 - RNA, 22 nt, Escherichia coli CFT073
ccaguuucuccugcaaugacaa

SEQ ID NO: 7253 - RNA, 22 nt, Escherichia coli CFT073
ccagaauucagguugcauccgu

SEQ ID NO: 7254 - RNA, 22 nt, Escherichia coli CFT073
caugaaaacaguguuauguugu

SEQ ID NO: 7255 - RNA, 22 nt, Escherichia coli CFT073
cauguguaguaucgcaaacaua

SEQ ID NO: 7256 - RNA, 22 nt, Escherichia coli CFT073
cauugaaaauaaauauccuccg

SEQ ID NO: 7257 - RNA, 22 nt, Escherichia coli CFT073
cagggcgcgaaugacagcagug

SEQ ID NO: 7258 - RNA, 20 nt, Escherichia coli CFT073
caguuugcuucugcauccac

SEQ ID NO: 7259 - RNA, 22 nt, Escherichia coli CFT073
caucccccgugguccgccagua

SEQ ID NO: 7260 - RNA, 22 nt, Escherichia coli CFT073
caucgugucuucauagcccugc

SEQ ID NO: 7261 - RNA, 22 nt, Escherichia coli CFT073
guauuauuucugcggcagguuu

SEQ ID NO: 7262 - RNA, 22 nt, Escherichia coli CFT073
gucaguuuuucacgagagauac

SEQ ID NO: 7263 - RNA, 22 nt, Escherichia coli CFT073
ggcuggcaguucaccauugccc

SEQ ID NO: 7264 - RNA, 22 nt, Escherichia coli CFT073
guugauauuguggucaagcgcg

SEQ ID NO: 7265 - RNA, 22 nt, Escherichia coli CFT073
uagggcugguggaggcgggacu

SEQ ID NO: 7266 - RNA, 22 nt, Escherichia coli CFT073
uaguaucacuuuaucagccaag

SEQ ID NO: 7267 - RNA, 23 nt, Escherichia coli CFT073
uauccacaccggacgugagaguc

SEQ ID NO: 7268 - RNA, 22 nt, Escherichia coli CFT073
uaucuugugcuuguggcugauc

SEQ ID NO: 7269 - RNA, 22 nt, Escherichia coli CFT073
guuuuguuagcguuaaaaacac

SEQ ID NO: 7270 - RNA, 22 nt, Escherichia coli CFT073
uaaaguuccgcguauugcguuc

SEQ ID NO: 7271 - RNA, 22 nt, Escherichia coli CFT073
uaaguaaagggaguuugauaug

SEQ ID NO: 7272 - RNA, 22 nt, Escherichia coli CFT073
ucagccacugaccgcugagcaa

SEQ ID NO: 7273 - RNA, 22 nt, Escherichia coli CFT073
uauuucugccccgcaggucugg

SEQ ID NO: 7274 - RNA, 22 nt, Escherichia coli CFT073
ucaggucacgcucuggaacagc

SEQ ID NO: 7275 - RNA, 22 nt, Escherichia coli CFT073
ucaguugggcugcgaaguuuuc

SEQ ID NO: 7276 - RNA, 22 nt, Escherichia coli CFT073
ucaugaaaucgacauguacgca

SEQ ID NO: 7277 - RNA, 23 nt, Escherichia coli CFT073
ucauuuucauugguuaacucggc

SEQ ID NO: 7278 - RNA, 22 nt, Escherichia coli CFT073
uccaggcaaacgccaguaaaaa

SEQ ID NO: 7279 - RNA, 22 nt, Escherichia coli CFT073
ucccacaaugccaauacacuug

SEQ ID NO: 7280 - RNA, 22 nt, Escherichia coli CFT073
uccggccuacaaaaucgugcaa

SEQ ID NO: 7281 - RNA, 22 nt, Escherichia coli CFT073
uccuccuuucagagugcuccgc

SEQ ID NO: 7282 - RNA, 19 nt, Escherichia coli CFT073
uccuguuccagcagucggc

SEQ ID NO: 7283 - RNA, 22 nt, Escherichia coli CFT073
ucggccucucuugcggucuggu

SEQ ID NO: 7284 - RNA, 22 nt, Escherichia coli CFT073
ggagaugcugcgugaagccgug

SEQ ID NO: 7285 - RNA, 22 nt, Escherichia coli CFT073
gcugguuaagcguauuagccaa

SEQ ID NO: 7286 - RNA, 22 nt, Escherichia coli CFT073
gcuuaaaagcgacgcaaucaca

SEQ ID NO: 7287 - RNA, 22 nt, Escherichia coli CFT073
gcugccauccuccgguaccacg

SEQ ID NO: 7288 - RNA, 22 nt, Escherichia coli CFT073
gcugauggcgcagguagcgccu

SEQ ID NO: 7289 - RNA, 22 nt, Escherichia coli CFT073
gcguaaggcgugggaugugcuc

SEQ ID NO: 7290 - RNA, 22 nt, Escherichia coli CFT073
aagagaugucauuacugaugcu

SEQ ID NO: 7291 - RNA, 18 nt, Escherichia coli CFT073
aacauuuuuaaagcccgg

SEQ ID NO: 7292 - RNA, 22 nt, Escherichia coli CFT073
aacgcugcgguuuugugcuggu

SEQ ID NO: 7293 - RNA, 22 nt, Escherichia coli CFT073
aaguuacaucaacaaacucagg

SEQ ID NO: 7294 - RNA, 22 nt, Escherichia coli CFT073
aauaacagacagugccaguuca

SEQ ID NO: 7295 - RNA, 22 nt, Escherichia coli CFT073
aauagcauucgcuuuuggacga

SEQ ID NO: 7296 - RNA, 22 nt, Escherichia coli CFT073
aauuaagaaagccgugcaggca

SEQ ID NO: 7297 - RNA, 22 nt, Escherichia coli CFT073
aauauuugugguuuaccuucug

SEQ ID NO: 7298 - RNA, 22 nt, Escherichia coli CFT073
aauuucaaucgcgucgcccagc

SEQ ID NO: 7299 - RNA, 22 nt, Escherichia coli CFT073
acagggcuugcuaaugcugaug

SEQ ID NO: 7300 - RNA, 22 nt, Escherichia coli CFT073
aaaaugcauuauacgguucugg

SEQ ID NO: 7301 - RNA, 20 nt, Escherichia coli CFT073
aaaaugucaaugacacugua

SEQ ID NO: 7302 - RNA, 21 nt, Escherichia coli CFT073
aaauuuaacuacugaugauug

SEQ ID NO: 7303 - RNA, 22 nt, Escherichia coli CFT073
acagagauguuuaauccuggcg

SEQ ID NO: 7304 - RNA, 19 nt, Escherichia coli CFT073
acaauagccaugugcaaua

SEQ ID NO: 7305 - RNA, 22 nt, Escherichia coli CFT073
acagggcuguagcaugcgucga

SEQ ID NO: 7306 - RNA, 22 nt, Escherichia coli CFT073
aaaaaguggcggagaucccgga

SEQ ID NO: 7307 - RNA, 22 nt, Escherichia coli CFT073
aaaaaucuccuugacaauuuau

SEQ ID NO: 7308 - RNA, 20 nt, Escherichia coli CFT073
aaaacgugauuuuuacuggc

SEQ ID NO: 7309 - RNA, 22 nt, Escherichia coli CFT073
aaaacugucugaaguggauuuu

SEQ ID NO: 7310 - RNA, 22 nt, Escherichia coli CFT073
aaaagugauauuacggucucgu

SEQ ID NO: 7311 - RNA, 18 nt, Escherichia coli CFT073
aagggcagggcaaguacc

SEQ ID NO: 7312 - RNA, 20 nt, Escherichia coli CFT073
aagcugcaucagggcgauau

SEQ ID NO: 7313 - RNA, 22 nt, Escherichia coli CFT073
aaguuugccguggcaguggcga

SEQ ID NO: 7314 - RNA, 22 nt, Escherichia coli CFT073
aaucaugagcaucgaaacguuc

SEQ ID NO: 7315 - RNA, 19 nt, Escherichia coli CFT073
aaucuggguuaagcguguc

SEQ ID NO: 7316 - RNA, 22 nt, Escherichia coli CFT073
aauguacaaucaaaccaguuga

SEQ ID NO: 7317 - RNA, 20 nt, Escherichia coli CFT073
aaugugcaggaugcguucgg

SEQ ID NO: 7318 - RNA, 22 nt, Escherichia coli CFT073
aauguugucggucgccauauaa

SEQ ID NO: 7319 - RNA, 22 nt, Escherichia coli CFT073
aauuuuauccaguaacgccugg

SEQ ID NO: 7320 - RNA, 22 nt, Escherichia coli CFT073
aagcaguuccuuuuggcucugu

SEQ ID NO: 7321 - RNA, 22 nt, Escherichia coli CFT073
aagaauuagcugacccagcguu

SEQ ID NO: 7322 - RNA, 22 nt, Escherichia coli CFT073
aaacugaggcugaugccagcgu

SEQ ID NO: 7323 - RNA, 22 nt, Escherichia coli CFT073
aaagaaauggcgcaaauuaguu

SEQ ID NO: 7324 - RNA, 22 nt, Escherichia coli CFT073
aaauaugcgacuggaaagagug

SEQ ID NO: 7325 - RNA, 22 nt, Escherichia coli CFT073
aacagcauggggaaugaucaga

SEQ ID NO: 7326 - RNA, 22 nt, Escherichia coli CFT073
aaaaguggaaacagguuauccc

SEQ ID NO: 7327 - RNA, 22 nt, Escherichia coli CFT073
aaaauaccgaagacagguguuc

SEQ ID NO: 7328 - RNA, 22 nt, Escherichia coli CFT073
aaaauuuuggucgcagcgccau

SEQ ID NO: 7329 - RNA, 22 nt, Escherichia coli CFT073
aggaagaugccucucaguugcg

SEQ ID NO: 7330 - RNA, 22 nt, Escherichia coli CFT073
aggcucaguacgcagcugaaga

SEQ ID NO: 7331 - RNA, 22 nt, Escherichia coli CFT073
aggcacauaacagcuaaguauu

SEQ ID NO: 7332 - RNA, 19 nt, Escherichia coli CFT073
aggugauugaaaccgaucu

SEQ ID NO: 7333 - RNA, 22 nt, Escherichia coli CFT073
agguggcaaaauuugggacaaa

SEQ ID NO: 7334 - RNA, 22 nt, Escherichia coli CFT073
agcagcaacgcuggcuggagca

SEQ ID NO: 7335 - RNA, 22 nt, Escherichia coli CFT073
aggaaauugugucagcgaauug

SEQ ID NO: 7336 - RNA, 22 nt, Escherichia coli CFT073
agaaauaccaucaaaaucguga

SEQ ID NO: 7337 - RNA, 15 nt, Escherichia coli CFT073
agaagcagccaguuu

SEQ ID NO: 7338 - RNA, 22 nt, Escherichia coli CFT073
acugucaucaaucaucuugaca

SEQ ID NO: 7339 - RNA, 22 nt, Escherichia coli CFT073
acugcgaaucgggaauuaucuu

SEQ ID NO: 7340 - RNA, 22 nt, Escherichia coli CFT073
agacaacaguuggaugcucauu

SEQ ID NO: 7341 - RNA, 23 nt, Escherichia coli CFT073
agcaaacagcacgacugcucacc

SEQ ID NO: 7342 - RNA, 22 nt, Escherichia coli CFT073
agauccuucacuuaauuucauu

SEQ ID NO: 7343 - RNA, 22 nt, Escherichia coli CFT073
acccagguggagacguucucca

SEQ ID NO: 7344 - RNA, 22 nt, Escherichia coli CFT073
acuaauuagccaucgauaaaaa

SEQ ID NO: 7345 - RNA, 22 nt, Escherichia coli CFT073
acuacuucauuaugagcaaacu

SEQ ID NO: 7346 - RNA, 22 nt, Escherichia coli CFT073
acuuaacagcccguuaacuuug

SEQ ID NO: 7347 - RNA, 22 nt, Escherichia coli CFT073
agaaauauuugcccggcgcguu

SEQ ID NO: 7348 - RNA, 22 nt, Escherichia coli CFT073
agagcaugaucgcgugggccga

SEQ ID NO: 7349 - RNA, 22 nt, Escherichia coli CFT073
agaucucuucgccaaagugcag

SEQ ID NO: 7350 - RNA, 22 nt, Escherichia coli CFT073
agcaggccaucacgaccuugcu

SEQ ID NO: 7351 - RNA, 22 nt, Escherichia coli CFT073
agcagacaaacagcgucgaggu

SEQ ID NO: 7352 - RNA, 22 nt, Escherichia coli CFT073
aucaaacaggugcuggaguggu

SEQ ID NO: 7353 - RNA, 22 nt, Escherichia coli CFT073
aucauaaugguacacuuuauag

SEQ ID NO: 7354 - RNA, 22 nt, Escherichia coli CFT073
auccuuaaccaugccgauaacg

SEQ ID NO: 7355 - RNA, 22 nt, Escherichia coli CFT073
aucuugaagugccaugggcgca

SEQ ID NO: 7356 - RNA, 22 nt, Escherichia coli CFT073
augaauauuuagacuaaagagu

SEQ ID NO: 7357 - RNA, 20 nt, Escherichia coli CFT073
augaaucagagaaaaaguga

SEQ ID NO: 7358 - RNA, 22 nt, Escherichia coli CFT073
aucuucucugcuuuuggcuggg

SEQ ID NO: 7359 - RNA, 22 nt, Escherichia coli CFT073
augauaaaacucacuaaacugu

SEQ ID NO: 7360 - RNA, 22 nt, Escherichia coli CFT073
agggcugcuugcuguucuccau

SEQ ID NO: 7361 - RNA, 22 nt, Escherichia coli CFT073
aggucaaucaucuguucacuau

SEQ ID NO: 7362 - RNA, 22 nt, Escherichia coli CFT073
aguaacugcuugguaucuuucg

SEQ ID NO: 7363 - RNA, 22 nt, Escherichia coli CFT073
aguaucaauagugauaucgcca

SEQ ID NO: 7364 - RNA, 22 nt, Escherichia coli CFT073
aguuccuuauaguauucaauga

SEQ ID NO: 7365 - RNA, 22 nt, Escherichia coli CFT073
aguuuacaacgcauuguuaaag

SEQ ID NO: 7366 - RNA, 22 nt, Escherichia coli CFT073
auacagaaagcuuauaaugcga

SEQ ID NO: 7367 - RNA, 22 nt, Escherichia coli CFT073
auaucguugcuaauaauucuaa

SEQ ID NO: 7368 - RNA, 22 nt, Escherichia coli CFT073
auauugaaggggcgagcaaaca

SEQ ID NO: 7369 - RNA, 22 nt, Escherichia coli CFT073
caauucugaacuacagccguag

SEQ ID NO: 7370 - RNA, 22 nt, Escherichia coli CFT073
caaaacugaugcagaaugcaga

SEQ ID NO: 7371 - RNA, 22 nt, Escherichia coli CFT073
caaauuuuaccucguugguauc

SEQ ID NO: 7372 - RNA, 22 nt, Escherichia coli CFT073
cagaaacguuguuaacccggca

SEQ ID NO: 7373 - RNA, 22 nt, Escherichia coli CFT073
cagagcuggcccgacagauggc

SEQ ID NO: 7374 - RNA, 22 nt, Escherichia coli CFT073
auguguucugggaucugcagga

SEQ ID NO: 7375 - RNA, 22 nt, Escherichia coli CFT073
auugagcauaacuuuaaugcgc

SEQ ID NO: 7376 - RNA, 22 nt, Escherichia coli CFT073
auggcgaucaggugcuggcuca

SEQ ID NO: 7377 - RNA, 22 nt, Escherichia coli CFT073
auggaaggaucuggauucugga

SEQ ID NO: 7378 - RNA, 22 nt, Escherichia coli CFT073
auggaagggauugaagagccgc

SEQ ID NO: 7379 - RNA, 20 nt, Escherichia coli CFT073
cauuggcugguuguuggggc

SEQ ID NO: 7380 - RNA, 21 nt, Escherichia coli CFT073
caguaaaacgcaccauacugu

SEQ ID NO: 7381 - RNA, 22 nt, Escherichia coli CFT073
caguaacacuuccgcacugacc

SEQ ID NO: 7382 - RNA, 22 nt, Escherichia coli CFT073
caugaugggcaugaaugucaua

SEQ ID NO: 7383 - RNA, 22 nt, Escherichia coli CFT073
cguuuuauccggccuacaauga

SEQ ID NO: 7384 - RNA, 22 nt, Escherichia coli CFT073
cugccagcuacuuugugucagu

SEQ ID NO: 7385 - RNA, 22 nt, Escherichia coli CFT073
cugagaagugaugcugucagca

SEQ ID NO: 7386 - RNA, 22 nt, Escherichia coli CFT073
cugcaacuggcugauggcagca

SEQ ID NO: 7387 - RNA, 22 nt, Escherichia coli CFT073
cuggagaguaauacccagucug

SEQ ID NO: 7388 - RNA, 22 nt, Escherichia coli CFT073
cugggaggccaguggcaagaaa

SEQ ID NO: 7389 - RNA, 22 nt, Escherichia coli CFT073
cugggauguauggauauguugu

SEQ ID NO: 7390 - RNA, 22 nt, Escherichia coli CFT073
cuggugaaaaugcucggccucg

SEQ ID NO: 7391 - RNA, 22 nt, Escherichia coli CFT073
gaaacgcucgaaaaacuggcag

SEQ ID NO: 7392 - RNA, 22 nt, Escherichia coli CFT073
gaaacuuugucgcguggaccca

SEQ ID NO: 7393 - RNA, 22 nt, Escherichia coli CFT073
gaaagugacggauuuaacgcgg

SEQ ID NO: 7394 - RNA, 18 nt, Escherichia coli CFT073
gaaauugaugccucuggc

SEQ ID NO: 7395 - RNA, 22 nt, Escherichia coli CFT073
cggagagcgaguccagccugau

SEQ ID NO: 7396 - RNA, 22 nt, Escherichia coli CFT073
cgcacaggauuauuacggugug

SEQ ID NO: 7397 - RNA, 22 nt, Homo sapiens
uuggcaaauagguuuuauugca

SEQ ID NO: 7398 - RNA, 22 nt, Homo sapiens
uugauauguuguuggauucacu

SEQ ID NO: 7399 - RNA, 22 nt, Homo sapiens
agagguauuggaaggaguguca

SEQ ID NO: 7400 - RNA, 20 nt, Homo sapiens
cagcaaccugcucucuuccu

SEQ ID NO: 7401 - RNA, 22 nt, Homo sapiens
uggugagaaaugagaugcuuuu

SEQ ID NO: 7402 - RNA, 22 nt, Homo sapiens
aaaccaccauuacuuuugcacc

SEQ ID NO: 7403 - RNA, 22 nt, Homo sapiens
uguauguagugaccagggccag

SEQ ID NO: 7404 - RNA, 22 nt, Homo sapiens
uuuccuguagggggcaaggccu

SEQ ID NO: 7405 - RNA, 20 nt, Homo sapiens
cuuuggcaaugagaacaggg

SEQ ID NO: 7406 - RNA, 22 nt, Homo sapiens
accugagauuacaggugcuggc

SEQ ID NO: 7407 - RNA, 22 nt, Homo sapiens
ugcauguucuuacucauacaug

SEQ ID NO: 7408 - RNA, 22 nt, Homo sapiens
ugcugcaaacaugagaggaagu

SEQ ID NO: 7409 - RNA, 22 nt, Homo sapiens
gugcacaacgugcagguuaguu

SEQ ID NO: 7410 - RNA, 22 nt, Homo sapiens
uuucauggaauauagucauuuu

SEQ ID NO: 7411 - RNA, 22 nt, Homo sapiens
ucacaguucagcauggcugagg

SEQ ID NO: 7412 - RNA, 22 nt, Homo sapiens
uugacauugcuguaguguccag

SEQ ID NO: 7413 - RNA, 22 nt, Homo sapiens
gugacauuuuuacugaugagag

SEQ ID NO: 7414 - RNA, 22 nt, Homo sapiens
uuaaauacagcaugguguuucu

SEQ ID NO: 7415 - RNA, 22 nt, Homo sapiens
cacagugaaugucaucauugcc

SEQ ID NO: 7416 - RNA, 22 nt, Homo sapiens
aaaguucuugcugaaggauuau

SEQ ID NO: 7417 - RNA, 22 nt, Homo sapiens
uauugcagaaugugaguuggca

SEQ ID NO: 7418 - RNA, 22 nt, Homo sapiens
uacugguuuuauauauuucucc

SEQ ID NO: 7419 - RNA, 22 nt, Homo sapiens
auagcagaauuuggucaagucu

SEQ ID NO: 7420 - RNA, 22 nt, Homo sapiens
auugcucaaaucaguacuugag

SEQ ID NO: 7421 - RNA, 20 nt, Homo sapiens
gauuagagagaggcugugca

SEQ ID NO: 7422 - RNA, 22 nt, Homo sapiens
auagcauaucccacaugucaga

SEQ ID NO: 7423 - RNA, 22 nt, Homo sapiens
gcuuuguugauggugagucugu

SEQ ID NO: 7424 - RNA, 22 nt, Homo sapiens
uagugaauguuggcuauuaaua

SEQ ID NO: 7425 - RNA, 22 nt, Homo sapiens
gucauugguucuguuuauguga

SEQ ID NO: 7426 - RNA, 22 nt, Homo sapiens
acaagugaauacaggauucucu

SEQ ID NO: 7427 - RNA, 22 nt, Homo sapiens
uuggccauaugacuugcuuugg

SEQ ID NO: 7428 - RNA, 17 nt, Homo sapiens
cuucaaauaauuucccc

SEQ ID NO: 7429 - RNA, 22 nt, Homo sapiens
auggagguguggggagugaguu

SEQ ID NO: 7430 - RNA, 22 nt, Homo sapiens
uuuaucuguuuaaaacuguuca

SEQ ID NO: 7431 - RNA, 22 nt, Homo sapiens
gugaaguuuuugugaggccuaa

SEQ ID NO: 7432 - RNA, 22 nt, Homo sapiens
uuuaaagcacggaguuuguggc

SEQ ID NO: 7433 - RNA, 22 nt, Homo sapiens
ugagguugguauuacugucucu

SEQ ID NO: 7434 - RNA, 22 nt, Homo sapiens
uaugaaagcuacuucucacaau

SEQ ID NO: 7435 - RNA, 21 nt, Homo sapiens
gugucacagacaugacagaug

SEQ ID NO: 7436 - RNA, 22 nt, Homo sapiens
ugaucucagcucacugguugaa

SEQ ID NO: 7437 - RNA, 22 nt, Homo sapiens
aucaaaugcuggcagagugccu

SEQ ID NO: 7438 - RNA, 22 nt, Homo sapiens
guaucacacuuauugaccugca

SEQ ID NO: 7439 - RNA, 22 nt, Homo sapiens
aauagcauugaaucuaccaauu

SEQ ID NO: 7440 - RNA, 22 nt, Homo sapiens
auaaauaguaguugugguggcc

SEQ ID NO: 7441 - RNA, 22 nt, Homo sapiens
gugacugggaguggugaagaua

SEQ ID NO: 7442 - RNA, 22 nt, Homo sapiens
uugcacaauggaauuuaucuuu

SEQ ID NO: 7443 - RNA, 22 nt, Homo sapiens
agugcauugcaucucugcuuca

SEQ ID NO: 7444 - RNA, 22 nt, Homo sapiens
aaauaguagcugaaugagggaa

SEQ ID NO: 7445 - RNA, 22 nt, Homo sapiens
uuuaacauuggaugagaucguc

SEQ ID NO: 7446 - RNA, 22 nt, Homo sapiens
uuggcaauugcuaugauuugaa

SEQ ID NO: 7447 - RNA, 22 nt, Homo sapiens
uugugcaugaugcauacauggu

SEQ ID NO: 7448 - RNA, 22 nt, Homo sapiens
ucauggcacugaugagaguuuc

SEQ ID NO: 7449 - RNA, 22 nt, Homo sapiens
aguaaaucacuaauggcuuccg

SEQ ID NO: 7450 - RNA, 18 nt, Homo sapiens
uggcaauaugguucuacc

SEQ ID NO: 7451 - RNA, 22 nt, Homo sapiens
ugaauagacacuaaagacugua

SEQ ID NO: 7452 - RNA, 22 nt, Homo sapiens
uuaaaugcauagaauguguagu

SEQ ID NO: 7453 - RNA, 22 nt, Homo sapiens
guagagguagacuuccuugucu

SEQ ID NO: 7454 - RNA, 21 nt, Homo sapiens
aaucacaguuguucugccuuc

SEQ ID NO: 7455 - RNA, 21 nt, Homo sapiens
uauagcagcacgauuuauagu

SEQ ID NO: 7456 - RNA, 22 nt, Homo sapiens
guaugcacauauguguauguau

SEQ ID NO: 7457 - RNA, 18 nt, Homo sapiens
ugacaucauuuagaaagg

SEQ ID NO: 7458 - RNA, 22 nt, Homo sapiens
auaaagcaagucucuggccuca

SEQ ID NO: 7459 - RNA, 22 nt, Homo sapiens
ccccauguucucucugcagcuc

SEQ ID NO: 7460 - RNA, 22 nt, Homo sapiens
uacauugucauauucucucucu

SEQ ID NO: 7461 - RNA, 22 nt, Homo sapiens
gucucacagcuagcugcuuuau

SEQ ID NO: 7462 - RNA, 22 nt, Homo sapiens
ucauguguugcacugaggaccu

SEQ ID NO: 7463 - RNA, 22 nt, Homo sapiens
gaaucacagauuaugaguaucu

SEQ ID NO: 7464 - RNA, 19 nt, Homo sapiens
agcaguguggagauuucuc

SEQ ID NO: 7465 - RNA, 22 nt, Homo sapiens
acauaaagaagcaggacauugu

SEQ ID NO: 7466 - RNA, 22 nt, Homo sapiens
ugacauagcuauuaagugaugc

SEQ ID NO: 7467 - RNA, 22 nt, Homo sapiens
ugugaagauguuucuuaauuga

SEQ ID NO: 7468 - RNA, 20 nt, Homo sapiens
aagugcaucguugugucugc

SEQ ID NO: 7469 - RNA, 22 nt, Homo sapiens
aggagguaggaauugugcuagg

SEQ ID NO: 7470 - RNA, 22 nt, Homo sapiens
aagcuggauuuaguguggagca

SEQ ID NO: 7471 - RNA, 22 nt, Homo sapiens
aggaauguuaguacuucuuagu

SEQ ID NO: 7472 - RNA, 22 nt, Homo sapiens
gauggaguugucgccugggcug

SEQ ID NO: 7473 - RNA, 22 nt, Homo sapiens
uggaagguaaguuuugagcauu

SEQ ID NO: 7474 - RNA, 23 nt, Homo sapiens
ugccuagaugcugcccugggaca

SEQ ID NO: 7475 - RNA, 22 nt, Homo sapiens
guacaguuuucaguguucacug

SEQ ID NO: 7476 - RNA, 22 nt, Homo sapiens
uagcaccugugcacaccaggca

SEQ ID NO: 7477 - RNA, 20 nt, Homo sapiens
acaaaugcauucugugacau

SEQ ID NO: 7478 - RNA, 22 nt, Homo sapiens
uucacagugugaucuaugggca

SEQ ID NO: 7479 - RNA, 22 nt, Homo sapiens
augaaagguugucuuaagccau

SEQ ID NO: 7480 - RNA, 22 nt, Homo sapiens
agcugguauuuugucgaggacu

SEQ ID NO: 7481 - RNA, 22 nt, Homo sapiens
ucccaguuuuucugaauaguca

SEQ ID NO: 7482 - RNA, 22 nt, Homo sapiens
augugcagauguuacaaauugu

SEQ ID NO: 7483 - RNA, 22 nt, Homo sapiens
auuaacaucuagaguuuuggug

SEQ ID NO: 7484 - RNA, 22 nt, Homo sapiens
gagauacacccagugcagaggc

SEQ ID NO: 7485 - RNA, 22 nt, Homo sapiens
ccucauggagaacaucugcuag

SEQ ID NO: 7486 - RNA, 22 nt, Homo sapiens
cauugcaguuuuugguguaucu

SEQ ID NO: 7487 - RNA, 22 nt, Homo sapiens
ucaaagugacaaaguugcagca

SEQ ID NO: 7488 - RNA, 22 nt, Homo sapiens
auuaaguugugccugaaaacuu

SEQ ID NO: 7489 - RNA, 22 nt, Homo sapiens
cuacacaugcaggcucccugcc

SEQ ID NO: 7490 - RNA, 22 nt, Homo sapiens
gugauauguuaggaucuaaguc

SEQ ID NO: 7491 - RNA, 22 nt, Homo sapiens
uggcauauaauauagaagacua

SEQ ID NO: 7492 - RNA, 22 nt, Homo sapiens
ugaggucauguucugucagguu

SEQ ID NO: 7493 - RNA, 21 nt, Homo sapiens
cugguccccuuuauguaugug

SEQ ID NO: 7494 - RNA, 22 nt, Homo sapiens
cacacugucuucaauggguggu

SEQ ID NO: 7495 - RNA, 18 nt, Homo sapiens
uggcaagugccauacggu

SEQ ID NO: 7496 - RNA, 22 nt, Homo sapiens
cacacuguuuuccauggggguu

SEQ ID NO: 7497 - RNA, 22 nt, Homo sapiens
ucacauuguuauguaaauguuu

SEQ ID NO: 7498 - RNA, 22 nt, Homo sapiens
ggaagguaauugucagcucaua

SEQ ID NO: 7499 - RNA, 18 nt, Homo sapiens
aaaaagugcucaggccua

SEQ ID NO: 7500 - RNA, 22 nt, Homo sapiens
guacaguauaguaauaggauuu

SEQ ID NO: 7501 - RNA, 22 nt, Homo sapiens
cucaguggauuagauaaugcac

SEQ ID NO: 7502 - RNA, 22 nt, Homo sapiens
gaaagguaggaacagggugcag

SEQ ID NO: 7503 - RNA, 22 nt, Homo sapiens
uuggaagagaagggagauaaac

SEQ ID NO: 7504 - RNA, 22 nt, Homo sapiens
uuacaguauugcaaggacuagg

SEQ ID NO: 7505 - RNA, 22 nt, Homo sapiens
auacuagucaagaauguaugag

SEQ ID NO: 7506 - RNA, 22 nt, Homo sapiens
aauaaagucugaagugugcuua

SEQ ID NO: 7507 - RNA, 21 nt, Homo sapiens
uggucccauaagauuauaaug

SEQ ID NO: 7508 - RNA, 22 nt, Homo sapiens
gugaaagacauauaugguuuga

SEQ ID NO: 7509 - RNA, 22 nt, Homo sapiens
auagcagaagaagggacaauuc

SEQ ID NO: 7510 - RNA, 22 nt, Homo sapiens
agcccauguggcugaggcuucu

SEQ ID NO: 7511 - RNA, 22 nt, Homo sapiens
uuccaugagaugcaucaaagcu

SEQ ID NO: 7512 - RNA, 22 nt, Homo sapiens
gagguauggauaucuggagagg

SEQ ID NO: 7513 - RNA, 22 nt, Homo sapiens
aagugaaugugcuggaauagcu

SEQ ID NO: 7514 - RNA, 22 nt, Homo sapiens
acaaagcgcuucucuuuagagu

SEQ ID NO: 7515 - RNA, 22 nt, Homo sapiens
aaugugcacuauuagggugaua

SEQ ID NO: 7516 - RNA, 22 nt, Homo sapiens
cagagguauugcaaaagccuag

SEQ ID NO: 7517 - RNA, 22 nt, Homo sapiens
cuagcagacacuuccagagagu

SEQ ID NO: 7518 - RNA, 22 nt, Homo sapiens
auagcagugugaggacagacua

SEQ ID NO: 7519 - RNA, 20 nt, Homo sapiens
uuaaaucuagugcagacuca

SEQ ID NO: 7520 - RNA, 22 nt, Homo sapiens
uuaaugaacuuuauuuuguaga

SEQ ID NO: 7521 - RNA, 22 nt, Homo sapiens
aagcuggagugcaguggugcga

SEQ ID NO: 7522 - RNA, 22 nt, Homo sapiens
cugugcauggauuuuaagauug

SEQ ID NO: 7523 - RNA, 22 nt, Homo sapiens
auguggcacuugacuuucucgc

SEQ ID NO: 7524 - RNA, 22 nt, Homo sapiens
gauagcagccauucuuuuuauu

SEQ ID NO: 7525 - RNA, 22 nt, Homo sapiens
ugugaaaucagauagccuuuuu

SEQ ID NO: 7526 - RNA, 22 nt, Homo sapiens
gcaaaugcuaugccauuuuaua

SEQ ID NO: 7527 - RNA, 17 nt, Homo sapiens
ucuaauaauaugcauuu

SEQ ID NO: 7528 - RNA, 22 nt, Homo sapiens
agagagguggguggagccccca

SEQ ID NO: 7529 - RNA, 22 nt, Homo sapiens
uaucacaaacuuagcaguuuaa

SEQ ID NO: 7530 - RNA, 22 nt, Homo sapiens
ucacauuguacaaacagguaag

SEQ ID NO: 7531 - RNA, 22 nt, Homo sapiens
ugaaacauacacucugaugggg

SEQ ID NO: 7532 - RNA, 22 nt, Homo sapiens
guaaaucucuguuuucauggac

SEQ ID NO: 7533 - RNA, 22 nt, Homo sapiens
ucauuggaugucugaaaugauu

SEQ ID NO: 7534 - RNA, 22 nt, Homo sapiens
auuguacuccagccuuggggac

SEQ ID NO: 7535 - RNA, 22 nt, Homo sapiens
uuggcaauauuuacugaaguug

SEQ ID NO: 7536 - RNA, 16 nt, Homo sapiens
gugagagaugacaaac

SEQ ID NO: 7537 - RNA, 20 nt, Homo sapiens
uauugcacuccagucugggc

SEQ ID NO: 7538 - RNA, 22 nt, Homo sapiens
aucaggaaccuuuuuggugugu

SEQ ID NO: 7539 - RNA, 22 nt, Homo sapiens
uucaggcaccauugucauugau

SEQ ID NO: 7540 - RNA, 22 nt, Homo sapiens
cucauuggcuacugaggcuugu

SEQ ID NO: 7541 - RNA, 22 nt, Homo sapiens
gucauugcuuaaggguucaugc

SEQ ID NO: 7542 - RNA, 22 nt, Homo sapiens
auugcacuccagccuuggggau

SEQ ID NO: 7543 - RNA, 22 nt, Homo sapiens
ucaaaugcuguauuguaguaau

SEQ ID NO: 7544 - RNA, 22 nt, Homo sapiens
aggcagcuguuauauacugagu

SEQ ID NO: 7545 - RNA, 22 nt, Homo sapiens
ugucccaguuggguauugaauu

SEQ ID NO: 7546 - RNA, 22 nt, Homo sapiens
cugaaagguauacgcuuguuau

SEQ ID NO: 7547 - RNA, 22 nt, Homo sapiens
uggcaauguggaaugguccagg

SEQ ID NO: 7548 - RNA, 22 nt, Homo sapiens
uggcaauaaaaugcaguuacuu

SEQ ID NO: 7549 - RNA, 22 nt, Homo sapiens
auuaaucaggcaaugcuugcua

SEQ ID NO: 7550 - RNA, 22 nt, Homo sapiens
augugcacaugcuuacauguga

SEQ ID NO: 7551 - RNA, 22 nt, Homo sapiens
ggacuguacuccuggccagugu

SEQ ID NO: 7552 - RNA, 22 nt, Homo sapiens
aagauauguuaguuauaaacuc

SEQ ID NO: 7553 - RNA, 22 nt, Homo sapiens
augacauugaugcucuggcugg

SEQ ID NO: 7554 - RNA, 22 nt, Homo sapiens
gaugccuuuuuguccucaguua

SEQ ID NO: 7555 - RNA, 22 nt, Homo sapiens
ugauauguaacuacuccuuaua

SEQ ID NO: 7556 - RNA, 22 nt, Homo sapiens
ugucauguaaagaguaaauggu

SEQ ID NO: 7557 - RNA, 22 nt, Homo sapiens
uaacuagaaaggagacaguugc

SEQ ID NO: 7558 - RNA, 22 nt, Homo sapiens
augacauuccacagccguagag

SEQ ID NO: 7559 - RNA, 19 nt, Homo sapiens
augacauuuggggguggac

SEQ ID NO: 7560 - RNA, 20 nt, Homo sapiens
ucacaagccaagaucacguc

SEQ ID NO: 7561 - RNA, 22 nt, Homo sapiens
uaagugaauguuggcuacugaa

SEQ ID NO: 7562 - RNA, 22 nt, Homo sapiens
ucugugcauuacacuuuucuca

SEQ ID NO: 7563 - RNA, 22 nt, Homo sapiens
cacaguguuccagcuauuugaa

SEQ ID NO: 7564 - RNA, 22 nt, Homo sapiens
aauaaagcugaauccuuccuga

SEQ ID NO: 7565 - RNA, 22 nt, Homo sapiens
agugguuuuaaguagagcauac

SEQ ID NO: 7566 - RNA, 22 nt, Homo sapiens
ucucacagaguugaacuuucuu

SEQ ID NO: 7567 - RNA, 22 nt, Homo sapiens
ggcuuggaggaaugugagggcu

SEQ ID NO: 7568 - RNA, 22 nt, Homo sapiens
auaacagcugcaaggcaaaagc

SEQ ID NO: 7569 - RNA, 22 nt, Homo sapiens
uaaugcacauuuauuuuaccuu

SEQ ID NO: 7570 - RNA, 18 nt, Homo sapiens
uuucaggguggacaugag

SEQ ID NO: 7571 - RNA, 22 nt, Homo sapiens
agccaguauuuccacagagugg

SEQ ID NO: 7572 - RNA, 22 nt, Homo sapiens
uggauugaaagcuuuaauauug

SEQ ID NO: 7573 - RNA, 19 nt, Homo sapiens
uagggcacgaggcagaguc

SEQ ID NO: 7574 - RNA, 22 nt, Homo sapiens
ugaugcuaccuaaagcaaccau

SEQ ID NO: 7575 - RNA, 22 nt, Homo sapiens
augagauauuuuauaagaucau

SEQ ID NO: 7576 - RNA, 22 nt, Homo sapiens
uugaccuaugggaguuugacua

SEQ ID NO: 7577 - RNA, 22 nt, Homo sapiens
cuagcagaacaauacaauucgg

SEQ ID NO: 7578 - RNA, 22 nt, Homo sapiens
ugagaacuuauggugauuuuuu

SEQ ID NO: 7579 - RNA, 22 nt, Homo sapiens
ugguaccuuuuaaugacuaauu

SEQ ID NO: 7580 - RNA, 22 nt, Homo sapiens
aucacauuuauaguggcacgca

SEQ ID NO: 7581 - RNA, 22 nt, Homo sapiens
uagcaacauucagcucagguac

SEQ ID NO: 7582 - RNA, 19 nt, Homo sapiens
ucuaaaucucuugauagac

SEQ ID NO: 7583 - RNA, 22 nt, Homo sapiens
cacacugucuuucagaaugguu

SEQ ID NO: 7584 - RNA, 22 nt, Homo sapiens
auaugacugccagggcccaguc

SEQ ID NO: 7585 - RNA, 23 nt, Homo sapiens
uuucuugggcaugcuaugucagu

SEQ ID NO: 7586 - RNA, 22 nt, Homo sapiens
ucucacagaguugaauguuucu

SEQ ID NO: 7587 - RNA, 22 nt, Homo sapiens
uggcuugauggcacaagguuuc

SEQ ID NO: 7588 - RNA, 20 nt, Homo sapiens
guaacagcacuuucccaaag

SEQ ID NO: 7589 - RNA, 22 nt, Homo sapiens
uaccaaguauuuucacaugaac

SEQ ID NO: 7590 - RNA, 22 nt, Homo sapiens
ccucacaaccuuuauugaagag

SEQ ID NO: 7591 - RNA, 19 nt, Homo sapiens
ucacacuguggcuucuuua

SEQ ID NO: 7592 - RNA, 22 nt, Homo sapiens
uucaucuggcaauucagagauu

SEQ ID NO: 7593 - RNA, 19 nt, Homo sapiens
gauauguugagcacccuuu

SEQ ID NO: 7594 - RNA, 22 nt, Homo sapiens
uuuacagucuuuugugugaguc

SEQ ID NO: 7595 - RNA, 22 nt, Homo sapiens
aauggcaagagccacagaggcg

SEQ ID NO: 7596 - RNA, 22 nt, Homo sapiens
ggaaagcuagguguggguguac

SEQ ID NO: 7597 - RNA, 21 nt, Homo sapiens
aagcaugguguaucuuuccau

SEQ ID NO: 7598 - RNA, 22 nt, Homo sapiens
cuuaaagcgaauauugguggua

SEQ ID NO: 7599 - RNA, 22 nt, Homo sapiens
accugguuuuaacauuguauua

SEQ ID NO: 7600 - RNA, 22 nt, Homo sapiens
aucaaaguuucccagaaguugu

SEQ ID NO: 7601 - RNA, 22 nt, Homo sapiens
gugcauaugcaugugcaugcac

SEQ ID NO: 7602 - RNA, 22 nt, Homo sapiens
auggcaaugcgauggugacuga

SEQ ID NO: 7603 - RNA, 22 nt, Homo sapiens
uagcaccaaacauauacucagu

SEQ ID NO: 7604 - RNA, 22 nt, Homo sapiens
uugaacuagaaccugcaaauuu

SEQ ID NO: 7605 - RNA, 22 nt, Homo sapiens
uaaugcacuuuccuccaaggcu

SEQ ID NO: 7606 - RNA, 22 nt, Homo sapiens
uuacuguauagaaucaucuuga

SEQ ID NO: 7607 - RNA, 22 nt, Homo sapiens
auuguacuacaccauaguacug

SEQ ID NO: 7608 - RNA, 22 nt, Homo sapiens
augugcaaauuuccaaacucuu

SEQ ID NO: 7609 - RNA, 22 nt, Homo sapiens
ggaaggucaaagggaaagcaga

SEQ ID NO: 7610 - RNA, 22 nt, Homo sapiens
ucucaguggcuuccucacuuuu

SEQ ID NO: 7611 - RNA, 22 nt, Homo sapiens
aucaaagugaauuaaugagaau

SEQ ID NO: 7612 - RNA, 22 nt, Homo sapiens
uaaagcgaggucuccuacaaga

SEQ ID NO: 7613 - RNA, 22 nt, Homo sapiens
auacaguaucuucuggcaagca

SEQ ID NO: 7614 - RNA, 22 nt, Homo sapiens
ucagaccauuucauuacagacu

SEQ ID NO: 7615 - RNA, 22 nt, Homo sapiens
uucaguagucaaaagauaaggg

SEQ ID NO: 7616 - RNA, 22 nt, Homo sapiens
ugcauauguugagaugcauauu

SEQ ID NO: 7617 - RNA, 20 nt, Homo sapiens
uugcagagcccaacccugga

SEQ ID NO: 7618 - RNA, 22 nt, Homo sapiens
gucuuuguuuggucuguaucag

SEQ ID NO: 7619 - RNA, 22 nt, Homo sapiens
auggcaauguaagucagaaaaa

SEQ ID NO: 7620 - RNA, 22 nt, Homo sapiens
uuuaaagcuccaagcaugucug

SEQ ID NO: 7621 - RNA, 22 nt, Homo sapiens
gagagcuaggccacuggggcuu

SEQ ID NO: 7622 - RNA, 22 nt, Homo sapiens
ugaaaguuauauugugaaauuc

SEQ ID NO: 7623 - RNA, 22 nt, Homo sapiens
agagguuuugcccucgagauaa

SEQ ID NO: 7624 - RNA, 22 nt, Homo sapiens
ggugagguaggaaaaguuagga

SEQ ID NO: 7625 - RNA, 22 nt, Homo sapiens
cuauucacaggcaauauguaca

SEQ ID NO: 7626 - RNA, 22 nt, Homo sapiens
uuuggcuuaagauugacugcaa

SEQ ID NO: 7627 - RNA, 22 nt, Homo sapiens
uggagagugauaaguaaaugga

SEQ ID NO: 7628 - RNA, 22 nt, Homo sapiens
agcauggucacuuugggcccca

SEQ ID NO: 7629 - RNA, 21 nt, Homo sapiens
uuucugggggagcauggcagg

SEQ ID NO: 7630 - RNA, 22 nt, Homo sapiens
gaaucacaguuauuagagcagc

SEQ ID NO: 7631 - RNA, 22 nt, Homo sapiens
caaaagugguucuuauccuuuu

SEQ ID NO: 7632 - RNA, 22 nt, Homo sapiens
ucucacaccccucucauauacc

SEQ ID NO: 7633 - RNA, 22 nt, Homo sapiens
ugauacugugcauuagaggcua

SEQ ID NO: 7634 - RNA, 22 nt, Homo sapiens
augagggagggguggugccgca

SEQ ID NO: 7635 - RNA, 22 nt, Homo sapiens
uugacagaccuuggucauaucc

SEQ ID NO: 7636 - RNA, 22 nt, Homo sapiens
auggagagaauuauucucucag

SEQ ID NO: 7637 - RNA, 22 nt, Homo sapiens
ucagggacgcuugacacaagcc

SEQ ID NO: 7638 - RNA, 22 nt, Homo sapiens
uuaaggaaggagucuuaaaugg

SEQ ID NO: 7639 - RNA, 20 nt, Homo sapiens
ucacuggagcucauuugauu

SEQ ID NO: 7640 - RNA, 22 nt, Homo sapiens
acuauacugaagcaaauuaaca

SEQ ID NO: 7641 - RNA, 22 nt, Homo sapiens
uugcacaauccugugagugagu

SEQ ID NO: 7642 - RNA, 22 nt, Homo sapiens
aaaugcucucuacacguuucug

SEQ ID NO: 7643 - RNA, 22 nt, Homo sapiens
uucacagucacccuucuccaug

SEQ ID NO: 7644 - RNA, 22 nt, Homo sapiens
cugagaagaaacagguaaggac

SEQ ID NO: 7645 - RNA, 22 nt, Homo sapiens
aggucccauguccucccugacc

SEQ ID NO: 7646 - RNA, 22 nt, Homo sapiens
augacauugaaaagcaagugga

SEQ ID NO: 7647 - RNA, 22 nt, Homo sapiens
ucacacuguuuugauuauuaua

SEQ ID NO: 7648 - RNA, 22 nt, Homo sapiens
uuugauguugauacuaccuuca

SEQ ID NO: 7649 - RNA, 22 nt, Homo sapiens
caaaggcuucugaaacugcaga

SEQ ID NO: 7650 - RNA, 22 nt, Homo sapiens
uauagcaguguaagaaucgagu

SEQ ID NO: 7651 - RNA, 21 nt, Homo sapiens
gagguaccucauguaagugga

SEQ ID NO: 7652 - RNA, 22 nt, Homo sapiens
ggcagacuguggaguucuuucu

SEQ ID NO: 7653 - RNA, 22 nt, Homo sapiens
uuuuuuaguuagcugggcauga

SEQ ID NO: 7654 - RNA, 22 nt, Homo sapiens
auacaguaaugucuuaggcugu

SEQ ID NO: 7655 - RNA, 22 nt, Homo sapiens
aagugaaugaugugaaguguaa

SEQ ID NO: 7656 - RNA, 20 nt, Homo sapiens
aaacucugucuucuuuauca

SEQ ID NO: 7657 - RNA, 21 nt, Homo sapiens
gauaucuuuauucccaagagc

SEQ ID NO: 7658 - RNA, 22 nt, Homo sapiens
aaguaaauauccgguaguccca

SEQ ID NO: 7659 - RNA, 22 nt, Homo sapiens
auggaaggagaggaaugaauga

SEQ ID NO: 7660 - RNA, 22 nt, Homo sapiens
ugaaggacauaaggcagaguga

SEQ ID NO: 7661 - RNA, 22 nt, Homo sapiens
uuggaauguacucuagccuaug

SEQ ID NO: 7662 - RNA, 22 nt, Homo sapiens
auggauguucuagggaugugau

SEQ ID NO: 7663 - RNA, 22 nt, Homo sapiens
uuuccuguaggaaggaaauaga

SEQ ID NO: 7664 - RNA, 22 nt, Homo sapiens
cauugcaguggaguggggaaga

SEQ ID NO: 7665 - RNA, 22 nt, Homo sapiens
agcugguauuuugucaaggaua

SEQ ID NO: 7666 - RNA, 22 nt, Homo sapiens
caacacuguuuauuggauagcc

SEQ ID NO: 7667 - RNA, 22 nt, Homo sapiens
aaugguguuuccguuaagcuga

SEQ ID NO: 7668 - RNA, 22 nt, Homo sapiens
auaaaugcaaugguauuuuuga

SEQ ID NO: 7669 - RNA, 19 nt, Homo sapiens
acauggauuuugugcaaac

SEQ ID NO: 7670 - RNA, 21 nt, Homo sapiens
ugauaugguuuggauaugugu

SEQ ID NO: 7671 - RNA, 22 nt, Homo sapiens
ugacucaguuguuagucuucau

SEQ ID NO: 7672 - RNA, 20 nt, Homo sapiens
gcauaugucuuuauagcaga

SEQ ID NO: 7673 - RNA, 22 nt, Homo sapiens
auagcacaguguguguacacca

SEQ ID NO: 7674 - RNA, 21 nt, Homo sapiens
agagaacugaaacaugugacu

SEQ ID NO: 7675 - RNA, 22 nt, Homo sapiens
aagcacccuuugucuggacaug

SEQ ID NO: 7676 - RNA, 22 nt, Homo sapiens
auuacauagucaaggugucuca

SEQ ID NO: 7677 - RNA, 22 nt, Homo sapiens
uggcagaugagccgcgcuccaa

SEQ ID NO: 7678 - RNA, 22 nt, Homo sapiens
ucacugugagaguuuauccugu

SEQ ID NO: 7679 - RNA, 22 nt, Homo sapiens
uucuuagucauguaauagucca

SEQ ID NO: 7680 - RNA, 22 nt, Homo sapiens
uaguucauuuuucuugcuuaga

SEQ ID NO: 7681 - RNA, 22 nt, Homo sapiens
uggcuagaugagauguacugca

SEQ ID NO: 7682 - RNA, 22 nt, Homo sapiens
uccaugugaaaucuaugaggac

SEQ ID NO: 7683 - RNA, 22 nt, Homo sapiens
auggcaauaauagcuaccauuu

SEQ ID NO: 7684 - RNA, 22 nt, Homo sapiens
ugaggcacucccuagcggggug

SEQ ID NO: 7685 - RNA, 22 nt, Homo sapiens
gcaagacaugucuaagguuuaa

SEQ ID NO: 7686 - RNA, 22 nt, Homo sapiens
acugacaugaucaggcauguuc

SEQ ID NO: 7687 - RNA, 22 nt, Homo sapiens
gugcacaaucgugcauuccuug

SEQ ID NO: 7688 - RNA, 22 nt, Homo sapiens
cucauggagauagagaauagaa

SEQ ID NO: 7689 - RNA, 22 nt, Homo sapiens
aggaauuuaauguaugauaaua

SEQ ID NO: 7690 - RNA, 18 nt, Homo sapiens
augugcaauuuuguauuu

SEQ ID NO: 7691 - RNA, 22 nt, Homo sapiens
aaagugauguccaggcuuucag

SEQ ID NO: 7692 - RNA, 22 nt, Homo sapiens
uugacauaguuucugaaauaga

SEQ ID NO: 7693 - RNA, 22 nt, Homo sapiens
accagucucagguaugucuuua

SEQ ID NO: 7694 - RNA, 20 nt, Homo sapiens
augucaggaagggagucagg

SEQ ID NO: 7695 - RNA, 22 nt, Homo sapiens
uacaaguggguuugugcaggag

SEQ ID NO: 7696 - RNA, 22 nt, Homo sapiens
auagcagaccaccucucccacu

SEQ ID NO: 7697 - RNA, 22 nt, Homo sapiens
auucuauaguccuaggauuggg

SEQ ID NO: 7698 - RNA, 22 nt, Homo sapiens
ugagauggguaauuaaauggug

SEQ ID NO: 7699 - RNA, 22 nt, Homo sapiens
aucucaguuaauuccaucuuuc

SEQ ID NO: 7700 - RNA, 22 nt, Homo sapiens
uuaaggcuuuaaguaaacacag

SEQ ID NO: 7701 - RNA, 22 nt, Homo sapiens
uuggagagagaggacucccggc

SEQ ID NO: 7702 - RNA, 22 nt, Homo sapiens
aagccagugugacaggaaacuu

SEQ ID NO: 7703 - RNA, 22 nt, Homo sapiens
uacaguagaaugucuuucaaaa

SEQ ID NO: 7704 - RNA, 22 nt, Homo sapiens
gacaccugguguggaacuggag

SEQ ID NO: 7705 - RNA, 22 nt, Homo sapiens
caugguguuaggcacugggaau

SEQ ID NO: 7706 - RNA, 22 nt, Homo sapiens
uaaagccauugucaaguuugua

SEQ ID NO: 7707 - RNA, 22 nt, Homo sapiens
aaucugucuuuuguuauugagg

SEQ ID NO: 7708 - RNA, 22 nt, Homo sapiens
ggaguguguaggagaaagguaa

SEQ ID NO: 7709 - RNA, 22 nt, Homo sapiens
agagguuuuggggcugagagcu

SEQ ID NO: 7710 - RNA, 22 nt, Homo sapiens
uaagugaauuucacuacugagu

SEQ ID NO: 7711 - RNA, 18 nt, Homo sapiens
uauuccucuuccucuauc

SEQ ID NO: 7712 - RNA, 19 nt, Homo sapiens
agagacucauuguagcauu

SEQ ID NO: 7713 - RNA, 22 nt, Homo sapiens
uuggagugugagagcagccugg

SEQ ID NO: 7714 - RNA, 22 nt, Homo sapiens
uagcaagaugaauuugugcaaa

SEQ ID NO: 7715 - RNA, 21 nt, Homo sapiens
uagcaaauugcuauuaaggca

SEQ ID NO: 7716 - RNA, 22 nt, Homo sapiens
uuuagguuacauauaauccaaa

SEQ ID NO: 7717 - RNA, 22 nt, Homo sapiens
uuaaaugcuagaauuuucuuug

SEQ ID NO: 7718 - RNA, 22 nt, Homo sapiens
uauugcagugagauccaucugg

SEQ ID NO: 7719 - RNA, 22 nt, Homo sapiens
uuaacagcacuacguggggauc

SEQ ID NO: 7720 - RNA, 22 nt, Homo sapiens
aguggaguguaaagcgucuuuu

SEQ ID NO: 7721 - RNA, 22 nt, Homo sapiens
ugaauacugugcaaaggauuug

SEQ ID NO: 7722 - RNA, 22 nt, Homo sapiens
augucaaggugaagaaagauca

SEQ ID NO: 7723 - RNA, 23 nt, Homo sapiens
auagagcuaggaugcagacagau

SEQ ID NO: 7724 - RNA, 22 nt, Homo sapiens
uuaagugcucaguuacucaguu

SEQ ID NO: 7725 - RNA, 19 nt, Homo sapiens
caauacuucuuggcauaca

SEQ ID NO: 7726 - RNA, 22 nt, Homo sapiens
ucacaaguguauagacaugucc

SEQ ID NO: 7727 - RNA, 22 nt, Homo sapiens
uugugaaaucuaggcagagguu

SEQ ID NO: 7728 - RNA, 22 nt, Homo sapiens
uggucccaugaacuuuagguca

SEQ ID NO: 7729 - RNA, 22 nt, Homo sapiens
acauaugaguacaugugccaug

SEQ ID NO: 7730 - RNA, 22 nt, Homo sapiens
aucauauccuagauauaacuuc

SEQ ID NO: 7731 - RNA, 17 nt, Homo sapiens
uuuuggauuagaaaucc

SEQ ID NO: 7732 - RNA, 22 nt, Homo sapiens
uugacuucagagcugauucaag

SEQ ID NO: 7733 - RNA, 22 nt, Homo sapiens
uuguauaggcucaguaagaauc

SEQ ID NO: 7734 - RNA, 22 nt, Homo sapiens
uuagaucaacauggaacucuau

SEQ ID NO: 7735 - RNA, 22 nt, Homo sapiens
uuuccaagaugcuuacuuucuc

SEQ ID NO: 7736 - RNA, 22 nt, Homo sapiens
agagugcuauagauuagauuuc

SEQ ID NO: 7737 - RNA, 22 nt, Homo sapiens
ucaacauugcugucaggcaucu

SEQ ID NO: 7738 - RNA, 22 nt, Homo sapiens
ugagaggugaauggcaggcuca

SEQ ID NO: 7739 - RNA, 22 nt, Homo sapiens
cagggaauguuauuuaauagca

SEQ ID NO: 7740 - RNA, 22 nt, Homo sapiens
agggcuuguuuaacuaucauua

SEQ ID NO: 7741 - RNA, 22 nt, Homo sapiens
uuacaucaucacauuaguuugc

SEQ ID NO: 7742 - RNA, 22 nt, Homo sapiens
gugaggaaggaaaccugcuagc

SEQ ID NO: 7743 - RNA, 22 nt, Homo sapiens
augauacuggcuucauagaaug

SEQ ID NO: 7744 - RNA, 22 nt, Homo sapiens
cccuguguuguucaaggaucug

SEQ ID NO: 7745 - RNA, 22 nt, Homo sapiens
aucugggguuggcaaaguuugg

SEQ ID NO: 7746 - RNA, 22 nt, Homo sapiens
augaccuuguccucagugucau

SEQ ID NO: 7747 - RNA, 22 nt, Homo sapiens
uguucuugaguugggaguacaa

SEQ ID NO: 7748 - RNA, 22 nt, Homo sapiens
ugauaggucuguuuugaaaagg

SEQ ID NO: 7749 - RNA, 22 nt, Homo sapiens
uuacaguagaugaggguauaau

SEQ ID NO: 7750 - RNA, 22 nt, Homo sapiens
uuccauguaguugagcaguuuu

SEQ ID NO: 7751 - RNA, 22 nt, Homo sapiens
guaaacuuccccucaugaauga

SEQ ID NO: 7752 - RNA, 22 nt, Homo sapiens
gugcuaggugcuaggaagauag

SEQ ID NO: 7753 - RNA, 22 nt, Homo sapiens
gagaacauacggcauuugguuu

SEQ ID NO: 7754 - RNA, 22 nt, Homo sapiens
augagcuaguguaggguacuga

SEQ ID NO: 7755 - RNA, 22 nt, Homo sapiens
auaauagcugaucauuuagaag

SEQ ID NO: 7756 - RNA, 22 nt, Homo sapiens
guaugucuugucuauggcugcu

SEQ ID NO: 7757 - RNA, 22 nt, Homo sapiens
augaagacaucgucugggauua

SEQ ID NO: 7758 - RNA, 22 nt, Homo sapiens
agugaaaucugaagaaggucau

SEQ ID NO: 7759 - RNA, 22 nt, Homo sapiens
uuugauguugagacuauaaagc

SEQ ID NO: 7760 - RNA, 22 nt, Homo sapiens
gugcacaacgugcaaguuuguu

SEQ ID NO: 7761 - RNA, 22 nt, Homo sapiens
gugacauuauuucagcuacaug

SEQ ID NO: 7762 - RNA, 23 nt, Homo sapiens
ucacaguggcugcuuaauuguga

SEQ ID NO: 7763 - RNA, 22 nt, Homo sapiens
cuuuaguugucuccucaagggu

SEQ ID NO: 7764 - RNA, 22 nt, Homo sapiens
ugagucuguucucacauugcua

SEQ ID NO: 7765 - RNA, 22 nt, Homo sapiens
cuucaaaguuggcuaggagaca

SEQ ID NO: 7766 - RNA, 22 nt, Homo sapiens
gagguaaguggauuaugagguc

SEQ ID NO: 7767 - RNA, 22 nt, Homo sapiens
uaugccuuuuggcucaagaaac

SEQ ID NO: 7768 - RNA, 22 nt, Homo sapiens
uauagcagccugaacaaaguaa

SEQ ID NO: 7769 - RNA, 22 nt, Homo sapiens
uaugcuuauugucucauccacu

SEQ ID NO: 7770 - RNA, 22 nt, Homo sapiens
acauauaaggagacuagggcau

SEQ ID NO: 7771 - RNA, 22 nt, Homo sapiens
cuguaugugagaaauaauaagu

SEQ ID NO: 7772 - RNA, 22 nt, Homo sapiens
uugagagaaaaaauuuauuggu

SEQ ID NO: 7773 - RNA, 22 nt, Homo sapiens
augugcaaagcacuguucagca

SEQ ID NO: 7774 - RNA, 22 nt, Homo sapiens
gagauguuuuguuaucaaagga

SEQ ID NO: 7775 - RNA, 22 nt, Homo sapiens
auagcagugugaaaacagacua

SEQ ID NO: 7776 - RNA, 22 nt, Homo sapiens
uggcaguuuacaaaugccauga

SEQ ID NO: 7777 - RNA, 19 nt, Homo sapiens
caguaucauugcacauagu

SEQ ID NO: 7778 - RNA, 22 nt, Homo sapiens
uuaaaguguuugcagacaggug

SEQ ID NO: 7779 - RNA, 22 nt, Homo sapiens
ugagaucaaggugggcccuggg

SEQ ID NO: 7780 - RNA, 22 nt, Homo sapiens
gaaugcuaagcaugugggaauu

SEQ ID NO: 7781 - RNA, 22 nt, Homo sapiens
cuacaguagagaggauguagaa

SEQ ID NO: 7782 - RNA, 23 nt, Homo sapiens
acacaguaaacuaaaagcuagcu

SEQ ID NO: 7783 - RNA, 22 nt, Homo sapiens
ugaaagcuacaggaaaguauuu

SEQ ID NO: 7784 - RNA, 22 nt, Homo sapiens
gaagcgaggugauuagcagaca

SEQ ID NO: 7785 - RNA, 22 nt, Homo sapiens
auggaggacaaugucaccuuca

SEQ ID NO: 7786 - RNA, 22 nt, Homo sapiens
uaugcacacguguccaugugca

SEQ ID NO: 7787 - RNA, 22 nt, Homo sapiens
aguaucacaggcaaaacagaau

SEQ ID NO: 7788 - RNA, 22 nt, Homo sapiens
ugugaacauuuuguauauauua

SEQ ID NO: 7789 - RNA, 22 nt, Homo sapiens
augagggaagcucacgugucca

SEQ ID NO: 7790 - RNA, 22 nt, Homo sapiens
ugauggcacagugaguuccagg

SEQ ID NO: 7791 - RNA, 19 nt, Homo sapiens
aagugaaugcuuuguucac

SEQ ID NO: 7792 - RNA, 22 nt, Homo sapiens
auggcaauaugaugcacuguuu

SEQ ID NO: 7793 - RNA, 20 nt, Homo sapiens
uuauagcuacaucuugacug

SEQ ID NO: 7794 - RNA, 22 nt, Homo sapiens
ucagaguagagcgacuucuccu

SEQ ID NO: 7795 - RNA, 22 nt, Homo sapiens
guacaagugcaguuucguuaca

SEQ ID NO: 7796 - RNA, 22 nt, Homo sapiens
ugauauggcuuggcuaugucac

SEQ ID NO: 7797 - RNA, 22 nt, Homo sapiens
cagcaucauucaucugggguaa

SEQ ID NO: 7798 - RNA, 21 nt, Homo sapiens
gaaauacugccuuaggagcug

SEQ ID NO: 7799 - RNA, 22 nt, Homo sapiens
aucucaguucaggcuggccaca

SEQ ID NO: 7800 - RNA, 22 nt, Homo sapiens
uaaucacagagguuuggccuca

SEQ ID NO: 7801 - RNA, 22 nt, Homo sapiens
gugaaguuuuuugcugagaguc

SEQ ID NO: 7802 - RNA, 22 nt, Homo sapiens
uuuggcuuugagaagcagugga

SEQ ID NO: 7803 - RNA, 22 nt, Homo sapiens
uaaagugaggauggcaguaggu

SEQ ID NO: 7804 - RNA, 22 nt, Homo sapiens
cuagcugcacuuccugcuacug

SEQ ID NO: 7805 - RNA, 21 nt, Homo sapiens
uggcuauuucuguggcauaca

SEQ ID NO: 7806 - RNA, 22 nt, Homo sapiens
agucaaaugcuuauguauaaag

SEQ ID NO: 7807 - RNA, 22 nt, Homo sapiens
cugaggacaucagggaagcauc

SEQ ID NO: 7808 - RNA, 22 nt, Homo sapiens
agcaggucuuaacuugugaggu

SEQ ID NO: 7809 - RNA, 22 nt, Homo sapiens
ugaaagacugaaagcuuuucuu

SEQ ID NO: 7810 - RNA, 22 nt, Homo sapiens
agaauguauauucuguaguugu

SEQ ID NO: 7811 - RNA, 19 nt, Homo sapiens
caugugcacuacuggcuuc

SEQ ID NO: 7812 - RNA, 22 nt, Homo sapiens
ugaagugaagacucacagaagg

SEQ ID NO: 7813 - RNA, 22 nt, Homo sapiens
ccauuucacucuuccugaagga

SEQ ID NO: 7814 - RNA, 22 nt, Homo sapiens
ugaaauacuuaauuucuccaug

SEQ ID NO: 7815 - RNA, 22 nt, Homo sapiens
gaggagucagacugugcaaggu

SEQ ID NO: 7816 - RNA, 22 nt, Homo sapiens
aaggaguagaggaauagcaaug

SEQ ID NO: 7817 - RNA, 22 nt, Homo sapiens
uacugagagaggaauauugaaa

SEQ ID NO: 7818 - RNA, 23 nt, Homo sapiens
accuucauucauucagcugaagu

SEQ ID NO: 7819 - RNA, 22 nt, Homo sapiens
cagagaacauucagagcuguag

SEQ ID NO: 7820 - RNA, 18 nt, Homo sapiens
gauaacaguggacuaugc

SEQ ID NO: 7821 - RNA, 22 nt, Homo sapiens
auaugcauacccucaccaacua

SEQ ID NO: 7822 - RNA, 22 nt, Homo sapiens
uguugcacuccauccugggcga

SEQ ID NO: 7823 - RNA, 22 nt, Homo sapiens
auggcaaugcgaugaugacuga

SEQ ID NO: 7824 - RNA, 22 nt, Homo sapiens
guacaguaguaaaagugaauga

SEQ ID NO: 7825 - RNA, 22 nt, Homo sapiens
aaaugcacgcuacccagcuaga

SEQ ID NO: 7826 - RNA, 22 nt, Homo sapiens
cuaacacagggcaagucaggcu

SEQ ID NO: 7827 - RNA, 22 nt, Homo sapiens
ugugaagauggacuaauauagu

SEQ ID NO: 7828 - RNA, 22 nt, Homo sapiens
uauagcagugaguauugacuaa

SEQ ID NO: 7829 - RNA, 22 nt, Homo sapiens
auggcacugccuggcuucaugg

SEQ ID NO: 7830 - RNA, 20 nt, Homo sapiens
aacaguguguaaguuuccuu

SEQ ID NO: 7831 - RNA, 22 nt, Homo sapiens
uucuaaacaucuuacaaugcau

SEQ ID NO: 7832 - RNA, 22 nt, Homo sapiens
ucagugcuuuuuguugucauca

SEQ ID NO: 7833 - RNA, 22 nt, Homo sapiens
gugaggucguagucauaggcaa

SEQ ID NO: 7834 - RNA, 22 nt, Homo sapiens
cuucucagugcucaucuuauuu

SEQ ID NO: 7835 - RNA, 21 nt, Homo sapiens
uaagcuaaacauucaguuaac

SEQ ID NO: 7836 - RNA, 22 nt, Homo sapiens
ucccugaguaucuaauguguuu

SEQ ID NO: 7837 - RNA, 22 nt, Homo sapiens
acagugcuucugauaugaugcc

SEQ ID NO: 7838 - RNA, 22 nt, Homo sapiens
ucacaugaagauuuuaguauac

SEQ ID NO: 7839 - RNA, 22 nt, Homo sapiens
guccaaauccaugggauguaca

SEQ ID NO: 7840 - RNA, 22 nt, Homo sapiens
aaugcacauaaaauccuccagg

SEQ ID NO: 7841 - RNA, 22 nt, Homo sapiens
gugaaagacagcauuaauggcu

SEQ ID NO: 7842 - RNA, 22 nt, Homo sapiens
acaguguguguguucaccuaga

SEQ ID NO: 7843 - RNA, 22 nt, Homo sapiens
gugaucuguccuucauagccug

SEQ ID NO: 7844 - RNA, 22 nt, Homo sapiens
gugauuauuaugcacugcaugc

SEQ ID NO: 7845 - RNA, 22 nt, Homo sapiens
cucauggaauacuucacagcca

SEQ ID NO: 7846 - RNA, 22 nt, Homo sapiens
ucacagugcaggaucaguuaau

SEQ ID NO: 7847 - RNA, 22 nt, Homo sapiens
uuagcaauagccugcaucugca

SEQ ID NO: 7848 - RNA, 22 nt, Homo sapiens
gcagaauugguuucuucuaagg

SEQ ID NO: 7849 - RNA, 22 nt, Homo sapiens
agaaccaaucccacauggauac

SEQ ID NO: 7850 - RNA, 22 nt, Homo sapiens
uuugacuuuuagaauaugaguu

SEQ ID NO: 7851 - RNA, 22 nt, Homo sapiens
ccaucacaggccucagugggaa

SEQ ID NO: 7852 - RNA, 21 nt, Homo sapiens
ugaaccccugcucucaagaaa

SEQ ID NO: 7853 - RNA, 22 nt, Homo sapiens
cuaaagugcuuaaaaucucauu

SEQ ID NO: 7854 - RNA, 22 nt, Homo sapiens
aacagaauccucuuuuccuggg

SEQ ID NO: 7855 - RNA, 20 nt, Homo sapiens
uucagcaaaggaaugggagu

SEQ ID NO: 7856 - RNA, 22 nt, Homo sapiens
ugcauacacaagcauacaugua

SEQ ID NO: 7857 - RNA, 22 nt, Homo sapiens
uggacugagauuucagcugcca

SEQ ID NO: 7858 - RNA, 22 nt, Homo sapiens
cugacauuguugaucacagcca

SEQ ID NO: 7859 - RNA, 22 nt, Homo sapiens
auugaacuuuugucacugacau

SEQ ID NO: 7860 - RNA, 22 nt, Homo sapiens
ugcugcaaucucggcacuuugg

SEQ ID NO: 7861 - RNA, 22 nt, Homo sapiens
ucacaugugcguuuuggcaugu

SEQ ID NO: 7862 - RNA, 22 nt, Homo sapiens
uugcaacuuagaaaaaucauuu

SEQ ID NO: 7863 - RNA, 22 nt, Homo sapiens
ugauagaucugggcaaaguaaa

SEQ ID NO: 7864 - RNA, 22 nt, Homo sapiens
uugaaagacagaggggcaaguu

SEQ ID NO: 7865 - RNA, 22 nt, Homo sapiens
gcuggcuuucuccugaucucag

SEQ ID NO: 7866 - RNA, 22 nt, Homo sapiens
cucaaagucaagggaaagcagg

SEQ ID NO: 7867 - RNA, 22 nt, Homo sapiens
uagaacauuccaggugauguug

SEQ ID NO: 7868 - RNA, 23 nt, Homo sapiens
uugcauagacauccucauagauu

SEQ ID NO: 7869 - RNA, 22 nt, Homo sapiens
gaguaacagcauaaauuuguga

SEQ ID NO: 7870 - RNA, 22 nt, Homo sapiens
agcuggcuguagcugcaagucu

SEQ ID NO: 7871 - RNA, 22 nt, Homo sapiens
ugaaugcuucaugucugggcug

SEQ ID NO: 7872 - RNA, 18 nt, Homo sapiens
auauugccuucagacuag

SEQ ID NO: 7873 - RNA, 22 nt, Homo sapiens
uaacauagucauauacuugcuu

SEQ ID NO: 7874 - RNA, 22 nt, Homo sapiens
uggaguguaaauuaguucagcc

SEQ ID NO: 7875 - RNA, 20 nt, Homo sapiens
ucacugugaacuucuugagg

SEQ ID NO: 7876 - RNA, 22 nt, Homo sapiens
auagcaggagaauggucauggg

SEQ ID NO: 7877 - RNA, 22 nt, Homo sapiens
augaaaguguguggaaacuuga

SEQ ID NO: 7878 - RNA, 22 nt, Homo sapiens
cauggauuuuuuugaauggcag

SEQ ID NO: 7879 - RNA, 22 nt, Homo sapiens
uuggcaauucagauucuuuuau

SEQ ID NO: 7880 - RNA, 22 nt, Homo sapiens
uaguaaacauaguucuuuugcu

SEQ ID NO: 7881 - RNA, 22 nt, Homo sapiens
guagcagaauaucagauaauuu

SEQ ID NO: 7882 - RNA, 22 nt, Homo sapiens
ucaaaguaaagccucaggaugg

SEQ ID NO: 7883 - RNA, 22 nt, Homo sapiens
uucaaaguaaaaauguguucac

SEQ ID NO: 7884 - RNA, 22 nt, Homo sapiens
aagagguaauaacaaagcuucu

SEQ ID NO: 7885 - RNA, 22 nt, Homo sapiens
ucuuugauuuuguuacuaagac

SEQ ID NO: 7886 - RNA, 22 nt, Homo sapiens
uuugccuuugugauauggucua

SEQ ID NO: 7887 - RNA, 22 nt, Homo sapiens
uucagagugaggcucucggaac

SEQ ID NO: 7888 - RNA, 22 nt, Homo sapiens
gaugagguagaagacucagcaa

SEQ ID NO: 7889 - RNA, 22 nt, Homo sapiens
augaugucauuuuaauuucuaa

SEQ ID NO: 7890 - RNA, 22 nt, Homo sapiens
cuguagcuuuuauaugcuuagc

SEQ ID NO: 7891 - RNA, 22 nt, Homo sapiens
ugguguuugagaagcugauguc

SEQ ID NO: 7892 - RNA, 22 nt, Homo sapiens
gugagaagaaaaauauggcugu

SEQ ID NO: 7893 - RNA, 22 nt, Homo sapiens
augugcaaauucauguucuuua

SEQ ID NO: 7894 - RNA, 22 nt, Homo sapiens
ugaaacacaccuccucuccauc

SEQ ID NO: 7895 - RNA, 22 nt, Homo sapiens
ucugguggugaugagagacagu

SEQ ID NO: 7896 - RNA, 22 nt, Homo sapiens
uaccacccuuuuuccagaagcc

SEQ ID NO: 7897 - RNA, 22 nt, Homo sapiens
uguaaaucugguuaauuggaua

SEQ ID NO: 7898 - RNA, 17 nt, Homo sapiens
ucaaaugcucccaguga

SEQ ID NO: 7899 - RNA, 22 nt, Homo sapiens
uuuaaggcaugccuguacaugc

SEQ ID NO: 7900 - RNA, 21 nt, Homo sapiens
ucacaaugaacagcagcagaa

SEQ ID NO: 7901 - RNA, 22 nt, Homo sapiens
gaauucugucgcuuacuagaug

SEQ ID NO: 7902 - RNA, 22 nt, Homo sapiens
auacacauuccugggccucacc

SEQ ID NO: 7903 - RNA, 22 nt, Homo sapiens
cauugcagauccuucaaaugac

SEQ ID NO: 7904 - RNA, 17 nt, Homo sapiens
ugugauugaagucaucc

SEQ ID NO: 7905 - RNA, 22 nt, Homo sapiens
cagcacauuacaaguacuuggu

SEQ ID NO: 7906 - RNA, 22 nt, Homo sapiens
cuaaagauagugacaugauuug

SEQ ID NO: 7907 - RNA, 22 nt, Homo sapiens
uccaguuguuauuuuuauaaag

SEQ ID NO: 7908 - RNA, 22 nt, Homo sapiens
aucagaguggguuuuaaaagug

SEQ ID NO: 7909 - RNA, 22 nt, Homo sapiens
cacacugucuucauuacuguag

SEQ ID NO: 7910 - RNA, 19 nt, Homo sapiens
ucuuugcuuuucuaagagg

SEQ ID NO: 7911 - RNA, 22 nt, Homo sapiens
uguugcacucuagccugggcaa

SEQ ID NO: 7912 - RNA, 22 nt, Homo sapiens
uauugaacgugggauauugaag

SEQ ID NO: 7913 - RNA, 22 nt, Homo sapiens
auguugcaguuuaauuauccua

SEQ ID NO: 7914 - RNA, 22 nt, Homo sapiens
uuggcaaucaauucugacgucu

SEQ ID NO: 7915 - RNA, 22 nt, Homo sapiens
uauugcagauacccaggaaguu

SEQ ID NO: 7916 - RNA, 22 nt, Homo sapiens
uugugaaaaaccucucguggaa

SEQ ID NO: 7917 - RNA, 22 nt, Homo sapiens
uucaaaguuggaggacaaacug

SEQ ID NO: 7918 - RNA, 22 nt, Homo sapiens
gcuggugacuuuaaguugaagc

SEQ ID NO: 7919 - RNA, 22 nt, Homo sapiens
ucaggguacuuguggccaaagu

SEQ ID NO: 7920 - RNA, 22 nt, Homo sapiens
ugacagcugaagauguugaacc

SEQ ID NO: 7921 - RNA, 22 nt, Homo sapiens
uuacaguucugguggagaggua

SEQ ID NO: 7922 - RNA, 22 nt, Homo sapiens
ugaaagacugaagaauaggcau

SEQ ID NO: 7923 - RNA, 22 nt, Homo sapiens
auagcagugugagaaugaacua

SEQ ID NO: 7924 - RNA, 22 nt, Homo sapiens
ucagggacuuacaaaccagaag

SEQ ID NO: 7925 - RNA, 22 nt, Homo sapiens
gagauggugugcuguuggaagu

SEQ ID NO: 7926 - RNA, 22 nt, Homo sapiens
ugaggagugaacuauuucugau

SEQ ID NO: 7927 - RNA, 22 nt, Homo sapiens
gugaaagauuaaaccagugugu

SEQ ID NO: 7928 - RNA, 21 nt, Homo sapiens
cucaaaguacugauauuacag

SEQ ID NO: 7929 - RNA, 23 nt, Homo sapiens
ggaaacauccagucuuucaccau

SEQ ID NO: 7930 - RNA, 20 nt, Homo sapiens
aauaacagccccagggaggu

SEQ ID NO: 7931 - RNA, 22 nt, Homo sapiens
uuagaacaguguuugccucgcu

SEQ ID NO: 7932 - RNA, 22 nt, Homo sapiens
ugaauaguuugacagaacucuu

SEQ ID NO: 7933 - RNA, 21 nt, Homo sapiens
aaaugcacauuacugcuggug

SEQ ID NO: 7934 - RNA, 22 nt, Homo sapiens
gauaacagauaaugucaguuau

SEQ ID NO: 7935 - RNA, 22 nt, Homo sapiens
auacaguauggagggcccagcu

SEQ ID NO: 7936 - RNA, 21 nt, Homo sapiens
acccucuaguuuucaacaggc

SEQ ID NO: 7937 - RNA, 22 nt, Homo sapiens
cuaaaacuuucugagugcagca

SEQ ID NO: 7938 - RNA, 22 nt, Homo sapiens
uaagugaauauggacaguuagc

SEQ ID NO: 7939 - RNA, 22 nt, Homo sapiens
uaagugaaggaaguguguuuac

SEQ ID NO: 7940 - RNA, 22 nt, Homo sapiens
augaaacuggcuaauuuuugua

SEQ ID NO: 7941 - RNA, 22 nt, Homo sapiens
aagcuggagugcaguggugcaa

SEQ ID NO: 7942 - RNA, 18 nt, Homo sapiens
cuuaacauugggaugaua

SEQ ID NO: 7943 - RNA, 21 nt, Homo sapiens
agagucaucucuaucuguacc

SEQ ID NO: 7944 - RNA, 22 nt, Homo sapiens
uguugcacuccagccuagguga

SEQ ID NO: 7945 - RNA, 22 nt, Homo sapiens
ucaggcacuaguaagaaaaagg

SEQ ID NO: 7946 - RNA, 22 nt, Homo sapiens
aaaaguucuuugagccuugaca

SEQ ID NO: 7947 - RNA, 22 nt, Homo sapiens
agcuauauugaggaugccauuc

SEQ ID NO: 7948 - RNA, 22 nt, Homo sapiens
ugaagacauuuuugggugugua

SEQ ID NO: 7949 - RNA, 19 nt, Homo sapiens
cucauggagaaggagaaua

SEQ ID NO: 7950 - RNA, 22 nt, Homo sapiens
uggauugagaagcuguggcuca

SEQ ID NO: 7951 - RNA, 22 nt, Homo sapiens
uaacauucacaugcugcaaaaa

SEQ ID NO: 7952 - RNA, 22 nt, Homo sapiens
guguauguuucucccugucccu

SEQ ID NO: 7953 - RNA, 23 nt, Homo sapiens
uggcauuuuaguuagcuucagug

SEQ ID NO: 7954 - RNA, 22 nt, Homo sapiens
gugcacaacaugcagguuuguu

SEQ ID NO: 7955 - RNA, 22 nt, Homo sapiens
auagcagugugaaaacagacug

SEQ ID NO: 7956 - RNA, 22 nt, Homo sapiens
uuucuauguugaccagucuaga

SEQ ID NO: 7957 - RNA, 22 nt, Homo sapiens
ugacaacugauuaacuccuuua

SEQ ID NO: 7958 - RNA, 22 nt, Homo sapiens
uaugugcacaugcccuggugac

SEQ ID NO: 7959 - RNA, 22 nt, Homo sapiens
uguugcacuccagccugggcaa

SEQ ID NO: 7960 - RNA, 23 nt, Homo sapiens
auugaacacuuucauaugugagg

SEQ ID NO: 7961 - RNA, 22 nt, Homo sapiens
aacacuguuuccagucaugauc

SEQ ID NO: 7962 - RNA, 22 nt, Homo sapiens
gaugcagcuaggauuugugaca

SEQ ID NO: 7963 - RNA, 22 nt, Homo sapiens
caaaugacaucauuucauucaa

SEQ ID NO: 7964 - RNA, 22 nt, Homo sapiens
ugugcaaucagcuucauuacau

SEQ ID NO: 7965 - RNA, 19 nt, Homo sapiens
ggucacagggguuacaagg

SEQ ID NO: 7966 - RNA, 22 nt, Homo sapiens
uaauacuguaauggugguuccg

SEQ ID NO: 7967 - RNA, 22 nt, Homo sapiens
ugauaacauuucuucugguaca

SEQ ID NO: 7968 - RNA, 22 nt, Homo sapiens
cuggcugagugguaaguagagg

SEQ ID NO: 7969 - RNA, 22 nt, Homo sapiens
uuucaguguggcaggcauagcu

SEQ ID NO: 7970 - RNA, 22 nt, Homo sapiens
agcugcaaagggagagaugauu

SEQ ID NO: 7971 - RNA, 22 nt, Homo sapiens
uagagcucaucuucuuuaaacu

SEQ ID NO: 7972 - RNA, 22 nt, Homo sapiens
agcaccauuagcguugggccgg

SEQ ID NO: 7973 - RNA, 22 nt, Homo sapiens
augaaaacaugauuugccuguu

SEQ ID NO: 7974 - RNA, 22 nt, Homo sapiens
uauugccuugccuacuuuucca

SEQ ID NO: 7975 - RNA, 20 nt, Homo sapiens
acacuggcuuugagauuuag

SEQ ID NO: 7976 - RNA, 22 nt, Homo sapiens
auaaaguucugcuggcauauau

SEQ ID NO: 7977 - RNA, 22 nt, Homo sapiens
gauaaaguauuggguacuaugc

SEQ ID NO: 7978 - RNA, 22 nt, Homo sapiens
cuggcaauaggcagugucccaa

SEQ ID NO: 7979 - RNA, 22 nt, Homo sapiens
agcaauaugacauugcuacauc

SEQ ID NO: 7980 - RNA, 22 nt, Homo sapiens
uugcgcuuuuccuauguugccc

SEQ ID NO: 7981 - RNA, 22 nt, Homo sapiens
uaugcuuauaaacauuugucag

SEQ ID NO: 7982 - RNA, 22 nt, Homo sapiens
uuaaaugcacauacuugagaaa

SEQ ID NO: 7983 - RNA, 22 nt, Homo sapiens
uaaugcuaucugggccaggggu

SEQ ID NO: 7984 - RNA, 22 nt, Homo sapiens
auugaacaugccauauguacca

SEQ ID NO: 7985 - RNA, 22 nt, Homo sapiens
ugagcagagggagaaguaaauu

SEQ ID NO: 7986 - RNA, 22 nt, Homo sapiens
gagaacauuuaagccacucagg

SEQ ID NO: 7987 - RNA, 20 nt, Homo sapiens
aagugaguguuaaacugaac

SEQ ID NO: 7988 - RNA, 22 nt, Homo sapiens
uucaggcaccauggucauugau

SEQ ID NO: 7989 - RNA, 19 nt, Homo sapiens
uggcuagagcagauauccu

SEQ ID NO: 7990 - RNA, 22 nt, Homo sapiens
gaggugauaucucauugugguu

SEQ ID NO: 7991 - RNA, 22 nt, Homo sapiens
gcauggagaaggggacugauuc

SEQ ID NO: 7992 - RNA, 22 nt, Homo sapiens
augaaaucuuuggcagaucuua

SEQ ID NO: 7993 - RNA, 22 nt, Homo sapiens
uuacaguaugaguaagaguucu

SEQ ID NO: 7994 - RNA, 22 nt, Homo sapiens
ugacuagagcaauuggaaacaa

SEQ ID NO: 7995 - RNA, 22 nt, Homo sapiens
guauaguaguacaaaaguuuuu

SEQ ID NO: 7996 - RNA, 22 nt, Homo sapiens
uaugcacacucucccaggaggg

SEQ ID NO: 7997 - RNA, 19 nt, Homo sapiens
uggagucaucaugcugcua

SEQ ID NO: 7998 - RNA, 22 nt, Homo sapiens
agcaccaauaacaguuucuagc

SEQ ID NO: 7999 - RNA, 22 nt, Homo sapiens
cauugcaguaagagugggcucu

SEQ ID NO: 8000 - RNA, 22 nt, Homo sapiens
aaaugcacaaagauuuugcacu

SEQ ID NO: 8001 - RNA, 22 nt, Homo sapiens
augagcuaauauggguaaguug

SEQ ID NO: 8002 - RNA, 22 nt, Homo sapiens
augaauacugcugcaaugaaca

SEQ ID NO: 8003 - RNA, 22 nt, Homo sapiens
ugagguuggguaauuuaugaag

SEQ ID NO: 8004 - RNA, 22 nt, Homo sapiens
aaagguaguacuucuagaaggg

SEQ ID NO: 8005 - RNA, 21 nt, Homo sapiens
cuaucucaguguuuacauuug

SEQ ID NO: 8006 - RNA, 22 nt, Homo sapiens
gugacagucaaagacaugacuu

SEQ ID NO: 8007 - RNA, 22 nt, Homo sapiens
ccauggcaauggucagucuauu

SEQ ID NO: 8008 - RNA, 22 nt, Homo sapiens
gugcacaacaugcaguuuuguu

SEQ ID NO: 8009 - RNA, 22 nt, Homo sapiens
uuaaagcuggcguuacaguuug

SEQ ID NO: 8010 - RNA, 22 nt, Homo sapiens
auggaguguggaacugggaauc

SEQ ID NO: 8011 - RNA, 22 nt, Homo sapiens
acauaguagacacugaaaauau

SEQ ID NO: 8012 - RNA, 22 nt, Homo sapiens
acauggcacugcgggcuucuug

SEQ ID NO: 8013 - RNA, 22 nt, Homo sapiens
agaaacauucucuugccuccuu

SEQ ID NO: 8014 - RNA, 22 nt, Homo sapiens
cauuugcacugagacucagcuu

SEQ ID NO: 8015 - RNA, 22 nt, Homo sapiens
auauucacagguaucagagauu

SEQ ID NO: 8016 - RNA, 22 nt, Homo sapiens
gaaagacuuucugcuguggaua

SEQ ID NO: 8017 - RNA, 21 nt, Homo sapiens
uauagcagcacgauuuauaau

SEQ ID NO: 8018 - RNA, 22 nt, Homo sapiens
ugagaagcauaccagugucugu

SEQ ID NO: 8019 - RNA, 22 nt, Homo sapiens
gcaaaugcuacaccauuuugua

SEQ ID NO: 8020 - RNA, 22 nt, Homo sapiens
auagcagcuugucagggcagac

SEQ ID NO: 8021 - RNA, 22 nt, Homo sapiens
uaaauugcauaaguacaaauga

SEQ ID NO: 8022 - RNA, 22 nt, Homo sapiens
uugauauguuguuagauucagu

SEQ ID NO: 8023 - RNA, 22 nt, Homo sapiens
uuggagagaaaggcaguuccug

SEQ ID NO: 8024 - RNA, 22 nt, Homo sapiens
uaaaugcuuaauugaaugugga

SEQ ID NO: 8025 - RNA, 22 nt, Homo sapiens
uauagcuaugggauguauuugc

SEQ ID NO: 8026 - RNA, 22 nt, Homo sapiens
auagaaucaucugugcacuagu

SEQ ID NO: 8027 - RNA, 22 nt, Homo sapiens
aggaagguaaacuaacuugccu

SEQ ID NO: 8028 - RNA, 22 nt, Homo sapiens
cucacggcccugcgcacuggca

SEQ ID NO: 8029 - RNA, 22 nt, Homo sapiens
uagcaguaucccaccaucuggu

SEQ ID NO: 8030 - RNA, 22 nt, Homo sapiens
agagugaagcuuuuuauauucu

SEQ ID NO: 8031 - RNA, 22 nt, Homo sapiens
uucaaaguaaagggauggagac

SEQ ID NO: 8032 - RNA, 22 nt, Homo sapiens
uuggacuucucaaggcaauaaa

SEQ ID NO: 8033 - RNA, 22 nt, Homo sapiens
gaaucauuguuucuaaguuugu

SEQ ID NO: 8034 - RNA, 22 nt, Homo sapiens
gugcacaaaucuuaaauguaca

SEQ ID NO: 8035 - RNA, 22 nt, Homo sapiens
uaugcacacacguguuuaugug

SEQ ID NO: 8036 - RNA, 22 nt, Homo sapiens
cuggcaauaaauuuuuguguug

SEQ ID NO: 8037 - RNA, 22 nt, Homo sapiens
gugcacaacguguagguuuguu

SEQ ID NO: 8038 - RNA, 22 nt, Homo sapiens
cucacugucaacauguauuugg

SEQ ID NO: 8039 - RNA, 22 nt, Homo sapiens
aaugacuaagaugguacauuuu

SEQ ID NO: 8040 - RNA, 22 nt, Homo sapiens
gugauuauccacgucuuuguga

SEQ ID NO: 8041 - RNA, 22 nt, Homo sapiens
uccaugugaaaaggucgugaua

SEQ ID NO: 8042 - RNA, 22 nt, Homo sapiens
agcugcaauguuuaguauaaua

SEQ ID NO: 8043 - RNA, 22 nt, Homo sapiens
uugguccccuucaaccagcugu

SEQ ID NO: 8044 - RNA, 22 nt, Homo sapiens
aagaccuaugcaggaagaaaug

SEQ ID NO: 8045 - RNA, 21 nt, Homo sapiens
uggucccauaagauuacaaug

SEQ ID NO: 8046 - RNA, 22 nt, Homo sapiens
aaucacaggucuuggcugcaug

SEQ ID NO: 8047 - RNA, 17 nt, Homo sapiens
gugagguggguaguauc

SEQ ID NO: 8048 - RNA, 22 nt, Homo sapiens
gugguguuugagcugccaggga

SEQ ID NO: 8049 - RNA, 22 nt, Homo sapiens
uggcgagaugcucgugugcaga

SEQ ID NO: 8050 - RNA, 22 nt, Homo sapiens
uuuaaagcuaaaauauguuuau

SEQ ID NO: 8051 - RNA, 22 nt, Homo sapiens
ugagaacuaaaaugugguauau

SEQ ID NO: 8052 - RNA, 22 nt, Homo sapiens
uuaacagcacaugcugucccuu

SEQ ID NO: 8053 - RNA, 22 nt, Homo sapiens
auagcauagucagcuucgcuga

SEQ ID NO: 8054 - RNA, 22 nt, Homo sapiens
uaucauggggacugcagccuag

SEQ ID NO: 8055 - RNA, 19 nt, Homo sapiens
uggcaaugucagcagagau

SEQ ID NO: 8056 - RNA, 22 nt, Homo sapiens
accaguuuuuuauacaucuucu

SEQ ID NO: 8057 - RNA, 22 nt, Homo sapiens
gccaagaagugucuaagcagga

SEQ ID NO: 8058 - RNA, 23 nt, Homo sapiens
ucugcggguguggacccuagugc

SEQ ID NO: 8059 - RNA, 20 nt, Homo sapiens
gacauagagacucucaaaaa

SEQ ID NO: 8060 - RNA, 22 nt, Homo sapiens
uucaauacuguugauccuuaug

SEQ ID NO: 8061 - RNA, 22 nt, Homo sapiens
uagcaccuuagcauuucuagug

SEQ ID NO: 8062 - RNA, 22 nt, Homo sapiens
guaacacaugcugcucucuggu

SEQ ID NO: 8063 - RNA, 22 nt, Homo sapiens
uaucacagguggacugcacacc

SEQ ID NO: 8064 - RNA, 22 nt, Homo sapiens
aaauugcaguuaggaugauggu

SEQ ID NO: 8065 - RNA, 22 nt, Homo sapiens
uuaaaaguauaggccuggcaua

SEQ ID NO: 8066 - RNA, 22 nt, Homo sapiens
ugcauuguuuagaaacacuggg

SEQ ID NO: 8067 - RNA, 22 nt, Homo sapiens
agcaccaauaaucagaguucuu

SEQ ID NO: 8068 - RNA, 22 nt, Homo sapiens
guacaguacugaaugaauguau

SEQ ID NO: 8069 - RNA, 22 nt, Homo sapiens
uguugcacuccagccuggguga

SEQ ID NO: 8070 - RNA, 22 nt, Homo sapiens
ucaacagugggcacuguaaaug

SEQ ID NO: 8071 - RNA, 22 nt, Homo sapiens
gggaggucauuguucaaugcug

SEQ ID NO: 8072 - RNA, 22 nt, Homo sapiens
ccacaguggauuaaaguuacug

SEQ ID NO: 8073 - RNA, 22 nt, Homo sapiens
uuaucauagugcaguuuucuga

SEQ ID NO: 8074 - RNA, 22 nt, Homo sapiens
gagaacauuaauaguuaauuuu

SEQ ID NO: 8075 - RNA, 22 nt, Homo sapiens
gaucugugugauuggaugcauu

SEQ ID NO: 8076 - RNA, 22 nt, Homo sapiens
aaagugaauguaucccguaagu

SEQ ID NO: 8077 - RNA, 22 nt, Homo sapiens
gucagucugucccugccuggcg

SEQ ID NO: 8078 - RNA, 22 nt, Homo sapiens
auaugcacgugcauacacacuu

SEQ ID NO: 8079 - RNA, 22 nt, Homo sapiens
cuacaguaugaaaccuuuacuc

SEQ ID NO: 8080 - RNA, 22 nt, Homo sapiens
gacagugagaugucaugugaaa

SEQ ID NO: 8081 - RNA, 22 nt, Homo sapiens
guagcagaacauguuccuugua

SEQ ID NO: 8082 - RNA, 22 nt, Homo sapiens
agagguaagcaguggcaagugc

SEQ ID NO: 8083 - RNA, 22 nt, Homo sapiens
auaacagcauuauugcauacgu

SEQ ID NO: 8084 - RNA, 22 nt, Homo sapiens
uuuaaugcaucccaaaauguag

SEQ ID NO: 8085 - RNA, 20 nt, Homo sapiens
ccccaguuuuucuauuagcu

SEQ ID NO: 8086 - RNA, 20 nt, Homo sapiens
cuucacagaaguggaaucau

SEQ ID NO: 8087 - RNA, 22 nt, Homo sapiens
caauggcaaugaaauagugaga

SEQ ID NO: 8088 - RNA, 22 nt, Homo sapiens
uagcagcaccccacucuacugg

SEQ ID NO: 8089 - RNA, 22 nt, Homo sapiens
uacaauagugacaaaucagcau

SEQ ID NO: 8090 - RNA, 22 nt, Homo sapiens
caaaggcuuccacugcauccuu

SEQ ID NO: 8091 - RNA, 22 nt, Homo sapiens
auuaaguuaggauuuugagaua

SEQ ID NO: 8092 - RNA, 19 nt, Homo sapiens
cugugcauuucuguggaag

SEQ ID NO: 8093 - RNA, 22 nt, Homo sapiens
cuaaggaaggacugaaaggaca

SEQ ID NO: 8094 - RNA, 22 nt, Homo sapiens
auuacaugucuauccaugaaca

SEQ ID NO: 8095 - RNA, 17 nt, Homo sapiens
auaugaauuuuggagau

SEQ ID NO: 8096 - RNA, 22 nt, Homo sapiens
uaacaguguauuccuuuggaca

SEQ ID NO: 8097 - RNA, 22 nt, Homo sapiens
aaaugcacagaaaggaugugga

SEQ ID NO: 8098 - RNA, 22 nt, Homo sapiens
ugagaggugauaaagcaagggu

SEQ ID NO: 8099 - RNA, 22 nt, Homo sapiens
uugaaagucuaggcuuacagua

SEQ ID NO: 8100 - RNA, 22 nt, Homo sapiens
ugagaucaacugagucagagca

SEQ ID NO: 8101 - RNA, 22 nt, Homo sapiens
aaggaguagaauagaugcaccu

SEQ ID NO: 8102 - RNA, 22 nt, Homo sapiens
gaaugcuaccagcaucuagugg

SEQ ID NO: 8103 - RNA, 22 nt, Homo sapiens
acccauguaggugggauuacag

SEQ ID NO: 8104 - RNA, 22 nt, Homo sapiens
uaauagcaguguuacuaggacu

SEQ ID NO: 8105 - RNA, 22 nt, Homo sapiens
uuggagugugcucauaacugcu

SEQ ID NO: 8106 - RNA, 22 nt, Homo sapiens
uaaugcacucgaaucauggaau

SEQ ID NO: 8107 - RNA, 22 nt, Homo sapiens
auagacacugaaaucccugcca

SEQ ID NO: 8108 - RNA, 22 nt, Homo sapiens
cugaaaguuauucaggggcaag

SEQ ID NO: 8109 - RNA, 22 nt, Homo sapiens
aacauuaaaccacccgauucac

SEQ ID NO: 8110 - RNA, 21 nt, Homo sapiens
auagggcuuguugauaguuaa

SEQ ID NO: 8111 - RNA, 22 nt, Homo sapiens
guuauguaucuugauugggugg

SEQ ID NO: 8112 - RNA, 22 nt, Homo sapiens
ggagcucaucuagcauagaggu

SEQ ID NO: 8113 - RNA, 19 nt, Homo sapiens
uacuggcucgggaauuuuc

SEQ ID NO: 8114 - RNA, 21 nt, Homo sapiens
uuuggcuucucugcugcagcc

SEQ ID NO: 8115 - RNA, 22 nt, Homo sapiens
cuaggcuguagagaaguucagu

SEQ ID NO: 8116 - RNA, 21 nt, Homo sapiens
uagagagcaauaccuccagag

SEQ ID NO: 8117 - RNA, 22 nt, Homo sapiens
augagauacuacaaaugaguuu

SEQ ID NO: 8118 - RNA, 22 nt, Homo sapiens
ucccauguagcuaggauuacag

SEQ ID NO: 8119 - RNA, 22 nt, Homo sapiens
caaauacuuucauguugucuug

SEQ ID NO: 8120 - RNA, 22 nt, Homo sapiens
uucaagucaaggaaagaggucu

SEQ ID NO: 8121 - RNA, 22 nt, Homo sapiens
agaggucuuaucaaacaugcuu

SEQ ID NO: 8122 - RNA, 22 nt, Homo sapiens
uuggagagugauauucagaugc

SEQ ID NO: 8123 - RNA, 22 nt, Homo sapiens
ugaaagcuacagucuccuagga

SEQ ID NO: 8124 - RNA, 22 nt, Homo sapiens
aggugguuuugaugagcaggua

SEQ ID NO: 8125 - RNA, 23 nt, Homo sapiens
uggaggacaagcauggauaguga

SEQ ID NO: 8126 - RNA, 22 nt, Homo sapiens
uacacagucaaaaauuuccagg

SEQ ID NO: 8127 - RNA, 22 nt, Homo sapiens
uacucaauugcagucaccuggc

SEQ ID NO: 8128 - RNA, 22 nt, Homo sapiens
uaugcacaugcaugcuugaaua

SEQ ID NO: 8129 - RNA, 22 nt, Homo sapiens
uuaaagugaucauaaggauagu

SEQ ID NO: 8130 - RNA, 22 nt, Homo sapiens
ggaaagauguaauauuaucuaa

SEQ ID NO: 8131 - RNA, 22 nt, Homo sapiens
uuaaaugcucacauaaagguag

SEQ ID NO: 8132 - RNA, 22 nt, Homo sapiens
cuagcuuuugauguaaagugag

SEQ ID NO: 8133 - RNA, 22 nt, Homo sapiens
aagucaguuugggagaagcuau

SEQ ID NO: 8134 - RNA, 22 nt, Homo sapiens
gaggcuagauggggaugugucc

SEQ ID NO: 8135 - RNA, 22 nt, Homo sapiens
augugaaugugaucggauaguc

SEQ ID NO: 8136 - RNA, 22 nt, Homo sapiens
gaauuguacugcaaucagggga

SEQ ID NO: 8137 - RNA, 22 nt, Homo sapiens
aaaugcuucuauguggcauguu

SEQ ID NO: 8138 - RNA, 22 nt, Homo sapiens
ucaaaugcucuuugcagagagg

SEQ ID NO: 8139 - RNA, 19 nt, Homo sapiens
augagucugcaagaaccag

SEQ ID NO: 8140 - RNA, 22 nt, Homo sapiens
agagauuauccuggcuucucug

SEQ ID NO: 8141 - RNA, 22 nt, Homo sapiens
ucucaguguuaucuaucugccu

SEQ ID NO: 8142 - RNA, 22 nt, Homo sapiens
uuaaggaaagcauuuaauucag

SEQ ID NO: 8143 - RNA, 22 nt, Homo sapiens
auagcaaugcaagaauggcuua

SEQ ID NO: 8144 - RNA, 22 nt, Homo sapiens
gcaccacugcacucucagcuug

SEQ ID NO: 8145 - RNA, 22 nt, Homo sapiens
aaucugggguuguuuggggagu

SEQ ID NO: 8146 - RNA, 22 nt, Homo sapiens
aaggaauucaaauuuucucugg

SEQ ID NO: 8147 - RNA, 22 nt, Homo sapiens
cagugcauaggaucuaaaauuu

SEQ ID NO: 8148 - RNA, 23 nt, Homo sapiens
uaucucaaugcacagagaggaaa

SEQ ID NO: 8149 - RNA, 22 nt, Homo sapiens
guucacagugguugccuuccag

SEQ ID NO: 8150 - RNA, 17 nt, Homo sapiens
ucccauguuucuucuac

SEQ ID NO: 8151 - RNA, 22 nt, Homo sapiens
uagcaucagauuccauauucua

SEQ ID NO: 8152 - RNA, 22 nt, Homo sapiens
gauaucuuuuguauggugagcu

SEQ ID NO: 8153 - RNA, 22 nt, Homo sapiens
uuuaaagcaugacgagaagaag

SEQ ID NO: 8154 - RNA, 22 nt, Homo sapiens
aaugcacauauauuuccuuauu

SEQ ID NO: 8155 - RNA, 22 nt, Homo sapiens
aauuacauggcaauugggaaau

SEQ ID NO: 8156 - RNA, 22 nt, Homo sapiens
ugucuuguagacaauguauagu

SEQ ID NO: 8157 - RNA, 22 nt, Homo sapiens
uugaaagcuaucucaaaucgcu

SEQ ID NO: 8158 - RNA, 22 nt, Homo sapiens
uagcugagacuacaguaggugc

SEQ ID NO: 8159 - RNA, 21 nt, Homo sapiens
uggcaacauggauggauucug

SEQ ID NO: 8160 - RNA, 22 nt, Homo sapiens
uaugcacaugugccugggugug

SEQ ID NO: 8161 - RNA, 22 nt, Homo sapiens
gugcacaaugugcagguuuguu

SEQ ID NO: 8162 - RNA, 22 nt, Homo sapiens
gugcacaacgugcaggcuuguu

SEQ ID NO: 8163 - RNA, 22 nt, Homo sapiens
caacagucagcccauccacaga

SEQ ID NO: 8164 - RNA, 22 nt, Homo sapiens
uggcagauaggauacaggacua

SEQ ID NO: 8165 - RNA, 22 nt, Homo sapiens
ugagcacauuuacaucaguucc

SEQ ID NO: 8166 - RNA, 22 nt, Homo sapiens
ggagucugauuuuuauguugcu

SEQ ID NO: 8167 - RNA, 22 nt, Homo sapiens
agaaugucaguauuggcuaaaa

SEQ ID NO: 8168 - RNA, 22 nt, Homo sapiens
ugaaggacauucuaugguagau

SEQ ID NO: 8169 - RNA, 22 nt, Homo sapiens
augccuagagucaguggaggug

SEQ ID NO: 8170 - RNA, 23 nt, Homo sapiens
cccaguuaauccuuaaucuccac

SEQ ID NO: 8171 - RNA, 22 nt, Homo sapiens
cuugaucaaugugguacuugau

SEQ ID NO: 8172 - RNA, 22 nt, Homo sapiens
aucauggaguauuugcaagucu

SEQ ID NO: 8173 - RNA, 22 nt, Homo sapiens
gugcacaacgugcagguuuguu

SEQ ID NO: 8174 - RNA, 22 nt, Homo sapiens
agugcauuuguucugugucagg

SEQ ID NO: 8175 - RNA, 22 nt, Homo sapiens
ugaaguaauguuuuauucuauu

SEQ ID NO: 8176 - RNA, 22 nt, Homo sapiens
ugugcaugacagcauacaaacg

SEQ ID NO: 8177 - RNA, 22 nt, Homo sapiens
ugaagcuaacuugauugugaug

SEQ ID NO: 8178 - RNA, 22 nt, Homo sapiens
uagagcacauuaucauuuccaa

SEQ ID NO: 8179 - RNA, 18 nt, Homo sapiens
uagaauauaggucauucu

SEQ ID NO: 8180 - RNA, 22 nt, Homo sapiens
auggucccauucauucacguau

SEQ ID NO: 8181 - RNA, 22 nt, Homo sapiens
acaucuguacaguggguguggu

SEQ ID NO: 8182 - RNA, 22 nt, Homo sapiens
cuagcagacaugggcugaacca

SEQ ID NO: 8183 - RNA, 22 nt, Homo sapiens
caaaagugauugcgguuuuugc

SEQ ID NO: 8184 - RNA, 22 nt, Homo sapiens
cacccuaucagauguccagaga

SEQ ID NO: 8185 - RNA, 22 nt, Homo sapiens
uaacuaaagagaagucaauguc

SEQ ID NO: 8186 - RNA, 22 nt, Homo sapiens
ggaaagacaccuuacuauguua

SEQ ID NO: 8187 - RNA, 22 nt, Homo sapiens
uauauguuuucauaaggcuaga

SEQ ID NO: 8188 - RNA, 22 nt, Homo sapiens
augaaagguauguuuucuguga

SEQ ID NO: 8189 - RNA, 22 nt, Homo sapiens
ggcaaugaggcggaccagcagg

SEQ ID NO: 8190 - RNA, 22 nt, Homo sapiens
ucaaaugcacguagagaaaaua

SEQ ID NO: 8191 - RNA, 22 nt, Homo sapiens
gagaaugcaugaaagacuuaca

SEQ ID NO: 8192 - RNA, 22 nt, Homo sapiens
uauaacaaugcaagaauggccu

SEQ ID NO: 8193 - RNA, 22 nt, Homo sapiens
gauggaguaauguaaucuugag

SEQ ID NO: 8194 - RNA, 22 nt, Homo sapiens
uauggcaaugcauaggaaggaa

SEQ ID NO: 8195 - RNA, 20 nt, Homo sapiens
uauaacaguuuggacccagu

SEQ ID NO: 8196 - RNA, 18 nt, Homo sapiens
gucucacaugguggaagc

SEQ ID NO: 8197 - RNA, 22 nt, Homo sapiens
uggaguguagaagccagccucc

SEQ ID NO: 8198 - RNA, 19 nt, Homo sapiens
auacacguguauacauaca

SEQ ID NO: 8199 - RNA, 22 nt, Homo sapiens
aucuuuaguggcuguuuucaga

SEQ ID NO: 8200 - RNA, 22 nt, Homo sapiens
guuugccuuuuagauaggaaug

SEQ ID NO: 8201 - RNA, 22 nt, Homo sapiens
uuucugggggugcugauggaaa

SEQ ID NO: 8202 - RNA, 22 nt, Homo sapiens
uagaauguaaauuccaagggca

SEQ ID NO: 8203 - RNA, 22 nt, Homo sapiens
augauggagguagauuguccau

SEQ ID NO: 8204 - RNA, 22 nt, Homo sapiens
uaaagcuaucacauuggugauu

SEQ ID NO: 8205 - RNA, 22 nt, Homo sapiens
ucagauacuggugacaugaaug

SEQ ID NO: 8206 - RNA, 22 nt, Homo sapiens
aaaugcaccacucuggugcagg

SEQ ID NO: 8207 - RNA, 22 nt, Homo sapiens
uggagaacauucauuugcaaga

SEQ ID NO: 8208 - RNA, 22 nt, Homo sapiens
gacacugucuucugcucuuaaa

SEQ ID NO: 8209 - RNA, 22 nt, Homo sapiens
ucuuuggauggaaauuggaguc

SEQ ID NO: 8210 - RNA, 22 nt, Homo sapiens
uuggacuggaacuauaccauug

SEQ ID NO: 8211 - RNA, 22 nt, Homo sapiens
caagugaauaguugcucucaga

SEQ ID NO: 8212 - RNA, 22 nt, Homo sapiens
uuggagagucacuaguuagugc

SEQ ID NO: 8213 - RNA, 22 nt, Homo sapiens
aaaguggugugaguauguaucu

SEQ ID NO: 8214 - RNA, 22 nt, Homo sapiens
uugaaggaggugcucacucucg

SEQ ID NO: 8215 - RNA, 22 nt, Homo sapiens
ugcugcaaacaggcaucugugg

SEQ ID NO: 8216 - RNA, 22 nt, Homo sapiens
ugaaauguuaaacaaguggcuc

SEQ ID NO: 8217 - RNA, 21 nt, Homo sapiens
cuaaggaaagcuaugaacccu

SEQ ID NO: 8218 - RNA, 22 nt, Homo sapiens
aauggcaaauguuuucuguuga

SEQ ID NO: 8219 - RNA, 22 nt, Homo sapiens
uguggaguguaugugacagaga

SEQ ID NO: 8220 - RNA, 22 nt, Homo sapiens
ccauugaacaugaaggaaugug

SEQ ID NO: 8221 - RNA, 22 nt, Homo sapiens
gaaugaauguuuauccuuagau

SEQ ID NO: 8222 - RNA, 18 nt, Homo sapiens
ucacugugugucuugggu

SEQ ID NO: 8223 - RNA, 21 nt, Haemophilus influenzae Rd
uuuccagugcuuuauauuaag

SEQ ID NO: 8224 - RNA, 21 nt, Haemophilus influenzae Rd
uucuuucguuuguccaggcaa

SEQ ID NO: 8225 - RNA, 22 nt, Haemophilus influenzae Rd
uugacaauggguuuugaugaug

SEQ ID NO: 8226 - RNA, 22 nt, Haemophilus influenzae Rd
uuaaugcacgaccacgguuugu

SEQ ID NO: 8227 - RNA, 18 nt, Haemophilus influenzae Rd
uuagaacuuuaucaugcu

SEQ ID NO: 8228 - RNA, 22 nt, Haemophilus influenzae Rd
uuauaaauaucaguauagcaac

SEQ ID NO: 8229 - RNA, 22 nt, Haemophilus influenzae Rd
uuaauaaagguggugcgaccgu

SEQ ID NO: 8230 - RNA, 22 nt, Haemophilus influenzae Rd
ucuuccuuaaaacaacagcuuu

SEQ ID NO: 8231 - RNA, 22 nt, Haemophilus influenzae Rd
cggaagcguuagcagcagcaaa

SEQ ID NO: 8232 - RNA, 22 nt, Haemophilus influenzae Rd
caucuuguuuuuaugccugaaa

SEQ ID NO: 8233 - RNA, 22 nt, Haemophilus influenzae Rd
ccccuuccgcccuucgggcacc

SEQ ID NO: 8234 - RNA, 22 nt, Haemophilus influenzae Rd
auuacuuauaugaucauagccu

SEQ ID NO: 8235 - RNA, 22 nt, Haemophilus influenzae Rd
auuuaaaauggcaucggcuugu

SEQ ID NO: 8236 - RNA, 22 nt, Haemophilus influenzae Rd
auguauuccguucaagaacaaa

SEQ ID NO: 8237 - RNA, 22 nt, Haemophilus influenzae Rd
auguggaaaaugugagcaagcu

SEQ ID NO: 8238 - RNA, 22 nt, Haemophilus influenzae Rd
cacuagaacaguuuuagaaugc

SEQ ID NO: 8239 - RNA, 19 nt, Haemophilus influenzae Rd
auuuucuaccaacauugca

SEQ ID NO: 8240 - RNA, 23 nt, Haemophilus influenzae Rd
auauuguggcucaauuggcuugg

SEQ ID NO: 8241 - RNA, 22 nt, Haemophilus influenzae Rd
auacaauauuggcuaugaugca

SEQ ID NO: 8242 - RNA, 22 nt, Haemophilus influenzae Rd
auaggauggguuucugcccacc

SEQ ID NO: 8243 - RNA, 20 nt, Haemophilus influenzae Rd
agauuguuguggcaaauuuc

SEQ ID NO: 8244 - RNA, 22 nt, Haemophilus influenzae Rd
agcaacuuuuacuuuaaugagu

SEQ ID NO: 8245 - RNA, 18 nt, Haemophilus influenzae Rd
acuuuuaacacuuaguca

SEQ ID NO: 8246 - RNA, 22 nt, Haemophilus influenzae Rd
accauuuacuaauaagcgauug

SEQ ID NO: 8247 - RNA, 22 nt, Haemophilus influenzae Rd
acgagcgugguaucaacguuug

SEQ ID NO: 8248 - RNA, 22 nt, Haemophilus influenzae Rd
agcagcugauuguauuggaaga

SEQ ID NO: 8249 - RNA, 22 nt, Haemophilus influenzae Rd
aaaaaaagaggcgugauuauag

SEQ ID NO: 8250 - RNA, 22 nt, Haemophilus influenzae Rd
aacaaugccacugccauaacga

SEQ ID NO: 8251 - RNA, 22 nt, Haemophilus influenzae Rd
aacuaggauuagcaagcauauu

SEQ ID NO: 8252 - RNA, 22 nt, Haemophilus influenzae Rd
aauuaaaacaucagguuuauua

SEQ ID NO: 8253 - RNA, 22 nt, Haemophilus influenzae Rd
aauaaauugaagcaauugguug

SEQ ID NO: 8254 - RNA, 22 nt, Haemophilus influenzae Rd
aaauauugugacaaaugauauu

SEQ ID NO: 8255 - RNA, 22 nt, Haemophilus influenzae Rd
aaacaucacaucagaaagauca

SEQ ID NO: 8256 - RNA, 22 nt, Haemophilus influenzae Rd
aauuuauccucugauguagggc

SEQ ID NO: 8257 - RNA, 22 nt, Haemophilus influenzae Rd
aauaacaugguacgagaugcgu

SEQ ID NO: 8258 - RNA, 22 nt, Haemophilus influenzae Rd
ucgcuagaaugaggcguuuaau

SEQ ID NO: 8259 - RNA, 22 nt, Haemophilus influenzae Rd
ucccaauuuagcugccgugauu

SEQ ID NO: 8260 - RNA, 22 nt, Haemophilus influenzae Rd
uauuuuaacggugaugacaauc

SEQ ID NO: 8261 - RNA, 22 nt, Haemophilus influenzae Rd
uaaugauuuacaaagcauacau

SEQ ID NO: 8262 - RNA, 22 nt, Haemophilus influenzae Rd
uaauuauuggcaucguuuuagg

SEQ ID NO: 8263 - RNA, 22 nt, Haemophilus influenzae Rd
guugggaacccuggauguggug

SEQ ID NO: 8264 - RNA, 22 nt, Haemophilus influenzae Rd
guauuucaucacgucuuacuuu

SEQ ID NO: 8265 - RNA, 22 nt, Haemophilus influenzae Rd
ccccuucaaauauaacgacguu

SEQ ID NO: 8266 - RNA, 22 nt, Haemophilus influenzae Rd
gcauaacagaacccaguuaaac

SEQ ID NO: 8267 - RNA, 22 nt, Haemophilus influenzae Rd
gaaaaugugcggugcaaaacau

SEQ ID NO: 8268 - RNA, 22 nt, Haemophilus influenzae Rd
ucaucuuuuacgaagugcaucg

SEQ ID NO: 8269 - RNA, 22 nt, Haemophilus influenzae Rd
uaugaacucgcgaacgaagaga

SEQ ID NO: 8270 - RNA, 22 nt, Haemophilus influenzae Rd
uauuguuaaagugaaaaauggu

SEQ ID NO: 8271 - RNA, 22 nt, Haemophilus influenzae Rd
uaauauaacggacguagaugac

SEQ ID NO: 8272 - RNA, 22 nt, Haemophilus influenzae Rd
uacaaaauuaccgcacuuuagg

SEQ ID NO: 8273 - RNA, 22 nt, Haemophilus influenzae Rd
ugcgguaaaaaauucgaggguu

SEQ ID NO: 8274 - RNA, 19 nt, Haemophilus influenzae Rd
ugccggcguggcgauugca

SEQ ID NO: 8275 - RNA, 22 nt, Haemophilus influenzae Rd
caaaugaucggcuucuuuuucu

SEQ ID NO: 8276 - RNA, 22 nt, Haemophilus influenzae Rd
auuaaugaauuacgauuucacc

SEQ ID NO: 8277 - RNA, 22 nt, Haemophilus influenzae Rd
auguuggaucgggcgcaauaag

SEQ ID NO: 8278 - RNA, 22 nt, Haemophilus influenzae Rd
aucaacuugcuaaagauuuagu

SEQ ID NO: 8279 - RNA, 22 nt, Haemophilus influenzae Rd
auauuucacaaugucagaagau

SEQ ID NO: 8280 - RNA, 22 nt, Haemophilus influenzae Rd
auauucuuauugcaacuuaugc

SEQ ID NO: 8281 - RNA, 22 nt, Haemophilus influenzae Rd
uugcggaaaacagucguuuauu

SEQ ID NO: 8282 - RNA, 22 nt, Haemophilus influenzae Rd
uaaauauuacguaacugaaaug

SEQ ID NO: 8283 - RNA, 22 nt, Haemophilus influenzae Rd
gugggaugcucguuuaacugca

SEQ ID NO: 8284 - RNA, 21 nt, Haemophilus influenzae Rd
gcaaaugugauuugccccuac

SEQ ID NO: 8285 - RNA, 22 nt, Homo sapiens
cuggaggccugaacauaaaugg

SEQ ID NO: 8286 - RNA, 22 nt, Homo sapiens
uuaaaugcuagaauuuucuuug

SEQ ID NO: 8287 - RNA, 20 nt, Homo sapiens
uauucacucuccagucuugc

SEQ ID NO: 8288 - RNA, 22 nt, Homo sapiens
gagcuagguuuugaauccagac

SEQ ID NO: 8289 - RNA, 22 nt, Homo sapiens
uggaaguauagauaauugaaag

SEQ ID NO: 8290 - RNA, 22 nt, Homo sapiens
ucacuagaucaagggagagaaa

SEQ ID NO: 8291 - RNA, 22 nt, Homo sapiens
auaagugagugauucaguguua

SEQ ID NO: 8292 - RNA, 22 nt, Homo sapiens
uagccucacaaagugcuuaaga

SEQ ID NO: 8293 - RNA, 22 nt, Homo sapiens
uucagggacuuuagacaagaga

SEQ ID NO: 8294 - RNA, 22 nt, Homo sapiens
cugggaugugacuguugccccc

SEQ ID NO: 8295 - RNA, 23 nt, Homo sapiens
ucaugaggccauucaaauccauu

SEQ ID NO: 8296 - RNA, 22 nt, Homo sapiens
ugacuaggaggcuggaggauga

SEQ ID NO: 8297 - RNA, 17 nt, Homo sapiens
guuuggguacuggguaa

SEQ ID NO: 8298 - RNA, 22 nt, Homo sapiens
agcgccacugcacuccagccug

SEQ ID NO: 8299 - RNA, 22 nt, Homo sapiens
aagcuggauuucgcauccuguu

SEQ ID NO: 8300 - RNA, 22 nt, Homo sapiens
augacuagaggagggauggcca

SEQ ID NO: 8301 - RNA, 23 nt, Homo sapiens
ugugcacauuuacauauauacac

SEQ ID NO: 8302 - RNA, 22 nt, Homo sapiens
uaugcacacacguguuuaugug

SEQ ID NO: 8303 - RNA, 22 nt, Homo sapiens
acugaucaauguuaaggcuuau

SEQ ID NO: 8304 - RNA, 22 nt, Homo sapiens
agugacaugggaucaaaucuga

SEQ ID NO: 8305 - RNA, 22 nt, Homo sapiens
ugugguuuuaguaaaacuaugu

SEQ ID NO: 8306 - RNA, 22 nt, Homo sapiens
ugaauagacacuaaagacugua

SEQ ID NO: 8307 - RNA, 22 nt, Homo sapiens
gaacuguuucuggugaaagagu

SEQ ID NO: 8308 - RNA, 22 nt, Homo sapiens
ugacuauaggauaacaugcauu

SEQ ID NO: 8309 - RNA, 19 nt, Homo sapiens
uuucaauguaaggauggag

SEQ ID NO: 8310 - RNA, 22 nt, Homo sapiens
ucacugaggucugagcuuuaug

SEQ ID NO: 8311 - RNA, 22 nt, Homo sapiens
uuagaacuagaggaguuugagu

SEQ ID NO: 8312 - RNA, 22 nt, Homo sapiens
ggacuagggacauggggagcug

SEQ ID NO: 8313 - RNA, 22 nt, Homo sapiens
uuaauguaucuaucacaucaca

SEQ ID NO: 8314 - RNA, 22 nt, Homo sapiens
aauacugaaaguauuuucaaau

SEQ ID NO: 8315 - RNA, 20 nt, Homo sapiens
uggaacuuaauugauggaca

SEQ ID NO: 8316 - RNA, 22 nt, Homo sapiens
augcacauggcuaacuuuuuuc

SEQ ID NO: 8317 - RNA, 23 nt, Homo sapiens
uggaaguauggaggaggcagaau

SEQ ID NO: 8318 - RNA, 22 nt, Homo sapiens
ugacuaggggcccuggcuucuu

SEQ ID NO: 8319 - RNA, 22 nt, Homo sapiens
gacuaggagagcagcugcccau

SEQ ID NO: 8320 - RNA, 22 nt, Homo sapiens
guggaagugucuggggccaggg

SEQ ID NO: 8321 - RNA, 22 nt, Homo sapiens
uuuaaugcgucucugaguuuug

SEQ ID NO: 8322 - RNA, 22 nt, Homo sapiens
uggaaguaaucaugagguagca

SEQ ID NO: 8323 - RNA, 22 nt, Homo sapiens
aagcuggauuuaguguggagca

SEQ ID NO: 8324 - RNA, 22 nt, Homo sapiens
uugugguuuuuaaaacuaggug

SEQ ID NO: 8325 - RNA, 22 nt, Homo sapiens
augacuauugcacuuuccuggu

SEQ ID NO: 8326 - RNA, 22 nt, Homo sapiens
cuuuaugagguuggauggaucu

SEQ ID NO: 8327 - RNA, 22 nt, Homo sapiens
uggagacugaucccucuuuccu

SEQ ID NO: 8328 - RNA, 22 nt, Homo sapiens
cuagaacuagaacugcuggggu

SEQ ID NO: 8329 - RNA, 22 nt, Homo sapiens
uagcuggaguuuuuguuauagg

SEQ ID NO: 8330 - RNA, 22 nt, Homo sapiens
gagguauagaacaccuuucaag

SEQ ID NO: 8331 - RNA, 22 nt, Homo sapiens
guuaagaaguguaacuuaaguu

SEQ ID NO: 8332 - RNA, 22 nt, Homo sapiens
ucacaggguguuauuagaauua

SEQ ID NO: 8333 - RNA, 22 nt, Homo sapiens
augaggcaggaaaggcguaucu

SEQ ID NO: 8334 - RNA, 22 nt, Homo sapiens
ugacuagggacauucuuccacg

SEQ ID NO: 8335 - RNA, 22 nt, Homo sapiens
gugcacaaucgugcauuccuug

SEQ ID NO: 8336 - RNA, 18 nt, Homo sapiens
ucacuagacacugaaucu

SEQ ID NO: 8337 - RNA, 22 nt, Homo sapiens
gacuaggagauauguuuucuuc

SEQ ID NO: 8338 - RNA, 22 nt, Homo sapiens
aucagaaucucuagugggacca

SEQ ID NO: 8339 - RNA, 22 nt, Homo sapiens
cuuuggcauuagccuguauaga

SEQ ID NO: 8340 - RNA, 22 nt, Homo sapiens
uuggauuuuaacaaacuaggug

SEQ ID NO: 8341 - RNA, 22 nt, Homo sapiens
gaagcauugauccacaggcgug

SEQ ID NO: 8342 - RNA, 22 nt, Homo sapiens
uugggacuggaaggaguaaggg

SEQ ID NO: 8343 - RNA, 22 nt, Homo sapiens
ggcagcucaggccccgcgcuga

SEQ ID NO: 8344 - RNA, 22 nt, Homo sapiens
auacuguuuuacaucauugccu

SEQ ID NO: 8345 - RNA, 22 nt, Homo sapiens
guggcgagaucauagcucauug

SEQ ID NO: 8346 - RNA, 22 nt, Homo sapiens
gaaugauacuguuaacgaaaga

SEQ ID NO: 8347 - RNA, 22 nt, Homo sapiens
uggaaguaaccaugaauggaau

SEQ ID NO: 8348 - RNA, 22 nt, Homo sapiens
uaugcacaugcaugcuugaaua

SEQ ID NO: 8349 - RNA, 22 nt, Homo sapiens
gaagcgaggugauuagcagaca

SEQ ID NO: 8350 - RNA, 22 nt, Homo sapiens
uauggauuuuuuugacaagagc

SEQ ID NO: 8351 - RNA, 22 nt, Homo sapiens
aaaugcacaaagauuuugcacu

SEQ ID NO: 8352 - RNA, 22 nt, Homo sapiens
gugcacaacaugcaguuuuguu

SEQ ID NO: 8353 - RNA, 22 nt, Homo sapiens
auggaggccuacagaauuuugg

SEQ ID NO: 8354 - RNA, 23 nt, Homo sapiens
ggauggaaaguuuugagggccac

SEQ ID NO: 8355 - RNA, 22 nt, Homo sapiens
uggagugauaugguuauauggg

SEQ ID NO: 8356 - RNA, 22 nt, Homo sapiens
acuauacuguaacuguauucag

SEQ ID NO: 8357 - RNA, 22 nt, Homo sapiens
augagucacuuauuauuggggu

SEQ ID NO: 8358 - RNA, 22 nt, Homo sapiens
cacuuugguucaccugaguuuc

SEQ ID NO: 8359 - RNA, 20 nt, Homo sapiens
aucagagacuaggauugcca

SEQ ID NO: 8360 - RNA, 22 nt, Homo sapiens
uuuccagguggccaacauuuua

SEQ ID NO: 8361 - RNA, 22 nt, Homo sapiens
auugcacaucugcacuacagcc

SEQ ID NO: 8362 - RNA, 22 nt, Homo sapiens
uuuggcuuuuguaauaacugcc

SEQ ID NO: 8363 - RNA, 22 nt, Homo sapiens
agagaacugauuggaugugggc

SEQ ID NO: 8364 - RNA, 22 nt, Homo sapiens
acccuggauucguggccuugaa

SEQ ID NO: 8365 - RNA, 22 nt, Homo sapiens
uuccacaaugguugaacuagcu

SEQ ID NO: 8366 - RNA, 22 nt, Homo sapiens
gugcacaaaucuuaaauguaca

SEQ ID NO: 8367 - RNA, 22 nt, Homo sapiens
uuccacaaugguugaacuaguu

SEQ ID NO: 8368 - RNA, 22 nt, Homo sapiens
aauacugagaugugagguacua

SEQ ID NO: 8369 - RNA, 17 nt, Homo sapiens
ugauaagugugagguga

SEQ ID NO: 8370 - RNA, 22 nt, Homo sapiens
uggaagugaacaaccaaggcag

SEQ ID NO: 8371 - RNA, 19 nt, Homo sapiens
ggcaauacuuucuuguugg

SEQ ID NO: 8372 - RNA, 22 nt, Homo sapiens
gugauagaucugggauucagaa

SEQ ID NO: 8373 - RNA, 22 nt, Homo sapiens
gcuaggagaucugcugcucucu

SEQ ID NO: 8374 - RNA, 22 nt, Homo sapiens
cuguaauguaaugagacuacau

SEQ ID NO: 8375 - RNA, 18 nt, Homo sapiens
ucccucagaauuauagaa

SEQ ID NO: 8376 - RNA, 22 nt, Homo sapiens
uguaaugaucaaaucagaguaa

SEQ ID NO: 8377 - RNA, 22 nt, Homo sapiens
uucacacugggccuacucugug

SEQ ID NO: 8378 - RNA, 22 nt, Homo sapiens
aaugcacauauauuuccuuauu

SEQ ID NO: 8379 - RNA, 22 nt, Homo sapiens
aucugcacaucuguguuuuugu

SEQ ID NO: 8380 - RNA, 22 nt, Homo sapiens
auaugcacuauacacacguaua

SEQ ID NO: 8381 - RNA, 22 nt, Homo sapiens
uggaaguagauagauuguguca

SEQ ID NO: 8382 - RNA, 22 nt, Homo sapiens
uacauacuucacagacuuuaaa

SEQ ID NO: 8383 - RNA, 21 nt, Homo sapiens
augugcacuaugucauuuaau

SEQ ID NO: 8384 - RNA, 19 nt, Homo sapiens
acagcugguuuugguuucu

SEQ ID NO: 8385 - RNA, 22 nt, Homo sapiens
accucagcccggggaaguugag

SEQ ID NO: 8386 - RNA, 22 nt, Homo sapiens
aucauacuguuuugauuacugu

SEQ ID NO: 8387 - RNA, 22 nt, Homo sapiens
uugguccucccaugcucaagag

SEQ ID NO: 8388 - RNA, 22 nt, Homo sapiens
uagcuggaauuacuugcaccug

SEQ ID NO: 8389 - RNA, 22 nt, Homo sapiens
ugagguuauuuguucaagaagu

SEQ ID NO: 8390 - RNA, 22 nt, Homo sapiens
aucagaaucucuagaggacugu

SEQ ID NO: 8391 - RNA, 22 nt, Homo sapiens
ucgcugcgaccuccaccucccg

SEQ ID NO: 8392 - RNA, 22 nt, Homo sapiens
augcagaucacauuuuucuguc

SEQ ID NO: 8393 - RNA, 22 nt, Homo sapiens
guccuggagaagcguggaccgg

SEQ ID NO: 8394 - RNA, 22 nt, Homo sapiens
uuggucucaucaagagcagcuu

SEQ ID NO: 8395 - RNA, 22 nt, Homo sapiens
auaugcauacauguaugcagga

SEQ ID NO: 8396 - RNA, 22 nt, Homo sapiens
gcgugguguuagaaugagaagu

SEQ ID NO: 8397 - RNA, 19 nt, Homo sapiens
ugcauugucugggaaaugg

SEQ ID NO: 8398 - RNA, 22 nt, Homo sapiens
aucacuagaucauagguaaaca

SEQ ID NO: 8399 - RNA, 22 nt, Homo sapiens
aagcuggagugcaguggugcaa

SEQ ID NO: 8400 - RNA, 22 nt, Homo sapiens
cuuuggccauagcuaaaugauu

SEQ ID NO: 8401 - RNA, 22 nt, Homo sapiens
ugauauauugaaugaugaaaca

SEQ ID NO: 8402 - RNA, 22 nt, Homo sapiens
gaggaguagggcacaaagccuu

SEQ ID NO: 8403 - RNA, 20 nt, Homo sapiens
cugcacauccacucuacuuc

SEQ ID NO: 8404 - RNA, 22 nt, Homo sapiens
ugaggauaguguugaaggcagg

SEQ ID NO: 8405 - RNA, 22 nt, Homo sapiens
ggacuaggagcuaggaagaucu

SEQ ID NO: 8406 - RNA, 22 nt, Homo sapiens
gggaagugugcagaguucucuu

SEQ ID NO: 8407 - RNA, 22 nt, Homo sapiens
ugacuaggaaauuagaacuuuu

SEQ ID NO: 8408 - RNA, 22 nt, Homo sapiens
uggcucuuucuagacuuaauua

SEQ ID NO: 8409 - RNA, 19 nt, Homo sapiens
uccccgggucuagugcagc

SEQ ID NO: 8410 - RNA, 22 nt, Homo sapiens
gcuaggagauccacugcucucu

SEQ ID NO: 8411 - RNA, 22 nt, Homo sapiens
ggccggguggccauggcugccc

SEQ ID NO: 8412 - RNA, 22 nt, Homo sapiens
ucacucagaccuggugauaugc

SEQ ID NO: 8413 - RNA, 22 nt, Homo sapiens
acacuuucuggagcugcacaua

SEQ ID NO: 8414 - RNA, 17 nt, Homo sapiens
ucuaauaauaugcauuu

SEQ ID NO: 8415 - RNA, 17 nt, Homo sapiens
uuuaaugcuaggacucu

SEQ ID NO: 8416 - RNA, 22 nt, Homo sapiens
uugacaaggagccauugcaucu

SEQ ID NO: 8417 - RNA, 22 nt, Homo sapiens
augacauugaaaagcaagugga

SEQ ID NO: 8418 - RNA, 22 nt, Homo sapiens
auaaagccaugagcuugagaug

SEQ ID NO: 8419 - RNA, 22 nt, Homo sapiens
cucacuaggaaguaaaguuugu

SEQ ID NO: 8420 - RNA, 22 nt, Homo sapiens
cacugcaguaaauugcgucggu

SEQ ID NO: 8421 - RNA, 22 nt, Homo sapiens
uuccacaaugguugaacuaauu

SEQ ID NO: 8422 - RNA, 22 nt, Homo sapiens
gagcuggacuucuuaccuuuuc

SEQ ID NO: 8423 - RNA, 23 nt, Homo sapiens
uccccgggagcaccagcuuguug

SEQ ID NO: 8424 - RNA, 22 nt, Homo sapiens
gacuagaaauuauuuagugagc

SEQ ID NO: 8425 - RNA, 22 nt, Homo sapiens
cagccgggugagguggcuuguu

SEQ ID NO: 8426 - RNA, 20 nt, Homo sapiens
uggcucuuugcugcuaaagu

SEQ ID NO: 8427 - RNA, 22 nt, Homo sapiens
uggcuccguuguacaggcugga

SEQ ID NO: 8428 - RNA, 22 nt, Homo sapiens
aggaaguaauaaguuugguucu

SEQ ID NO: 8429 - RNA, 22 nt, Homo sapiens
gccccgggugaugcagccguca

SEQ ID NO: 8430 - RNA, 22 nt, Homo sapiens
uaaguauuaugugcugcauuuu

SEQ ID NO: 8431 - RNA, 20 nt, Homo sapiens
uggaaguaagaauauaggug

SEQ ID NO: 8432 - RNA, 22 nt, Homo sapiens
augcacuuggcaggaugauucc

SEQ ID NO: 8433 - RNA, 22 nt, Homo sapiens
aagcuggagugcaguggugcga

SEQ ID NO: 8434 - RNA, 22 nt, Homo sapiens
uuugguguauaaaaaugcuagu

SEQ ID NO: 8435 - RNA, 22 nt, Homo sapiens
auugauaguuuaauaggaauug

SEQ ID NO: 8436 - RNA, 22 nt, Homo sapiens
ggcagcuguguccuucguaagg

SEQ ID NO: 8437 - RNA, 22 nt, Homo sapiens
acuagguaguaaucugcagaga

SEQ ID NO: 8438 - RNA, 22 nt, Homo sapiens
aggcagcuguuauauacugagu

SEQ ID NO: 8439 - RNA, 22 nt, Homo sapiens
uuccacaauggcugaacuaguu

SEQ ID NO: 8440 - RNA, 21 nt, Homo sapiens
ugacuagggauaugugccacu

SEQ ID NO: 8441 - RNA, 23 nt, Homo sapiens
aggaaguaacuaucuuuucuguc

SEQ ID NO: 8442 - RNA, 22 nt, Homo sapiens
aaauugcacaaguggugauuug

SEQ ID NO: 8443 - RNA, 22 nt, Homo sapiens
uugauagaucagggauuugauu

SEQ ID NO: 8444 - RNA, 23 nt, Homo sapiens
ucgguccccuuggcugcccucgg

SEQ ID NO: 8445 - RNA, 22 nt, Homo sapiens
cauggcccugggcugggcgaac

SEQ ID NO: 8446 - RNA, 22 nt, Homo sapiens
augugcacaugcuuacauguga

SEQ ID NO: 8447 - RNA, 22 nt, Homo sapiens
uggaagugucugugcccagcuc

SEQ ID NO: 8448 - RNA, 22 nt, Homo sapiens
uugauagacaucugaguuguug

SEQ ID NO: 8449 - RNA, 22 nt, Homo sapiens
cucacuaguaaggcuguuuagu

SEQ ID NO: 8450 - RNA, 21 nt, Homo sapiens
ugcagccauucagcccuaugc

SEQ ID NO: 8451 - RNA, 22 nt, Homo sapiens
auacaguugccauuucuugugc

SEQ ID NO: 8452 - RNA, 22 nt, Homo sapiens
ccuucuuuuguaaggcugaaua

SEQ ID NO: 8453 - RNA, 22 nt, Homo sapiens
caaugcauuauucucccacuuc

SEQ ID NO: 8454 - RNA, 23 nt, Homo sapiens
ucacuagaguccuggaguuugag

SEQ ID NO: 8455 - RNA, 22 nt, Homo sapiens
uacuagaaccuuauucagagug

SEQ ID NO: 8456 - RNA, 20 nt, Homo sapiens
agacuagggagcagaaagcc

SEQ ID NO: 8457 - RNA, 22 nt, Homo sapiens
gcgguagcauagacugcaggac

SEQ ID NO: 8458 - RNA, 22 nt, Homo sapiens
ugggcggagacgugcagccgcc

SEQ ID NO: 8459 - RNA, 22 nt, Homo sapiens
ucagaacugauacuagaacuuu

SEQ ID NO: 8460 - RNA, 22 nt, Homo sapiens
ucacacgugaacucaucacaga

SEQ ID NO: 8461 - RNA, 22 nt, Homo sapiens
gugaacagaaccugggaucgaa

SEQ ID NO: 8462 - RNA, 22 nt, Homo sapiens
ugacuagggcucuaaacagcuc

SEQ ID NO: 8463 - RNA, 22 nt, Homo sapiens
aaacugaucugaaggccaggcu

SEQ ID NO: 8464 - RNA, 22 nt, Homo sapiens
uggcagcugcuucaugggaugc

SEQ ID NO: 8465 - RNA, 22 nt, Homo sapiens
uccccgagcccaggcugugacu

SEQ ID NO: 8466 - RNA, 22 nt, Homo sapiens
ugugguuuuuuucuccaauagg

SEQ ID NO: 8467 - RNA, 22 nt, Homo sapiens
uugauagacacauauccaugug

SEQ ID NO: 8468 - RNA, 22 nt, Homo sapiens
uugaaguagaaagacgaaauuu

SEQ ID NO: 8469 - RNA, 22 nt, Homo sapiens
uugugaaaucuaggcagagguu

SEQ ID NO: 8470 - RNA, 22 nt, Homo sapiens
aagugcuuuacacaugcaugau

SEQ ID NO: 8471 - RNA, 22 nt, Homo sapiens
aagaguuaguaaaauuuccucu

SEQ ID NO: 8472 - RNA, 22 nt, Homo sapiens
uugugaaugaugucgcaauaaa

SEQ ID NO: 8473 - RNA, 22 nt, Homo sapiens
gaugaggcuagagacaugugua

SEQ ID NO: 8474 - RNA, 22 nt, Homo sapiens
uguauguuguaagacuuagacc

SEQ ID NO: 8475 - RNA, 18 nt, Homo sapiens
uagaauauaggucauucu

SEQ ID NO: 8476 - RNA, 22 nt, Homo sapiens
caucagagugagauauaagauc

SEQ ID NO: 8477 - RNA, 22 nt, Homo sapiens
uuaugcagcaaagugcuugaaa

SEQ ID NO: 8478 - RNA, 19 nt, Homo sapiens
gacuccagaguugugugcu

SEQ ID NO: 8479 - RNA, 22 nt, Homo sapiens
ucacugaggucugagcuuuaug

SEQ ID NO: 8480 - RNA, 18 nt, Homo sapiens
ccauucaacagauuuguc

SEQ ID NO: 8481 - RNA, 22 nt, Homo sapiens
accucagcccggggaaguugag

SEQ ID NO: 8482 - RNA, 22 nt, Homo sapiens
agcauuaguugugaagccuuua

SEQ ID NO: 8483 - RNA, 22 nt, Homo sapiens
cauugcacuccagccugcacga

SEQ ID NO: 8484 - RNA, 22 nt, Homo sapiens
ugagauuaaucuuuaaguaaga

SEQ ID NO: 8485 - RNA, 22 nt, Homo sapiens
uuagucaaguguacugugaaug

SEQ ID NO: 8486 - RNA, 22 nt, Homo sapiens
ucacugagaaugauguuucuga

SEQ ID NO: 8487 - RNA, 19 nt, Homo sapiens
cauggcuuauaauuuuaau

SEQ ID NO: 8488 - RNA, 22 nt, Homo sapiens
aaaagucuguagugaaagguga

SEQ ID NO: 8489 - RNA, 22 nt, Homo sapiens
uuauugcacuccagccugggua

SEQ ID NO: 8490 - RNA, 22 nt, Homo sapiens
uuuugcaccauccuaauaguau

SEQ ID NO: 8491 - RNA, 22 nt, Homo sapiens
caauacuguguugaauaagagu

SEQ ID NO: 8492 - RNA, 22 nt, Homo sapiens
guacaugcaugcaugggugugc

SEQ ID NO: 8493 - RNA, 19 nt, Homo sapiens
cuaaguccccuugauuaga

SEQ ID NO: 8494 - RNA, 22 nt, Homo sapiens
gugcaaaucucugaguaucuuu

SEQ ID NO: 8495 - RNA, 22 nt, Homo sapiens
cuguaauguaaugagacuacau

SEQ ID NO: 8496 - RNA, 22 nt, Homo sapiens
aguauugcuaauaagagauuug

SEQ ID NO: 8497 - RNA, 22 nt, Homo sapiens
gguggugguauuucagaaaaug

SEQ ID NO: 8498 - RNA, 22 nt, Homo sapiens
ucaucagaguuuacaagcucag

SEQ ID NO: 8499 - RNA, 22 nt, Homo sapiens
uaucacagaggguauccuagag

SEQ ID NO: 8500 - RNA, 22 nt, Homo sapiens
auuacauagucaaggugucuca

SEQ ID NO: 8501 - RNA, 22 nt, Homo sapiens
ugcgccauugcauuccagccug

SEQ ID NO: 8502 - RNA, 22 nt, Homo sapiens
uacauacuucacagacuuuaaa

SEQ ID NO: 8503 - RNA, 22 nt, Homo sapiens
uggcaaaucagaggcauggaca

SEQ ID NO: 8504 - RNA, 22 nt, Homo sapiens
aagucaaggagagaagcuucag

SEQ ID NO: 8505 - RNA, 22 nt, Homo sapiens
uuaccuuuuuaagacagguuag

SEQ ID NO: 8506 - RNA, 22 nt, Homo sapiens
augagguaguagaaagucaggu

SEQ ID NO: 8507 - RNA, 22 nt, Homo sapiens
guggaaaacauaugcuuguuga

SEQ ID NO: 8508 - RNA, 22 nt, Homo sapiens
aaagugcugagucuaggcgggg

SEQ ID NO: 8509 - RNA, 22 nt, Homo sapiens
uugccuaggcuggagugcagug

SEQ ID NO: 8510 - RNA, 22 nt, Homo sapiens
cauugcacuccagccugaguga

SEQ ID NO: 8511 - RNA, 22 nt, Homo sapiens
aaagugcugggaucacacugaa

SEQ ID NO: 8512 - RNA, 20 nt, Homo sapiens
ugacaagugagaauuauggg

SEQ ID NO: 8513 - RNA, 22 nt, Homo sapiens
ugaaagcuacaggaaaguauuu

SEQ ID NO: 8514 - RNA, 22 nt, Homo sapiens
cuucaugucuucaauggggggg

SEQ ID NO: 8515 - RNA, 22 nt, Homo sapiens
aagggagcugcauaaucuugug

SEQ ID NO: 8516 - RNA, 22 nt, Homo sapiens
cccugagaugugaauuucagag

SEQ ID NO: 8517 - RNA, 22 nt, Homo sapiens
augcacauggcuaacuuuuuuc

SEQ ID NO: 8518 - RNA, 20 nt, Homo sapiens
cuuggcuuucuugguguuaa

SEQ ID NO: 8519 - RNA, 22 nt, Homo sapiens
aucaccuggaggugaucacuug

SEQ ID NO: 8520 - RNA, 22 nt, Homo sapiens
uaaaagucaucacaacuggagu

SEQ ID NO: 8521 - RNA, 22 nt, Homo sapiens
uugucaacaugaaacuguguuu

SEQ ID NO: 8522 - RNA, 22 nt, Homo sapiens
ucacugcgaccucugccucccg

SEQ ID NO: 8523 - RNA, 22 nt, Homo sapiens
guugcucaggccggagugcagu

SEQ ID NO: 8524 - RNA, 18 nt, Homo sapiens
ucacggggagcagcagcc

SEQ ID NO: 8525 - RNA, 22 nt, Homo sapiens
cccagagacagaaugauaaacu

SEQ ID NO: 8526 - RNA, 22 nt, Homo sapiens
ugagauuaucuugaucuugaaa

SEQ ID NO: 8527 - RNA, 22 nt, Homo sapiens
auugcacaaagagggaaacuga

SEQ ID NO: 8528 - RNA, 22 nt, Homo sapiens
cauugcacuccagccuggccaa

SEQ ID NO: 8529 - RNA, 22 nt, Homo sapiens
agaauguaaacagaauagagga

SEQ ID NO: 8530 - RNA, 22 nt, Homo sapiens
acugcacuccagccucggcaau

SEQ ID NO: 8531 - RNA, 22 nt, Homo sapiens
uauggcaaugcauaggaaggaa

SEQ ID NO: 8532 - RNA, 22 nt, Homo sapiens
uaggaaguuucuugauuacuua

SEQ ID NO: 8533 - RNA, 22 nt, Homo sapiens
uugcaucagcaggcauaauugg

SEQ ID NO: 8534 - RNA, 22 nt, Homo sapiens
uggagucuugaugauuuucaaa

SEQ ID NO: 8535 - RNA, 21 nt, Homo sapiens
ugcauauuggaacuuucucuc

SEQ ID NO: 8536 - RNA, 22 nt, Homo sapiens
guguauauccuauuaguucugu

SEQ ID NO: 8537 - RNA, 22 nt, Homo sapiens
uaauucacauaaagcacuuaga

SEQ ID NO: 8538 - RNA, 22 nt, Homo sapiens
gucagugugauaucugcagggg

SEQ ID NO: 8539 - RNA, 17 nt, Homo sapiens
uucucaguucugaucuc

SEQ ID NO: 8540 - RNA, 20 nt, Homo sapiens
uucaucaggauauuggucua

SEQ ID NO: 8541 - RNA, 22 nt, Homo sapiens
gaggugaaggucucaauaaaua

SEQ ID NO: 8542 - RNA, 19 nt, Homo sapiens
uuucaauguaaggauggag

SEQ ID NO: 8543 - RNA, 23 nt, Homo sapiens
uggguucauucuugaagucagug

SEQ ID NO: 8544 - RNA, 22 nt, Homo sapiens
uucauaguuuauacugauauuu

SEQ ID NO: 8545 - RNA, 22 nt, Homo sapiens
uggucaccuucuugcucugucu

SEQ ID NO: 8546 - RNA, 22 nt, Homo sapiens
cagcagguuuuuaucaguuaag

SEQ ID NO: 8547 - RNA, 22 nt, Homo sapiens
guaaauaccaguuucuggaaca

SEQ ID NO: 8548 - RNA, 20 nt, Homo sapiens
auucaaguaugccuugagaa

SEQ ID NO: 8549 - RNA, 22 nt, Homo sapiens
ugaugguuuuaaaaagaggagu

SEQ ID NO: 8550 - RNA, 22 nt, Homo sapiens
ugagacggagucuugcucuguc

SEQ ID NO: 8551 - RNA, 22 nt, Homo sapiens
guucaagugauucuacugccuc

SEQ ID NO: 8552 - RNA, 22 nt, Homo sapiens
ucaucagugcuugcaaauuauu

SEQ ID NO: 8553 - RNA, 22 nt, Homo sapiens
uguagcagccauaaacacagug

SEQ ID NO: 8554 - RNA, 22 nt, Homo sapiens
ggagaauguaauugguauuuug

SEQ ID NO: 8555 - RNA, 22 nt, Homo sapiens
cacugcacuccagucccgucuc

SEQ ID NO: 8556 - RNA, 19 nt, Homo sapiens
uggcacauguauacauaug

SEQ ID NO: 8557 - RNA, 22 nt, Homo sapiens
guauggguuuuguuucuucugg

SEQ ID NO: 8558 - RNA, 22 nt, Homo sapiens
uuggaagauuacuuaguuuucu

SEQ ID NO: 8559 - RNA, 22 nt, Homo sapiens
ucucuguuugucuguuacuggu

SEQ ID NO: 8560 - RNA, 19 nt, Homo sapiens
ugacacuguuggugggagg

SEQ ID NO: 8561 - RNA, 22 nt, Homo sapiens
caaagucuucucauuaugucuu

SEQ ID NO: 8562 - RNA, 22 nt, Homo sapiens
ugagacgaagucuugcucuguu

SEQ ID NO: 8563 - RNA, 22 nt, Homo sapiens
auggaagaaaguuggguucuug

SEQ ID NO: 8564 - RNA, 22 nt, Homo sapiens
aauggcaaauguuuucuguuga

SEQ ID NO: 8565 - RNA, 21 nt, Homo sapiens
uaucagagacauugagaggca

SEQ ID NO: 8566 - RNA, 22 nt, Homo sapiens
gaugugaaaucauaguuucuag

SEQ ID NO: 8567 - RNA, 22 nt, Homo sapiens
ugugccacuccagcucuagcuu

SEQ ID NO: 8568 - RNA, 22 nt, Homo sapiens
ucaagcaauucugcugccucag

SEQ ID NO: 8569 - RNA, 22 nt, Homo sapiens
ucuggagugugaaguggauaug

SEQ ID NO: 8570 - RNA, 22 nt, Homo sapiens
uugagcaauccuccugccaugu

SEQ ID NO: 8571 - RNA, 19 nt, Homo sapiens
uguugcacauaucaauaug

SEQ ID NO: 8572 - RNA, 22 nt, Homo sapiens
caacauccaccuccuggguuca

SEQ ID NO: 8573 - RNA, 22 nt, Homo sapiens
cuugcacuccacuguucuccug

SEQ ID NO: 8574 - RNA, 22 nt, Homo sapiens
gucaucaggacgggucaucugc

SEQ ID NO: 8575 - RNA, 22 nt, Homo sapiens
gcacauauguaaauagcugccu

SEQ ID NO: 8576 - RNA, 22 nt, Homo sapiens
acugagacugagaauguuucuu

SEQ ID NO: 8577 - RNA, 22 nt, Homo sapiens
acccaguagccagauguagcug

SEQ ID NO: 8578 - RNA, 22 nt, Homo sapiens
ugagauggagucuugucgccua

SEQ ID NO: 8579 - RNA, 23 nt, Homo sapiens
ggcaagaucucagcucacugcaa

SEQ ID NO: 8580 - RNA, 22 nt, Homo sapiens
auucccuuagcugccucagccu

SEQ ID NO: 8581 - RNA, 22 nt, Homo sapiens
uaagugcuguguuguuaccuaa

SEQ ID NO: 8582 - RNA, 22 nt, Homo sapiens
gcuggguucagagugggcugcg

SEQ ID NO: 8583 - RNA, 21 nt, Homo sapiens
uaacagcuccacuccauucuc

SEQ ID NO: 8584 - RNA, 22 nt, Homo sapiens
uucaucaguuauauuggccuga

SEQ ID NO: 8585 - RNA, 22 nt, Homo sapiens
auggcuauuccauaggcagagc

SEQ ID NO: 8586 - RNA, 22 nt, Homo sapiens
uucauguaauuccauaagguaa

SEQ ID NO: 8587 - RNA, 22 nt, Homo sapiens
uugauaguuuuaaaauuaaucu

SEQ ID NO: 8588 - RNA, 22 nt, Homo sapiens
auugcagcuugcagggugugua

SEQ ID NO: 8589 - RNA, 22 nt, Homo sapiens
gaaagauuuccugagcuagaaa

SEQ ID NO: 8590 - RNA, 22 nt, Homo sapiens
uuaacagucacuuagcucauuu

SEQ ID NO: 8591 - RNA, 22 nt, Homo sapiens
auugcaugucauguuuagugua

SEQ ID NO: 8592 - RNA, 20 nt, Homo sapiens
uucuauggugaugaguccug

SEQ ID NO: 8593 - RNA, 22 nt, Homo sapiens
uauugcacuuuuccauaggagu

SEQ ID NO: 8594 - RNA, 22 nt, Homo sapiens
uaucacaggucaggaaucuugc

SEQ ID NO: 8595 - RNA, 22 nt, Homo sapiens
uuggaagacauucugucugcua

SEQ ID NO: 8596 - RNA, 22 nt, Homo sapiens
ugaaguaauguuuuauucuauu

SEQ ID NO: 8597 - RNA, 22 nt, Homo sapiens
uugagccaaggauugucuuucc

SEQ ID NO: 8598 - RNA, 22 nt, Homo sapiens
uucauagucacauucgaugucu

SEQ ID NO: 8599 - RNA, 22 nt, Homo sapiens
uuagggaguaaucuaaaaaugg

SEQ ID NO: 8600 - RNA, 22 nt, Homo sapiens
aagggaauguuguggcugguuu

SEQ ID NO: 8601 - RNA, 22 nt, Homo sapiens
auaaaugccuguuguuuuaagc

SEQ ID NO: 8602 - RNA, 22 nt, Homo sapiens
cauugcaacuucugccucccag

SEQ ID NO: 8603 - RNA, 18 nt, Homo sapiens
guaaauguaucuauugcc

SEQ ID NO: 8604 - RNA, 22 nt, Homo sapiens
ugugaauguaagaaaauccaac

SEQ ID NO: 8605 - RNA, 22 nt, Homo sapiens
agucacagccuuuuacuuuaga

SEQ ID NO: 8606 - RNA, 22 nt, Homo sapiens
caggugcauuggcugacaccug

SEQ ID NO: 8607 - RNA, 21 nt, Homo sapiens
uggaauuaauggagagguguu

SEQ ID NO: 8608 - RNA, 22 nt, Homo sapiens
uugauauguuguuagauucagu

SEQ ID NO: 8609 - RNA, 22 nt, Homo sapiens
uaucacuguuguuuguuuaagg

SEQ ID NO: 8610 - RNA, 22 nt, Homo sapiens
auuacaugucuauccaugaaca

SEQ ID NO: 8611 - RNA, 22 nt, Homo sapiens
ucagcagugugaaaacaaacua

SEQ ID NO: 8612 - RNA, 22 nt, Homo sapiens
auugucccucuuaaucccagca

SEQ ID NO: 8613 - RNA, 22 nt, Homo sapiens
gccuagagaaguaaauauuauc

SEQ ID NO: 8614 - RNA, 22 nt, Homo sapiens
ugaaaucauguaguuauugcaa

SEQ ID NO: 8615 - RNA, 22 nt, Homo sapiens
uacaaagugggaaacgaagguu

SEQ ID NO: 8616 - RNA, 22 nt, Homo sapiens
gcagcaucaaaucacacaagau

SEQ ID NO: 8617 - RNA, 22 nt, Homo sapiens
uucaucaguugagcugguugcu

SEQ ID NO: 8618 - RNA, 22 nt, Homo sapiens
uucucuguggauugggugagag

SEQ ID NO: 8619 - RNA, 23 nt, Homo sapiens
augacacuccugugcgcacccug

SEQ ID NO: 8620 - RNA, 22 nt, Homo sapiens
ucacaguucagcauggcugagg

SEQ ID NO: 8621 - RNA, 22 nt, Homo sapiens
uuggaagagaagggagauaaac

SEQ ID NO: 8622 - RNA, 22 nt, Homo sapiens
uugaaggaggugcucacucucg

SEQ ID NO: 8623 - RNA, 22 nt, Homo sapiens
uugaugauguuucugccuugcc

SEQ ID NO: 8624 - RNA, 22 nt, Homo sapiens
aaagugcuuacuaaguugccaa

SEQ ID NO: 8625 - RNA, 22 nt, Homo sapiens
auagcagugugagaaugaacua

SEQ ID NO: 8626 - RNA, 22 nt, Homo sapiens
auuuggguuuuacaucaggcua

SEQ ID NO: 8627 - RNA, 22 nt, Homo sapiens
ucacuguguauguauaugcagg

SEQ ID NO: 8628 - RNA, 22 nt, Homo sapiens
cuucaaaguuggcuaggagaca

SEQ ID NO: 8629 - RNA, 18 nt, Homo sapiens
ggaaaacuuuucuaagua

SEQ ID NO: 8630 - RNA, 22 nt, Homo sapiens
acagucacaauuuguaccuuuu

SEQ ID NO: 8631 - RNA, 22 nt, Homo sapiens
gaagugcuuuuggacuaacagu

SEQ ID NO: 8632 - RNA, 22 nt, Homo sapiens
ugagauaauuuacuuguugagg

SEQ ID NO: 8633 - RNA, 23 nt, Homo sapiens
aagagguaugacuaugaagugga

SEQ ID NO: 8634 - RNA, 22 nt, Homo sapiens
uaugucuauuauguagcaggaa

SEQ ID NO: 8635 - RNA, 18 nt, Homo sapiens
cuggaugucgaguguguu

SEQ ID NO: 8636 - RNA, 22 nt, Homo sapiens
auaugcauacauguaugcagga

SEQ ID NO: 8637 - RNA, 22 nt, Homo sapiens
uuggcagcauuccagccaagca

SEQ ID NO: 8638 - RNA, 22 nt, Homo sapiens
acugcacuccagccuccugggu

SEQ ID NO: 8639 - RNA, 22 nt, Homo sapiens
uccaguuuuguuaacauauggu

SEQ ID NO: 8640 - RNA, 22 nt, Homo sapiens
uugcacauuuuuucuggcagaa

SEQ ID NO: 8641 - RNA, 22 nt, Homo sapiens
uugaauagaaguguugaaagug

SEQ ID NO: 8642 - RNA, 22 nt, Homo sapiens
aguccauuugaugaugauucca

SEQ ID NO: 8643 - RNA, 22 nt, Homo sapiens
cauugcacacauuuaccuaugu

SEQ ID NO: 8644 - RNA, 22 nt, Homo sapiens
uuauucauuaacagggaccaaa

SEQ ID NO: 8645 - RNA, 22 nt, Homo sapiens
auaaagacacuuggcaugauuu

SEQ ID NO: 8646 - RNA, 22 nt, Homo sapiens
uuacagauggauggcagcuggc

SEQ ID NO: 8647 - RNA, 22 nt, Homo sapiens
cacccuugcagggacagcuuug

SEQ ID NO: 8648 - RNA, 22 nt, Homo sapiens
auacuguacugaaguacccauu

SEQ ID NO: 8649 - RNA, 22 nt, Homo sapiens
cagagguaagcaagucagcauu

SEQ ID NO: 8650 - RNA, 22 nt, Homo sapiens
uagcaguaagaaacugacauug

SEQ ID NO: 8651 - RNA, 22 nt, Homo sapiens
augugaaugugaucggauaguc

SEQ ID NO: 8652 - RNA, 22 nt, Homo sapiens
gauggcacuuaagagcaagagc

SEQ ID NO: 8653 - RNA, 22 nt, Homo sapiens
uuaugucuuugagcaaugcugu

SEQ ID NO: 8654 - RNA, 22 nt, Homo sapiens
gcagaauugguuucuucuaagg

SEQ ID NO: 8655 - RNA, 22 nt, Homo sapiens
uguaacacacacuguuuacucc

SEQ ID NO: 8656 - RNA, 22 nt, Homo sapiens
gagacggagucucgcucugucg

SEQ ID NO: 8657 - RNA, 22 nt, Homo sapiens
gagacggagucuugcucuguug

SEQ ID NO: 8658 - RNA, 22 nt, Homo sapiens
gagcacugauuuauuuuugucu

SEQ ID NO: 8659 - RNA, 22 nt, Homo sapiens
uaucagcagagucauacuucaa

SEQ ID NO: 8660 - RNA, 22 nt, Homo sapiens
auaagugagugauucaguguua

SEQ ID NO: 8661 - RNA, 22 nt, Homo sapiens
aguggaauuaagaaacugaauu

SEQ ID NO: 8662 - RNA, 22 nt, Homo sapiens
aucaaaguaucucaauauggua

SEQ ID NO: 8663 - RNA, 22 nt, Homo sapiens
aagugcaaauucccaggcucug

SEQ ID NO: 8664 - RNA, 22 nt, Homo sapiens
cucccagagccaguuauaggcu

SEQ ID NO: 8665 - RNA, 22 nt, Homo sapiens
ugagaugcuccucuugcaaagc

SEQ ID NO: 8666 - RNA, 22 nt, Homo sapiens
gugggcucguucguguuagaca

SEQ ID NO: 8667 - RNA, 22 nt, Homo sapiens
aagagguagcagucacaaaaga

SEQ ID NO: 8668 - RNA, 22 nt, Homo sapiens
caagugcuacagagaaaucuuu

SEQ ID NO: 8669 - RNA, 22 nt, Homo sapiens
cccuguguuuagcugaagguuu

SEQ ID NO: 8670 - RNA, 22 nt, Homo sapiens
cauugcacucuaucccgguggg

SEQ ID NO: 8671 - RNA, 22 nt, Homo sapiens
aaguacuguuuaaauugcagaa

SEQ ID NO: 8672 - RNA, 22 nt, Homo sapiens
gcuggaauuaacauagaugugc

SEQ ID NO: 8673 - RNA, 22 nt, Homo sapiens
uugugaauggugccacaauaaa

SEQ ID NO: 8674 - RNA, 22 nt, Homo sapiens
ucccauguagcuaggauuacag

SEQ ID NO: 8675 - RNA, 22 nt, Homo sapiens
cuccauuuggaacagauguccu

SEQ ID NO: 8676 - RNA, 22 nt, Homo sapiens
ugaguucuuuguagauucugug

SEQ ID NO: 8677 - RNA, 22 nt, Homo sapiens
ucaugucuuguuguauuuauuu

SEQ ID NO: 8678 - RNA, 22 nt, Homo sapiens
uugcacauugauuuuguaucuu

SEQ ID NO: 8679 - RNA, 22 nt, Homo sapiens
auaucugcauugccauuuaugu

SEQ ID NO: 8680 - RNA, 22 nt, Homo sapiens
aaagugcuuccuuuuugagggu

SEQ ID NO: 8681 - RNA, 22 nt, Homo sapiens
acugcacuccggccuggcaaca

SEQ ID NO: 8682 - RNA, 22 nt, Homo sapiens
uucauggaauauugaccauuuu

SEQ ID NO: 8683 - RNA, 22 nt, Homo sapiens
aaagugauguccaggcuuucag

SEQ ID NO: 8684 - RNA, 22 nt, Homo sapiens
auggaagacuccucuuugggua

SEQ ID NO: 8685 - RNA, 21 nt, Homo sapiens
ucaguuacugagagagaagug

SEQ ID NO: 8686 - RNA, 22 nt, Homo sapiens
ugugcauaugucuuuauaguag

SEQ ID NO: 8687 - RNA, 22 nt, Homo sapiens
guaaucucagcuacuugggagc

SEQ ID NO: 8688 - RNA, 22 nt, Homo sapiens
agccauacaacguaugcaugua

SEQ ID NO: 8689 - RNA, 22 nt, Homo sapiens
caugucuuuuaaacauucaacu

SEQ ID NO: 8690 - RNA, 22 nt, Homo sapiens
cuggccagagacauucauuaaa

SEQ ID NO: 8691 - RNA, 22 nt, Homo sapiens
aaucacauugaaucugcuaccu

SEQ ID NO: 8692 - RNA, 22 nt, Homo sapiens
aaguagcuggaugcaguggcac

SEQ ID NO: 8693 - RNA, 22 nt, Homo sapiens
uugcacauguugaaccagcaaa

SEQ ID NO: 8694 - RNA, 22 nt, Homo sapiens
ugagauaggaucuugcucuguu

SEQ ID NO: 8695 - RNA, 22 nt, Homo sapiens
ucggcucagugcaagcucugcc

SEQ ID NO: 8696 - RNA, 22 nt, Homo sapiens
aaaugccucccauucuacugac

SEQ ID NO: 8697 - RNA, 20 nt, Homo sapiens
uaagugcuugaugaaugaac

SEQ ID NO: 8698 - RNA, 22 nt, Homo sapiens
gucuggcacagggaaaguacaa

SEQ ID NO: 8699 - RNA, 22 nt, Homo sapiens
uugaggaaugugauuucaaaua

SEQ ID NO: 8700 - RNA, 22 nt, Homo sapiens
uugugcauaucagagguuugcu

SEQ ID NO: 8701 - RNA, 22 nt, Homo sapiens
uucugaguggcuuucaacacug

SEQ ID NO: 8702 - RNA, 18 nt, Homo sapiens
uguugguguucacucacu

SEQ ID NO: 8703 - RNA, 22 nt, Homo sapiens
aauuacauggcaauugggaaau

SEQ ID NO: 8704 - RNA, 22 nt, Homo sapiens
gugucuccugccuucaugcagc

SEQ ID NO: 8705 - RNA, 22 nt, Homo sapiens
uagacacugcauauuuuuuuaa

SEQ ID NO: 8706 - RNA, 22 nt, Homo sapiens
uuuguauguuggagauuggaga

SEQ ID NO: 8707 - RNA, 22 nt, Homo sapiens
cagugcuuuaucaaguccucca

SEQ ID NO: 8708 - RNA, 22 nt, Homo sapiens
auuuggguaaugagugcaaggg

SEQ ID NO: 8709 - RNA, 18 nt, Homo sapiens
uuugguccuuuauaaaca

SEQ ID NO: 8710 - RNA, 22 nt, Homo sapiens
uugagauuuuccucaaauauuu

SEQ ID NO: 8711 - RNA, 22 nt, Homo sapiens
uuaaaagcuaucuccaagguca

SEQ ID NO: 8712 - RNA, 22 nt, Homo sapiens
guaaucucagcuucuugggagg

SEQ ID NO: 8713 - RNA, 22 nt, Homo sapiens
uuggaagacaaugcugauucuc

SEQ ID NO: 8714 - RNA, 22 nt, Homo sapiens
cuccuguagccccaucaucuuu

SEQ ID NO: 8715 - RNA, 22 nt, Homo sapiens
gacauguaaggcucucucuguu

SEQ ID NO: 8716 - RNA, 22 nt, Homo sapiens
ccugagaucauacuguuaguaa

SEQ ID NO: 8717 - RNA, 22 nt, Homo sapiens
aacugguauuucccaugaauuu

SEQ ID NO: 8718 - RNA, 22 nt, Homo sapiens
aaguggaauguuuguggcacaa

SEQ ID NO: 8719 - RNA, 22 nt, Homo sapiens
uucaacagugauggccuuugua

SEQ ID NO: 8720 - RNA, 22 nt, Homo sapiens
auagcagaacagugucucacug

SEQ ID NO: 8721 - RNA, 20 nt, Homo sapiens
gugagguagaggguuaccug

SEQ ID NO: 8722 - RNA, 22 nt, Homo sapiens
aguaacaggauccaaagaaugu

SEQ ID NO: 8723 - RNA, 22 nt, Homo sapiens
ucauagucuaagguucuuuugc

SEQ ID NO: 8724 - RNA, 22 nt, Homo sapiens
uuacaugucuugguaagguuag

SEQ ID NO: 8725 - RNA, 22 nt, Homo sapiens
cuagcagacaugggcugaacca

SEQ ID NO: 8726 - RNA, 22 nt, Homo sapiens
cuugcacucagaagauucaguu

SEQ ID NO: 8727 - RNA, 23 nt, Homo sapiens
ucaguacuccacuuucaauagug

SEQ ID NO: 8728 - RNA, 23 nt, Homo sapiens
ucucauuccuugaaaauaaugac

SEQ ID NO: 8729 - RNA, 22 nt, Homo sapiens
aagugcuuccuuucagaggguu

SEQ ID NO: 8730 - RNA, 22 nt, Homo sapiens
uguauuuguuguuaaauggaga

SEQ ID NO: 8731 - RNA, 22 nt, Homo sapiens
gacacugucuucugcucuuaaa

SEQ ID NO: 8732 - RNA, 22 nt, Homo sapiens
agagugcaaagguuggggcugg

SEQ ID NO: 8733 - RNA, 22 nt, Homo sapiens
gcagagaaacaggucuaaggag

SEQ ID NO: 8734 - RNA, 22 nt, Homo sapiens
uuugugaaugucauaagcucca

SEQ ID NO: 8735 - RNA, 22 nt, Homo sapiens
uugccuaggcuggauugcagug

SEQ ID NO: 8736 - RNA, 22 nt, Homo sapiens
ugugaauggugcugcaaugaac

SEQ ID NO: 8737 - RNA, 22 nt, Homo sapiens
agcagagcaguggauuuuguga

SEQ ID NO: 8738 - RNA, 22 nt, Homo sapiens
uauugcacuccucaugcauuug

SEQ ID NO: 8739 - RNA, 22 nt, Homo sapiens
augauagucuugagaagcauuu

SEQ ID NO: 8740 - RNA, 22 nt, Homo sapiens
augagauucuuagagaagucug

SEQ ID NO: 8741 - RNA, 22 nt, Homo sapiens
cugcaguaaccacuguaggugu

SEQ ID NO: 8742 - RNA, 18 nt, Homo sapiens
cuugucaaaucuuuccuc

SEQ ID NO: 8743 - RNA, 18 nt, Homo sapiens
cuuaacauugggaugaua

SEQ ID NO: 8744 - RNA, 22 nt, Homo sapiens
uguagucauuccuuuuugcuuu

SEQ ID NO: 8745 - RNA, 22 nt, Homo sapiens
auaugcauguacccacacaggc

SEQ ID NO: 8746 - RNA, 22 nt, Homo sapiens
ucagacacugagcaaacgacua

SEQ ID NO: 8747 - RNA, 22 nt, Homo sapiens
aagagguagaagcuugccuucu

SEQ ID NO: 8748 - RNA, 22 nt, Homo sapiens
uaaagcuuggauuuaggcuaau

SEQ ID NO: 8749 - RNA, 22 nt, Homo sapiens
gugcacaucuguguuccagcua

SEQ ID NO: 8750 - RNA, 22 nt, Homo sapiens
gaaaacugcuucucuggguuuc

SEQ ID NO: 8751 - RNA, 22 nt, Homo sapiens
ucacaugggugcaauauaauca

SEQ ID NO: 8752 - RNA, 22 nt, Homo sapiens
aaucacuuugcuacaaggcagu

SEQ ID NO: 8753 - RNA, 22 nt, Homo sapiens
gugucucagcccagaccuauuu

SEQ ID NO: 8754 - RNA, 22 nt, Homo sapiens
gagauauuuagaaauguguucu

SEQ ID NO: 8755 - RNA, 22 nt, Homo sapiens
uaguauguuuauagcauugagu

SEQ ID NO: 8756 - RNA, 21 nt, Homo sapiens
ugaaaugcaugugcacauuaa

SEQ ID NO: 8757 - RNA, 22 nt, Homo sapiens
uucaaaguguugguuuugggcu

SEQ ID NO: 8758 - RNA, 22 nt, Homo sapiens
acuccauuucauuuuagcucuu

SEQ ID NO: 8759 - RNA, 22 nt, Homo sapiens
ucagaguagcugucugaggugc

SEQ ID NO: 8760 - RNA, 22 nt, Homo sapiens
aucuuguguugaauggugcaga

SEQ ID NO: 8761 - RNA, 18 nt, Homo sapiens
ugugacauugagcauguc

SEQ ID NO: 8762 - RNA, 22 nt, Homo sapiens
cugaaagagcauuugaaugggu

SEQ ID NO: 8763 - RNA, 22 nt, Homo sapiens
uucuggccccucccaaucucau

SEQ ID NO: 8764 - RNA, 22 nt, Homo sapiens
acugagaucuuuaaauaaauaa

SEQ ID NO: 8765 - RNA, 22 nt, Homo sapiens
auaugucuguuuagucuguaau

SEQ ID NO: 8766 - RNA, 22 nt, Homo sapiens
aauugcauugaauuuguagcuu

SEQ ID NO: 8767 - RNA, 22 nt, Homo sapiens
guaaucucagcuacucgggaga

SEQ ID NO: 8768 - RNA, 22 nt, Homo sapiens
uuuugcacuguuuuaucugaca

SEQ ID NO: 8769 - RNA, 22 nt, Homo sapiens
gagaacugagauaagugauauu

SEQ ID NO: 8770 - RNA, 22 nt, Homo sapiens
auguggaaagcagcaugauaug

SEQ ID NO: 8771 - RNA, 17 nt, Homo sapiens
augugaauguucaaaua

SEQ ID NO: 8772 - RNA, 22 nt, Homo sapiens
uuucagagucaucugcccaagu

SEQ ID NO: 8773 - RNA, 22 nt, Homo sapiens
uuauuagagauauuugguuagg

SEQ ID NO: 8774 - RNA, 22 nt, Homo sapiens
ucagcagugugaaaauggacua

SEQ ID NO: 8775 - RNA, 22 nt, Homo sapiens
guguaaaacaauuagaggauuu

SEQ ID NO: 8776 - RNA, 22 nt, Homo sapiens
ugacagagaagcauugaguuca

SEQ ID NO: 8777 - RNA, 23 nt, Homo sapiens
uggcaagaauucuuaccgugugg

SEQ ID NO: 8778 - RNA, 22 nt, Homo sapiens
cuaugucuuucauauuuugggg

SEQ ID NO: 8779 - RNA, 22 nt, Homo sapiens
uugugaauggugccgcaauaaa

SEQ ID NO: 8780 - RNA, 22 nt, Homo sapiens
cauugcacuccagcccuggcaa

SEQ ID NO: 8781 - RNA, 22 nt, Homo sapiens
uugugaauggugcugcaguaaa

SEQ ID NO: 8782 - RNA, 22 nt, Homo sapiens
ugcagagaaacauuuuguauuu

SEQ ID NO: 8783 - RNA, 22 nt, Homo sapiens
auggaagaaacgauuuucugga

SEQ ID NO: 8784 - RNA, 22 nt, Homo sapiens
ccaggguuccacgccuggcugu

SEQ ID NO: 8785 - RNA, 22 nt, Homo sapiens
ugaagugaagacucacagaagg

SEQ ID NO: 8786 - RNA, 22 nt, Homo sapiens
ucuacagccaguucaggaagaa

SEQ ID NO: 8787 - RNA, 20 nt, Homo sapiens
cauugcacuccagcuugggc

SEQ ID NO: 8788 - RNA, 22 nt, Homo sapiens
ugugaagaaagucauugguagc

SEQ ID NO: 8789 - RNA, 21 nt, Homo sapiens
aagcacauugaguguguguga

SEQ ID NO: 8790 - RNA, 22 nt, Homo sapiens
aggcaugauuguauuuugcucu

SEQ ID NO: 8791 - RNA, 22 nt, Homo sapiens
ugucaguuucuugagauggaac

SEQ ID NO: 8792 - RNA, 22 nt, Homo sapiens
uaugcagacauuguuccaacca

SEQ ID NO: 8793 - RNA, 22 nt, Homo sapiens
uuugcuauagugaauagugcug

SEQ ID NO: 8794 - RNA, 22 nt, Homo sapiens
uuuuggcuagaaauauaccucc

SEQ ID NO: 8795 - RNA, 22 nt, Homo sapiens
uucauaguaacaguaacuaugg

SEQ ID NO: 8796 - RNA, 22 nt, Homo sapiens
ucacugaaaccacugccuccug

SEQ ID NO: 8797 - RNA, 18 nt, Homo sapiens
ucacaaccacagugcugu

SEQ ID NO: 8798 - RNA, 22 nt, Homo sapiens
uaacaggcaaggucacaccuug

SEQ ID NO: 8799 - RNA, 22 nt, Homo sapiens
caagugcuugaugaaugaucaa

SEQ ID NO: 8800 - RNA, 22 nt, Homo sapiens
uugaagugaagaacaauaucac

SEQ ID NO: 8801 - RNA, 21 nt, Homo sapiens
ucacugagcaucaugguuuca

SEQ ID NO: 8802 - RNA, 20 nt, Homo sapiens
auugcagcaugauuuauaau

SEQ ID NO: 8803 - RNA, 22 nt, Homo sapiens
uggaauuaauuaaaauauacug

SEQ ID NO: 8804 - RNA, 22 nt, Homo sapiens
gaacccuggaggcggagguugc

SEQ ID NO: 8805 - RNA, 22 nt, Homo sapiens
ugagacauauuauacugcuuuu

SEQ ID NO: 8806 - RNA, 22 nt, Homo sapiens
uacagccacauaauguaugauu

SEQ ID NO: 8807 - RNA, 22 nt, Homo sapiens
ugagaaugcagaaucucgugca

SEQ ID NO: 8808 - RNA, 22 nt, Homo sapiens
ugucauguuucuacugaccaaa

SEQ ID NO: 8809 - RNA, 22 nt, Homo sapiens
uuacuguagugucauaucguau

SEQ ID NO: 8810 - RNA, 20 nt, Homo sapiens
ucacugugaacuucuugagg

SEQ ID NO: 8811 - RNA, 20 nt, Homo sapiens
uuccuuaggcauuggaagaa

SEQ ID NO: 8812 - RNA, 21 nt, Homo sapiens
guucaagugauccuccugucu

SEQ ID NO: 8813 - RNA, 22 nt, Homo sapiens
acauucagcuguuguuucaaug

SEQ ID NO: 8814 - RNA, 18 nt, Homo sapiens
uugaauaguguccaaucu

SEQ ID NO: 8815 - RNA, 22 nt, Homo sapiens
ucugagaucaugucugugcugu

SEQ ID NO: 8816 - RNA, 22 nt, Homo sapiens
uugucauuuucagaguguuacg

SEQ ID NO: 8817 - RNA, 23 nt, Homo sapiens
ugagauuacccagaaagaguaua

SEQ ID NO: 8818 - RNA, 22 nt, Homo sapiens
acuuuuugaugaggucguuugu

SEQ ID NO: 8819 - RNA, 22 nt, Homo sapiens
uggaagccuagauucuuuucuu

SEQ ID NO: 8820 - RNA, 22 nt, Homo sapiens
uagcaguauugaaagaugaggg

SEQ ID NO: 8821 - RNA, 22 nt, Homo sapiens
cccugaagauacagaguuuggg

SEQ ID NO: 8822 - RNA, 22 nt, Homo sapiens
uauuacauccauaggcucugcu

SEQ ID NO: 8823 - RNA, 22 nt, Homo sapiens
ugugaacaaaauuuguugcaua

SEQ ID NO: 8824 - RNA, 22 nt, Homo sapiens
guaauaacuguggaaaaagguu

SEQ ID NO: 8825 - RNA, 19 nt, Homo sapiens
uaugcuauuuauuagaagu

SEQ ID NO: 8826 - RNA, 22 nt, Homo sapiens
cauugcacuccagccuuggcaa

SEQ ID NO: 8827 - RNA, 23 nt, Homo sapiens
ugagaugucugauugcgaggguc

SEQ ID NO: 8828 - RNA, 22 nt, Homo sapiens
uaucacagcauugucuauaaua

SEQ ID NO: 8829 - RNA, 22 nt, Homo sapiens
auuccuuaggcccuuugguuag

SEQ ID NO: 8830 - RNA, 22 nt, Homo sapiens
cauugcacuccagccugaggga

SEQ ID NO: 8831 - RNA, 18 nt, Homo sapiens
ugacuguccagguggacc

SEQ ID NO: 8832 - RNA, 22 nt, Homo sapiens
uccaguuuggaggcuugaugug

SEQ ID NO: 8833 - RNA, 22 nt, Homo sapiens
uugaggaaugucauuuguguuu

SEQ ID NO: 8834 - RNA, 22 nt, Homo sapiens
auccacaugcaguuggaaacag

SEQ ID NO: 8835 - RNA, 22 nt, Homo sapiens
ucaggcaccuuccucuuaucug

SEQ ID NO: 8836 - RNA, 22 nt, Homo sapiens
augacauugaugcucuggcugg

SEQ ID NO: 8837 - RNA, 22 nt, Homo sapiens
acccgcccagguguggccggga

SEQ ID NO: 8838 - RNA, 22 nt, Homo sapiens
gucaggcaccgauacaguuuuu

SEQ ID NO: 8839 - RNA, 22 nt, Homo sapiens
uucacagagagaacucaaacca

SEQ ID NO: 8840 - RNA, 22 nt, Homo sapiens
cuuucucagugagacccgagau

SEQ ID NO: 8841 - RNA, 22 nt, Homo sapiens
uucuauggucacagaugcuuga

SEQ ID NO: 8842 - RNA, 22 nt, Homo sapiens
ccauggcaauggucagucuauu

SEQ ID NO: 8843 - RNA, 22 nt, Homo sapiens
uaucaugucuguguguaccuag

SEQ ID NO: 8844 - RNA, 22 nt, Homo sapiens
aacaccauucucuguaacaaga

SEQ ID NO: 8845 - RNA, 21 nt, Homo sapiens
aggauaguagauuaaauauuu

SEQ ID NO: 8846 - RNA, 22 nt, Homo sapiens
uuucaagugcugucuuagcugu

SEQ ID NO: 8847 - RNA, 22 nt, Homo sapiens
ucaacaggucaauugcauagaa

SEQ ID NO: 8848 - RNA, 22 nt, Homo sapiens
uugcacauugcaccuuuuguau

SEQ ID NO: 8849 - RNA, 22 nt, Homo sapiens
ucaguguuuggaaucucaauuu

SEQ ID NO: 8850 - RNA, 22 nt, Homo sapiens
agcgccacugcacuccagccug

SEQ ID NO: 8851 - RNA, 22 nt, Homo sapiens
aauggcaagagccacagaggcg

SEQ ID NO: 8852 - RNA, 22 nt, Homo sapiens
ugcauauucgaguuauuuuggg

SEQ ID NO: 8853 - RNA, 22 nt, Homo sapiens
guacaguaguaaaagugaauga

SEQ ID NO: 8854 - RNA, 22 nt, Homo sapiens
ucauggcacugaugagaguuuc

SEQ ID NO: 8855 - RNA, 22 nt, Homo sapiens
uugugaauggaguagcaggauc

SEQ ID NO: 8856 - RNA, 17 nt, Homo sapiens
aaggugcuucgaccucc

SEQ ID NO: 8857 - RNA, 22 nt, Homo sapiens
ugagaaugaugauuuccaguuu

SEQ ID NO: 8858 - RNA, 19 nt, Homo sapiens
cuauugcacauagcugaag

SEQ ID NO: 8859 - RNA, 22 nt, Homo sapiens
uucaagcuauggugaucuuuuc

SEQ ID NO: 8860 - RNA, 22 nt, Homo sapiens
ugacaugaugagcaauaauggc

SEQ ID NO: 8861 - RNA, 22 nt, Homo sapiens
gggaucaacuuauacuaaaauu

SEQ ID NO: 8862 - RNA, 22 nt, Homo sapiens
uuuuuggaggagguuagaucau

SEQ ID NO: 8863 - RNA, 22 nt, Homo sapiens
uaucaacaggguggccagugua

SEQ ID NO: 8864 - RNA, 22 nt, Homo sapiens
uuuccagguggccaacauuuua

SEQ ID NO: 8865 - RNA, 22 nt, Homo sapiens
aucuggguccguucugcuucuc

SEQ ID NO: 8866 - RNA, 22 nt, Homo sapiens
ggcaagaucuuggcucacugaa

SEQ ID NO: 8867 - RNA, 22 nt, Homo sapiens
agugcaauaaggauguagaacu

SEQ ID NO: 8868 - RNA, 22 nt, Homo sapiens
aaaugcuuucuuggaccauuug

SEQ ID NO: 8869 - RNA, 22 nt, Homo sapiens
uuaauuguccaaguucaucucu

SEQ ID NO: 8870 - RNA, 22 nt, Homo sapiens
aagcuacauuuuauuuauguca

SEQ ID NO: 8871 - RNA, 22 nt, Homo sapiens
uuaagucacacuagacaacuga

SEQ ID NO: 8872 - RNA, 22 nt, Homo sapiens
augacauguauuuccaggauuu

SEQ ID NO: 8873 - RNA, 22 nt, Homo sapiens
aagagguaggaaauggucauuu

SEQ ID NO: 8874 - RNA, 23 nt, Homo sapiens
uauugcacuaugguaacccuuuu

SEQ ID NO: 8875 - RNA, 22 nt, Homo sapiens
uugcacauugauuuuguauccu

SEQ ID NO: 8876 - RNA, 22 nt, Homo sapiens
acugcacuccaccuugggcaac

SEQ ID NO: 8877 - RNA, 22 nt, Homo sapiens
ugguauguaugauuaacaugga

SEQ ID NO: 8878 - RNA, 22 nt, Homo sapiens
ucauugcaaucucugccucccg

SEQ ID NO: 8879 - RNA, 22 nt, Homo sapiens
uuacaguugugagccaccaugc

SEQ ID NO: 8880 - RNA, 22 nt, Homo sapiens
acuggacuuaaugaugaauugu

SEQ ID NO: 8881 - RNA, 22 nt, Homo sapiens
cauugcacuccagccugcugac

SEQ ID NO: 8882 - RNA, 22 nt, Homo sapiens
acccugucauccacauggugcu

SEQ ID NO: 8883 - RNA, 22 nt, Homo sapiens
uucuauguuugaaaaugccaaa

SEQ ID NO: 8884 - RNA, 22 nt, Homo sapiens
uuggucucaucaagagcagcuu

SEQ ID NO: 8885 - RNA, 19 nt, Homo sapiens
uauguaguuuucucaauau

SEQ ID NO: 8886 - RNA, 22 nt, Homo sapiens
gugagguacgugucaagaacca

SEQ ID NO: 8887 - RNA, 22 nt, Homo sapiens
cucauugcaaucucugccuccc

SEQ ID NO: 8888 - RNA, 22 nt, Homo sapiens
aaucacaguguucuugugaggg

SEQ ID NO: 8889 - RNA, 22 nt, Homo sapiens
caugcauuggucuauuauguga

SEQ ID NO: 8890 - RNA, 22 nt, Homo sapiens
ggcacaaugucagcucacugca

SEQ ID NO: 8891 - RNA, 22 nt, Homo sapiens
acauggcacugcgggcuucuug

SEQ ID NO: 8892 - RNA, 22 nt, Homo sapiens
cuggaagaaaaucacgccaucu

SEQ ID NO: 8893 - RNA, 18 nt, Homo sapiens
uuuggcuguucaugacuc

SEQ ID NO: 8894 - RNA, 22 nt, Homo sapiens
ucauacaguaguccucacuugu

SEQ ID NO: 8895 - RNA, 22 nt, Homo sapiens
auuaagugcuugcagaagucca

SEQ ID NO: 8896 - RNA, 22 nt, Homo sapiens
uagcagcauaaauggacuaaga

SEQ ID NO: 8897 - RNA, 22 nt, Homo sapiens
cauugcacuccagccucggcaa

SEQ ID NO: 8898 - RNA, 22 nt, Homo sapiens
uauugcacuccagccuuggcaa

SEQ ID NO: 8899 - RNA, 22 nt, Homo sapiens
uuaugucuuuuguguucagcua

SEQ ID NO: 8900 - RNA, 22 nt, Homo sapiens
uagaucauauacuugccaugac

SEQ ID NO: 8901 - RNA, 22 nt, Homo sapiens
augaaauugcuaucgcaguacu

SEQ ID NO: 8902 - RNA, 22 nt, Homo sapiens
uugugaaugaugucgcaguaaa

SEQ ID NO: 8903 - RNA, 22 nt, Homo sapiens
cauugcacuccacuccugaaca

SEQ ID NO: 8904 - RNA, 22 nt, Homo sapiens
aauacagcacacagaugggucu

SEQ ID NO: 8905 - RNA, 22 nt, Homo sapiens
acuggcuuauuucacuuagcau

SEQ ID NO: 8906 - RNA, 22 nt, Homo sapiens
guaaaguaaagcacaucaaggu

SEQ ID NO: 8907 - RNA, 22 nt, Homo sapiens
uuucuauguugaccagucuaga

SEQ ID NO: 8908 - RNA, 22 nt, Homo sapiens
guuuuuggggucacuauuaccg

SEQ ID NO: 8909 - RNA, 22 nt, Homo sapiens
cauugcacuccauccuuggcaa

SEQ ID NO: 8910 - RNA, 22 nt, Homo sapiens
auugcagcccacccugggugau

SEQ ID NO: 8911 - RNA, 22 nt, Homo sapiens
ucaguaaaugcuguucucuuuu

SEQ ID NO: 8912 - RNA, 22 nt, Homo sapiens
uuauuagguuagugcaaaaguu

SEQ ID NO: 8913 - RNA, 22 nt, Homo sapiens
cucacaugcucaccugguguuc

SEQ ID NO: 8914 - RNA, 22 nt, Homo sapiens
ucacuguugaugggcaugcagg

SEQ ID NO: 8915 - RNA, 22 nt, Homo sapiens
aagggaauguuguagcugguuu

SEQ ID NO: 8916 - RNA, 22 nt, Homo sapiens
ucaagcaauucuccugccucag

SEQ ID NO: 8917 - RNA, 20 nt, Homo sapiens
guggaagauaaguagccuga

SEQ ID NO: 8918 - RNA, 22 nt, Homo sapiens
agaacacugaguucagggucag

SEQ ID NO: 8919 - RNA, 19 nt, Homo sapiens
cauugcacuccacccuggg

SEQ ID NO: 8920 - RNA, 22 nt, Homo sapiens
gugaaagauuaaaccagugugu

SEQ ID NO: 8921 - RNA, 22 nt, Homo sapiens
uuugggaaugaguuuaucauuu

SEQ ID NO: 8922 - RNA, 22 nt, Homo sapiens
cccaguuuugcuucucaugagg

SEQ ID NO: 8923 - RNA, 22 nt, Homo sapiens
uaucacuuugauaguuuaaaug

SEQ ID NO: 8924 - RNA, 22 nt, Homo sapiens
uggcaagagauaugugucuaua

SEQ ID NO: 8925 - RNA, 22 nt, Homo sapiens
gcagcacauggcagaacauauu

SEQ ID NO: 8926 - RNA, 22 nt, Homo sapiens
ucugagaugagacuuugaauuu

SEQ ID NO: 8927 - RNA, 22 nt, Homo sapiens
augauaaguuauuagaagaaga

SEQ ID NO: 8928 - RNA, 22 nt, Homo sapiens
cuugcacuugaaauuccaguuu

SEQ ID NO: 8929 - RNA, 22 nt, Homo sapiens
ugugccacugcacuucagccug

SEQ ID NO: 8930 - RNA, 22 nt, Homo sapiens
acccagaguuccuugucuuuca

SEQ ID NO: 8931 - RNA, 22 nt, Homo sapiens
gucacuguggagaagaaagugg

SEQ ID NO: 8932 - RNA, 22 nt, Homo sapiens
uuggaaaaauccaccuugaucu

SEQ ID NO: 8933 - RNA, 22 nt, Homo sapiens
aauuaguugucgugagaguggu

SEQ ID NO: 8934 - RNA, 22 nt, Homo sapiens
ccuguguuaugguuucuaaugu

SEQ ID NO: 8935 - RNA, 22 nt, Homo sapiens
uaagugcuugacuuugauguuu

SEQ ID NO: 8936 - RNA, 22 nt, Homo sapiens
auagcagugugaggacagacua

SEQ ID NO: 8937 - RNA, 22 nt, Homo sapiens
uuacuguauagaaucaucuuga

SEQ ID NO: 8938 - RNA, 22 nt, Homo sapiens
cuggaauguuccuaaagauuca

SEQ ID NO: 8939 - RNA, 22 nt, Homo sapiens
uaugcuuauaaacauuugucag

SEQ ID NO: 8940 - RNA, 22 nt, Homo sapiens
ucuugcacaaauuauuuuaacu

SEQ ID NO: 8941 - RNA, 22 nt, Homo sapiens
ugaaucauuucuugucuucagu

SEQ ID NO: 8942 - RNA, 22 nt, Homo sapiens
acugaguguugauuuagauuaa

SEQ ID NO: 8943 - RNA, 22 nt, Homo sapiens
auagcagugugaaaacagacua

SEQ ID NO: 8944 - RNA, 20 nt, Homo sapiens
aguauucacuuuuuucaugg

SEQ ID NO: 8945 - RNA, 21 nt, Homo sapiens
ucaucagucaaagacaauggu

SEQ ID NO: 8946 - RNA, 22 nt, Homo sapiens
cccugagaugcuguuaaucugu

SEQ ID NO: 8947 - RNA, 22 nt, Homo sapiens
uucucaguuccuacuuugguga

SEQ ID NO: 8948 - RNA, 22 nt, Homo sapiens
uugugcaugaugcauacauggu

SEQ ID NO: 8949 - RNA, 22 nt, Homo sapiens
ucacacugaauuugaagcaaug

SEQ ID NO: 8950 - RNA, 22 nt, Homo sapiens
uagcaguaucccaccaucuggu

SEQ ID NO: 8951 - RNA, 22 nt, Homo sapiens
gagaacauuuaagccacucagg

SEQ ID NO: 8952 - RNA, 21 nt, Homo sapiens
aauacucuagguuaagagagc

SEQ ID NO: 8953 - RNA, 22 nt, Homo sapiens
aaaguggugggauuccaggcau

SEQ ID NO: 8954 - RNA, 22 nt, Homo sapiens
uguguaauaccuuugacuauau

SEQ ID NO: 8955 - RNA, 22 nt, Homo sapiens
uuggcaacauagugagaccccc

SEQ ID NO: 8956 - RNA, 22 nt, Homo sapiens
cagugcuuguuauuguucuauu

SEQ ID NO: 8957 - RNA, 22 nt, Homo sapiens
ucacuaaagaaaauggcaugga

SEQ ID NO: 8958 - RNA, 22 nt, Homo sapiens
augagauaaaccaucucuuaag

SEQ ID NO: 8959 - RNA, 22 nt, Homo sapiens
aagugcuucuuuccucgagaag

SEQ ID NO: 8960 - RNA, 22 nt, Homo sapiens
caaagucuauucuacccuuacc

SEQ ID NO: 8961 - RNA, 22 nt, Homo sapiens
ggcagcaugggugccuuuguga

SEQ ID NO: 8962 - RNA, 22 nt, Homo sapiens
ugugaagauggacuaauauagu

SEQ ID NO: 8963 - RNA, 22 nt, Homo sapiens
cagagaaugucuuuuuuaacca

SEQ ID NO: 8964 - RNA, 22 nt, Homo sapiens
gagaacauuaauaguuaauuuu

SEQ ID NO: 8965 - RNA, 22 nt, Homo sapiens
acaagcacaaauuuaauccugu

SEQ ID NO: 8966 - RNA, 17 nt, Homo sapiens
uuuuggauuagaaaucc

SEQ ID NO: 8967 - RNA, 22 nt, Homo sapiens
aaagugcugggauuaggccagg

SEQ ID NO: 8968 - RNA, 22 nt, Homo sapiens
agcucuuguuaguauuagcagu

SEQ ID NO: 8969 - RNA, 22 nt, Homo sapiens
gagagugcuuggcaucugcuga

SEQ ID NO: 8970 - RNA, 22 nt, Homo sapiens
uaaaugcucuuuaaaagugcuu

SEQ ID NO: 8971 - RNA, 18 nt, Homo sapiens
uccaguuuucccagcauc

SEQ ID NO: 8972 - RNA, 20 nt, Homo sapiens
auguaauguaugauauguac

SEQ ID NO: 8973 - RNA, 22 nt, Homo sapiens
uaugugcaaauuaauugcuaga

SEQ ID NO: 8974 - RNA, 22 nt, Homo sapiens
ucucuggauaucuacuuauguu

SEQ ID NO: 8975 - RNA, 22 nt, Homo sapiens
augcagugugcaacagauuaag

SEQ ID NO: 8976 - RNA, 22 nt, Homo sapiens
cuggaguaugaaccauguauca

SEQ ID NO: 8977 - RNA, 18 nt, Homo sapiens
ucacagguaaaguugaca

SEQ ID NO: 8978 - RNA, 22 nt, Homo sapiens
cccagaguucuuaaauacugag

SEQ ID NO: 8979 - RNA, 22 nt, Homo sapiens
uacaaagcuuucugcaaaucau

SEQ ID NO: 8980 - RNA, 22 nt, Homo sapiens
ugacucaguuucucagguagua

SEQ ID NO: 8981 - RNA, 18 nt, Homo sapiens
ucagucacugccuggcuu

SEQ ID NO: 8982 - RNA, 22 nt, Homo sapiens
cuggcaagaggauaaaguccua

SEQ ID NO: 8983 - RNA, 22 nt, Homo sapiens
aacagucaauugcugaugaccu

SEQ ID NO: 8984 - RNA, 22 nt, Homo sapiens
caagagaccugagugucauucu

SEQ ID NO: 8985 - RNA, 21 nt, Homo sapiens
gaccacagcagggaaugucag

SEQ ID NO: 8986 - RNA, 22 nt, Homo sapiens
uaaagugaggauggcaguaggu

SEQ ID NO: 8987 - RNA, 22 nt, Homo sapiens
augugcaacugcuggaacaguc

SEQ ID NO: 8988 - RNA, 19 nt, Homo sapiens
ugacaugaaacccaagauc

SEQ ID NO: 8989 - RNA, 22 nt, Homo sapiens
ugagaucacuaagagguaaugg

SEQ ID NO: 8990 - RNA, 22 nt, Homo sapiens
uggcaagaccccaucucuacaa

SEQ ID NO: 8991 - RNA, 22 nt, Homo sapiens
uaacauagucauauacuugcuu

SEQ ID NO: 8992 - RNA, 22 nt, Homo sapiens
ucaugugaggauaacaauagug

SEQ ID NO: 8993 - RNA, 22 nt, Homo sapiens
uccugagacucacaggcucccc

SEQ ID NO: 8994 - RNA, 23 nt, Homo sapiens
ggaguguaaugacucgaucucgg

SEQ ID NO: 8995 - RNA, 22 nt, Homo sapiens
uuguaaagaucauaugcuguuc

SEQ ID NO: 8996 - RNA, 22 nt, Homo sapiens
ucuggcuuauuucacuuagcau

SEQ ID NO: 8997 - RNA, 22 nt, Homo sapiens
uauacagcaaguuacugugcug

SEQ ID NO: 8998 - RNA, 22 nt, Homo sapiens
uuguaacaugcuuucacuucag

SEQ ID NO: 8999 - RNA, 23 nt, Homo sapiens
aucacuguuaacaauuucuuccu

SEQ ID NO: 9000 - RNA, 22 nt, Homo sapiens
aaggugcuguaagcauccaugu

SEQ ID NO: 9001 - RNA, 21 nt, Homo sapiens
cauaaugcuacuuauuuuaug

SEQ ID NO: 9002 - RNA, 18 nt, Homo sapiens
ugcauacuaucugauuuu

SEQ ID NO: 9003 - RNA, 22 nt, Homo sapiens
aaagugcuaggauuaccugggg

SEQ ID NO: 9004 - RNA, 22 nt, Homo sapiens
uuuaucuguuuaaaacuguuca

SEQ ID NO: 9005 - RNA, 22 nt, Homo sapiens
uugugaaaaaccucucguggaa

SEQ ID NO: 9006 - RNA, 22 nt, Homo sapiens
ugucaguuuuaacuagggaaua

SEQ ID NO: 9007 - RNA, 22 nt, Homo sapiens
uucacuguagccucagccucuu

SEQ ID NO: 9008 - RNA, 22 nt, Homo sapiens
auaucacucccaauaucgcagg

SEQ ID NO: 9009 - RNA, 22 nt, Homo sapiens
ucuccauuguccagaugaggaa

SEQ ID NO: 9010 - RNA, 22 nt, Homo sapiens
ugagaaugacugggcaugcugc

SEQ ID NO: 9011 - RNA, 22 nt, Homo sapiens
gugcacaugguagguauugagu

SEQ ID NO: 9012 - RNA, 22 nt, Homo sapiens
ucucaaccucccaaguagcugg

SEQ ID NO: 9013 - RNA, 22 nt, Homo sapiens
augugaacaucauagaaugcac

SEQ ID NO: 9014 - RNA, 22 nt, Homo sapiens
aguggaaucuguuauacuaacu

SEQ ID NO: 9015 - RNA, 22 nt, Homo sapiens
gugcacauauggugcauaagug

SEQ ID NO: 9016 - RNA, 22 nt, Homo sapiens
uuuuuggauaaugguacaugua

SEQ ID NO: 9017 - RNA, 22 nt, Homo sapiens
uucacuguuaagcaguuaaacu

SEQ ID NO: 9018 - RNA, 22 nt, Homo sapiens
gagguaucauuauguugcccag

SEQ ID NO: 9019 - RNA, 22 nt, Homo sapiens
aagugcuuaggauagugugugg

SEQ ID NO: 9020 - RNA, 22 nt, Homo sapiens
uuggcaaguccccaccucucuc

SEQ ID NO: 9021 - RNA, 20 nt, Homo sapiens
ucaaggcacgaauaaaaguu

SEQ ID NO: 9022 - RNA, 22 nt, Homo sapiens
guaaucucagcuacuugggagu

SEQ ID NO: 9023 - RNA, 21 nt, Homo sapiens
ugagaugugaccagggcauca

SEQ ID NO: 9024 - RNA, 22 nt, Homo sapiens
gugcaaauuccagcucaacucc

SEQ ID NO: 9025 - RNA, 22 nt, Homo sapiens
uugaaccauucuuuugauagag

SEQ ID NO: 9026 - RNA, 22 nt, Homo sapiens
caucacaugcuuauuuuccuca

SEQ ID NO: 9027 - RNA, 22 nt, Homo sapiens
uaucaagaugacaaacuuugcu

SEQ ID NO: 9028 - RNA, 22 nt, Homo sapiens
gcaccaugguagaauaauggua

SEQ ID NO: 9029 - RNA, 22 nt, Homo sapiens
gaguuagguugucaaugucuua

SEQ ID NO: 9030 - RNA, 22 nt, Homo sapiens
uggagugcaauggcaccaucuu

SEQ ID NO: 9031 - RNA, 22 nt, Homo sapiens
auugcuauuauuugaccauugu

SEQ ID NO: 9032 - RNA, 22 nt, Homo sapiens
augagacauuaaaguguguuug

SEQ ID NO: 9033 - RNA, 22 nt, Homo sapiens
aauugcacuggaaguaacugag

SEQ ID NO: 9034 - RNA, 22 nt, Homo sapiens
uugugaauggugccucaguaaa

SEQ ID NO: 9035 - RNA, 22 nt, Homo sapiens
auucagaggggcagcugucuug

SEQ ID NO: 9036 - RNA, 22 nt, Homo sapiens
agacacuguugaaaaggcccca

SEQ ID NO: 9037 - RNA, 20 nt, Homo sapiens
cauugcacuccagccugcug

SEQ ID NO: 9038 - RNA, 22 nt, Homo sapiens
uuguguacuacaguaugccaca

SEQ ID NO: 9039 - RNA, 22 nt, Homo sapiens
ugagaugugaucaccugaaggg

SEQ ID NO: 9040 - RNA, 19 nt, Homo sapiens
auaaaugccuacaagggug

SEQ ID NO: 9041 - RNA, 20 nt, Homo sapiens
aucacuggagaaggaaaccu

SEQ ID NO: 9042 - RNA, 22 nt, Homo sapiens
ugagauuauauuucuuaacaga

SEQ ID NO: 9043 - RNA, 22 nt, Homo sapiens
ucaucaggcucauucaagcuga

SEQ ID NO: 9044 - RNA, 20 nt, Homo sapiens
uccaguuuuggagacauucu

SEQ ID NO: 9045 - RNA, 22 nt, Homo sapiens
aagugcuuacagggaacaugau

SEQ ID NO: 9046 - RNA, 23 nt, Homo sapiens
auaagccuuuucuuucugcccca

SEQ ID NO: 9047 - RNA, 23 nt, Homo sapiens
aauugcacauuccuugcuggcag

SEQ ID NO: 9048 - RNA, 22 nt, Homo sapiens
uuguacuuuuaguagagacggg

SEQ ID NO: 9049 - RNA, 22 nt, Homo sapiens
aaagugcugggauuuuaggcau

SEQ ID NO: 9050 - RNA, 22 nt, Homo sapiens
uggaauguagcguugacacgag

SEQ ID NO: 9051 - RNA, 22 nt, Homo sapiens
uugucacccuacauaacaggga

SEQ ID NO: 9052 - RNA, 22 nt, Homo sapiens
gaaucacugugguaucccaugc

SEQ ID NO: 9053 - RNA, 22 nt, Homo sapiens
ucauggcauuguuaaggguuuu

SEQ ID NO: 9054 - RNA, 16 nt, Homo sapiens
uuauugcauucuucuc

SEQ ID NO: 9055 - RNA, 22 nt, Homo sapiens
gagagguaguuuuuuggucguc

SEQ ID NO: 9056 - RNA, 22 nt, Homo sapiens
auacacgguaggcacauauuua

SEQ ID NO: 9057 - RNA, 22 nt, Homo sapiens
ucucaaguggucgcaguuagau

SEQ ID NO: 9058 - RNA, 22 nt, Homo sapiens
uauacugucuuuguaugccuag

SEQ ID NO: 9059 - RNA, 22 nt, Homo sapiens
uugaaagaaaggagacugaguu

SEQ ID NO: 9060 - RNA, 22 nt, Homo sapiens
auagcagugugaaaauggacua

SEQ ID NO: 9061 - RNA, 22 nt, Homo sapiens
uagagguauuaacaguagaaga

SEQ ID NO: 9062 - RNA, 22 nt, Homo sapiens
uugagcccuggagguggaggcu

SEQ ID NO: 9063 - RNA, 22 nt, Homo sapiens
acugcacuccagccuuggcggc

SEQ ID NO: 9064 - RNA, 20 nt, Homo sapiens
uggugguuuuaugugguuua

SEQ ID NO: 9065 - RNA, 22 nt, Homo sapiens
uuggccauaugacuugcuuugg

SEQ ID NO: 9066 - RNA, 22 nt, Homo sapiens
uugagguaauaaacagccauuc

SEQ ID NO: 9067 - RNA, 22 nt, Homo sapiens
acaguaaugggccccuuuuccu

SEQ ID NO: 9068 - RNA, 22 nt, Homo sapiens
uaucagagcugucagccuaccu

SEQ ID NO: 9069 - RNA, 22 nt, Homo sapiens
auuaucacaguuuugcauaugg

SEQ ID NO: 9070 - RNA, 22 nt, Homo sapiens
aagagguaauaacaaagcuucu

SEQ ID NO: 9071 - RNA, 22 nt, Homo sapiens
agaguacaggcaaguuagucau

SEQ ID NO: 9072 - RNA, 22 nt, Homo sapiens
auuuguccugccuuuuccuccu

SEQ ID NO: 9073 - RNA, 22 nt, Homo sapiens
ugacauuacagucacuugcugu

SEQ ID NO: 9074 - RNA, 23 nt, Homo sapiens
gagaccagcuucagaaagcacga

SEQ ID NO: 9075 - RNA, 22 nt, Homo sapiens
ugucauucaggaaauucuaagu

SEQ ID NO: 9076 - RNA, 22 nt, Homo sapiens
gucuggcuuaucucacuuacca

SEQ ID NO: 9077 - RNA, 22 nt, Homo sapiens
gugccuuuucugagcaaugagc

SEQ ID NO: 9078 - RNA, 21 nt, Homo sapiens
caugucacugcacucuagccu

SEQ ID NO: 9079 - RNA, 23 nt, Homo sapiens
uucaccguguuggccaggcuggu

SEQ ID NO: 9080 - RNA, 22 nt, Homo sapiens
cagccgggugagguggcuuguu

SEQ ID NO: 9081 - RNA, 22 nt, Homo sapiens
aaagugcugggauuggcugggc

SEQ ID NO: 9082 - RNA, 22 nt, Homo sapiens
ggccggguggccauggcugccc

SEQ ID NO: 9083 - RNA, 22 nt, Homo sapiens
uuaggcuuuauugaaaacaaua

SEQ ID NO: 9084 - RNA, 22 nt, Homo sapiens
acugcacucuagccuuggcaac

SEQ ID NO: 9085 - RNA, 22 nt, Homo sapiens
auugcacacagaaucaggguaa

SEQ ID NO: 9086 - RNA, 22 nt, Homo sapiens
cugaaagagcauguaacacagu

SEQ ID NO: 9087 - RNA, 22 nt, Homo sapiens
caagugcucuaggauccugagu

SEQ ID NO: 9088 - RNA, 20 nt, Homo sapiens
uggucaccuucaggagguuc

SEQ ID NO: 9089 - RNA, 22 nt, Homo sapiens
uaagcagugcaagaauggaaua

SEQ ID NO: 9090 - RNA, 22 nt, Homo sapiens
auagcagugugaaaauugacug

SEQ ID NO: 9091 - RNA, 22 nt, Homo sapiens
gagauauucugguuuacuaaau

SEQ ID NO: 9092 - RNA, 22 nt, Homo sapiens
uggaaguauagauaauugaaag

SEQ ID NO: 9093 - RNA, 22 nt, Homo sapiens
uaaagcuuagauccaugguggc

SEQ ID NO: 9094 - RNA, 22 nt, Homo sapiens
guagugcaguuugagaaucagu

SEQ ID NO: 9095 - RNA, 22 nt, Homo sapiens
ucacuagggagaaacugaggcu

SEQ ID NO: 9096 - RNA, 22 nt, Homo sapiens
uauaagacgagcaaaaagcuug

SEQ ID NO: 9097 - RNA, 22 nt, Homo sapiens
aagugcucuugaaacugccuua

SEQ ID NO: 9098 - RNA, 22 nt, Homo sapiens
cacugcgacguccgccucccgg

SEQ ID NO: 9099 - RNA, 22 nt, Homo sapiens
gucacuggcugucuuguaugau

SEQ ID NO: 9100 - RNA, 22 nt, Homo sapiens
aguggcaaugugauguccugaa

SEQ ID NO: 9101 - RNA, 22 nt, Homo sapiens
uugagauaggagcuguuguucu

SEQ ID NO: 9102 - RNA, 22 nt, Homo sapiens
cauugcacucugcauuccaguc

SEQ ID NO: 9103 - RNA, 22 nt, Homo sapiens
ucugccuuuucaugugggaugg

SEQ ID NO: 9104 - RNA, 21 nt, Homo sapiens
ugugaacauguuggguggcau

SEQ ID NO: 9105 - RNA, 22 nt, Homo sapiens
uaugaaagcuacuucucacaau

SEQ ID NO: 9106 - RNA, 22 nt, Homo sapiens
aaagugcuguagacugggcgca

SEQ ID NO: 9107 - RNA, 22 nt, Homo sapiens
uuucugagaccaaaacuuguaa

SEQ ID NO: 9108 - RNA, 17 nt, Homo sapiens
ugcaauuuaagcuagau

SEQ ID NO: 9109 - RNA, 22 nt, Homo sapiens
cugauacugagaccuuggguua

SEQ ID NO: 9110 - RNA, 22 nt, Homo sapiens
uacagucacauuccugaccaua

SEQ ID NO: 9111 - RNA, 22 nt, Homo sapiens
aagugacauugugcccauuuga

SEQ ID NO: 9112 - RNA, 22 nt, Homo sapiens
gugaaagacauauaugguuuga

SEQ ID NO: 9113 - RNA, 22 nt, Homo sapiens
cucacugucaacauguauuugg

SEQ ID NO: 9114 - RNA, 22 nt, Homo sapiens
uaugacauaguccuuaacccuc

SEQ ID NO: 9115 - RNA, 22 nt, Homo sapiens
gugccacugcacuccggccugg

SEQ ID NO: 9116 - RNA, 22 nt, Homo sapiens
agucaagaaucucagcaucuuu

SEQ ID NO: 9117 - RNA, 22 nt, Homo sapiens
aaguaaauauccgguaguccca

SEQ ID NO: 9118 - RNA, 22 nt, Homo sapiens
cauugcacucuagucuggguga

SEQ ID NO: 9119 - RNA, 22 nt, Homo sapiens
gagauauuauuucccuuucaca

SEQ ID NO: 9120 - RNA, 22 nt, Homo sapiens
uuauacucgucugaaugauucu

SEQ ID NO: 9121 - RNA, 22 nt, Homo sapiens
aaagugcugagacagacuggga

SEQ ID NO: 9122 - RNA, 22 nt, Homo sapiens
ugaacagcacguuuauucagaa

SEQ ID NO: 9123 - RNA, 22 nt, Homo sapiens
uguaauuuaaaugauccuugga

SEQ ID NO: 9124 - RNA, 22 nt, Homo sapiens
uuauuagguuaaccuauagcua

SEQ ID NO: 9125 - RNA, 22 nt, Homo sapiens
ccugagacuugagggggcuucu

SEQ ID NO: 9126 - RNA, 22 nt, Homo sapiens
ucaucuggcgaaugugaagagu

SEQ ID NO: 9127 - RNA, 20 nt, Homo sapiens
ucucauggagggaaagagca

SEQ ID NO: 9128 - RNA, 22 nt, Homo sapiens
ggcagcauugccuuugcaguga

SEQ ID NO: 9129 - RNA, 22 nt, Homo sapiens
ugcaaaugcugcuauuucucuu

SEQ ID NO: 9130 - RNA, 21 nt, Homo sapiens
agcagcuuugguugaagcaga

SEQ ID NO: 9131 - RNA, 22 nt, Homo sapiens
agcagagcauauucauucgggg

SEQ ID NO: 9132 - RNA, 22 nt, Homo sapiens
uuaaguuaggcuucagcagucu

SEQ ID NO: 9133 - RNA, 23 nt, Homo sapiens
cuuuguccccacccaaaucucau

SEQ ID NO: 9134 - RNA, 22 nt, Homo sapiens
acugcacuccaguuugggcagc

SEQ ID NO: 9135 - RNA, 22 nt, Homo sapiens
gagacugagucuugcucugucg

SEQ ID NO: 9136 - RNA, 22 nt, Homo sapiens
guucaaguuuucucuugugggu

SEQ ID NO: 9137 - RNA, 22 nt, Homo sapiens
ugaugucuugcaggcacgagau

SEQ ID NO: 9138 - RNA, 22 nt, Homo sapiens
gcugagaucucuugccugaacu

SEQ ID NO: 9139 - RNA, 22 nt, Homo sapiens
guaugucuuuauagcagugugg

SEQ ID NO: 9140 - RNA, 22 nt, Homo sapiens
acugcacuccagccuuggccac

SEQ ID NO: 9141 - RNA, 22 nt, Homo sapiens
uaagugaauuugacagguaaug

SEQ ID NO: 9142 - RNA, 22 nt, Homo sapiens
uaugucuggaguuacugagcug

SEQ ID NO: 9143 - RNA, 22 nt, Homo sapiens
auucacuuuuauagacaggucu

SEQ ID NO: 9144 - RNA, 22 nt, Homo sapiens
gugcacauuguuuaugucuguu

SEQ ID NO: 9145 - RNA, 22 nt, Homo sapiens
auacaguugccauuucuugugc

SEQ ID NO: 9146 - RNA, 22 nt, Homo sapiens
cagagguauugcaaaagccuag

SEQ ID NO: 9147 - RNA, 22 nt, Homo sapiens
accugagauuacaggugcuggc

SEQ ID NO: 9148 - RNA, 22 nt, Homo sapiens
auugucacccgggcaguaagca

SEQ ID NO: 9149 - RNA, 22 nt, Homo sapiens
ucugacacagugauuaguaaau

SEQ ID NO: 9150 - RNA, 22 nt, Homo sapiens
ugaaacauacacucugaugggg

SEQ ID NO: 9151 - RNA, 22 nt, Homo sapiens
augacugucagggcagucauug

SEQ ID NO: 9152 - RNA, 22 nt, Homo sapiens
uacagucauaaugccuagugac

SEQ ID NO: 9153 - RNA, 22 nt, Homo sapiens
caugucuuuuauucugugugau

SEQ ID NO: 9154 - RNA, 22 nt, Homo sapiens
aauaauggcaccaaagcacaag

SEQ ID NO: 9155 - RNA, 22 nt, Homo sapiens
ugaaaguuauauugugaaauuc

SEQ ID NO: 9156 - RNA, 22 nt, Homo sapiens
cauugcacuccagcuugggcga

SEQ ID NO: 9157 - RNA, 22 nt, Homo sapiens
ucuaauguaaccugcaaauauu

SEQ ID NO: 9158 - RNA, 22 nt, Homo sapiens
cucucaagaugcugggauuaca

SEQ ID NO: 9159 - RNA, 22 nt, Homo sapiens
ugagaucacgccacugcacucc

SEQ ID NO: 9160 - RNA, 22 nt, Homo sapiens
ccaguguucuggaaggcugagu

SEQ ID NO: 9161 - RNA, 22 nt, Homo sapiens
uagcaguaaagaaugugauguu

SEQ ID NO: 9162 - RNA, 19 nt, Homo sapiens
ggucacagggguuacaagg

SEQ ID NO: 9163 - RNA, 22 nt, Homo sapiens
uaagugaauauggacaguuagc

SEQ ID NO: 9164 - RNA, 18 nt, Homo sapiens
auugcacaccagccuggg

SEQ ID NO: 9165 - RNA, 22 nt, Homo sapiens
uuccaguuauuauaccucuuaa

SEQ ID NO: 9166 - RNA, 22 nt, Homo sapiens
augucuggcagaagacuucuca

SEQ ID NO: 9167 - RNA, 22 nt, Homo sapiens
uuuguccccgcccagaucucau

SEQ ID NO: 9168 - RNA, 22 nt, Homo sapiens
uaacauuguugauuauacuaag

SEQ ID NO: 9169 - RNA, 22 nt, Homo sapiens
ucagugucugugauggagaggu

SEQ ID NO: 9170 - RNA, 19 nt, Homo sapiens
ugcaaauucuaaaaacuga

SEQ ID NO: 9171 - RNA, 20 nt, Homo sapiens
uauugcacuccagucugggc

SEQ ID NO: 9172 - RNA, 22 nt, Homo sapiens
acuucauucucuggaucagaau

SEQ ID NO: 9173 - RNA, 19 nt, Homo sapiens
uccaccgcgugcaccucua

SEQ ID NO: 9174 - RNA, 20 nt, Homo sapiens
auaugcagacacauacauac

SEQ ID NO: 9175 - RNA, 22 nt, Homo sapiens
ugugucuccugaaaauucacau

SEQ ID NO: 9176 - RNA, 22 nt, Homo sapiens
agacacugaaauguauugaaga

SEQ ID NO: 9177 - RNA, 17 nt, Homo sapiens
ucuaauaauaugcauuu

SEQ ID NO: 9178 - RNA, 22 nt, Homo sapiens
ggaucacuugagaccaggaguu

SEQ ID NO: 9179 - RNA, 22 nt, Homo sapiens
agaucauaugcaguaaugaacu

SEQ ID NO: 9180 - RNA, 22 nt, Homo sapiens
uugcauagaccgaugucuugga

SEQ ID NO: 9181 - RNA, 22 nt, Homo sapiens
uauuccacaauaugauuuuuaa

SEQ ID NO: 9182 - RNA, 22 nt, Homo sapiens
gagacggagucucgcucuguca

SEQ ID NO: 9183 - RNA, 19 nt, Homo sapiens
uggaaugaaauguuagggg

SEQ ID NO: 9184 - RNA, 22 nt, Homo sapiens
cauugcacucuagccucggcaa

SEQ ID NO: 9185 - RNA, 22 nt, Homo sapiens
ugagaugugaagaucacaugaa

SEQ ID NO: 9186 - RNA, 22 nt, Homo sapiens
cccugagaaaacuuuguccuua

SEQ ID NO: 9187 - RNA, 22 nt, Homo sapiens
guggaaugauaucucauugugg

SEQ ID NO: 9188 - RNA, 22 nt, Homo sapiens
agcuggauguauguuaagugaa

SEQ ID NO: 9189 - RNA, 23 nt, Homo sapiens
uaagucacacagauuaauuuauu

SEQ ID NO: 9190 - RNA, 22 nt, Homo sapiens
uauugcacaugaggagacauug

SEQ ID NO: 9191 - RNA, 22 nt, Homo sapiens
auguagugugauuuucacuaga

SEQ ID NO: 9192 - RNA, 22 nt, Homo sapiens
ggaaauguuuagcauccacuuu

SEQ ID NO: 9193 - RNA, 22 nt, Homo sapiens
cucaaguacaugggauuacagg

SEQ ID NO: 9194 - RNA, 22 nt, Homo sapiens
agucacagugaccuugucugac

SEQ ID NO: 9195 - RNA, 22 nt, Homo sapiens
ugagauagggucucacucuguc

SEQ ID NO: 9196 - RNA, 22 nt, Homo sapiens
uccugagaauagaguugcaugu

SEQ ID NO: 9197 - RNA, 22 nt, Homo sapiens
cauugcacuccagccuagccaa

SEQ ID NO: 9198 - RNA, 22 nt, Homo sapiens
guacaguauaguaauaggauuu

SEQ ID NO: 9199 - RNA, 18 nt, Homo sapiens
aaaaagugcucaggccua

SEQ ID NO: 9200 - RNA, 22 nt, Homo sapiens
acaccuguggucccaguaacuu

SEQ ID NO: 9201 - RNA, 22 nt, Homo sapiens
agaauguauauucuguaguugu

SEQ ID NO: 9202 - RNA, 23 nt, Homo sapiens
aggcauuguacaguaauggaaaa

SEQ ID NO: 9203 - RNA, 22 nt, Homo sapiens
caauggcacgaucucgucucac

SEQ ID NO: 9204 - RNA, 22 nt, Homo sapiens
uccugagagcagacccucuaua

SEQ ID NO: 9205 - RNA, 22 nt, Homo sapiens
ucauucauuugcucacuccaca

SEQ ID NO: 9206 - RNA, 22 nt, Homo sapiens
uugcaaugugaugugauuugga

SEQ ID NO: 9207 - RNA, 18 nt, Homo sapiens
uaagugcuuuaaacacau

SEQ ID NO: 9208 - RNA, 22 nt, Homo sapiens
aagugcuucagaagacaauauu

SEQ ID NO: 9209 - RNA, 22 nt, Homo sapiens
auaugcuuauuagcaagaaaua

SEQ ID NO: 9210 - RNA, 20 nt, Homo sapiens
uauucacucuccagucuugc

SEQ ID NO: 9211 - RNA, 22 nt, Homo sapiens
cugguuuguaaaguuccugaga

SEQ ID NO: 9212 - RNA, 22 nt, Homo sapiens
uuacugcucuuuugucaugagu

SEQ ID NO: 9213 - RNA, 22 nt, Homo sapiens
cauugcacuccagcccagguga

SEQ ID NO: 9214 - RNA, 22 nt, Homo sapiens
uagucacacacucaacuuuuca

SEQ ID NO: 9215 - RNA, 22 nt, Homo sapiens
cauugcacuccagucugggcaa

SEQ ID NO: 9216 - RNA, 22 nt, Homo sapiens
agcuggucuacguguguaugag

SEQ ID NO: 9217 - RNA, 22 nt, Homo sapiens
cauugcacugcagcccgggcaa

SEQ ID NO: 9218 - RNA, 22 nt, Homo sapiens
uugucccauggggucuuccuuu

SEQ ID NO: 9219 - RNA, 22 nt, Homo sapiens
uacaugcaugggcaugugugca

SEQ ID NO: 9220 - RNA, 22 nt, Homo sapiens
auagcagugugaaaacagacug

SEQ ID NO: 9221 - RNA, 22 nt, Homo sapiens
uuuauggagagauauuuauggu

SEQ ID NO: 9222 - RNA, 22 nt, Homo sapiens
uacucuuuagcuccuuaaggaa

SEQ ID NO: 9223 - RNA, 22 nt, Homo sapiens
augguuuauuuguaagcagagu

SEQ ID NO: 9224 - RNA, 22 nt, Homo sapiens
uagagguauguauaguauucuu

SEQ ID NO: 9225 - RNA, 22 nt, Homo sapiens
uuaaucaggccguuuccuaaga

SEQ ID NO: 9226 - RNA, 19 nt, Homo sapiens
ccauggcaaugaucugaug

SEQ ID NO: 9227 - RNA, 22 nt, Homo sapiens
uauugauuaauugugauuaggc

SEQ ID NO: 9228 - RNA, 22 nt, Homo sapiens
agccuguguugaauuauagaaa

SEQ ID NO: 9229 - RNA, 19 nt, Homo sapiens
acugcacuccuccuugggu

SEQ ID NO: 9230 - RNA, 22 nt, Homo sapiens
uaagugaauguuggcuacugaa

SEQ ID NO: 9231 - RNA, 22 nt, Homo sapiens
ggucacauuggacuaucaaguu

SEQ ID NO: 9232 - RNA, 22 nt, Homo sapiens
uugugaucauugucaaauagug

SEQ ID NO: 9233 - RNA, 22 nt, Homo sapiens
ucuugggugaguuugugaauaa

SEQ ID NO: 9234 - RNA, 21 nt, Homo sapiens
gacauggcgauacuccgucuc

SEQ ID NO: 9235 - RNA, 17 nt, Homo sapiens
uuucagaguggaagugu

SEQ ID NO: 9236 - RNA, 22 nt, Homo sapiens
uaucacagugcuggaguauucc

SEQ ID NO: 9237 - RNA, 22 nt, Homo sapiens
aauaaagucugaagugugcuua

SEQ ID NO: 9238 - RNA, 16 nt, Homo sapiens
uguauugcuaaaaaga

SEQ ID NO: 9239 - RNA, 22 nt, Homo sapiens
aaagugcugggauuggccgggc

SEQ ID NO: 9240 - RNA, 22 nt, Homo sapiens
gccugagaggauaugauccccu

SEQ ID NO: 9241 - RNA, 22 nt, Homo sapiens
cuucaaguguggccaccugacc

SEQ ID NO: 9242 - RNA, 21 nt, Homo sapiens
agcuaaauuggaaauuucugu

SEQ ID NO: 9243 - RNA, 22 nt, Homo sapiens
ucagaguagaaacacuuccaua

SEQ ID NO: 9244 - RNA, 21 nt, Homo sapiens
caauggcacaaucucugcuca

SEQ ID NO: 9245 - RNA, 22 nt, Homo sapiens
cacaaaguagauuagucuucca

SEQ ID NO: 9246 - RNA, 22 nt, Homo sapiens
uuguaaucaacacaucauuggg

SEQ ID NO: 9247 - RNA, 22 nt, Homo sapiens
aagacuguaauccaucuugagu

SEQ ID NO: 9248 - RNA, 22 nt, Homo sapiens
uugugaaugaugccgcaauaaa

SEQ ID NO: 9249 - RNA, 22 nt, Homo sapiens
uugugaauggugccgcaguaaa

SEQ ID NO: 9250 - RNA, 20 nt, Homo sapiens
guccauuugcugccauugcu

SEQ ID NO: 9251 - RNA, 22 nt, Homo sapiens
cacagaauucauuggauuaccu

SEQ ID NO: 9252 - RNA, 22 nt, Homo sapiens
aguacaauguugaguagaagug

SEQ ID NO: 9253 - RNA, 22 nt, Homo sapiens
uaugucuuuugcuugcaaauag

SEQ ID NO: 9254 - RNA, 22 nt, Homo sapiens
ugcaaauguuaggugucauuau

SEQ ID NO: 9255 - RNA, 22 nt, Homo sapiens
auguauacaugcaggucacagg

SEQ ID NO: 9256 - RNA, 22 nt, Homo sapiens
ucaggcaugcagcaaugcagug

SEQ ID NO: 9257 - RNA, 16 nt, Homo sapiens
cauugcacucuagccu

SEQ ID NO: 9258 - RNA, 22 nt, Homo sapiens
agauggguuuucacauguuggc

SEQ ID NO: 9259 - RNA, 22 nt, Homo sapiens
ucugugaaugaacacuugaaaa

SEQ ID NO: 9260 - RNA, 21 nt, Homo sapiens
gagguaccucauguaagugga

SEQ ID NO: 9261 - RNA, 21 nt, Homo sapiens
uuggggaauggagagguuuuc

SEQ ID NO: 9262 - RNA, 22 nt, Homo sapiens
auaacucuguuuuuuucaugca

SEQ ID NO: 9263 - RNA, 19 nt, Homo sapiens
uacauaguauuuaguggca

SEQ ID NO: 9264 - RNA, 22 nt, Homo sapiens
aaagugcugagauuguaggcau

SEQ ID NO: 9265 - RNA, 22 nt, Homo sapiens
ugaggaacuagcuacccuaaua

SEQ ID NO: 9266 - RNA, 22 nt, Homo sapiens
auauuggccuaaaauucucuuu

SEQ ID NO: 9267 - RNA, 22 nt, Homo sapiens
uagcaguauaugagagcuauug

SEQ ID NO: 9268 - RNA, 22 nt, Homo sapiens
auuaagugcuugccagugcugg

SEQ ID NO: 9269 - RNA, 22 nt, Homo sapiens
aacacuaucugccuuacaggga

SEQ ID NO: 9270 - RNA, 22 nt, Homo sapiens
uggauaguaauaaacauauagg

SEQ ID NO: 9271 - RNA, 23 nt, Homo sapiens
aggaauggaaaaccaaguaucau

SEQ ID NO: 9272 - RNA, 18 nt, Homo sapiens
agagcacugaguuuuaga

SEQ ID NO: 9273 - RNA, 22 nt, Homo sapiens
uuugaauggaaguuuugugaaa

SEQ ID NO: 9274 - RNA, 22 nt, Homo sapiens
uuggcagcacgcaguccagagg

SEQ ID NO: 9275 - RNA, 22 nt, Homo sapiens
aggugaaugcucacauucuaau

SEQ ID NO: 9276 - RNA, 20 nt, Homo sapiens
uccugagauucccaguucuc

SEQ ID NO: 9277 - RNA, 22 nt, Homo sapiens
ucuucaugcuugaaauaauagc

SEQ ID NO: 9278 - RNA, 22 nt, Homo sapiens
uuaucauagugcaguuuucuga

SEQ ID NO: 9279 - RNA, 22 nt, Homo sapiens
ucuagccuaugaagcuugucca

SEQ ID NO: 9280 - RNA, 22 nt, Homo sapiens
ucauucauucauccagcuugag

SEQ ID NO: 9281 - RNA, 22 nt, Homo sapiens
ugugauaguuggcuaaagcagu

SEQ ID NO: 9282 - RNA, 22 nt, Homo sapiens
cagucacagugacaggaugugg

SEQ ID NO: 9283 - RNA, 23 nt, Homo sapiens
ggaguguauuggcacgaucucag

SEQ ID NO: 9284 - RNA, 22 nt, Homo sapiens
gugccacugcaccuggccuaag

SEQ ID NO: 9285 - RNA, 22 nt, Homo sapiens
aucaaaguuucccagaaguugu

SEQ ID NO: 9286 - RNA, 22 nt, Homo sapiens
aacagugcuguuauaaauguac

SEQ ID NO: 9287 - RNA, 22 nt, Homo sapiens
uucauguaauauuucacagcuu

SEQ ID NO: 9288 - RNA, 22 nt, Homo sapiens
acugcacuucagccuuggcuac

SEQ ID NO: 9289 - RNA, 22 nt, Homo sapiens
ugcuaugucagccaggcugguc

SEQ ID NO: 9290 - RNA, 22 nt, Homo sapiens
ugaaauuauucuuaccaaggug

SEQ ID NO: 9291 - RNA, 22 nt, Homo sapiens
ugagauguggcuagagagguug

SEQ ID NO: 9292 - RNA, 22 nt, Homo sapiens
guaaucucaccuacuugggagg

SEQ ID NO: 9293 - RNA, 22 nt, Homo sapiens
aagagguagucugucccuuagc

SEQ ID NO: 9294 - RNA, 22 nt, Homo sapiens
guggacaugaauuuuggaggca

SEQ ID NO: 9295 - RNA, 22 nt, Homo sapiens
aauacugugauaucgagcgauu

SEQ ID NO: 9296 - RNA, 22 nt, Homo sapiens
ucagacacugcccuccaccugu

SEQ ID NO: 9297 - RNA, 23 nt, Homo sapiens
uucaucagggauauuggccugaa

SEQ ID NO: 9298 - RNA, 22 nt, Homo sapiens
uagcaguaccccaguauccugg

SEQ ID NO: 9299 - RNA, 22 nt, Homo sapiens
uuucauggaggauuugcuucuu

SEQ ID NO: 9300 - RNA, 22 nt, Homo sapiens
uauugcucaugcauuuaauuuc

SEQ ID NO: 9301 - RNA, 22 nt, Homo sapiens
gucaugucugcacauaguaaaa

SEQ ID NO: 9302 - RNA, 22 nt, Homo sapiens
cuuugguguauuuucagagacc

SEQ ID NO: 9303 - RNA, 22 nt, Homo sapiens
aauugcaccaucuagaucaaga

SEQ ID NO: 9304 - RNA, 22 nt, Homo sapiens
ucugucuugugguuugagugcc

SEQ ID NO: 9305 - RNA, 22 nt, Homo sapiens
ucacugugguuuugaugugcau

SEQ ID NO: 9306 - RNA, 22 nt, Homo sapiens
uggcaaaugaaagaaagccagu

SEQ ID NO: 9307 - RNA, 22 nt, Homo sapiens
guugcucaggcuggagugcagu

SEQ ID NO: 9308 - RNA, 22 nt, Homo sapiens
ucaagcaauucuccucucagcc

SEQ ID NO: 9309 - RNA, 22 nt, Homo sapiens
auugcacaccagucugggcaaa

SEQ ID NO: 9310 - RNA, 22 nt, Homo sapiens
guauggaagucaguuuguuggc

SEQ ID NO: 9311 - RNA, 22 nt, Homo sapiens
ucucagugaauguggaaaaagc

SEQ ID NO: 9312 - RNA, 22 nt, Homo sapiens
augucaaagaggaaaacuggau

SEQ ID NO: 9313 - RNA, 22 nt, Homo sapiens
uucacaguacucccuggaauua

SEQ ID NO: 9314 - RNA, 18 nt, Homo sapiens
ccuuaguuauagagaguc

SEQ ID NO: 9315 - RNA, 22 nt, Homo sapiens
auguaauguuaaauugcuaauu

SEQ ID NO: 9316 - RNA, 22 nt, Homo sapiens
agcaguguggccuuagacccgg

SEQ ID NO: 9317 - RNA, 22 nt, Homo sapiens
ggcacuguggcucaagccugua

SEQ ID NO: 9318 - RNA, 22 nt, Homo sapiens
agaugguauuauagguuucugu

SEQ ID NO: 9319 - RNA, 22 nt, Homo sapiens
augaguaugagaauacauuaag

SEQ ID NO: 9320 - RNA, 22 nt, Homo sapiens
auacaagugccauguuggugug

SEQ ID NO: 9321 - RNA, 22 nt, Homo sapiens
caaaggauucauuuccaggagu

SEQ ID NO: 9322 - RNA, 22 nt, Homo sapiens
cauugcacuccagccugaccaa

SEQ ID NO: 9323 - RNA, 22 nt, Homo sapiens
gagacugagucuugcucuguca

SEQ ID NO: 9324 - RNA, 22 nt, Homo sapiens
aaagugaauguaucccguaagu

SEQ ID NO: 9325 - RNA, 23 nt, Homo sapiens
ucgcagcauucaauaccaggcag

SEQ ID NO: 9326 - RNA, 22 nt, Homo sapiens
gugacugcauccauccaggcuu

SEQ ID NO: 9327 - RNA, 22 nt, Homo sapiens
ugacaugauuguauauuuagaa

SEQ ID NO: 9328 - RNA, 22 nt, Homo sapiens
uugaaauguuuagaaguuugga

SEQ ID NO: 9329 - RNA, 22 nt, Homo sapiens
uugaaagcuaucucaaaucgcu

SEQ ID NO: 9330 - RNA, 22 nt, Homo sapiens
aagugcuuuuuagauaugguuu

SEQ ID NO: 9331 - RNA, 22 nt, Homo sapiens
gagcaucaguggccucaucuca

SEQ ID NO: 9332 - RNA, 22 nt, Homo sapiens
uuuuaguggaauauuuacaguu

SEQ ID NO: 9333 - RNA, 18 nt, Homo sapiens
acugcacuccaccuuggg

SEQ ID NO: 9334 - RNA, 21 nt, Homo sapiens
uuacaauggcuccuugaaggu

SEQ ID NO: 9335 - RNA, 22 nt, Homo sapiens
aggaucauugacuauuauaagg

SEQ ID NO: 9336 - RNA, 22 nt, Homo sapiens
cugacuuuagaacccaaaaagu

SEQ ID NO: 9337 - RNA, 22 nt, Homo sapiens
ugugccacugcacucccgccug

SEQ ID NO: 9338 - RNA, 20 nt, Homo sapiens
guucauguaauuaguucagg

SEQ ID NO: 9339 - RNA, 22 nt, Homo sapiens
uuaaauacagcaugguguuucu

SEQ ID NO: 9340 - RNA, 22 nt, Homo sapiens
cuuuuggcuuagaauugucuug

SEQ ID NO: 9341 - RNA, 22 nt, Homo sapiens
gagauacuugguuucuguuucu

SEQ ID NO: 9342 - RNA, 22 nt, Homo sapiens
uuggccagugucuuuuuuuccu

SEQ ID NO: 9343 - RNA, 22 nt, Homo sapiens
uugaaagucuaggcuuacagua

SEQ ID NO: 9344 - RNA, 22 nt, Homo sapiens
uuugucccucucaccaacgggg

SEQ ID NO: 9345 - RNA, 19 nt, Homo sapiens
ucgcgccauucuccugccu

SEQ ID NO: 9346 - RNA, 22 nt, Homo sapiens
uuuaaagcaugacgagaagaag

SEQ ID NO: 9347 - RNA, 22 nt, Homo sapiens
caaaagugguucuuauccuuuu

SEQ ID NO: 9348 - RNA, 22 nt, Homo sapiens
ugcgccauugcacuccagccug

SEQ ID NO: 9349 - RNA, 20 nt, Homo sapiens
ggaauagucuacacucugac

SEQ ID NO: 9350 - RNA, 22 nt, Homo sapiens
uuggcuuggagaguugaaaugu

SEQ ID NO: 9351 - RNA, 22 nt, Homo sapiens
ucagaguagagcgacuucuccu

SEQ ID NO: 9352 - RNA, 22 nt, Homo sapiens
ggagaugauuaugaaucacuua

SEQ ID NO: 9353 - RNA, 22 nt, Homo sapiens
uggaguguguugcagaugaagg

SEQ ID NO: 9354 - RNA, 22 nt, Homo sapiens
ugaugacauugucacagucuga

SEQ ID NO: 9355 - RNA, 22 nt, Homo sapiens
cuguaugugagaaauaauaagu

SEQ ID NO: 9356 - RNA, 22 nt, Homo sapiens
uagcaguagacagacuuuggcu

SEQ ID NO: 9357 - RNA, 22 nt, Homo sapiens
uaaucacagagguuuggccuca

SEQ ID NO: 9358 - RNA, 22 nt, Homo sapiens
uuguaaacaucuguacauugcu

SEQ ID NO: 9359 - RNA, 22 nt, Homo sapiens
uugaaagacagaggggcaaguu

SEQ ID NO: 9360 - RNA, 22 nt, Homo sapiens
cuggauauguugcaacauuucc

SEQ ID NO: 9361 - RNA, 22 nt, Homo sapiens
gugucccagugugcauacaggu

SEQ ID NO: 9362 - RNA, 22 nt, Homo sapiens
uuauucauuaauugcuaagguu

SEQ ID NO: 9363 - RNA, 22 nt, Homo sapiens
cauugcacuccagcucugggcg

SEQ ID NO: 9364 - RNA, 22 nt, Homo sapiens
uuauuagguugguggaaaagua

SEQ ID NO: 9365 - RNA, 22 nt, Homo sapiens
uggcaccauccaggugucucua

SEQ ID NO: 9366 - RNA, 22 nt, Homo sapiens
augggaaaaucagaaggccugg

SEQ ID NO: 9367 - RNA, 22 nt, Homo sapiens
auaagauaguggaagugggauu

SEQ ID NO: 9368 - RNA, 22 nt, Homo sapiens
uaugucuucuuuagagaaaugu

SEQ ID NO: 9369 - RNA, 22 nt, Homo sapiens
uugacuucagagcugauucaag

SEQ ID NO: 9370 - RNA, 22 nt, Homo sapiens
uugucuccuagacgaccaggcg

SEQ ID NO: 9371 - RNA, 22 nt, Homo sapiens
cugucucagccucuccaguagc

SEQ ID NO: 9372 - RNA, 22 nt, Homo sapiens
uucaguccauuuccuuggucac

SEQ ID NO: 9373 - RNA, 22 nt, Homo sapiens
acacuggaguuaaaggugauuu

SEQ ID NO: 9374 - RNA, 22 nt, Homo sapiens
ucgcgccauucuccugccucag

SEQ ID NO: 9375 - RNA, 17 nt, Homo sapiens
auaugucugcuggggga

SEQ ID NO: 9376 - RNA, 22 nt, Homo sapiens
auagcagugugaaaauguacua

SEQ ID NO: 9377 - RNA, 22 nt, Homo sapiens
agcaguacauaaaaagcauccu

SEQ ID NO: 9378 - RNA, 22 nt, Homo sapiens
guggaagaccagacuuuccaac

SEQ ID NO: 9379 - RNA, 20 nt, Homo sapiens
uaagugcauaggauauuucu

SEQ ID NO: 9380 - RNA, 22 nt, Homo sapiens
auacaagcaguccaacuccaua

SEQ ID NO: 9381 - RNA, 22 nt, Homo sapiens
accaugcaguccaauaugcaca

SEQ ID NO: 9382 - RNA, 22 nt, Homo sapiens
uugcacauggcaggugcucaau

SEQ ID NO: 9383 - RNA, 22 nt, Homo sapiens
uacgccuguaauaucagcauuu

SEQ ID NO: 9384 - RNA, 22 nt, Homo sapiens
aucucuugccagucagaauggu

SEQ ID NO: 9385 - RNA, 22 nt, Homo sapiens
auggaagaauugucggggaugu

SEQ ID NO: 9386 - RNA, 22 nt, Homo sapiens
uugagacggaguuuugcucuug

SEQ ID NO: 9387 - RNA, 22 nt, Homo sapiens
aaucacacuugauguugagcaa

SEQ ID NO: 9388 - RNA, 22 nt, Homo sapiens
uagcaguauacguacugggucc

SEQ ID NO: 9389 - RNA, 22 nt, Homo sapiens
ggagcugugauuugaguccaga

SEQ ID NO: 9390 - RNA, 22 nt, Homo sapiens
ucacuuugacggccaacuucua

SEQ ID NO: 9391 - RNA, 22 nt, Homo sapiens
uaagguccuuaaauguguaacc

SEQ ID NO: 9392 - RNA, 22 nt, Homo sapiens
caagugcuuucuuggggauuua

SEQ ID NO: 9393 - RNA, 22 nt, Homo sapiens
uuguaaaguucucucccgaaaa

SEQ ID NO: 9394 - RNA, 22 nt, Homo sapiens
guaaucucagcuacucaggagg

SEQ ID NO: 9395 - RNA, 20 nt, Homo sapiens
aagugcuuccuuuuagaggg

SEQ ID NO: 9396 - RNA, 22 nt, Homo sapiens
agguagcauagcgggaauauca

SEQ ID NO: 9397 - RNA, 22 nt, Homo sapiens
uucuggaaaucagcagagggug

SEQ ID NO: 9398 - RNA, 22 nt, Homo sapiens
uuccaugugggcuugucaagua

SEQ ID NO: 9399 - RNA, 22 nt, Homo sapiens
uuccaguguguucauccucaga

SEQ ID NO: 9400 - RNA, 22 nt, Homo sapiens
cugccacugacaccucaaggac

SEQ ID NO: 9401 - RNA, 22 nt, Homo sapiens
aaauugcuuuugaagacuuagu

SEQ ID NO: 9402 - RNA, 22 nt, Homo sapiens
caagugaauaguugcucucaga

SEQ ID NO: 9403 - RNA, 22 nt, Homo sapiens
ggcuuggaggaaugugagggcu

SEQ ID NO: 9404 - RNA, 22 nt, Homo sapiens
uagagguagagugacuucccca

SEQ ID NO: 9405 - RNA, 22 nt, Homo sapiens
ucuuuggucuacuuucauaugu

SEQ ID NO: 9406 - RNA, 22 nt, Homo sapiens
uggcaaaaaucacaaguaccuu

SEQ ID NO: 9407 - RNA, 22 nt, Homo sapiens
ucauugcauguuaauuaaacag

SEQ ID NO: 9408 - RNA, 22 nt, Homo sapiens
guucaagugauagcugggauua

SEQ ID NO: 9409 - RNA, 22 nt, Homo sapiens
uaacagcucuacagcugcucuu

SEQ ID NO: 9410 - RNA, 19 nt, Homo sapiens
auacacguguauacauaca

SEQ ID NO: 9411 - RNA, 22 nt, Homo sapiens
uucuccugguggacccuaaacg

SEQ ID NO: 9412 - RNA, 22 nt, Homo sapiens
guaugucuugucuauggcugcu

SEQ ID NO: 9413 - RNA, 22 nt, Homo sapiens
uaggcagccagcuguggauuga

SEQ ID NO: 9414 - RNA, 19 nt, Homo sapiens
ucauagucuaagaugagaa

SEQ ID NO: 9415 - RNA, 22 nt, Homo sapiens
uucauggaacaaguggguucaa

SEQ ID NO: 9416 - RNA, 22 nt, Homo sapiens
ugugccacugcacuccugccug

SEQ ID NO: 9417 - RNA, 18 nt, Homo sapiens
acauucagcuugaagaua

SEQ ID NO: 9418 - RNA, 21 nt, Homo sapiens
ccauggcaaugguaaacugac

SEQ ID NO: 9419 - RNA, 22 nt, Homo sapiens
accaguuuuuuauacaucuucu

SEQ ID NO: 9420 - RNA, 22 nt, Homo sapiens
augaccaaugggcagagcuaga

SEQ ID NO: 9421 - RNA, 22 nt, Homo sapiens
gugaaaagaugagcaccauaca

SEQ ID NO: 9422 - RNA, 22 nt, Homo sapiens
acauguaauugauuuuguguua

SEQ ID NO: 9423 - RNA, 22 nt, Homo sapiens
aaagugcuucucuuuggugggu

SEQ ID NO: 9424 - RNA, 22 nt, Homo sapiens
uuccuggagaguuuucccaaag

SEQ ID NO: 9425 - RNA, 22 nt, Homo sapiens
gugucaugagggggacaggaag

SEQ ID NO: 9426 - RNA, 22 nt, Homo sapiens
uauuccuuuugcauuuccacau

SEQ ID NO: 9427 - RNA, 22 nt, Homo sapiens
auugcaaagcguagacucuaaa

SEQ ID NO: 9428 - RNA, 22 nt, Homo sapiens
aucacuguuuugaugcucggac

SEQ ID NO: 9429 - RNA, 22 nt, Homo sapiens
uggaaugugaauaacuuccuuc

SEQ ID NO: 9430 - RNA, 22 nt, Homo sapiens
aagugcuuuguacagggguuga

SEQ ID NO: 9431 - RNA, 22 nt, Homo sapiens
ugagacacuucccagaucccuu

SEQ ID NO: 9432 - RNA, 22 nt, Homo sapiens
gcugcacuuuaaggcauccccu

SEQ ID NO: 9433 - RNA, 22 nt, Homo sapiens
auuauugcucccaauuuuucac

SEQ ID NO: 9434 - RNA, 22 nt, Homo sapiens
gauuuuccaguggcccugauca

SEQ ID NO: 9435 - RNA, 22 nt, Homo sapiens
agcagguguccacaauguuugc

SEQ ID NO: 9436 - RNA, 22 nt, Homo sapiens
gcaggcaugacauuucacucuu

SEQ ID NO: 9437 - RNA, 21 nt, Homo sapiens
auuguauguaaaccaaaugag

SEQ ID NO: 9438 - RNA, 22 nt, Homo sapiens
uggacauguacauauguguaug

SEQ ID NO: 9439 - RNA, 22 nt, Homo sapiens
cauugcacuccagccuugguga

SEQ ID NO: 9440 - RNA, 22 nt, Homo sapiens
uauuaguuuucuguggauuaca

SEQ ID NO: 9441 - RNA, 22 nt, Homo sapiens
auacuguuuuacaucauugccu

SEQ ID NO: 9442 - RNA, 22 nt, Homo sapiens
gugagauaucuagacuagggaa

SEQ ID NO: 9443 - RNA, 20 nt, Homo sapiens
uuccagcacauuagggaagc

SEQ ID NO: 9444 - RNA, 22 nt, Homo sapiens
ugcaugaugcugagauuuggga

SEQ ID NO: 9445 - RNA, 23 nt, Homo sapiens
aaauuugccuauuauuccuaugg

SEQ ID NO: 9446 - RNA, 22 nt, Homo sapiens
uagcagguguuccacaaauauu

SEQ ID NO: 9447 - RNA, 22 nt, Homo sapiens
auggcuuuuuaaaucauguugu

SEQ ID NO: 9448 - RNA, 22 nt, Homo sapiens
uucaugucuuggcuguuagagu

SEQ ID NO: 9449 - RNA, 20 nt, Homo sapiens
auuguccuugauuacacaga

SEQ ID NO: 9450 - RNA, 22 nt, Homo sapiens
cugugcuugagagaugacacag

SEQ ID NO: 9451 - RNA, 22 nt, Homo sapiens
agagugaagcuuuuuauauucu

SEQ ID NO: 9452 - RNA, 22 nt, Homo sapiens
ugugccacugcacucuggccug

SEQ ID NO: 9453 - RNA, 22 nt, Homo sapiens
uaagugaauuucacuacugagu

SEQ ID NO: 9454 - RNA, 22 nt, Homo sapiens
uaaguagaggaaucauuuugug

SEQ ID NO: 9455 - RNA, 22 nt, Homo sapiens
cuggugauugguuucauucagu

SEQ ID NO: 9456 - RNA, 22 nt, Homo sapiens
uaagucacuccagguuaaagug

SEQ ID NO: 9457 - RNA, 20 nt, Homo sapiens
uaucacaguucaggaacucu

SEQ ID NO: 9458 - RNA, 22 nt, Homo sapiens
aagagaugaagguccugacugu

SEQ ID NO: 9459 - RNA, 22 nt, Homo sapiens
augaaaagcauaaacgcugaag

SEQ ID NO: 9460 - RNA, 20 nt, Homo sapiens
uaagugcuuuauauugauua

SEQ ID NO: 9461 - RNA, 22 nt, Homo sapiens
ucucauggagucaggagcagaa

SEQ ID NO: 9462 - RNA, 22 nt, Homo sapiens
ucagacacuguggccuuuggac

SEQ ID NO: 9463 - RNA, 22 nt, Homo sapiens
ugucacaguuuguacuuuauag

SEQ ID NO: 9464 - RNA, 22 nt, Homo sapiens
ugagaugcauauucuggcuccu

SEQ ID NO: 9465 - RNA, 22 nt, Homo sapiens
uagagguagguguaugaacuag

SEQ ID NO: 9466 - RNA, 22 nt, Homo sapiens
cucagcuacuugggaagcugag

SEQ ID NO: 9467 - RNA, 22 nt, Homo sapiens
ucuuuuggguauggagccauca

SEQ ID NO: 9468 - RNA, 22 nt, Homo sapiens
aauaaagcagcuuuuugggacu

SEQ ID NO: 9469 - RNA, 22 nt, Homo sapiens
uaauccuagcacuuuggaagac

SEQ ID NO: 9470 - RNA, 22 nt, Homo sapiens
ugggagacuacauuuuuaacaa

SEQ ID NO: 9471 - RNA, 22 nt, Homo sapiens
uaggugaaugcuggaagaaaug

SEQ ID NO: 9472 - RNA, 22 nt, Homo sapiens
guggaaaauuauugcuguuuuu

SEQ ID NO: 9473 - RNA, 22 nt, Homo sapiens
acugcacuccagccuuggcaac

SEQ ID NO: 9474 - RNA, 22 nt, Homo sapiens
ugugaacauuuuguauauauua

SEQ ID NO: 9475 - RNA, 22 nt, Homo sapiens
uugcacauggcuggggaggccu

SEQ ID NO: 9476 - RNA, 22 nt, Homo sapiens
uagagguauaccaaaaaggcau

SEQ ID NO: 9477 - RNA, 22 nt, Homo sapiens
uaaacugucuugcaguuacaug

SEQ ID NO: 9478 - RNA, 22 nt, Homo sapiens
ugucacagagauuuugguaugu

SEQ ID NO: 9479 - RNA, 22 nt, Homo sapiens
cauugcacuuagacaacuuuug

SEQ ID NO: 9480 - RNA, 22 nt, Homo sapiens
uuugucccuuugcaguggcaca

SEQ ID NO: 9481 - RNA, 22 nt, Homo sapiens
guuggcaaguggcugagcuggg

SEQ ID NO: 9482 - RNA, 22 nt, Homo sapiens
cuaugagucugcagaucuauua

SEQ ID NO: 9483 - RNA, 22 nt, Homo sapiens
cucauugcaaucuccaccuccc

SEQ ID NO: 9484 - RNA, 22 nt, Homo sapiens
ccugagacgaauggagugaaca

SEQ ID NO: 9485 - RNA, 22 nt, Homo sapiens
cagcuaaauuguuaaauccaag

SEQ ID NO: 9486 - RNA, 22 nt, Homo sapiens
uugcaaagaccucuucacuucc

SEQ ID NO: 9487 - RNA, 22 nt, Homo sapiens
uugccuaggcuggaguucagug

SEQ ID NO: 9488 - RNA, 18 nt, Homo sapiens
ucuggcuucuuuguucca

SEQ ID NO: 9489 - RNA, 22 nt, Homo sapiens
auuacacuuucuauucaaugag

SEQ ID NO: 9490 - RNA, 22 nt, Homo sapiens
cacauugcaggaaaguucauua

SEQ ID NO: 9491 - RNA, 22 nt, Homo sapiens
uugcauaagugcauucugugau

SEQ ID NO: 9492 - RNA, 22 nt, Homo sapiens
ugagaugugugcauucaacuca

SEQ ID NO: 9493 - RNA, 18 nt, Homo sapiens
auauugcauuggauggau

SEQ ID NO: 9494 - RNA, 22 nt, Homo sapiens
guguccucgaguacacaucagg

SEQ ID NO: 9495 - RNA, 23 nt, Homo sapiens
ugagauuauaaucuuuuacuucu

SEQ ID NO: 9496 - RNA, 22 nt, Homo sapiens
acaagacuucuuguauucuagu

SEQ ID NO: 9497 - RNA, 22 nt, Homo sapiens
uaagugaaggaaguguguuuac

SEQ ID NO: 9498 - RNA, 20 nt, Homo sapiens
uaagugcuugagacuucuga

SEQ ID NO: 9499 - RNA, 22 nt, Homo sapiens
cucaguuuugccuuguuuaagg

SEQ ID NO: 9500 - RNA, 22 nt, Homo sapiens
uauugcacgccagccugagcaa

SEQ ID NO: 9501 - RNA, 22 nt, Homo sapiens
ccuucuuuuguaaggcugaaua

SEQ ID NO: 9502 - RNA, 22 nt, Homo sapiens
uccugagacugaggagcuuugg

SEQ ID NO: 9503 - RNA, 22 nt, Homo sapiens
accuggcacuuagcaaaucuga

SEQ ID NO: 9504 - RNA, 22 nt, Homo sapiens
gauggcacuaagccauguagga

SEQ ID NO: 9505 - RNA, 22 nt, Homo sapiens
caggugcuuacuuaauagccau

SEQ ID NO: 9506 - RNA, 22 nt, Homo sapiens
auucaaagugcauguucccacu

SEQ ID NO: 9507 - RNA, 22 nt, Homo sapiens
auggcacagaguagaugcucaa

SEQ ID NO: 9508 - RNA, 22 nt, Homo sapiens
cauugcacuccagccugccugg

SEQ ID NO: 9509 - RNA, 20 nt, Homo sapiens
cuggaugucgaggcagaggu

SEQ ID NO: 9510 - RNA, 22 nt, Homo sapiens
ugaaauuguuugcaaggauagg

SEQ ID NO: 9511 - RNA, 22 nt, Homo sapiens
guaaucucagcuacucgggagg

SEQ ID NO: 9512 - RNA, 22 nt, Homo sapiens
aaaugcauaucaagauugcccu

SEQ ID NO: 9513 - RNA, 22 nt, Homo sapiens
ucagguccuuacugugcucccu

SEQ ID NO: 9514 - RNA, 22 nt, Homo sapiens
auaugucuuaguuaccuugggc

SEQ ID NO: 9515 - RNA, 22 nt, Homo sapiens
cauugcacuccaccuuggguaa

SEQ ID NO: 9516 - RNA, 22 nt, Homo sapiens
gcagucacagggagauggugac

SEQ ID NO: 9517 - RNA, 22 nt, Homo sapiens
uuggcagcuguggaaucugggc

SEQ ID NO: 9518 - RNA, 22 nt, Homo sapiens
uucauagucuaugcaaguaaga

SEQ ID NO: 9519 - RNA, 22 nt, Homo sapiens
guggaaaaguaguugcgguuuu

SEQ ID NO: 9520 - RNA, 22 nt, Homo sapiens
uaucacaggucaggaaccuugu

SEQ ID NO: 9521 - RNA, 22 nt, Homo sapiens
agucacagguucuugggauuag

SEQ ID NO: 9522 - RNA, 20 nt, Homo sapiens
guucacaggcuuccuuucag

SEQ ID NO: 9523 - RNA, 22 nt, Homo sapiens
gugugcucaucacaugcaauag

SEQ ID NO: 9524 - RNA, 22 nt, Homo sapiens
caaaagugauugcgguuuuugc

SEQ ID NO: 9525 - RNA, 17 nt, Homo sapiens
gugagguauccucaaaa

SEQ ID NO: 9526 - RNA, 22 nt, Homo sapiens
uugaauagaagguuuuuuguuc

SEQ ID NO: 9527 - RNA, 22 nt, Homo sapiens
aggacacugauguaugcugugg

SEQ ID NO: 9528 - RNA, 22 nt, Homo sapiens
cauugcacuccaucccgggaaa

SEQ ID NO: 9529 - RNA, 22 nt, Homo sapiens
cauacagcuaguaaguguaaga

SEQ ID NO: 9530 - RNA, 21 nt, Homo sapiens
uccugagagaggaguaacucu

SEQ ID NO: 9531 - RNA, 19 nt, Homo sapiens
uacccagaagcagcauugu

SEQ ID NO: 9532 - RNA, 22 nt, Homo sapiens
cugagauggagucucgcauugu

SEQ ID NO: 9533 - RNA, 22 nt, Homo sapiens
augauguaggccauggguuucu

SEQ ID NO: 9534 - RNA, 22 nt, Homo sapiens
ggguucaaaucuuggcucuuac

SEQ ID NO: 9535 - RNA, 22 nt, Homo sapiens
acugcacuccacccuuggcagc

SEQ ID NO: 9536 - RNA, 22 nt, Homo sapiens
auaugucuauuauuagggcagg

SEQ ID NO: 9537 - RNA, 22 nt, Homo sapiens
uauuguacauguuauagauuuu

SEQ ID NO: 9538 - RNA, 20 nt, Homo sapiens
ugugauuauuuaguugcaug

SEQ ID NO: 9539 - RNA, 22 nt, Homo sapiens
uuagugaaugcaccacuucuga

SEQ ID NO: 9540 - RNA, 22 nt, Homo sapiens
aaauugcauugagcugcuuauu

SEQ ID NO: 9541 - RNA, 22 nt, Homo sapiens
auuccauuuguuaucacacccg

SEQ ID NO: 9542 - RNA, 20 nt, Homo sapiens
augaagugaaguuagggaac

SEQ ID NO: 9543 - RNA, 22 nt, Homo sapiens
uaguuauggaguaauuuuaagc

SEQ ID NO: 9544 - RNA, 22 nt, Homo sapiens
uagacacuagauaugugacuga

SEQ ID NO: 9545 - RNA, 22 nt, Homo sapiens
ugaauguaagaugucugcuggu

SEQ ID NO: 9546 - RNA, 22 nt, Homo sapiens
agaacuguccauucagcaugaa

SEQ ID NO: 9547 - RNA, 22 nt, Homo sapiens
guggaagaaaucagguuauuug

SEQ ID NO: 9548 - RNA, 22 nt, Homo sapiens
ugcauccauucuagacucaucu

SEQ ID NO: 9549 - RNA, 22 nt, Homo sapiens
gcauggccuuuaaaugucacag

SEQ ID NO: 9550 - RNA, 21 nt, Homo sapiens
uaucacaguagaauaggaucu

SEQ ID NO: 9551 - RNA, 22 nt, Homo sapiens
ucaggcuuuucccagagugaug

SEQ ID NO: 9552 - RNA, 22 nt, Homo sapiens
guggaauggaaugauuguguau

SEQ ID NO: 9553 - RNA, 22 nt, Homo sapiens
aauacuggcacugaagaccaug

SEQ ID NO: 9554 - RNA, 21 nt, Homo sapiens
ugugaccucugucucugaguc

SEQ ID NO: 9555 - RNA, 22 nt, Homo sapiens
aagcaggugucugugucuguaa

SEQ ID NO: 9556 - RNA, 22 nt, Homo sapiens
gcaguggugugugccagccuag

SEQ ID NO: 9557 - RNA, 22 nt, Homo sapiens
ucuggcuugugaacugucuucu

SEQ ID NO: 9558 - RNA, 22 nt, Homo sapiens
ugagaucaugccacugcacuuc

SEQ ID NO: 9559 - RNA, 22 nt, Homo sapiens
uugaaagaugaacuggauugga

SEQ ID NO: 9560 - RNA, 22 nt, Homo sapiens
cccugagagcagggucuuucuc

SEQ ID NO: 9561 - RNA, 22 nt, Homo sapiens
cucaaguaauccucccgccuug

SEQ ID NO: 9562 - RNA, 22 nt, Homo sapiens
uggaaugucagcuacaagaggg

SEQ ID NO: 9563 - RNA, 22 nt, Homo sapiens
uuugguaguuuguugggaccca

SEQ ID NO: 9564 - RNA, 21 nt, Homo sapiens
uaaagcuuagcuauaguggcu

SEQ ID NO: 9565 - RNA, 22 nt, Homo sapiens
ugaguuagguaauaauaaauau

SEQ ID NO: 9566 - RNA, 18 nt, Homo sapiens
uaaauugcuucaccugag

SEQ ID NO: 9567 - RNA, 22 nt, Homo sapiens
aacacggcccgcagagcaagcu

SEQ ID NO: 9568 - RNA, 22 nt, Homo sapiens
ugccuaguagaaggugaacaug

SEQ ID NO: 9569 - RNA, 22 nt, Homo sapiens
ugugaacacagaggcuauggca

SEQ ID NO: 9570 - RNA, 22 nt, Homo sapiens
aacagugcauuccuguccauau

SEQ ID NO: 9571 - RNA, 22 nt, Homo sapiens
ugucaugaacucacauucuggg

SEQ ID NO: 9572 - RNA, 22 nt, Homo sapiens
aucccagaaacucggguuucuc

SEQ ID NO: 9573 - RNA, 22 nt, Homo sapiens
auccaucagacggcaggcguug

SEQ ID NO: 9574 - RNA, 22 nt, Homo sapiens
uagagguaggucuucgagucuc

SEQ ID NO: 9575 - RNA, 18 nt, Homo sapiens
uucuuguguugauauuuu

SEQ ID NO: 9576 - RNA, 22 nt, Homo sapiens
ugauugcacaccugcacucaag

SEQ ID NO: 9577 - RNA, 22 nt, Homo sapiens
aucacuguaaguuuacacuuug

SEQ ID NO: 9578 - RNA, 22 nt, Homo sapiens
aaagucuguuacagcuauuucu

SEQ ID NO: 9579 - RNA, 22 nt, Homo sapiens
uuaaucuguucucuguauucua

SEQ ID NO: 9580 - RNA, 22 nt, Homo sapiens
uucuaaguaauuuugcaugccu

SEQ ID NO: 9581 - RNA, 22 nt, Homo sapiens
ucacugugugucucuguaucug

SEQ ID NO: 9582 - RNA, 21 nt, Homo sapiens
uacaaugcacaggagagccuc

SEQ ID NO: 9583 - RNA, 22 nt, Homo sapiens
cuuuuggcuuaagauugucuug

SEQ ID NO: 9584 - RNA, 22 nt, Homo sapiens
aguagcaauggcucugagcuau

SEQ ID NO: 9585 - RNA, 22 nt, Homo sapiens
uaaguaaaugaaagguugauuu

SEQ ID NO: 9586 - RNA, 22 nt, Homo sapiens
aucacugugauuucuacugugc

SEQ ID NO: 9587 - RNA, 22 nt, Homo sapiens
ugugcucaucucagucaacugu

SEQ ID NO: 9588 - RNA, 22 nt, Homo sapiens
gugaggcacugcugcuuuccag

SEQ ID NO: 9589 - RNA, 22 nt, Homo sapiens
uggaauguaacuugaaacuuuu

SEQ ID NO: 9590 - RNA, 22 nt, Homo sapiens
accugagacuaggcauuuuaua

SEQ ID NO: 9591 - RNA, 20 nt, Homo sapiens
cuugccuagcccuuugccuc

SEQ ID NO: 9592 - RNA, 22 nt, Homo sapiens
uaugucaugggguuuuugagau

SEQ ID NO: 9593 - RNA, 22 nt, Homo sapiens
uagaaagcaugaccuucagaua

SEQ ID NO: 9594 - RNA, 22 nt, Homo sapiens
aagggaauguuguggcugguug

SEQ ID NO: 9595 - RNA, 22 nt, Homo sapiens
uagcaguauggagcgaggccca

SEQ ID NO: 9596 - RNA, 22 nt, Homo sapiens
uguacuucaagauuaugguuua

SEQ ID NO: 9597 - RNA, 22 nt, Homo sapiens
gucacugucuacuguaauagcc

SEQ ID NO: 9598 - RNA, 18 nt, Homo sapiens
uugcaaauucuucccugu

SEQ ID NO: 9599 - RNA, 22 nt, Homo sapiens
guaaucucagcuacuugggagg

SEQ ID NO: 9600 - RNA, 22 nt, Homo sapiens
auagugcagugaugaaccuagg

SEQ ID NO: 9601 - RNA, 22 nt, Homo sapiens
gaaucacaguuauuagagcagc

SEQ ID NO: 9602 - RNA, 22 nt, Homo sapiens
uggaaugguaucuuguuggggu

SEQ ID NO: 9603 - RNA, 17 nt, Homo sapiens
cccuaguagcugggacu

SEQ ID NO: 9604 - RNA, 22 nt, Homo sapiens
uugagacggagucuugcucuuu

SEQ ID NO: 9605 - RNA, 22 nt, Homo sapiens
gucacuguuuccuauuauauuu

SEQ ID NO: 9606 - RNA, 22 nt, Homo sapiens
agaaacauucucuugccuccuu

SEQ ID NO: 9607 - RNA, 20 nt, Homo sapiens
aagacacuguccccacugga

SEQ ID NO: 9608 - RNA, 22 nt, Homo sapiens
auuggcagaaaucuuuauagua

SEQ ID NO: 9609 - RNA, 18 nt, Homo sapiens
uuucaagucuuaggugac

SEQ ID NO: 9610 - RNA, 22 nt, Homo sapiens
aagggaaugugguagcugguuu

SEQ ID NO: 9611 - RNA, 22 nt, Homo sapiens
ugagauuguaucugcaaugugu

SEQ ID NO: 9612 - RNA, 22 nt, Homo sapiens
guaugauacuguaacagugggu

SEQ ID NO: 9613 - RNA, 22 nt, Homo sapiens
auugcacaucugcacuacagcc

SEQ ID NO: 9614 - RNA, 22 nt, Homo sapiens
aaaggcuucggaucagaaggua

SEQ ID NO: 9615 - RNA, 17 nt, Homo sapiens
aaucagauuucugagga

SEQ ID NO: 9616 - RNA, 19 nt, Homo sapiens
uuuugcucuuuauaccuau

SEQ ID NO: 9617 - RNA, 21 nt, Homo sapiens
ugcuauguuguccaggcuggc

SEQ ID NO: 9618 - RNA, 21 nt, Homo sapiens
auugcacaauauacccaugua

SEQ ID NO: 9619 - RNA, 22 nt, Homo sapiens
uucauaguucuuuuagucauua

SEQ ID NO: 9620 - RNA, 22 nt, Homo sapiens
gucacauugaugcccauggugg

SEQ ID NO: 9621 - RNA, 22 nt, Homo sapiens
auccuuuagacuguccaguuga

SEQ ID NO: 9622 - RNA, 22 nt, Homo sapiens
ggaucauaugauagcucaauuu

SEQ ID NO: 9623 - RNA, 22 nt, Homo sapiens
auuguaauuuuagagaaagugg

SEQ ID NO: 9624 - RNA, 22 nt, Homo sapiens
uucacagucacccuucuccaug

SEQ ID NO: 9625 - RNA, 22 nt, Homo sapiens
caugacacuggcauguuucuuu

SEQ ID NO: 9626 - RNA, 22 nt, Homo sapiens
aucaugucuucccagugauucu

SEQ ID NO: 9627 - RNA, 22 nt, Homo sapiens
uugugaauggugccgcgauaaa

SEQ ID NO: 9628 - RNA, 22 nt, Homo sapiens
cauugcacuccagccuaggcaa

SEQ ID NO: 9629 - RNA, 22 nt, Homo sapiens
uugccuaggcuggagugcagua

SEQ ID NO: 9630 - RNA, 22 nt, Homo sapiens
uacuguacugcaguucugcaaa

SEQ ID NO: 9631 - RNA, 21 nt, Homo sapiens
uaaaacuguaacuuuguccug

SEQ ID NO: 9632 - RNA, 22 nt, Homo sapiens
gugagauacuagagauauagug

SEQ ID NO: 9633 - RNA, 22 nt, Homo sapiens
auacuguauaggauuguagccu

SEQ ID NO: 9634 - RNA, 22 nt, Homo sapiens
auaaaugcuuagaucuguauau

SEQ ID NO: 9635 - RNA, 22 nt, Homo sapiens
agaaccaaucccacauggauac

SEQ ID NO: 9636 - RNA, 22 nt, Homo sapiens
auggccgggugcgguggcucac

SEQ ID NO: 9637 - RNA, 22 nt, Homo sapiens
aauugcacuacugcacucccac

SEQ ID NO: 9638 - RNA, 22 nt, Homo sapiens
gugaaagacagcauuaauggcu

SEQ ID NO: 9639 - RNA, 22 nt, Homo sapiens
uuuuaguggacaaagguauuua

SEQ ID NO: 9640 - RNA, 22 nt, Homo sapiens
uuuuccagugggacucccauua

SEQ ID NO: 9641 - RNA, 22 nt, Homo sapiens
cauugcacugcuucuugggugu

SEQ ID NO: 9642 - RNA, 22 nt, Homo sapiens
acugcacuucagccuugggaaa

SEQ ID NO: 9643 - RNA, 22 nt, Homo sapiens
uuucugaggccucaccagaagc

SEQ ID NO: 9644 - RNA, 22 nt, Homo sapiens
gugcaaugagaaggggcucugg

SEQ ID NO: 9645 - RNA, 22 nt, Homo sapiens
gaauuguacugcaaucagggga

SEQ ID NO: 9646 - RNA, 22 nt, Homo sapiens
acagaacugggcuugcuuuugg

SEQ ID NO: 9647 - RNA, 22 nt, Homo sapiens
uaggucaguuuuggcuuggcuu

SEQ ID NO: 9648 - RNA, 22 nt, Homo sapiens
ccuuggcaauggcuggggcuga

SEQ ID NO: 9649 - RNA, 22 nt, Homo sapiens
guggaagauaguguguuaaugu

SEQ ID NO: 9650 - RNA, 19 nt, Homo sapiens
ugccauguagcacaugguc

SEQ ID NO: 9651 - RNA, 22 nt, Homo sapiens
uucaagaauuaaaguggcuuuu

SEQ ID NO: 9652 - RNA, 22 nt, Homo sapiens
uccuucaguccaguggguuuug

SEQ ID NO: 9653 - RNA, 22 nt, Homo sapiens
cauugcacuccagccuggcaac

SEQ ID NO: 9654 - RNA, 22 nt, Homo sapiens
agagugcuauagauuagauuuc

SEQ ID NO: 9655 - RNA, 22 nt, Homo sapiens
ggaaucugaaccaugggaaugg

SEQ ID NO: 9656 - RNA, 22 nt, Homo sapiens
aauugcacuaagcauaguccag

SEQ ID NO: 9657 - RNA, 22 nt, Homo sapiens
aucgcgccauuguacuccagcc

SEQ ID NO: 9658 - RNA, 22 nt, Homo sapiens
uucuggccuccauuuuucuccu

SEQ ID NO: 9659 - RNA, 22 nt, Homo sapiens
acaccaugucuguuucugguuu

SEQ ID NO: 9660 - RNA, 22 nt, Homo sapiens
ugccuaguggaaggagagcaaa

SEQ ID NO: 9661 - RNA, 22 nt, Homo sapiens
uuuuggcucugucuguaucuuu

SEQ ID NO: 9662 - RNA, 22 nt, Homo sapiens
uugaguuugaguauucuaaagc

SEQ ID NO: 9663 - RNA, 22 nt, Homo sapiens
acauaguagacacugaaaauau

SEQ ID NO: 9664 - RNA, 22 nt, Homo sapiens
gugugauuguuaauuuuaggug

SEQ ID NO: 9665 - RNA, 22 nt, Homo sapiens
uucaguauugcaccuggagucc

SEQ ID NO: 9666 - RNA, 22 nt, Homo sapiens
agugccaaaucgagggcucuga

SEQ ID NO: 9667 - RNA, 22 nt, Homo sapiens
aaagugcugagaguucuaacuu

SEQ ID NO: 9668 - RNA, 22 nt, Homo sapiens
ugagacacugaauccggccuga

SEQ ID NO: 9669 - RNA, 22 nt, Homo sapiens
acccugugaauauuuaaacuuc

SEQ ID NO: 9670 - RNA, 22 nt, Homo sapiens
aauaaagcauggcuacuccaua

SEQ ID NO: 9671 - RNA, 22 nt, Homo sapiens
uggcaagauuguuccgguuugg

SEQ ID NO: 9672 - RNA, 22 nt, Homo sapiens
ucaaagugagcuccuucucacu

SEQ ID NO: 9673 - RNA, 22 nt, Homo sapiens
cugauugucaucaauauuauua

SEQ ID NO: 9674 - RNA, 22 nt, Homo sapiens
uucucaauggcaacuuguugcu

SEQ ID NO: 9675 - RNA, 22 nt, Homo sapiens
uagcagaauauaccucuuacuu

SEQ ID NO: 9676 - RNA, 22 nt, Homo sapiens
uugaaagcuaucagagauucca

SEQ ID NO: 9677 - RNA, 22 nt, Homo sapiens
uuccaguugugagcuauccggg

SEQ ID NO: 9678 - RNA, 22 nt, Homo sapiens
cuuucugaggagaauagagaac

SEQ ID NO: 9679 - RNA, 22 nt, Homo sapiens
uuggagugugcucauaacugcu

SEQ ID NO: 9680 - RNA, 22 nt, Homo sapiens
gagaaugaugauuuccaauuuc

SEQ ID NO: 9681 - RNA, 22 nt, Homo sapiens
ugucacccuuuauccauuuccu

SEQ ID NO: 9682 - RNA, 22 nt, Homo sapiens
uauggcacuaguacuggaaagc

SEQ ID NO: 9683 - RNA, 22 nt, Homo sapiens
uggucuucuggccuccagaacc

SEQ ID NO: 9684 - RNA, 22 nt, Homo sapiens
uugaaagucauuucuucuaagu

SEQ ID NO: 9685 - RNA, 16 nt, Homo sapiens
aucacuugcuucuuuu

SEQ ID NO: 9686 - RNA, 22 nt, Homo sapiens
cauugcacuccaucuugggcaa

SEQ ID NO: 9687 - RNA, 22 nt, Homo sapiens
cauugcacuccagcuugggcaa

SEQ ID NO: 9688 - RNA, 22 nt, Homo sapiens
cacuuugguucaccugaguuuc

SEQ ID NO: 9689 - RNA, 23 nt, Homo sapiens
ggaaacauccagucuuucaccau

SEQ ID NO: 9690 - RNA, 22 nt, Homo sapiens
uugaaagacaucaccuacugcu

SEQ ID NO: 9691 - RNA, 22 nt, Homo sapiens
auauguauuuuaacguguaagg

SEQ ID NO: 9692 - RNA, 22 nt, Homo sapiens
aucccuugacguggagucucug

SEQ ID NO: 9693 - RNA, 22 nt, Homo sapiens
gcaaagaaugcagauuugccuc

SEQ ID NO: 9694 - RNA, 22 nt, Homo sapiens
uggucaccugaauuaugcaugu

SEQ ID NO: 9695 - RNA, 22 nt, Homo sapiens
uacaagcacaggcagcaggcug

SEQ ID NO: 9696 - RNA, 22 nt, Homo sapiens
aaaugcagucuuuguucugggc

SEQ ID NO: 9697 - RNA, 22 nt, Homo sapiens
guucuggagauaaagccaaggu

SEQ ID NO: 9698 - RNA, 22 nt, Homo sapiens
cauugcacugcauucugggcaa

SEQ ID NO: 9699 - RNA, 22 nt, Mycobacterium avium subsp. paratuberculosis
uuucugaguucgcgggucaccg

SEQ ID NO: 9700 - RNA, 22 nt, Mycobacterium avium subsp. paratuberculosis
uuucauucgcccguuggguugg

SEQ ID NO: 9701 - RNA, 22 nt, Mycobacterium avium subsp. paratuberculosis
uugaggaucagguucagcuggc

SEQ ID NO: 9702 - RNA, 22 nt, Mycobacterium avium subsp. paratuberculosis
uugagguugaacuugccggugc

SEQ ID NO: 9703 - RNA, 22 nt, Mycobacterium avium subsp. paratuberculosis
uugcuggcaccgcugcgcuggg

SEQ ID NO: 9704 - RNA, 22 nt, Mycobacterium avium subsp. paratuberculosis
uuguggccggugucucaugucg

SEQ ID NO: 9705 - RNA, 22 nt, Mycobacterium avium subsp. paratuberculosis
uuguuuuuggccggauggccgu

SEQ ID NO: 9706 - RNA, 21 nt, Mycobacterium avium subsp. paratuberculosis
uugguguugcggcugcggucc

SEQ ID NO: 9707 - RNA, 22 nt, Mycobacterium avium subsp. paratuberculosis
uucaagguugaagcccuaaccu

SEQ ID NO: 9708 - RNA, 22 nt, Mycobacterium avium subsp. paratuberculosis
ugggccgacggcggcauccggc

SEQ ID NO: 9709 - RNA, 22 nt, Mycobacterium avium subsp. paratuberculosis
ugggcuggcgcgccgccgaggu

SEQ ID NO: 9710 - RNA, 18 nt, Mycobacterium avium subsp. paratuberculosis
ugggcuggcgguccugcg

SEQ ID NO: 9711 - RNA, 22 nt, Mycobacterium avium subsp. paratuberculosis
ugguggugcccggcgucggcgc

SEQ ID NO: 9712 - RNA, 22 nt, Mycobacterium avium subsp. paratuberculosis
uggugguggucaucgcgauccu

SEQ ID NO: 9713 - RNA, 22 nt, Mycobacterium avium subsp. paratuberculosis
ugguuggucaccaucaccgacg

SEQ ID NO: 9714 - RNA, 22 nt, Mycobacterium avium subsp. paratuberculosis
uguccgcagaucgagcagccgu

SEQ ID NO: 9715 - RNA, 22 nt, Mycobacterium avium subsp. paratuberculosis
ugugggaugaggugcaggugca

SEQ ID NO: 9716 - RNA, 22 nt, Mycobacterium avium subsp. paratuberculosis
ugugguaccggcccguugcugc

SEQ ID NO: 9717 - RNA, 23 nt, Mycobacterium avium subsp. paratuberculosis
ugugcuuccgggugucgucggac

SEQ ID NO: 9718 - RNA, 22 nt, Mycobacterium avium subsp. paratuberculosis
ucuugcagggccuggagcuugg

SEQ ID NO: 9719 - RNA, 19 nt, Mycobacterium avium subsp. paratuberculosis
ucugcaggguggcccaguu

SEQ ID NO: 9720 - RNA, 22 nt, Mycobacterium avium subsp. paratuberculosis
ucugccaacauaagagccgacg

SEQ ID NO: 9721 - RNA, 22 nt, Mycobacterium avium subsp. paratuberculosis
ucuggccaccaccaaacgccug

SEQ ID NO: 9722 - RNA, 23 nt, Mycobacterium avium subsp. paratuberculosis
ucuggccucggagccgccgagcc

SEQ ID NO: 9723 - RNA, 22 nt, Mycobacterium avium subsp. paratuberculosis
ugaccugcgaccaggaccgguc

SEQ ID NO: 9724 - RNA, 22 nt, Mycobacterium avium subsp. paratuberculosis
ugagaggugacgcaauugacgc

SEQ ID NO: 9725 - RNA, 22 nt, Mycobacterium avium subsp. paratuberculosis
ugccccuacuugucccgcucgg

SEQ ID NO: 9726 - RNA, 22 nt, Mycobacterium avium subsp. paratuberculosis
ugcaggauccgccaggcgacuu

SEQ ID NO: 9727 - RNA, 22 nt, Mycobacterium avium subsp. paratuberculosis
ugcaggccgucgcggguguugu

SEQ ID NO: 9728 - RNA, 22 nt, Mycobacterium avium subsp. paratuberculosis
ugcccggcugggaagccggcau

SEQ ID NO: 9729 - RNA, 23 nt, Mycobacterium avium subsp. paratuberculosis
ugcuggcccccguguucuccucc

SEQ ID NO: 9730 - RNA, 22 nt, Mycobacterium avium subsp. paratuberculosis
ugcuggccgacauggcgagaau

SEQ ID NO: 9731 - RNA, 22 nt, Mycobacterium avium subsp. paratuberculosis
ugcugggaucgcuccccgacau

SEQ ID NO: 9732 - RNA, 22 nt, Mycobacterium avium subsp. paratuberculosis
ugcuuggacuccucggggaugu

SEQ ID NO: 9733 - RNA, 22 nt, Mycobacterium avium subsp. paratuberculosis
uggacgcgggccugucccacgu

SEQ ID NO: 9734 - RNA, 22 nt, Mycobacterium avium subsp. paratuberculosis
ugcccggcggugcgccuaccgg

SEQ ID NO: 9735 - RNA, 22 nt, Mycobacterium avium subsp. paratuberculosis
ugcgccaccaagauaucgggcg

SEQ ID NO: 9736 - RNA, 22 nt, Mycobacterium avium subsp. paratuberculosis
ugcgccaccgguggaacggucg

SEQ ID NO: 9737 - RNA, 22 nt, Mycobacterium avium subsp. paratuberculosis
ugcgcgcggaccugcuccacca

SEQ ID NO: 9738 - RNA, 22 nt, Mycobacterium avium subsp. paratuberculosis
ugcugcgcacuuugccgcuccu

SEQ ID NO: 9739 - RNA, 22 nt, Mycobacterium avium subsp. paratuberculosis
uggccagccggccguguagcuc

SEQ ID NO: 9740 - RNA, 23 nt, Mycobacterium avium subsp. paratuberculosis
uggcaggccggccugaugguggc

SEQ ID NO: 9741 - RNA, 22 nt, Mycobacterium avium subsp. paratuberculosis
ugggcgcacuuucgccggacgc

SEQ ID NO: 9742 - RNA, 22 nt, Mycobacterium avium subsp. paratuberculosis
ugggcgcgugcguugcagccgg

SEQ ID NO: 9743 - RNA, 22 nt, Mycobacterium avium subsp. paratuberculosis
ugggcucaccaggacgucgcgc

SEQ ID NO: 9744 - RNA, 22 nt, Mycobacterium avium subsp. paratuberculosis
ugggcucagccugcuggucgaa

SEQ ID NO: 9745 - RNA, 22 nt, Mycobacterium avium subsp. paratuberculosis
uggcguggcccugcugcacgcg

SEQ ID NO: 9746 - RNA, 22 nt, Mycobacterium avium subsp. paratuberculosis
uggcuggccgucaucaccggcg

SEQ ID NO: 9747 - RNA, 22 nt, Mycobacterium avium subsp. paratuberculosis
gcaacaaccccacguucggcgu

SEQ ID NO: 9748 - RNA, 22 nt, Mycobacterium avium subsp. paratuberculosis
gcaacugcucagccacuccuug

SEQ ID NO: 9749 - RNA, 22 nt, Mycobacterium avium subsp. paratuberculosis
gaugccuucgacaaggcgaaga

SEQ ID NO: 9750 - RNA, 22 nt, Mycobacterium avium subsp. paratuberculosis
gagggccugggcuacuacugcg

SEQ ID NO: 9751 - RNA, 20 nt, Mycobacterium avium subsp. paratuberculosis
gaccaugcagcaggaccgcu

SEQ ID NO: 9752 - RNA, 20 nt, Mycobacterium avium subsp. paratuberculosis
gacguucuccacgcugcggc

SEQ ID NO: 9753 - RNA, 22 nt, Mycobacterium avium subsp. paratuberculosis
gaagugcaccugguugcugauc

SEQ ID NO: 9754 - RNA, 22 nt, Mycobacterium avium subsp. paratuberculosis
gaagugcugcgcgaugauaagc

SEQ ID NO: 9755 - RNA, 22 nt, Mycobacterium avium subsp. paratuberculosis
gaccugcagccggaugugcuga

SEQ ID NO: 9756 - RNA, 22 nt, Mycobacterium avium subsp. paratuberculosis
gagaaccaguccucgggcguca

SEQ ID NO: 9757 - RNA, 22 nt, Mycobacterium avium subsp. paratuberculosis
gagauacacccgggcauccgac

SEQ ID NO: 9758 - RNA, 22 nt, Mycobacterium avium subsp. paratuberculosis
gagcaggaaggccaccagcgca

SEQ ID NO: 9759 - RNA, 22 nt, Mycobacterium avium subsp. paratuberculosis
gccagccagccguugccggauc

SEQ ID NO: 9760 - RNA, 22 nt, Mycobacterium avium subsp. paratuberculosis
gccagcagccgcgaggugucac

SEQ ID NO: 9761 - RNA, 23 nt, Mycobacterium avium subsp. paratuberculosis
gccagcucgacggggugcucggc

SEQ ID NO: 9762 - RNA, 22 nt, Mycobacterium avium subsp. paratuberculosis
gccaggcugggcgagcugcuag

SEQ ID NO: 9763 - RNA, 22 nt, Mycobacterium avium subsp. paratuberculosis
gcccacaaguccgaggugcugg

SEQ ID NO: 9764 - RNA, 22 nt, Mycobacterium avium subsp. paratuberculosis
gcccgccucugagcgacaauca

SEQ ID NO: 9765 - RNA, 22 nt, Mycobacterium avium subsp. paratuberculosis
gccacccugcugggcaugcugg

SEQ ID NO: 9766 - RNA, 22 nt, Mycobacterium avium subsp. paratuberculosis
gccaccucggcacccuggugau

SEQ ID NO: 9767 - RNA, 22 nt, Mycobacterium avium subsp. paratuberculosis
gcagcgugaugagcgaugccgc

SEQ ID NO: 9768 - RNA, 22 nt, Mycobacterium avium subsp. paratuberculosis
gcagcaugucccagucguggua

SEQ ID NO: 9769 - RNA, 22 nt, Mycobacterium avium subsp. paratuberculosis
gauggugccgcggaacuucucg

SEQ ID NO: 9770 - RNA, 22 nt, Mycobacterium avium subsp. paratuberculosis
gcacgcccgcgagcaccgccau

SEQ ID NO: 9771 - RNA, 22 nt, Mycobacterium avium subsp. paratuberculosis
gccauuuucccgagucccggca

SEQ ID NO: 9772 - RNA, 21 nt, Mycobacterium avium subsp. paratuberculosis
gccguggcguuacgagcgagc

SEQ ID NO: 9773 - RNA, 22 nt, Mycobacterium avium subsp. paratuberculosis
gccuccagcgccaucaccagcu

SEQ ID NO: 9774 - RNA, 22 nt, Mycobacterium avium subsp. paratuberculosis
gccugcagauaguccagcgugu

SEQ ID NO: 9775 - RNA, 22 nt, Mycobacterium avium subsp. paratuberculosis
gcgaugaggaucugucucaucg

SEQ ID NO: 9776 - RNA, 21 nt, Mycobacterium avium subsp. paratuberculosis
gccugggcaccaggucgacga

SEQ ID NO: 9777 - RNA, 22 nt, Mycobacterium avium subsp. paratuberculosis
gcgaccuggauggcguggcugc

SEQ ID NO: 9778 - RNA, 21 nt, Mycobacterium avium subsp. paratuberculosis
gcugccagggcacgcugcggg

SEQ ID NO: 9779 - RNA, 22 nt, Mycobacterium avium subsp. paratuberculosis
gugggccaacgugagcuccagu

SEQ ID NO: 9780 - RNA, 22 nt, Mycobacterium avium subsp. paratuberculosis
gugggcugucggugaccuggcu

SEQ ID NO: 9781 - RNA, 22 nt, Mycobacterium avium subsp. paratuberculosis
gugauggcggcgaccaccaucg

SEQ ID NO: 9782 - RNA, 22 nt, Mycobacterium avium subsp. paratuberculosis
guggcagccagcauucggccgc

SEQ ID NO: 9783 - RNA, 23 nt, Mycobacterium avium subsp. paratuberculosis
guuuggguacguuaugggcuugc

SEQ ID NO: 9784 - RNA, 22 nt, Mycobacterium avium subsp. paratuberculosis
gugguggucaaucacgcucggc

SEQ ID NO: 9785 - RNA, 22 nt, Mycobacterium avium subsp. paratuberculosis
gugguggugucggccgacguug

SEQ ID NO: 9786 - RNA, 22 nt, Mycobacterium avium subsp. paratuberculosis
guuccagcucggcgagcgugcg

SEQ ID NO: 9787 - RNA, 22 nt, Mycobacterium avium subsp. paratuberculosis
gucggcuccuugcuggacggcc

SEQ ID NO: 9788 - RNA, 22 nt, Mycobacterium avium subsp. paratuberculosis
guccagccgucgaauugugccc

SEQ ID NO: 9789 - RNA, 22 nt, Mycobacterium avium subsp. paratuberculosis
gugaagccgccgcggcccagcu

SEQ ID NO: 9790 - RNA, 22 nt, Mycobacterium avium subsp. paratuberculosis
gugaccagggugcccagcugga

SEQ ID NO: 9791 - RNA, 20 nt, Mycobacterium avium subsp. paratuberculosis
gugcacaucgacccggcgga

SEQ ID NO: 9792 - RNA, 22 nt, Mycobacterium avium subsp. paratuberculosis
gugccccagcagcucggugagc

SEQ ID NO: 9793 - RNA, 22 nt, Mycobacterium avium subsp. paratuberculosis
gucacgccagcgugacgcucgg

SEQ ID NO: 9794 - RNA, 22 nt, Mycobacterium avium subsp. paratuberculosis
gucacgcuagcgugacgcucgc

SEQ ID NO: 9795 - RNA, 22 nt, Mycobacterium avium subsp. paratuberculosis
guacaugccgccgcaggcgccc

SEQ ID NO: 9796 - RNA, 22 nt, Mycobacterium avium subsp. paratuberculosis
ggugguggcccggaucgacugg

SEQ ID NO: 9797 - RNA, 22 nt, Mycobacterium avium subsp. paratuberculosis
ggugguggucgacgaggcgcag

SEQ ID NO: 9798 - RNA, 23 nt, Mycobacterium avium subsp. paratuberculosis
gguucuucuuacggucgcuguca

SEQ ID NO: 9799 - RNA, 22 nt, Mycobacterium avium subsp. paratuberculosis
gguugguggcggcgaucaggau

SEQ ID NO: 9800 - RNA, 22 nt, Mycobacterium avium subsp. paratuberculosis
ggugacgccgcaucugcuggug

SEQ ID NO: 9801 - RNA, 22 nt, Mycobacterium avium subsp. paratuberculosis
ggugcugcggcuccacgaaguc

SEQ ID NO: 9802 - RNA, 22 nt, Mycobacterium avium subsp. paratuberculosis
ggucacccgcaacggcgagcag

SEQ ID NO: 9803 - RNA, 22 nt, Mycobacterium avium subsp. paratuberculosis
ggucaccuccaucgcgacgucg

SEQ ID NO: 9804 - RNA, 22 nt, Mycobacterium avium subsp. paratuberculosis
ggucaccuucuccgagcgggcc

SEQ ID NO: 9805 - RNA, 22 nt, Mycobacterium avium subsp. paratuberculosis
ggguugaugccgaccgucucgu

SEQ ID NO: 9806 - RNA, 21 nt, Mycobacterium avium subsp. paratuberculosis
gggguuggcacaugaucaccg

SEQ ID NO: 9807 - RNA, 22 nt, Mycobacterium avium subsp. paratuberculosis
ggguaucaccucgggcgaggcc

SEQ ID NO: 9808 - RNA, 22 nt, Mycobacterium avium subsp. paratuberculosis
gggugcuuucgcgucugcucgc

SEQ ID NO: 9809 - RNA, 22 nt, Mycobacterium avium subsp. paratuberculosis
gggccagaaccaccaggugcgc

SEQ ID NO: 9810 - RNA, 22 nt, Mycobacterium avium subsp. paratuberculosis
gggcggcacggugacggccagg

SEQ ID NO: 9811 - RNA, 22 nt, Mycobacterium avium subsp. paratuberculosis
gggcgggucgaucugcagcggg

SEQ ID NO: 9812 - RNA, 21 nt, Mycobacterium avium subsp. paratuberculosis
gggcucagccgaagccggcgc

SEQ ID NO: 9813 - RNA, 22 nt, Mycobacterium avium subsp. paratuberculosis
gggcugguucucggucggcgac

SEQ ID NO: 9814 - RNA, 22 nt, Mycobacterium avium subsp. paratuberculosis
gggcuuggcgcagcgccgcaua

SEQ ID NO: 9815 - RNA, 22 nt, Mycobacterium avium subsp. paratuberculosis
gggguucaucuccgcggcgucg

SEQ ID NO: 9816 - RNA, 22 nt, Mycobacterium avium subsp. paratuberculosis
gggguugacgaucgcugcggcg

SEQ ID NO: 9817 - RNA, 22 nt, Mycobacterium avium subsp. paratuberculosis
ggagccggccgagguugcgcug

SEQ ID NO: 9818 - RNA, 22 nt, Mycobacterium avium subsp. paratuberculosis
gcuucuucgcgcaugcgcugcc

SEQ ID NO: 9819 - RNA, 22 nt, Mycobacterium avium subsp. paratuberculosis
gcuggcgccacugcagcccggu

SEQ ID NO: 9820 - RNA, 22 nt, Mycobacterium avium subsp. paratuberculosis
gcugggcacgccggagcugcgg

SEQ ID NO: 9821 - RNA, 22 nt, Mycobacterium avium subsp. paratuberculosis
gcugggccgcugguugcccgag

SEQ ID NO: 9822 - RNA, 22 nt, Mycobacterium avium subsp. paratuberculosis
gcuggccaacugcggagacgcc

SEQ ID NO: 9823 - RNA, 22 nt, Mycobacterium avium subsp. paratuberculosis
gcuggccaccggcaccgcggcg

SEQ ID NO: 9824 - RNA, 22 nt, Mycobacterium avium subsp. paratuberculosis
gcuggccacgcucggcccgcug

SEQ ID NO: 9825 - RNA, 22 nt, Mycobacterium avium subsp. paratuberculosis
ggcagcacccgcagcaggucgu

SEQ ID NO: 9826 - RNA, 22 nt, Mycobacterium avium subsp. paratuberculosis
ggcagcacgugcagcgcggucu

SEQ ID NO: 9827 - RNA, 22 nt, Mycobacterium avium subsp. paratuberculosis
ggcagcagcgagaagugcaggu

SEQ ID NO: 9828 - RNA, 22 nt, Mycobacterium avium subsp. paratuberculosis
ggcagccuguaucaccacuucu

SEQ ID NO: 9829 - RNA, 22 nt, Mycobacterium avium subsp. paratuberculosis
ggcagcgaugcggccggucuca

SEQ ID NO: 9830 - RNA, 22 nt, Mycobacterium avium subsp. paratuberculosis
ggaguuucuggccggcaagaag

SEQ ID NO: 9831 - RNA, 22 nt, Mycobacterium avium subsp. paratuberculosis
ggagggucgcuaucugcgcggc

SEQ ID NO: 9832 - RNA, 22 nt, Mycobacterium avium subsp. paratuberculosis
ggccagcacgguguugacggug

SEQ ID NO: 9833 - RNA, 22 nt, Mycobacterium avium subsp. paratuberculosis
ggccagccgggcgacggucugc

SEQ ID NO: 9834 - RNA, 22 nt, Mycobacterium avium subsp. paratuberculosis
ggcccggcuucuggcacggcgc

SEQ ID NO: 9835 - RNA, 22 nt, Mycobacterium avium subsp. paratuberculosis
ggcuggucaaacagcuugcgcc

SEQ ID NO: 9836 - RNA, 22 nt, Mycobacterium avium subsp. paratuberculosis
ggcugauuuugcgggccgcccg

SEQ ID NO: 9837 - RNA, 22 nt, Mycobacterium avium subsp. paratuberculosis
ggcuugaggucgucgcggucac

SEQ ID NO: 9838 - RNA, 22 nt, Mycobacterium avium subsp. paratuberculosis
gggcaccaccgaguagcugccg

SEQ ID NO: 9839 - RNA, 22 nt, Mycobacterium avium subsp. paratuberculosis
ggcgccacgcggaaucgccagc

SEQ ID NO: 9840 - RNA, 22 nt, Mycobacterium avium subsp. paratuberculosis
ggcggcgccggcgaucacggug

SEQ ID NO: 9841 - RNA, 22 nt, Mycobacterium avium subsp. paratuberculosis
uugcgcugcugccauaccugcu

SEQ ID NO: 9842 - RNA, 22 nt, Mycobacterium avium subsp. paratuberculosis
uuggucacccugaccucaccga

SEQ ID NO: 9843 - RNA, 22 nt, Mycobacterium avium subsp. paratuberculosis
uuggucucgcucagcucggugg

SEQ ID NO: 9844 - RNA, 22 nt, Mycobacterium avium subsp. paratuberculosis
uuggugguggucgucgacgagc

SEQ ID NO: 9845 - RNA, 22 nt, Mycobacterium avium subsp. paratuberculosis
uuguaugaccucgguugaugcu

SEQ ID NO: 9846 - RNA, 21 nt, Mycobacterium avium subsp. paratuberculosis
uugucaccgccguccggcgac

SEQ ID NO: 9847 - RNA, 22 nt, Mycobacterium avium subsp. paratuberculosis
uugucaccggccuggcccuggu

SEQ ID NO: 9848 - RNA, 22 nt, Mycobacterium avium subsp. paratuberculosis
uuuggcugagcacgucgacccg

SEQ ID NO: 9849 - RNA, 22 nt, Mycobacterium avium subsp. paratuberculosis
agucccugcugcagcgggguca

SEQ ID NO: 9850 - RNA, 22 nt, Mycobacterium avium subsp. paratuberculosis
uucggggagcgcgacaccguuu

SEQ ID NO: 9851 - RNA, 22 nt, Mycobacterium avium subsp. paratuberculosis
uucugguccuucauccggugcg

SEQ ID NO: 9852 - RNA, 22 nt, Mycobacterium avium subsp. paratuberculosis
uucagggucucgccgaucaccc

SEQ ID NO: 9853 - RNA, 22 nt, Mycobacterium avium subsp. paratuberculosis
uuacuuaucgguaagucaguua

SEQ ID NO: 9854 - RNA, 22 nt, Mycobacterium avium subsp. paratuberculosis
uguccugcgacccgucgcgcgg

SEQ ID NO: 9855 - RNA, 22 nt, Mycobacterium avium subsp. paratuberculosis
ugucgccaccggcuccgcaucg

SEQ ID NO: 9856 - RNA, 22 nt, Mycobacterium avium subsp. paratuberculosis
ugugaccuccggugggcugauc

SEQ ID NO: 9857 - RNA, 22 nt, Mycobacterium avium subsp. paratuberculosis
uggugguccgagugaccauggu

SEQ ID NO: 9858 - RNA, 22 nt, Mycobacterium avium subsp. paratuberculosis
ugguggagcagguccgcgcgca

SEQ ID NO: 9859 - RNA, 22 nt, Mycobacterium avium subsp. paratuberculosis
ugguggucgcgcugacgcucgc

SEQ ID NO: 9860 - RNA, 22 nt, Mycobacterium avium subsp. paratuberculosis
ugguggucuugcgcgccagccg

SEQ ID NO: 9861 - RNA, 22 nt, Mycobacterium avium subsp. paratuberculosis
aucaccugcaugagcugguggc

SEQ ID NO: 9862 - RNA, 22 nt, Mycobacterium avium subsp. paratuberculosis
aucaccuuggucagcagcgcgg

SEQ ID NO: 9863 - RNA, 23 nt, Mycobacterium avium subsp. paratuberculosis
auccaggcgcugcgcgagcaccg

SEQ ID NO: 9864 - RNA, 22 nt, Mycobacterium avium subsp. paratuberculosis
auggcgaucggcgggcacggcc

SEQ ID NO: 9865 - RNA, 22 nt, Mycobacterium avium subsp. paratuberculosis
augcuuggggguucucagcggu

SEQ ID NO: 9866 - RNA, 22 nt, Mycobacterium avium subsp. paratuberculosis
auggcagcggauccucgacauc

SEQ ID NO: 9867 - RNA, 22 nt, Mycobacterium avium subsp. paratuberculosis
auggucaggaugucgaccucga

SEQ ID NO: 9868 - RNA, 22 nt, Mycobacterium avium subsp. paratuberculosis
augguggccagcacccccggca

SEQ ID NO: 9869 - RNA, 22 nt, Mycobacterium avium subsp. paratuberculosis
auguuggccagccacgcguccg

SEQ ID NO: 9870 - RNA, 22 nt, Mycobacterium avium subsp. paratuberculosis
auugcucagcagcuuguucagg

SEQ ID NO: 9871 - RNA, 22 nt, Mycobacterium avium subsp. paratuberculosis
auuggcacgucguagaauuggg

SEQ ID NO: 9872 - RNA, 22 nt, Mycobacterium avium subsp. paratuberculosis
caagcugcgcgccggaccgugg

SEQ ID NO: 9873 - RNA, 22 nt, Mycobacterium avium subsp. paratuberculosis
cacgaugcuggagaucaccagg

SEQ ID NO: 9874 - RNA, 22 nt, Mycobacterium avium subsp. paratuberculosis
caauuucuacgugaugcgcaac

SEQ ID NO: 9875 - RNA, 22 nt, Mycobacterium avium subsp. paratuberculosis
cagcacaccgcgguguucaacg

SEQ ID NO: 9876 - RNA, 22 nt, Mycobacterium avium subsp. paratuberculosis
caggaugaagccgacuucgacc

SEQ ID NO: 9877 - RNA, 22 nt, Mycobacterium avium subsp. paratuberculosis
cagcauccgacgcgccggagcc

SEQ ID NO: 9878 - RNA, 22 nt, Mycobacterium avium subsp. paratuberculosis
cagcaugucgaucgaccagguc

SEQ ID NO: 9879 - RNA, 22 nt, Mycobacterium avium subsp. paratuberculosis
ugcgcagcccugggaagcggcc

SEQ ID NO: 9880 - RNA, 22 nt, Mycobacterium avium subsp. paratuberculosis
ugcccaccacgccgucgggcca

SEQ ID NO: 9881 - RNA, 22 nt, Mycobacterium avium subsp. paratuberculosis
ugcccggcuucaucgacucgac

SEQ ID NO: 9882 - RNA, 23 nt, Mycobacterium avium subsp. paratuberculosis
ugcacgucugccucgccgacccc

SEQ ID NO: 9883 - RNA, 22 nt, Mycobacterium avium subsp. paratuberculosis
ugcacugccgugaagagugcuc

SEQ ID NO: 9884 - RNA, 22 nt, Mycobacterium avium subsp. paratuberculosis
ugaccugcgcggcccggccacu

SEQ ID NO: 9885 - RNA, 22 nt, Mycobacterium avium subsp. paratuberculosis
ugacgccaguucuccgcgccga

SEQ ID NO: 9886 - RNA, 22 nt, Mycobacterium avium subsp. paratuberculosis
ugguggcgcuggucgcggugcu

SEQ ID NO: 9887 - RNA, 18 nt, Mycobacterium avium subsp. paratuberculosis
uggguccaaguauccuga

SEQ ID NO: 9888 - RNA, 22 nt, Mycobacterium avium subsp. paratuberculosis
uggucagccgccaggcgucggc

SEQ ID NO: 9889 - RNA, 22 nt, Mycobacterium avium subsp. paratuberculosis
ugggccaacggaauguagucgg

SEQ ID NO: 9890 - RNA, 22 nt, Mycobacterium avium subsp. paratuberculosis
ugggcggugguccucaaugcgc

SEQ ID NO: 9891 - RNA, 22 nt, Mycobacterium avium subsp. paratuberculosis
uggcugaccagaaagucgacca

SEQ ID NO: 9892 - RNA, 22 nt, Mycobacterium avium subsp. paratuberculosis
uggcgcaauuggcggacaugcu

SEQ ID NO: 9893 - RNA, 22 nt, Mycobacterium avium subsp. paratuberculosis
uggccagcuugguggugucggu

SEQ ID NO: 9894 - RNA, 22 nt, Mycobacterium avium subsp. paratuberculosis
ugcugggcggugccgcagccga

SEQ ID NO: 9895 - RNA, 22 nt, Mycobacterium avium subsp. paratuberculosis
ugcugggcucgcugcggaucgg

SEQ ID NO: 9896 - RNA, 22 nt, Mycobacterium avium subsp. paratuberculosis
ugcuggucgagcggaugcaguc

SEQ ID NO: 9897 - RNA, 22 nt, Mycobacterium avium subsp. paratuberculosis
uggcaccaagaaguggggggug

SEQ ID NO: 9898 - RNA, 22 nt, Mycobacterium avium subsp. paratuberculosis
uggaaaagauggguccgguccg

SEQ ID NO: 9899 - RNA, 22 nt, Mycobacterium avium subsp. paratuberculosis
guggcgucgaugcgaaucccgg

SEQ ID NO: 9900 - RNA, 22 nt, Mycobacterium avium subsp. paratuberculosis
ucccaaggcuguucgugggcgu

SEQ ID NO: 9901 - RNA, 22 nt, Mycobacterium avium subsp. paratuberculosis
ucauuuggugcucaccgugcag

SEQ ID NO: 9902 - RNA, 22 nt, Mycobacterium avium subsp. paratuberculosis
uccagcagcugggcgcgcauuc

SEQ ID NO: 9903 - RNA, 22 nt, Mycobacterium avium subsp. paratuberculosis
uccagccaggcgcggcggcuca

SEQ ID NO: 9904 - RNA, 22 nt, Mycobacterium avium subsp. paratuberculosis
uccagcuggucgacgccgccag

SEQ ID NO: 9905 - RNA, 22 nt, Mycobacterium avium subsp. paratuberculosis
ucagcaggucgaugcgguugcg

SEQ ID NO: 9906 - RNA, 22 nt, Mycobacterium avium subsp. paratuberculosis
uccuggugaucuccagcaucgu

SEQ ID NO: 9907 - RNA, 22 nt, Mycobacterium avium subsp. paratuberculosis
ucgccugcggcaaugagcccua

SEQ ID NO: 9908 - RNA, 22 nt, Mycobacterium avium subsp. paratuberculosis
uccugcgccgccacgacagcaa

SEQ ID NO: 9909 - RNA, 22 nt, Mycobacterium avium subsp. paratuberculosis
ucgauguuguggucaacuucca

SEQ ID NO: 9910 - RNA, 17 nt, Mycobacterium avium subsp. paratuberculosis
ucugcagcugcgccugc

SEQ ID NO: 9911 - RNA, 22 nt, Mycobacterium avium subsp. paratuberculosis
ucucggccggccgcgccguguc

SEQ ID NO: 9912 - RNA, 22 nt, Mycobacterium avium subsp. paratuberculosis
ucucauuccugagacuuucuug

SEQ ID NO: 9913 - RNA, 22 nt, Mycobacterium avium subsp. paratuberculosis
ucgcuggacugccacagguucg

SEQ ID NO: 9914 - RNA, 22 nt, Mycobacterium avium subsp. paratuberculosis
ucgguggcugcagcucggccug

SEQ ID NO: 9915 - RNA, 22 nt, Mycobacterium avium subsp. paratuberculosis
ucugucucaggugcaggacgac

SEQ ID NO: 9916 - RNA, 22 nt, Mycobacterium avium subsp. paratuberculosis
ucugggcccgucacggugccgg

SEQ ID NO: 9917 - RNA, 22 nt, Mycobacterium avium subsp. paratuberculosis
ucugcauucgaaaguacuauuu

SEQ ID NO: 9918 - RNA, 22 nt, Mycobacterium avium subsp. paratuberculosis
ucuuggugcacgaucagcucgc

SEQ ID NO: 9919 - RNA, 22 nt, Mycobacterium avium subsp. paratuberculosis
cuucuugcgauugcggcuggcg

SEQ ID NO: 9920 - RNA, 22 nt, Mycobacterium avium subsp. paratuberculosis
cuugacgugcucggcgcucagc

SEQ ID NO: 9921 - RNA, 22 nt, Mycobacterium avium subsp. paratuberculosis
gaaagugcaaccagcgacgugu

SEQ ID NO: 9922 - RNA, 22 nt, Mycobacterium avium subsp. paratuberculosis
cuuugaaauaggcgugcaggcg

SEQ ID NO: 9923 - RNA, 22 nt, Mycobacterium avium subsp. paratuberculosis
cugcagacccgcgccgucuggc

SEQ ID NO: 9924 - RNA, 20 nt, Mycobacterium avium subsp. paratuberculosis
cugccccggcgggauggcga

SEQ ID NO: 9925 - RNA, 22 nt, Mycobacterium avium subsp. paratuberculosis
cugggccaucgaccgcggcgcg

SEQ ID NO: 9926 - RNA, 22 nt, Mycobacterium avium subsp. paratuberculosis
cuggcugacgucagcgacuucg

SEQ ID NO: 9927 - RNA, 22 nt, Mycobacterium avium subsp. paratuberculosis
cuggugaaucggcccauagcgg

SEQ ID NO: 9928 - RNA, 22 nt, Mycobacterium avium subsp. paratuberculosis
cuggcgcaguuuucggccgaag

SEQ ID NO: 9929 - RNA, 22 nt, Mycobacterium avium subsp. paratuberculosis
cuggccagcuugcgggccgacu

SEQ ID NO: 9930 - RNA, 22 nt, Mycobacterium avium subsp. paratuberculosis
cuggcccacuacgccgggcugg

SEQ ID NO: 9931 - RNA, 22 nt, Mycobacterium avium subsp. paratuberculosis
cuggccgaggccggccacaccg

SEQ ID NO: 9932 - RNA, 22 nt, Mycobacterium avium subsp. paratuberculosis
cggguucaccgcggugauccug

SEQ ID NO: 9933 - RNA, 22 nt, Mycobacterium avium subsp. paratuberculosis
cggucaccccguagcgggccag

SEQ ID NO: 9934 - RNA, 22 nt, Mycobacterium avium subsp. paratuberculosis
cggucaccgccgcgccggacgg

SEQ ID NO: 9935 - RNA, 22 nt, Mycobacterium avium subsp. paratuberculosis
cggucaccgguguggagauguu

SEQ ID NO: 9936 - RNA, 23 nt, Mycobacterium avium subsp. paratuberculosis
cggucagggugaugaugccguuc

SEQ ID NO: 9937 - RNA, 22 nt, Mycobacterium avium subsp. paratuberculosis
cguggagggcugcacggcgccg

SEQ ID NO: 9938 - RNA, 22 nt, Mycobacterium avium subsp. paratuberculosis
cgugccccgcgacaagccaggc

SEQ ID NO: 9939 - RNA, 22 nt, Mycobacterium avium subsp. paratuberculosis
cucccuggcugccgcuggagcg

SEQ ID NO: 9940 - RNA, 20 nt, Mycobacterium avium subsp. paratuberculosis
cuaccugguggagcaggccc

SEQ ID NO: 9941 - RNA, 22 nt, Mycobacterium avium subsp. paratuberculosis
cucacuccucguucaccugugu

SEQ ID NO: 9942 - RNA, 22 nt, Mycobacterium avium subsp. paratuberculosis
cuccuggaagccggccgcgacg

SEQ ID NO: 9943 - RNA, 22 nt, Mycobacterium avium subsp. paratuberculosis
cucggccaagggcccgcacgcc

SEQ ID NO: 9944 - RNA, 22 nt, Mycobacterium avium subsp. paratuberculosis
cucggccaggcucgcggcgaug

SEQ ID NO: 9945 - RNA, 19 nt, Mycobacterium avium subsp. paratuberculosis
cucuagccuacgcagcccg

SEQ ID NO: 9946 - RNA, 22 nt, Mycobacterium avium subsp. paratuberculosis
cucugcugcgcugccuggucga

SEQ ID NO: 9947 - RNA, 22 nt, Mycobacterium avium subsp. paratuberculosis
gcauggcccugcccgucgucag

SEQ ID NO: 9948 - RNA, 22 nt, Mycobacterium avium subsp. paratuberculosis
gccaccaccgucugcucggcgg

SEQ ID NO: 9949 - RNA, 22 nt, Mycobacterium avium subsp. paratuberculosis
gccagcacccgcaacagcuguu

SEQ ID NO: 9950 - RNA, 22 nt, Mycobacterium avium subsp. paratuberculosis
gccagcaccgcgcugugcgugg

SEQ ID NO: 9951 - RNA, 22 nt, Mycobacterium avium subsp. paratuberculosis
gcagcauguccugccggcgggu

SEQ ID NO: 9952 - RNA, 22 nt, Mycobacterium avium subsp. paratuberculosis
gcagcaggacgagcucaccucg

SEQ ID NO: 9953 - RNA, 22 nt, Mycobacterium avium subsp. paratuberculosis
gccgaacugcugggccugggca

SEQ ID NO: 9954 - RNA, 22 nt, Mycobacterium avium subsp. paratuberculosis
gccagguuguuguuggugcggc

SEQ ID NO: 9955 - RNA, 22 nt, Mycobacterium avium subsp. paratuberculosis
gccccgacucgacgcuggcggu

SEQ ID NO: 9956 - RNA, 22 nt, Mycobacterium avium subsp. paratuberculosis
gcccgccaugcccgggaucugg

SEQ ID NO: 9957 - RNA, 20 nt, Mycobacterium avium subsp. paratuberculosis
gccaugagugcacguugggc

SEQ ID NO: 9958 - RNA, 22 nt, Mycobacterium avium subsp. paratuberculosis
gccaggccuccugcacggcguc

SEQ ID NO: 9959 - RNA, 22 nt, Mycobacterium avium subsp. paratuberculosis
gagcucacccggcucgccgugc

SEQ ID NO: 9960 - RNA, 22 nt, Mycobacterium avium subsp. paratuberculosis
gagacccacccaggucugccgg

SEQ ID NO: 9961 - RNA, 22 nt, Mycobacterium avium subsp. paratuberculosis
gagacgagcgccuguaugaccg

SEQ ID NO: 9962 - RNA, 22 nt, Mycobacterium avium subsp. paratuberculosis
gaccagguggccgcccgcaccc

SEQ ID NO: 9963 - RNA, 22 nt, Mycobacterium avium subsp. paratuberculosis
gaccagguuggucaccggcacc

SEQ ID NO: 9964 - RNA, 22 nt, Mycobacterium avium subsp. paratuberculosis
gaccccagucggacaggucgcg

SEQ ID NO: 9965 - RNA, 22 nt, Mycobacterium avium subsp. paratuberculosis
gaccugcucgacgggugggugg

SEQ ID NO: 9966 - RNA, 22 nt, Mycobacterium avium subsp. paratuberculosis
gaggguggcguacagggugccg

SEQ ID NO: 9967 - RNA, 22 nt, Mycobacterium avium subsp. paratuberculosis
gauggcgacggauucgcggguc

SEQ ID NO: 9968 - RNA, 22 nt, Mycobacterium avium subsp. paratuberculosis
gaugggucugcgccucgaucag

SEQ ID NO: 9969 - RNA, 22 nt, Mycobacterium avium subsp. paratuberculosis
gauggugucgcgcuggcuggac

SEQ ID NO: 9970 - RNA, 20 nt, Mycobacterium avium subsp. paratuberculosis
gcaaggggcgaucgcggcaa

SEQ ID NO: 9971 - RNA, 22 nt, Mycobacterium avium subsp. paratuberculosis
cccgcgcccggguucgaggcca

SEQ ID NO: 9972 - RNA, 22 nt, Mycobacterium avium subsp. paratuberculosis
ccaugguggcguccaggaugcg

SEQ ID NO: 9973 - RNA, 22 nt, Mycobacterium avium subsp. paratuberculosis
cccaggcuggccaggaugccca

SEQ ID NO: 9974 - RNA, 22 nt, Mycobacterium avium subsp. paratuberculosis
ccagccguggcaggacaacgag

SEQ ID NO: 9975 - RNA, 22 nt, Mycobacterium avium subsp. paratuberculosis
ccagccguugucgaacagcagc

SEQ ID NO: 9976 - RNA, 22 nt, Mycobacterium avium subsp. paratuberculosis
ccagccgcggucgggcagccag

SEQ ID NO: 9977 - RNA, 22 nt, Mycobacterium avium subsp. paratuberculosis
ccagcugggcgccaccugcaac

SEQ ID NO: 9978 - RNA, 22 nt, Mycobacterium avium subsp. paratuberculosis
caucucgggcgcgauguaggcg

SEQ ID NO: 9979 - RNA, 22 nt, Mycobacterium avium subsp. paratuberculosis
caucugcacgcaggccugcacg

SEQ ID NO: 9980 - RNA, 22 nt, Mycobacterium avium subsp. paratuberculosis
cauccugggcgccaccgcgcac

SEQ ID NO: 9981 - RNA, 22 nt, Mycobacterium avium subsp. paratuberculosis
cauccaccuggagggcccgugg

SEQ ID NO: 9982 - RNA, 18 nt, Mycobacterium avium subsp. paratuberculosis
cagggucuuucuggugcc

SEQ ID NO: 9983 - RNA, 22 nt, Mycobacterium avium subsp. paratuberculosis
caggucuuccagaaggcggucg

SEQ ID NO: 9984 - RNA, 22 nt, Mycobacterium avium subsp. paratuberculosis
caguuccucgucgcagucggcg

SEQ ID NO: 9985 - RNA, 22 nt, Mycobacterium avium subsp. paratuberculosis
caguucggcuuugagcucgucg

SEQ ID NO: 9986 - RNA, 22 nt, Mycobacterium avium subsp. paratuberculosis
cagcuuggccaggucucccucg

SEQ ID NO: 9987 - RNA, 22 nt, Mycobacterium avium subsp. paratuberculosis
cagcucgcccgcggccuggccg

SEQ ID NO: 9988 - RNA, 22 nt, Mycobacterium avium subsp. paratuberculosis
cagcugcaggguggccagcgac

SEQ ID NO: 9989 - RNA, 22 nt, Mycobacterium avium subsp. paratuberculosis
caugaguacaagugaguaccga

SEQ ID NO: 9990 - RNA, 22 nt, Mycobacterium avium subsp. paratuberculosis
ccaaccgcaucggcagcgccac

SEQ ID NO: 9991 - RNA, 22 nt, Mycobacterium avium subsp. paratuberculosis
ccacacccgcugcgagaucagc

SEQ ID NO: 9992 - RNA, 22 nt, Mycobacterium avium subsp. paratuberculosis
ccaccaccugcggcagcucgaa

SEQ ID NO: 9993 - RNA, 22 nt, Mycobacterium avium subsp. paratuberculosis
ccagagccuuuccagcaggccc

SEQ ID NO: 9994 - RNA, 22 nt, Mycobacterium avium subsp. paratuberculosis
ccacccgcaucccgugccaggc

SEQ ID NO: 9995 - RNA, 22 nt, Mycobacterium avium subsp. paratuberculosis
ccagcagcgagaugacccggug

SEQ ID NO: 9996 - RNA, 22 nt, Mycobacterium avium subsp. paratuberculosis
ccagcccgaacuaucggcugug

SEQ ID NO: 9997 - RNA, 22 nt, Mycobacterium avium subsp. paratuberculosis
ccagcccuaugagcagcccggc

SEQ ID NO: 9998 - RNA, 22 nt, Mycobacterium avium subsp. paratuberculosis
ccagccgcagcccguccuccau

SEQ ID NO: 9999 - RNA, 23 nt, Mycobacterium avium subsp. paratuberculosis
ccgguuugcggugcagcacuguc

SEQ ID NO: 10000 - RNA, 22 nt, Mycobacterium avium subsp. paratuberculosis
ccgagcucgcgcugcugaccgc

SEQ ID NO: 10001 - RNA, 22 nt, Mycobacterium avium subsp. paratuberculosis
ccgccacuucccgcagguuguc

SEQ ID NO: 10002 - RNA, 22 nt, Mycobacterium avium subsp. paratuberculosis
ccguggccuugccgccggauga

SEQ ID NO: 10003 - RNA, 22 nt, Mycobacterium avium subsp. paratuberculosis
ccugccagucccgcucgauggg

SEQ ID NO: 10004 - RNA, 22 nt, Mycobacterium avium subsp. paratuberculosis
ccuugagcaccgguccggcguu

SEQ ID NO: 10005 - RNA, 22 nt, Mycobacterium avium subsp. paratuberculosis
cgaccugcggccgucggaugcg

SEQ ID NO: 10006 - RNA, 22 nt, Mycobacterium avium subsp. paratuberculosis
cgcacccuguccggcgggcagc

SEQ ID NO: 10007 - RNA, 22 nt, Mycobacterium avium subsp. paratuberculosis
cgcagcauuucuucgaucgcgg

SEQ ID NO: 10008 - RNA, 22 nt, Mycobacterium avium subsp. paratuberculosis
cgcauccagccgcuggcgcccg

SEQ ID NO: 10009 - RNA, 22 nt, Mycobacterium avium subsp. paratuberculosis
cgccacccccgagcaggcggcg

SEQ ID NO: 10010 - RNA, 22 nt, Mycobacterium avium subsp. paratuberculosis
cgccccaccgauugcucgaaau

SEQ ID NO: 10011 - RNA, 22 nt, Mycobacterium avium subsp. paratuberculosis
cggagaccauguucgccgagca

SEQ ID NO: 10012 - RNA, 22 nt, Mycobacterium avium subsp. paratuberculosis
cgcccggccaccgacgugaugg

SEQ ID NO: 10013 - RNA, 22 nt, Mycobacterium avium subsp. paratuberculosis
cgccuugagacaggacacgucg

SEQ ID NO: 10014 - RNA, 21 nt, Mycobacterium avium subsp. paratuberculosis
cgcugcccggcgcgauguugg

SEQ ID NO: 10015 - RNA, 22 nt, Mycobacterium avium subsp. paratuberculosis
cgagcugcucgacaucgacgag

SEQ ID NO: 10016 - RNA, 22 nt, Mycobacterium avium subsp. paratuberculosis
cgcccggcgccgcgacugguga

SEQ ID NO: 10017 - RNA, 22 nt, Mycobacterium avium subsp. paratuberculosis
cgccuugggcucccaguggucg

SEQ ID NO: 10018 - RNA, 22 nt, Mycobacterium avium subsp. paratuberculosis
cgcgcgccguagacguccagca

SEQ ID NO: 10019 - RNA, 22 nt, Mycobacterium avium subsp. paratuberculosis
gucaccaucaguugccacgacg

SEQ ID NO: 10020 - RNA, 22 nt, Mycobacterium avium subsp. paratuberculosis
gucaucagcuggcugucggcca

SEQ ID NO: 10021 - RNA, 21 nt, Mycobacterium avium subsp. paratuberculosis
ggugcuuuugugucugcucgc

SEQ ID NO: 10022 - RNA, 22 nt, Mycobacterium avium subsp. paratuberculosis
gguucaaggugaugcccgacga

SEQ ID NO: 10023 - RNA, 22 nt, Mycobacterium avium subsp. paratuberculosis
ggguggcucaacaccccggacg

SEQ ID NO: 10024 - RNA, 22 nt, Mycobacterium avium subsp. paratuberculosis
ggguggucagcgcgaucuucag

SEQ ID NO: 10025 - RNA, 22 nt, Mycobacterium avium subsp. paratuberculosis
ggguuugguccucgaucacgcg

SEQ ID NO: 10026 - RNA, 22 nt, Mycobacterium avium subsp. paratuberculosis
ggucacccgguugggggucacc

SEQ ID NO: 10027 - RNA, 22 nt, Mycobacterium avium subsp. paratuberculosis
gggucaccggauggucgaugac

SEQ ID NO: 10028 - RNA, 22 nt, Mycobacterium avium subsp. paratuberculosis
ggcugugcucgggcggcagguc

SEQ ID NO: 10029 - RNA, 22 nt, Mycobacterium avium subsp. paratuberculosis
ggcuugacaucuauuccggacu

SEQ ID NO: 10030 - RNA, 22 nt, Mycobacterium avium subsp. paratuberculosis
gggcgcuggcgcuggacagcga

SEQ ID NO: 10031 - RNA, 22 nt, Mycobacterium avium subsp. paratuberculosis
gggcugaccggcgauggccauc

SEQ ID NO: 10032 - RNA, 22 nt, Mycobacterium avium subsp. paratuberculosis
gggcugcacgacggccuugacu

SEQ ID NO: 10033 - RNA, 22 nt, Mycobacterium avium subsp. paratuberculosis
guugggggcgcugggauuugcc

SEQ ID NO: 10034 - RNA, 22 nt, Mycobacterium avium subsp. paratuberculosis
guugguggaucgucgcgaaguc

SEQ ID NO: 10035 - RNA, 22 nt, Mycobacterium avium subsp. paratuberculosis
guugaugugcaccaucucugcg

SEQ ID NO: 10036 - RNA, 22 nt, Mycobacterium avium subsp. paratuberculosis
guugcagcgccgucugcagcug

SEQ ID NO: 10037 - RNA, 19 nt, Mycobacterium avium subsp. paratuberculosis
guggccaagacggccagca

SEQ ID NO: 10038 - RNA, 22 nt, Mycobacterium avium subsp. paratuberculosis
guggccacgaucgccgcggugg

SEQ ID NO: 10039 - RNA, 22 nt, Mycobacterium avium subsp. paratuberculosis
guggccagccgggcgaccgucu

SEQ ID NO: 10040 - RNA, 22 nt, Mycobacterium avium subsp. paratuberculosis
guggcuggccgaguucgcgcug

SEQ ID NO: 10041 - RNA, 22 nt, Mycobacterium avium subsp. paratuberculosis
guggcugggucuggucgccaac

SEQ ID NO: 10042 - RNA, 20 nt, Mycobacterium avium subsp. paratuberculosis
guggucaccggcgauggugc

SEQ ID NO: 10043 - RNA, 22 nt, Mycobacterium avium subsp. paratuberculosis
gugguggccgcggugaccaaug

SEQ ID NO: 10044 - RNA, 22 nt, Mycobacterium avium subsp. paratuberculosis
gugguggcggcgcuggcgcaca

SEQ ID NO: 10045 - RNA, 22 nt, Mycobacterium avium subsp. paratuberculosis
gugguguccaccccgccggcgg

SEQ ID NO: 10046 - RNA, 22 nt, Mycobacterium avium subsp. paratuberculosis
gugugaaaacgcccgcgacuac

SEQ ID NO: 10047 - RNA, 22 nt, Mycobacterium avium subsp. paratuberculosis
gugcaccugcuggaucacggcg

SEQ ID NO: 10048 - RNA, 22 nt, Mycobacterium avium subsp. paratuberculosis
gugcucacgcugcugcuggccg

SEQ ID NO: 10049 - RNA, 22 nt, Mycobacterium avium subsp. paratuberculosis
gugcuuuugcgucugcucgcca

SEQ ID NO: 10050 - RNA, 22 nt, Mycobacterium avium subsp. paratuberculosis
ucaauuccgguggugugcugaa

SEQ ID NO: 10051 - RNA, 22 nt, Mycobacterium avium subsp. paratuberculosis
ucaccaugcacccagaucucgc

SEQ ID NO: 10052 - RNA, 22 nt, Mycobacterium avium subsp. paratuberculosis
ucaccgccggcguggaccggcu

SEQ ID NO: 10053 - RNA, 22 nt, Mycobacterium avium subsp. paratuberculosis
ucagguugguggcucccaguau

SEQ ID NO: 10054 - RNA, 22 nt, Mycobacterium avium subsp. paratuberculosis
ucaggccgguggcgguguugcu

SEQ ID NO: 10055 - RNA, 22 nt, Mycobacterium avium subsp. paratuberculosis
ucagccucggccuggacagucg

SEQ ID NO: 10056 - RNA, 22 nt, Mycobacterium avium subsp. paratuberculosis
ucagcgucgucgcgccggcuuu

SEQ ID NO: 10057 - RNA, 22 nt, Mycobacterium avium subsp. paratuberculosis
uccgcgccucgacgcccggaua

SEQ ID NO: 10058 - RNA, 22 nt, Mycobacterium avium subsp. paratuberculosis
uccugggcaucgccaagucggu

SEQ ID NO: 10059 - RNA, 22 nt, Mycobacterium avium subsp. paratuberculosis
ucaggcuggaagugcucggcuu

SEQ ID NO: 10060 - RNA, 22 nt, Mycobacterium avium subsp. paratuberculosis
uccauucucggccgggugcaca

SEQ ID NO: 10061 - RNA, 22 nt, Mycobacterium avium subsp. paratuberculosis
uccacccgcagagaucccaagg

SEQ ID NO: 10062 - RNA, 22 nt, Mycobacterium avium subsp. paratuberculosis
uccaccgcccaggucgaugcgc

SEQ ID NO: 10063 - RNA, 22 nt, Mycobacterium avium subsp. paratuberculosis
ucgcugggcgcccaggcgcguu

SEQ ID NO: 10064 - RNA, 22 nt, Mycobacterium avium subsp. paratuberculosis
ucgcugggcggcagcucggcau

SEQ ID NO: 10065 - RNA, 22 nt, Mycobacterium avium subsp. paratuberculosis
uccuggggccgggcccgagcau

SEQ ID NO: 10066 - RNA, 22 nt, Mycobacterium avium subsp. paratuberculosis
uccuggugcguccaagcggagu

SEQ ID NO: 10067 - RNA, 22 nt, Mycobacterium avium subsp. paratuberculosis
ucgagcagccgaccagcgucac

SEQ ID NO: 10068 - RNA, 22 nt, Mycobacterium avium subsp. paratuberculosis
ucggcagcagcuggcucagcga

SEQ ID NO: 10069 - RNA, 22 nt, Mycobacterium avium subsp. paratuberculosis
ucggcucaccgacgacgaggug

SEQ ID NO: 10070 - RNA, 22 nt, Mycobacterium avium subsp. paratuberculosis
gcugaaccugauccucaagggc

SEQ ID NO: 10071 - RNA, 22 nt, Mycobacterium avium subsp. paratuberculosis
gcguggugaucguguuccccgg

SEQ ID NO: 10072 - RNA, 22 nt, Mycobacterium avium subsp. paratuberculosis
gccucgacgugcgugucgccgc

SEQ ID NO: 10073 - RNA, 22 nt, Mycobacterium avium subsp. paratuberculosis
gccguggugguuagcggcauga

SEQ ID NO: 10074 - RNA, 22 nt, Mycobacterium avium subsp. paratuberculosis
gccugccaccggucucgaacuc

SEQ ID NO: 10075 - RNA, 22 nt, Mycobacterium avium subsp. paratuberculosis
gccugcugacggggucgcugga

SEQ ID NO: 10076 - RNA, 22 nt, Mycobacterium avium subsp. paratuberculosis
gccuggaccuggacuggcgccc

SEQ ID NO: 10077 - RNA, 22 nt, Mycobacterium avium subsp. paratuberculosis
gcgccgcugcaggcugcacucg

SEQ ID NO: 10078 - RNA, 22 nt, Mycobacterium avium subsp. paratuberculosis
gcugcaucgcgaaccggucgcc

SEQ ID NO: 10079 - RNA, 22 nt, Mycobacterium avium subsp. paratuberculosis
gcugccagucggccgccuuggu

SEQ ID NO: 10080 - RNA, 22 nt, Mycobacterium avium subsp. paratuberculosis
gcugcggcccgaggucgagggu

SEQ ID NO: 10081 - RNA, 18 nt, Mycobacterium avium subsp. paratuberculosis
gcugcggcugcagcagga

SEQ ID NO: 10082 - RNA, 19 nt, Mycobacterium avium subsp. paratuberculosis
gcugggccuggucgcgucc

SEQ ID NO: 10083 - RNA, 23 nt, Mycobacterium avium subsp. paratuberculosis
ggaaagugugaucccgaugaugg

SEQ ID NO: 10084 - RNA, 22 nt, Mycobacterium avium subsp. paratuberculosis
gcugguagacgacgacgccgag

SEQ ID NO: 10085 - RNA, 22 nt, Mycobacterium avium subsp. paratuberculosis
ggaccugcgacugcaccccacc

SEQ ID NO: 10086 - RNA, 22 nt, Mycobacterium avium subsp. paratuberculosis
ggaccugcuggaccggcugcac

SEQ ID NO: 10087 - RNA, 22 nt, Mycobacterium avium subsp. paratuberculosis
ggcagcaugcucuccucguggu

SEQ ID NO: 10088 - RNA, 22 nt, Mycobacterium avium subsp. paratuberculosis
ggccagcagggugggguuacgg

SEQ ID NO: 10089 - RNA, 22 nt, Mycobacterium avium subsp. paratuberculosis
ggccagcucggcgaucgcccgu

SEQ ID NO: 10090 - RNA, 22 nt, Mycobacterium avium subsp. paratuberculosis
ggccucccacagcgggcggugc

SEQ ID NO: 10091 - RNA, 22 nt, Mycobacterium avium subsp. paratuberculosis
ggccugcagaaugcgcguuuug

SEQ ID NO: 10092 - RNA, 22 nt, Mycobacterium avium subsp. paratuberculosis
ggccuggucaucgagcuggcgg

SEQ ID NO: 10093 - RNA, 22 nt, Mycobacterium avium subsp. paratuberculosis
ggccuggucggcguucagcguc

SEQ ID NO: 10094 - RNA, 22 nt, Mycobacterium avium subsp. paratuberculosis
ggcgagcagacgcaaaagcccc

SEQ ID NO: 10095 - RNA, 22 nt, Mycobacterium avium subsp. paratuberculosis
ggccgcgcucaaacaccugggc

SEQ ID NO: 10096 - RNA, 22 nt, Mycobacterium avium subsp. paratuberculosis
ggcgccacgcccgggcaccugg

SEQ ID NO: 10097 - RNA, 22 nt, Mycobacterium avium subsp. paratuberculosis
ggcgcgggcgucccgguggugc

SEQ ID NO: 10098 - RNA, 22 nt, Mycobacterium avium subsp. paratuberculosis
ggcgcgggcguuggccacccag

SEQ ID NO: 10099 - RNA, 22 nt, Mycobacterium avium subsp. paratuberculosis
ggcuggauaacacaggacgacg

SEQ ID NO: 10100 - RNA, 22 nt, Mycobacterium avium subsp. paratuberculosis
aacgugaagcuaguuucacguu

SEQ ID NO: 10101 - RNA, 22 nt, Mycobacterium avium subsp. paratuberculosis
aacaggccgcggcguugcaacu

SEQ ID NO: 10102 - RNA, 22 nt, Mycobacterium avium subsp. paratuberculosis
aagcaguacgcgaugucggauc

SEQ ID NO: 10103 - RNA, 22 nt, Mycobacterium avium subsp. paratuberculosis
aagaaggcccagucgcggcugc

SEQ ID NO: 10104 - RNA, 22 nt, Mycobacterium avium subsp. paratuberculosis
aacugcuggcccggcacagugu

SEQ ID NO: 10105 - RNA, 22 nt, Mycobacterium avium subsp. paratuberculosis
accauggccgcccggguggugu

SEQ ID NO: 10106 - RNA, 22 nt, Mycobacterium avium subsp. paratuberculosis
acagccgcagcacgggcuggcg

SEQ ID NO: 10107 - RNA, 22 nt, Mycobacterium avium subsp. paratuberculosis
acagcugcgaccacgucagggu

SEQ ID NO: 10108 - RNA, 22 nt, Mycobacterium avium subsp. paratuberculosis
acagaugucaauagugugaguu

SEQ ID NO: 10109 - RNA, 22 nt, Mycobacterium avium subsp. paratuberculosis
aauccacaucgccgacggcgug

SEQ ID NO: 10110 - RNA, 22 nt, Mycobacterium avium subsp. paratuberculosis
aaguaucuagaugaauucagug

SEQ ID NO: 10111 - RNA, 22 nt, Mycobacterium avium subsp. paratuberculosis
aaugccucaucgaggcgcugca

SEQ ID NO: 10112 - RNA, 22 nt, Mycobacterium avium subsp. paratuberculosis
aagacaacgcgugucauuggcg

SEQ ID NO: 10113 - RNA, 22 nt, Mycobacterium avium subsp. paratuberculosis
aaaguuugcgguuucagcauuc

SEQ ID NO: 10114 - RNA, 22 nt, Mycobacterium avium subsp. paratuberculosis
aaaccagcacugagugcccacc

SEQ ID NO: 10115 - RNA, 21 nt, Mycobacterium avium subsp. paratuberculosis
agcaugaagccggugcucagc

SEQ ID NO: 10116 - RNA, 22 nt, Mycobacterium avium subsp. paratuberculosis
agcagagccuugcgcugacgau

SEQ ID NO: 10117 - RNA, 22 nt, Mycobacterium avium subsp. paratuberculosis
aggcuugcgcuggcaacucaac

SEQ ID NO: 10118 - RNA, 22 nt, Mycobacterium avium subsp. paratuberculosis
agcccggcgaucugcuggcugc

SEQ ID NO: 10119 - RNA, 22 nt, Mycobacterium avium subsp. paratuberculosis
agcucagcgaccacacgguguc

SEQ ID NO: 10120 - RNA, 22 nt, Mycobacterium avium subsp. paratuberculosis
aggggcugcacgucggccaccc

SEQ ID NO: 10121 - RNA, 22 nt, Mycobacterium avium subsp. paratuberculosis
agggucuaguugaacgagucgc

SEQ ID NO: 10122 - RNA, 22 nt, Mycobacterium avium subsp. paratuberculosis
aggucacccugggcgaguuggu

SEQ ID NO: 10123 - RNA, 22 nt, Mycobacterium avium subsp. paratuberculosis
agcccggccgcagccuggagcg

SEQ ID NO: 10124 - RNA, 22 nt, Mycobacterium avium subsp. paratuberculosis
agccgggcgugcucguuggcgu

SEQ ID NO: 10125 - RNA, 22 nt, Mycobacterium avium subsp. paratuberculosis
acgagcuguggguuuccaggua

SEQ ID NO: 10126 - RNA, 22 nt, Mycobacterium avium subsp. paratuberculosis
accugggccagaugcucgacuu

SEQ ID NO: 10127 - RNA, 22 nt, Mycobacterium avium subsp. paratuberculosis
accuugacggcgugcccgacgu

SEQ ID NO: 10128 - RNA, 22 nt, Mycobacterium avium subsp. paratuberculosis
accuugacguccucaucguggg

SEQ ID NO: 10129 - RNA, 22 nt, Mycobacterium avium subsp. paratuberculosis
acguccuggauguggcccgcgc

SEQ ID NO: 10130 - RNA, 22 nt, Mycobacterium avium subsp. paratuberculosis
acccggcugccggaccaccuca

SEQ ID NO: 10131 - RNA, 22 nt, Mycobacterium avium subsp. paratuberculosis
acccggcugggcgccuacgcgc

SEQ ID NO: 10132 - RNA, 22 nt, Mycobacterium avium subsp. paratuberculosis
acccggcuggucgaggaccugc

SEQ ID NO: 10133 - RNA, 22 nt, Mycobacterium avium subsp. paratuberculosis
accggcaucaccacggcgaugg

SEQ ID NO: 10134 - RNA, 22 nt, Mycobacterium avium subsp. paratuberculosis
accucccagcccucggugaacu

SEQ ID NO: 10135 - RNA, 22 nt, Mycobacterium avium subsp. paratuberculosis
agcaccgccgucaccugcccga

SEQ ID NO: 10136 - RNA, 21 nt, Mycobacterium avium subsp. paratuberculosis
agcaacaauggcgcucggccg

SEQ ID NO: 10137 - RNA, 22 nt, Mycobacterium avium subsp. paratuberculosis
agagcuccagcgagaacgggcc

SEQ ID NO: 10138 - RNA, 22 nt, Mycobacterium avium subsp. paratuberculosis
agaggaacaucgcgauggcccu

SEQ ID NO: 10139 - RNA, 22 nt, Mycobacterium avium subsp. paratuberculosis
agagucucaugggcaucaucgg

SEQ ID NO: 10140 - RNA, 19 nt, Mycobacterium avium subsp. paratuberculosis
acugcgacgaucaaccggc

SEQ ID NO: 10141 - RNA, 22 nt, Mycobacterium avium subsp. paratuberculosis
acugggccgcccuguaccggaa

SEQ ID NO: 10142 - RNA, 22 nt, Mycobacterium avium subsp. paratuberculosis
acugccacaacgacucccgcgu

SEQ ID NO: 10143 - RNA, 22 nt, Mycobacterium avium subsp. paratuberculosis
acguugggcagaaacgcuuuuc

SEQ ID NO: 10144 - RNA, 22 nt, Mycobacterium avium subsp. paratuberculosis
acucgcccggcgcccugcugcg

SEQ ID NO: 10145 - RNA, 22 nt, Mycobacterium avium subsp. paratuberculosis
acgcacccgccgaucgaggacc

SEQ ID NO: 10146 - RNA, 20 nt, Mycobacterium avium subsp. paratuberculosis
acgucccaauccugcuggug

SEQ ID NO: 10147 - RNA, 22 nt, Mycobacterium avium subsp. paratuberculosis
acgccgugguacuccggcgcga

SEQ ID NO: 10148 - RNA, 22 nt, Mycobacterium avium subsp. paratuberculosis
acgcugggcuacgaggugcgcu

SEQ ID NO: 10149 - RNA, 22 nt, Mycobacterium avium subsp. paratuberculosis
accuccagcacccgggucagcg

SEQ ID NO: 10150 - RNA, 22 nt, Mycobacterium avium subsp. paratuberculosis
accugggcgcgccggucgagcc

SEQ ID NO: 10151 - RNA, 22 nt, Mycobacterium avium subsp. paratuberculosis
agcaccgccagcacccacgaca

SEQ ID NO: 10152 - RNA, 22 nt, Mycobacterium avium subsp. paratuberculosis
agauccagccgagcagcaccau

SEQ ID NO: 10153 - RNA, 22 nt, Mycobacterium avium subsp. paratuberculosis
agacccagcagcaccgacgcga

SEQ ID NO: 10154 - RNA, 22 nt, Mycobacterium avium subsp. paratuberculosis
agaccgagcuguuggccggcgc

SEQ ID NO: 10155 - RNA, 22 nt, Mycobacterium avium subsp. paratuberculosis
agcagcaugccgucgcggcgaa

SEQ ID NO: 10156 - RNA, 22 nt, Mycobacterium avium subsp. paratuberculosis
agcagguggugcgcugcagcga

SEQ ID NO: 10157 - RNA, 22 nt, Mycobacterium avium subsp. paratuberculosis
accacgaggaccagcgucgcga

SEQ ID NO: 10158 - RNA, 22 nt, Mycobacterium avium subsp. paratuberculosis
accagcagcgcgucacgcugag

SEQ ID NO: 10159 - RNA, 22 nt, Mycobacterium avium subsp. paratuberculosis
accagcagcugcccgggcggua

SEQ ID NO: 10160 - RNA, 18 nt, Mycobacterium avium subsp. paratuberculosis
accacccaggagaucguc

SEQ ID NO: 10161 - RNA, 22 nt, Mycobacterium avium subsp. paratuberculosis
accagcaguaugggcgccgguu

SEQ ID NO: 10162 - RNA, 22 nt, Mycobacterium avium subsp. paratuberculosis
aucaggucggugcggugcuugg

SEQ ID NO: 10163 - RNA, 22 nt, Mycobacterium avium subsp. paratuberculosis
aucagcagcgaccgcacgugcg

SEQ ID NO: 10164 - RNA, 22 nt, Mycobacterium avium subsp. paratuberculosis
auccagcagcggccggucccgc

SEQ ID NO: 10165 - RNA, 22 nt, Mycobacterium avium subsp. paratuberculosis
auccaggccgccgagaucgagc

SEQ ID NO: 10166 - RNA, 22 nt, Mycobacterium avium subsp. paratuberculosis
auccaggcgguguucggcuuca

SEQ ID NO: 10167 - RNA, 22 nt, Mycobacterium avium subsp. paratuberculosis
auccaggcguugaucgacggcc

SEQ ID NO: 10168 - RNA, 22 nt, Mycobacterium avium subsp. paratuberculosis
aucuucuucuccgcggugcuga

SEQ ID NO: 10169 - RNA, 22 nt, Mycobacterium avium subsp. paratuberculosis
augauggugguaagcauuucgg

SEQ ID NO: 10170 - RNA, 18 nt, Mycobacterium avium subsp. paratuberculosis
auccugcacugcgacggc

SEQ ID NO: 10171 - RNA, 22 nt, Mycobacterium avium subsp. paratuberculosis
aguccuugaccaggaacuucag

SEQ ID NO: 10172 - RNA, 22 nt, Mycobacterium avium subsp. paratuberculosis
aggucaccgaagagguugccgc

SEQ ID NO: 10173 - RNA, 22 nt, Mycobacterium avium subsp. paratuberculosis
aggugcugcgcggacucuugcu

SEQ ID NO: 10174 - RNA, 22 nt, Mycobacterium avium subsp. paratuberculosis
agcuggucucggaucuggugcg

SEQ ID NO: 10175 - RNA, 20 nt, Mycobacterium avium subsp. paratuberculosis
caagggaguauucgggguuc

SEQ ID NO: 10176 - RNA, 22 nt, Mycobacterium avium subsp. paratuberculosis
caccagcaggauugggacgucg

SEQ ID NO: 10177 - RNA, 22 nt, Mycobacterium avium subsp. paratuberculosis
cacaccugggaagagcgcuggg

SEQ ID NO: 10178 - RNA, 22 nt, Mycobacterium avium subsp. paratuberculosis
cacaggugaucaucgaugcggc

SEQ ID NO: 10179 - RNA, 22 nt, Mycobacterium avium subsp. paratuberculosis
cacgcacugaccgggcugcagg

SEQ ID NO: 10180 - RNA, 23 nt, Mycobacterium avium subsp. paratuberculosis
cacgccagcgugacgcucggugc

SEQ ID NO: 10181 - RNA, 22 nt, Mycobacterium avium subsp. paratuberculosis
cacggcccgcucggacacccgc

SEQ ID NO: 10182 - RNA, 22 nt, Mycobacterium avium subsp. paratuberculosis
auggacaaccacuucgugccga

SEQ ID NO: 10183 - RNA, 22 nt, Mycobacterium avium subsp. paratuberculosis
auggcagcagcaucgugguggc

SEQ ID NO: 10184 - RNA, 22 nt, Mycobacterium avium subsp. paratuberculosis
augccucacucucgcaacgguc

SEQ ID NO: 10185 - RNA, 18 nt, Mycobacterium avium subsp. paratuberculosis
cccaugaguuuugccgcc

SEQ ID NO: 10186 - RNA, 22 nt, Mycobacterium avium subsp. paratuberculosis
ccccagccgagcgugcaccggc

SEQ ID NO: 10187 - RNA, 22 nt, Mycobacterium avium subsp. paratuberculosis
ccgccuccccguuggggugauu

SEQ ID NO: 10188 - RNA, 22 nt, Mycobacterium avium subsp. paratuberculosis
cccugggccugacauacgugcg

SEQ ID NO: 10189 - RNA, 22 nt, Mycobacterium avium subsp. paratuberculosis
ccgacgaguucggccuguucga

SEQ ID NO: 10190 - RNA, 17 nt, Mycobacterium avium subsp. paratuberculosis
ccgagcaccaccagcac

SEQ ID NO: 10191 - RNA, 22 nt, Mycobacterium avium subsp. paratuberculosis
ccgagcaccggauccaguccgc

SEQ ID NO: 10192 - RNA, 22 nt, Mycobacterium avium subsp. paratuberculosis
ccaacaacucgacguucggcgg

SEQ ID NO: 10193 - RNA, 22 nt, Mycobacterium avium subsp. paratuberculosis
ccagcaggucgcgguuggccag

SEQ ID NO: 10194 - RNA, 22 nt, Mycobacterium avium subsp. paratuberculosis
ccagcugguccagcacgucggg

SEQ ID NO: 10195 - RNA, 22 nt, Mycobacterium avium subsp. paratuberculosis
ccauaaguaguccuaauugccc

SEQ ID NO: 10196 - RNA, 22 nt, Mycobacterium avium subsp. paratuberculosis
ccagguugcgguggucccggug

SEQ ID NO: 10197 - RNA, 22 nt, Mycobacterium avium subsp. paratuberculosis
ccaguucgacggcgucgacgcc

SEQ ID NO: 10198 - RNA, 22 nt, Mycobacterium avium subsp. paratuberculosis
cccagcagcugcaggccgacag

SEQ ID NO: 10199 - RNA, 22 nt, Mycobacterium avium subsp. paratuberculosis
cccagcagcuggaggggcucgc

SEQ ID NO: 10200 - RNA, 22 nt, Mycobacterium avium subsp. paratuberculosis
cccagcagcuggauccgcaggc

SEQ ID NO: 10201 - RNA, 22 nt, Mycobacterium avium subsp. paratuberculosis
cagguucgugccuucggacagg

SEQ ID NO: 10202 - RNA, 22 nt, Mycobacterium avium subsp. paratuberculosis
caguauggauuggccggcgcgc

SEQ ID NO: 10203 - RNA, 22 nt, Mycobacterium avium subsp. paratuberculosis
cacuuccauuucccuugcccgc

SEQ ID NO: 10204 - RNA, 22 nt, Mycobacterium avium subsp. paratuberculosis
cagggugccgccuccaggucgc

SEQ ID NO: 10205 - RNA, 22 nt, Mycobacterium avium subsp. paratuberculosis
caggcugcccggcugcugccca

SEQ ID NO: 10206 - RNA, 22 nt, Mycobacterium avium subsp. paratuberculosis
caggcuggcaucgucggcgccg

SEQ ID NO: 10207 - RNA, 22 nt, Mycobacterium avium subsp. paratuberculosis
caugaggugacguucgaauccg

SEQ ID NO: 10208 - RNA, 22 nt, Mycobacterium avium subsp. paratuberculosis
ccacagagacucacgcgauggc

SEQ ID NO: 10209 - RNA, 22 nt, Mycobacterium avium subsp. paratuberculosis
cagcaggucauguucuagcggc

SEQ ID NO: 10210 - RNA, 22 nt, Mycobacterium avium subsp. paratuberculosis
cagcccggccagcucgucgggg

SEQ ID NO: 10211 - RNA, 22 nt, Mycobacterium avium subsp. paratuberculosis
cagcaaggcgcaugucggagcg

SEQ ID NO: 10212 - RNA, 22 nt, Mycobacterium avium subsp. paratuberculosis
cagcacgcggcguccaucaucg

SEQ ID NO: 10213 - RNA, 22 nt, Mycobacterium avium subsp. paratuberculosis
cagcgcgccgcggguggaguug

SEQ ID NO: 10214 - RNA, 22 nt, Mycobacterium avium subsp. paratuberculosis
cagcgggugcucggccugccgc

SEQ ID NO: 10215 - RNA, 22 nt, Mycobacterium avium subsp. paratuberculosis
cagcuugucgccgacgugcgcg

SEQ ID NO: 10216 - RNA, 22 nt, Mycobacterium avium subsp. paratuberculosis
caggauguggcugaccugcagg

SEQ ID NO: 10217 - RNA, 22 nt, Mycobacterium avium subsp. paratuberculosis
cggugguggccggcagccaguc

SEQ ID NO: 10218 - RNA, 22 nt, Mycobacterium avium subsp. paratuberculosis
cggugguggcgccgcugcuguc

SEQ ID NO: 10219 - RNA, 22 nt, Mycobacterium avium subsp. paratuberculosis
cggcugcaacgacugaccggcg

SEQ ID NO: 10220 - RNA, 22 nt, Mycobacterium avium subsp. paratuberculosis
cgggccaaccggcuggcccggc

SEQ ID NO: 10221 - RNA, 22 nt, Mycobacterium avium subsp. paratuberculosis
cggucaggccacugcucggccc

SEQ ID NO: 10222 - RNA, 22 nt, Mycobacterium avium subsp. paratuberculosis
cugugucuguccgcggcaucgc

SEQ ID NO: 10223 - RNA, 22 nt, Mycobacterium avium subsp. paratuberculosis
cuugaaccgguucaucgcgcug

SEQ ID NO: 10224 - RNA, 22 nt, Mycobacterium avium subsp. paratuberculosis
cuggugaucagcgccggcaucc

SEQ ID NO: 10225 - RNA, 22 nt, Mycobacterium avium subsp. paratuberculosis
cuggacugggacaagggcaaga

SEQ ID NO: 10226 - RNA, 22 nt, Mycobacterium avium subsp. paratuberculosis
cuggucacgcuguucgucaucu

SEQ ID NO: 10227 - RNA, 22 nt, Mycobacterium avium subsp. paratuberculosis
cugggcgcgcugccacagcgug

SEQ ID NO: 10228 - RNA, 22 nt, Mycobacterium avium subsp. paratuberculosis
cugggcgcggugguggccgcca

SEQ ID NO: 10229 - RNA, 22 nt, Mycobacterium avium subsp. paratuberculosis
cuggccauggcguucggccggu

SEQ ID NO: 10230 - RNA, 22 nt, Mycobacterium avium subsp. paratuberculosis
cuggccgacgcgcuggugcgac

SEQ ID NO: 10231 - RNA, 22 nt, Mycobacterium avium subsp. paratuberculosis
cugcgagccgguauugugaucg

SEQ ID NO: 10232 - RNA, 22 nt, Mycobacterium avium subsp. paratuberculosis
cugaccccggcgcgccagucgg

SEQ ID NO: 10233 - RNA, 22 nt, Mycobacterium avium subsp. paratuberculosis
cugcccaaggacaccgcggcgc

SEQ ID NO: 10234 - RNA, 22 nt, Mycobacterium avium subsp. paratuberculosis
cugcccgaccaggaccugccgu

SEQ ID NO: 10235 - RNA, 22 nt, Mycobacterium avium subsp. paratuberculosis
cucgcugguggccgcggugcug

SEQ ID NO: 10236 - RNA, 22 nt, Mycobacterium avium subsp. paratuberculosis
cgugguggcgcagaccaagacc

SEQ ID NO: 10237 - RNA, 22 nt, Mycobacterium avium subsp. paratuberculosis
cguggugguagccggcggucag

SEQ ID NO: 10238 - RNA, 22 nt, Mycobacterium avium subsp. paratuberculosis
cucacgccgucggugcugggcc

SEQ ID NO: 10239 - RNA, 22 nt, Mycobacterium avium subsp. paratuberculosis
cucccggggcgagcugcacggc

SEQ ID NO: 10240 - RNA, 22 nt, Mycobacterium avium subsp. paratuberculosis
cuccgggcugaucgcccgcacc

SEQ ID NO: 10241 - RNA, 19 nt, Mycobacterium avium subsp. paratuberculosis
cgcaagggccuagucggga

SEQ ID NO: 10242 - RNA, 21 nt, Mycobacterium avium subsp. paratuberculosis
cgcagcagucggucgauguuc

SEQ ID NO: 10243 - RNA, 22 nt, Mycobacterium avium subsp. paratuberculosis
cgcagcauugcguccgccuaac

SEQ ID NO: 10244 - RNA, 22 nt, Mycobacterium avium subsp. paratuberculosis
cgcccggcgcgaccuuccuguc

SEQ ID NO: 10245 - RNA, 22 nt, Mycobacterium avium subsp. paratuberculosis
cgacuugagcgcggccaggaug

SEQ ID NO: 10246 - RNA, 22 nt, Mycobacterium avium subsp. paratuberculosis
cgagcucaagauccaugccgcc

SEQ ID NO: 10247 - RNA, 22 nt, Mycobacterium avium subsp. paratuberculosis
ccuugugaccgcgcuguacguc

SEQ ID NO: 10248 - RNA, 20 nt, Mycobacterium avium subsp. paratuberculosis
ccugggccaaaaaucgcacc

SEQ ID NO: 10249 - RNA, 22 nt, Mycobacterium avium subsp. paratuberculosis
ccuggccgacaccaaccccgaa

SEQ ID NO: 10250 - RNA, 22 nt, Mycobacterium avium subsp. paratuberculosis
ccuccuggccgcccagggcgug

SEQ ID NO: 10251 - RNA, 22 nt, Mycobacterium avium subsp. paratuberculosis
ccgggccagcuccacgcacugg

SEQ ID NO: 10252 - RNA, 22 nt, Mycobacterium avium subsp. paratuberculosis
ccgcucccaccgccgggcugau

SEQ ID NO: 10253 - RNA, 20 nt, Homo sapiens
uaucacaguucaggaacucu

SEQ ID NO: 10254 - RNA, 22 nt, Homo sapiens
gcuggaauuaacauagaugugc

SEQ ID NO: 10255 - RNA, 22 nt, Homo sapiens
uugcauaagugcauucugugau

SEQ ID NO: 10256 - RNA, 22 nt, Homo sapiens
gagaacugagauaagugauauu

SEQ ID NO: 10257 - RNA, 22 nt, Homo sapiens
acagucacaauuuguaccuuuu

SEQ ID NO: 10258 - RNA, 22 nt, Homo sapiens
auaaagacacuuggcaugauuu

SEQ ID NO: 10259 - RNA, 22 nt, Homo sapiens
cucauugcaaucuccaccuccc

SEQ ID NO: 10260 - RNA, 20 nt, Homo sapiens
uaagugcuuuauauugauua

SEQ ID NO: 10261 - RNA, 22 nt, Homo sapiens
auguggaaagcagcaugauaug

SEQ ID NO: 10262 - RNA, 22 nt, Homo sapiens
ugagauaauuuacuuguugagg

SEQ ID NO: 10263 - RNA, 22 nt, Homo sapiens
cauugcacucuaucccgguggg

SEQ ID NO: 10264 - RNA, 22 nt, Homo sapiens
ggcagcaugggugccuuuguga

SEQ ID NO: 10265 - RNA, 22 nt, Homo sapiens
aaguacuguuuaaauugcagaa

SEQ ID NO: 10266 - RNA, 22 nt, Homo sapiens
uagcaguaagaaacugacauug

SEQ ID NO: 10267 - RNA, 22 nt, Homo sapiens
aagagguagcagucacaaaaga

SEQ ID NO: 10268 - RNA, 22 nt, Homo sapiens
ugagaugcauauucuggcuccu

SEQ ID NO: 10269 - RNA, 22 nt, Homo sapiens
ucacacugaauuugaagcaaug

SEQ ID NO: 10270 - RNA, 22 nt, Homo sapiens
uguauuuguuguuaaauggaga

SEQ ID NO: 10271 - RNA, 22 nt, Homo sapiens
aagugcaaauucccaggcucug

SEQ ID NO: 10272 - RNA, 18 nt, Homo sapiens
ucuggcuucuuuguucca

SEQ ID NO: 10273 - RNA, 22 nt, Homo sapiens
uuugggaaugaguuuaucauuu

SEQ ID NO: 10274 - RNA, 22 nt, Homo sapiens
aaaguggugggauuccaggcau

SEQ ID NO: 10275 - RNA, 22 nt, Homo sapiens
uugugaauggugcugcaguaaa

SEQ ID NO: 10276 - RNA, 22 nt, Homo sapiens
cccuguguuuagcugaagguuu

SEQ ID NO: 10277 - RNA, 22 nt, Homo sapiens
guaaucucagcuucuugggagg

SEQ ID NO: 10278 - RNA, 22 nt, Homo sapiens
augugcaacugcuggaacaguc

SEQ ID NO: 10279 - RNA, 22 nt, Homo sapiens
uggcaaaugaaagaaagccagu

SEQ ID NO: 10280 - RNA, 22 nt, Homo sapiens
augaaaagcauaaacgcugaag

SEQ ID NO: 10281 - RNA, 22 nt, Homo sapiens
auuuggguuuuacaucaggcua

SEQ ID NO: 10282 - RNA, 22 nt, Homo sapiens
uuugucccuuugcaguggcaca

SEQ ID NO: 10283 - RNA, 22 nt, Homo sapiens
aagggagcugcauaaucuugug

SEQ ID NO: 10284 - RNA, 22 nt, Homo sapiens
aaagugcugggauuaggccagg

SEQ ID NO: 10285 - RNA, 22 nt, Homo sapiens
auuacacuuucuauucaaugag

SEQ ID NO: 10286 - RNA, 22 nt, Homo sapiens
ugacucaguuucucagguagua

SEQ ID NO: 10287 - RNA, 23 nt, Homo sapiens
ucaguacuccacuuucaauagug

SEQ ID NO: 10288 - RNA, 22 nt, Homo sapiens
cuggcaagaggauaaaguccua

SEQ ID NO: 10289 - RNA, 23 nt, Homo sapiens
aagagguaugacuaugaagugga

SEQ ID NO: 10290 - RNA, 18 nt, Homo sapiens
cuugucaaaucuuuccuc

SEQ ID NO: 10291 - RNA, 20 nt, Homo sapiens
auguaauguaugauauguac

SEQ ID NO: 10292 - RNA, 18 nt, Homo sapiens
uccaguuuucccagcauc

SEQ ID NO: 10293 - RNA, 22 nt, Homo sapiens
agagugcaaagguuggggcugg

SEQ ID NO: 10294 - RNA, 22 nt, Homo sapiens
cuagcagacaugggcugaacca

SEQ ID NO: 10295 - RNA, 22 nt, Homo sapiens
cugcaguaaccacuguaggugu

SEQ ID NO: 10296 - RNA, 22 nt, Homo sapiens
aacagucaauugcugaugaccu

SEQ ID NO: 10297 - RNA, 22 nt, Homo sapiens
uaaagcuuggauuuaggcuaau

SEQ ID NO: 10298 - RNA, 22 nt, Homo sapiens
cuggaagaaaaucacgccaucu

SEQ ID NO: 10299 - RNA, 22 nt, Homo sapiens
acugagacugagaauguuucuu

SEQ ID NO: 10300 - RNA, 22 nt, Homo sapiens
aagugcuuccuuucagaggguu

SEQ ID NO: 10301 - RNA, 22 nt, Homo sapiens
gcagcaucaaaucacacaagau

SEQ ID NO: 10302 - RNA, 21 nt, Homo sapiens
ugugaccucugucucugaguc

SEQ ID NO: 10303 - RNA, 22 nt, Homo sapiens
uuggcagcuguggaaucugggc

SEQ ID NO: 10304 - RNA, 22 nt, Homo sapiens
ugugucuccugaaaauucacau

SEQ ID NO: 10305 - RNA, 19 nt, Homo sapiens
ugcaaauucuaaaaacuga

SEQ ID NO: 10306 - RNA, 22 nt, Homo sapiens
ugagauggagucuugucgccua

SEQ ID NO: 10307 - RNA, 21 nt, Homo sapiens
ugugaacauguuggguggcau

SEQ ID NO: 10308 - RNA, 22 nt, Homo sapiens
agucaagaaucucagcaucuuu

SEQ ID NO: 10309 - RNA, 23 nt, Homo sapiens
uauugcacuaugguaacccuuuu

SEQ ID NO: 10310 - RNA, 22 nt, Homo sapiens
cucacugucaacauguauuugg

SEQ ID NO: 10311 - RNA, 22 nt, Homo sapiens
cauugcacuccagccugcugac

SEQ ID NO: 10312 - RNA, 22 nt, Homo sapiens
cacccuugcagggacagcuuug

SEQ ID NO: 10313 - RNA, 22 nt, Homo sapiens
uauuaguuuucuguggauuaca

SEQ ID NO: 10314 - RNA, 22 nt, Homo sapiens
gauggcacuaagccauguagga

SEQ ID NO: 10315 - RNA, 17 nt, Homo sapiens
uuuuggauuagaaaucc

SEQ ID NO: 10316 - RNA, 22 nt, Homo sapiens
uguagucauuccuuuuugcuuu

SEQ ID NO: 10317 - RNA, 22 nt, Homo sapiens
uucaugucuuggcuguuagagu

SEQ ID NO: 10318 - RNA, 22 nt, Homo sapiens
aauggcaaauguuuucuguuga

SEQ ID NO: 10319 - RNA, 22 nt, Homo sapiens
gugaaagacauauaugguuuga

SEQ ID NO: 10320 - RNA, 22 nt, Homo sapiens
aagcuacauuuuauuuauguca

SEQ ID NO: 10321 - RNA, 22 nt, Homo sapiens
aucuuguguugaauggugcaga

SEQ ID NO: 10322 - RNA, 22 nt, Homo sapiens
caucacaugcuuauuuuccuca

SEQ ID NO: 10323 - RNA, 22 nt, Homo sapiens
acugaguguugauuuagauuaa

SEQ ID NO: 10324 - RNA, 22 nt, Homo sapiens
ucagacacugagcaaacgacua

SEQ ID NO: 10325 - RNA, 18 nt, Homo sapiens
ggaaaacuuuucuaagua

SEQ ID NO: 10326 - RNA, 22 nt, Homo sapiens
uaugugcaaauuaauugcuaga

SEQ ID NO: 10327 - RNA, 22 nt, Homo sapiens
ugugaauggugcugcaaugaac

SEQ ID NO: 10328 - RNA, 22 nt, Homo sapiens
uaguauguuuauagcauugagu

SEQ ID NO: 10329 - RNA, 22 nt, Homo sapiens
auaugucuguuuagucuguaau

SEQ ID NO: 10330 - RNA, 21 nt, Homo sapiens
uaucagagacauugagaggca

SEQ ID NO: 10331 - RNA, 22 nt, Homo sapiens
uuuugcacuguuuuaucugaca

SEQ ID NO: 10332 - RNA, 22 nt, Homo sapiens
guaaucucagcuacuugggagc

SEQ ID NO: 10333 - RNA, 22 nt, Homo sapiens
ucuugcacaaauuauuuuaacu

SEQ ID NO: 10334 - RNA, 22 nt, Homo sapiens
uugcacauuuuuucuggcagaa

SEQ ID NO: 10335 - RNA, 22 nt, Homo sapiens
uagcaguaucccaccaucuggu

SEQ ID NO: 10336 - RNA, 22 nt, Homo sapiens
uaugucuauuauguagcaggaa

SEQ ID NO: 10337 - RNA, 22 nt, Homo sapiens
acugcacuccagccuccugggu

SEQ ID NO: 10338 - RNA, 22 nt, Homo sapiens
uugugcaugaugcauacauggu

SEQ ID NO: 10339 - RNA, 22 nt, Homo sapiens
ucucuggauaucuacuuauguu

SEQ ID NO: 10340 - RNA, 22 nt, Homo sapiens
gugcacaucuguguuccagcua

SEQ ID NO: 10341 - RNA, 22 nt, Homo sapiens
augacugucagggcagucauug

SEQ ID NO: 10342 - RNA, 17 nt, Homo sapiens
ugcaauuuaagcuagau

SEQ ID NO: 10343 - RNA, 22 nt, Homo sapiens
agcuggauguauguuaagugaa

SEQ ID NO: 10344 - RNA, 22 nt, Homo sapiens
uaugaaagcuacuucucacaau

SEQ ID NO: 10345 - RNA, 22 nt, Homo sapiens
acuucauucucuggaucagaau

SEQ ID NO: 10346 - RNA, 22 nt, Homo sapiens
gugucaugagggggacaggaag

SEQ ID NO: 10347 - RNA, 22 nt, Homo sapiens
accugagauuacaggugcuggc

SEQ ID NO: 10348 - RNA, 22 nt, Homo sapiens
ucaguaaaugcuguucucuuuu

SEQ ID NO: 10349 - RNA, 22 nt, Homo sapiens
guucaagugauagcugggauua

SEQ ID NO: 10350 - RNA, 22 nt, Homo sapiens
auugucccucuuaaucccagca

SEQ ID NO: 10351 - RNA, 22 nt, Homo sapiens
uuucugagaccaaaacuuguaa

SEQ ID NO: 10352 - RNA, 22 nt, Homo sapiens
gacacugucuucugcucuuaaa

SEQ ID NO: 10353 - RNA, 22 nt, Homo sapiens
agcagguguccacaauguuugc

SEQ ID NO: 10354 - RNA, 22 nt, Homo sapiens
aaucacaguguucuugugaggg

SEQ ID NO: 10355 - RNA, 22 nt, Homo sapiens
agcauuaguugugaagccuuua

SEQ ID NO: 10356 - RNA, 22 nt, Homo sapiens
ugaaaucauguaguuauugcaa

SEQ ID NO: 10357 - RNA, 18 nt, Homo sapiens
cuuaacauugggaugaua

SEQ ID NO: 10358 - RNA, 22 nt, Homo sapiens
accucagcccggggaaguugag

SEQ ID NO: 10359 - RNA, 22 nt, Homo sapiens
uauugcacaugaggagacauug

SEQ ID NO: 10360 - RNA, 22 nt, Homo sapiens
uaucacaggucaggaaccuugu

SEQ ID NO: 10361 - RNA, 22 nt, Homo sapiens
auugcaugucauguuuagugua

SEQ ID NO: 10362 - RNA, 19 nt, Homo sapiens
uauguaguuuucucaauau

SEQ ID NO: 10363 - RNA, 17 nt, Homo sapiens
gugagguauccucaaaa

SEQ ID NO: 10364 - RNA, 22 nt, Homo sapiens
uagcaguaaagaaugugauguu

SEQ ID NO: 10365 - RNA, 22 nt, Homo sapiens
cauugcacuccaucccgggaaa

SEQ ID NO: 10366 - RNA, 22 nt, Homo sapiens
uuaacagucacuuagcucauuu

SEQ ID NO: 10367 - RNA, 22 nt, Homo sapiens
auggcacagaguagaugcucaa

SEQ ID NO: 10368 - RNA, 22 nt, Homo sapiens
gaacccuggaggcggagguugc

SEQ ID NO: 10369 - RNA, 22 nt, Homo sapiens
ugugaacauuuuguauauauua

SEQ ID NO: 10370 - RNA, 22 nt, Homo sapiens
gagacugagucuugcucugucg

SEQ ID NO: 10371 - RNA, 22 nt, Homo sapiens
ucacaguucagcauggcugagg

SEQ ID NO: 10372 - RNA, 22 nt, Homo sapiens
acauucagcuguuguuucaaug

SEQ ID NO: 10373 - RNA, 22 nt, Homo sapiens
uauuguacauguuauagauuuu

SEQ ID NO: 10374 - RNA, 22 nt, Homo sapiens
ucagguccuuacugugcucccu

SEQ ID NO: 10375 - RNA, 22 nt, Homo sapiens
cuggaauguuccuaaagauuca

SEQ ID NO: 10376 - RNA, 22 nt, Homo sapiens
auuccauuuguuaucacacccg

SEQ ID NO: 10377 - RNA, 22 nt, Homo sapiens
uaagugaauuugacagguaaug

SEQ ID NO: 10378 - RNA, 22 nt, Homo sapiens
gcauggccuuuaaaugucacag

SEQ ID NO: 10379 - RNA, 22 nt, Homo sapiens
uugcauagaccgaugucuugga

SEQ ID NO: 10380 - RNA, 22 nt, Homo sapiens
aaauugcauugagcugcuuauu

SEQ ID NO: 10381 - RNA, 22 nt, Homo sapiens
gccuagagaaguaaauauuauc

SEQ ID NO: 10382 - RNA, 22 nt, Homo sapiens
uucauguaauuccauaagguaa

SEQ ID NO: 10383 - RNA, 22 nt, Homo sapiens
uaguuauggaguaauuuuaagc

SEQ ID NO: 10384 - RNA, 22 nt, Homo sapiens
uacagucauaaugccuagugac

SEQ ID NO: 10385 - RNA, 22 nt, Homo sapiens
gaagugcuuuuggacuaacagu

SEQ ID NO: 10386 - RNA, 22 nt, Homo sapiens
gagacggagucucgcucuguca

SEQ ID NO: 10387 - RNA, 22 nt, Homo sapiens
uaggugaaugcuggaagaaaug

SEQ ID NO: 10388 - RNA, 22 nt, Homo sapiens
uugaaggaggugcucacucucg

SEQ ID NO: 10389 - RNA, 22 nt, Homo sapiens
uaagugaauguuggcuacugaa

SEQ ID NO: 10390 - RNA, 22 nt, Homo sapiens
uugcacauggcuggggaggccu

SEQ ID NO: 10391 - RNA, 22 nt, Homo sapiens
uuuuaguggaauauuuacaguu

SEQ ID NO: 10392 - RNA, 22 nt, Homo sapiens
uggcaagauuguuccgguuugg

SEQ ID NO: 10393 - RNA, 22 nt, Homo sapiens
uuauucauuaauugcuaagguu

SEQ ID NO: 10394 - RNA, 22 nt, Homo sapiens
cauugcacuccagcucugggcg

SEQ ID NO: 10395 - RNA, 21 nt, Homo sapiens
uacaaugcacaggagagccuc

SEQ ID NO: 10396 - RNA, 22 nt, Homo sapiens
uucuaaguaauuuugcaugccu

SEQ ID NO: 10397 - RNA, 22 nt, Homo sapiens
ugagaucaugccacugcacuuc

SEQ ID NO: 10398 - RNA, 22 nt, Homo sapiens
uuugucccucucaccaacgggg

SEQ ID NO: 10399 - RNA, 22 nt, Homo sapiens
cugauacugagaccuuggguua

SEQ ID NO: 10400 - RNA, 22 nt, Homo sapiens
ucuggcuugugaacugucuucu

SEQ ID NO: 10401 - RNA, 22 nt, Homo sapiens
auuaucacaguuuugcauaugg

SEQ ID NO: 10402 - RNA, 22 nt, Homo sapiens
uggcaagaccccaucucuacaa

SEQ ID NO: 10403 - RNA, 22 nt, Homo sapiens
gguggugguauuucagaaaaug

SEQ ID NO: 10404 - RNA, 22 nt, Homo sapiens
uugugcauaucagagguuugcu

SEQ ID NO: 10405 - RNA, 22 nt, Homo sapiens
uuggaagacaaugcugauucuc

SEQ ID NO: 10406 - RNA, 22 nt, Homo sapiens
uaaguaaaugaaagguugauuu

SEQ ID NO: 10407 - RNA, 22 nt, Homo sapiens
uagagguauuaacaguagaaga

SEQ ID NO: 10408 - RNA, 22 nt, Homo sapiens
ucuggcuuauuucacuuagcau

SEQ ID NO: 10409 - RNA, 22 nt, Homo sapiens
cuuuuggcuuaagauugucuug

SEQ ID NO: 10410 - RNA, 17 nt, Homo sapiens
cccuaguagcugggacu

SEQ ID NO: 10411 - RNA, 22 nt, Homo sapiens
uagacacugcauauuuuuuuaa

SEQ ID NO: 10412 - RNA, 22 nt, Homo sapiens
uggaaguauagauaauugaaag

SEQ ID NO: 10413 - RNA, 22 nt, Homo sapiens
ugagauuauauuucuuaacaga

SEQ ID NO: 10414 - RNA, 22 nt, Homo sapiens
gugcaaaucucugaguaucuuu

SEQ ID NO: 10415 - RNA, 22 nt, Homo sapiens
gugucccagugugcauacaggu

SEQ ID NO: 10416 - RNA, 22 nt, Homo sapiens
uagucacacacucaacuuuuca

SEQ ID NO: 10417 - RNA, 22 nt, Homo sapiens
ugcagagaaacauuuuguauuu

SEQ ID NO: 10418 - RNA, 22 nt, Homo sapiens
cugauugucaucaauauuauua

SEQ ID NO: 10419 - RNA, 22 nt, Homo sapiens
ucccauguagcuaggauuacag

SEQ ID NO: 10420 - RNA, 22 nt, Homo sapiens
ccuuggcaauggcuggggcuga

SEQ ID NO: 10421 - RNA, 22 nt, Homo sapiens
uugaaagaugaacuggauugga

SEQ ID NO: 10422 - RNA, 22 nt, Homo sapiens
uucacaguacucccuggaauua

SEQ ID NO: 10423 - RNA, 22 nt, Homo sapiens
uuuccagguggccaacauuuua

SEQ ID NO: 10424 - RNA, 22 nt, Homo sapiens
aauuaguugucgugagaguggu

SEQ ID NO: 10425 - RNA, 22 nt, Homo sapiens
agccuguguugaauuauagaaa

SEQ ID NO: 10426 - RNA, 22 nt, Homo sapiens
gugaaagacagcauuaauggcu

SEQ ID NO: 10427 - RNA, 22 nt, Homo sapiens
ucggcucagugcaagcucugcc

SEQ ID NO: 10428 - RNA, 22 nt, Homo sapiens
aagggaauguuguggcugguug

SEQ ID NO: 10429 - RNA, 22 nt, Homo sapiens
aucacugugauuucuacugugc

SEQ ID NO: 10430 - RNA, 22 nt, Homo sapiens
cacauugcaggaaaguucauua

SEQ ID NO: 10431 - RNA, 22 nt, Homo sapiens
gaguuagguugucaaugucuua

SEQ ID NO: 10432 - RNA, 22 nt, Homo sapiens
uggaaugucagcuacaagaggg

SEQ ID NO: 10433 - RNA, 22 nt, Homo sapiens
ucauggcacugaugagaguuuc

SEQ ID NO: 10434 - RNA, 17 nt, Homo sapiens
auaugucugcuggggga

SEQ ID NO: 10435 - RNA, 22 nt, Homo sapiens
uacaagcacaggcagcaggcug

SEQ ID NO: 10436 - RNA, 22 nt, Homo sapiens
aauacuggcacugaagaccaug

SEQ ID NO: 10437 - RNA, 22 nt, Homo sapiens
uacaugcaugggcaugugugca

SEQ ID NO: 10438 - RNA, 22 nt, Homo sapiens
uuggagugugcucauaacugcu

SEQ ID NO: 10439 - RNA, 22 nt, Homo sapiens
uugugaaugaugccgcaauaaa

SEQ ID NO: 10440 - RNA, 22 nt, Homo sapiens
uugugaauggugccgcaguaaa

SEQ ID NO: 10441 - RNA, 22 nt, Homo sapiens
cuucaaguguggccaccugacc

SEQ ID NO: 10442 - RNA, 22 nt, Homo sapiens
ugagacacugaauccggccuga

SEQ ID NO: 10443 - RNA, 21 nt, Homo sapiens
agcuaaauuggaaauuucugu

SEQ ID NO: 10444 - RNA, 22 nt, Homo sapiens
uugaaagcuaucagagauucca

SEQ ID NO: 10445 - RNA, 16 nt, Homo sapiens
cauugcacucuagccu

SEQ ID NO: 10446 - RNA, 22 nt, Homo sapiens
uugaaagacaucaccuacugcu

SEQ ID NO: 10447 - RNA, 22 nt, Homo sapiens
agauggguuuucacauguuggc

SEQ ID NO: 10448 - RNA, 22 nt, Homo sapiens
uuaaucuguucucuguauucua

SEQ ID NO: 10449 - RNA, 22 nt, Homo sapiens
gagcaucaguggccucaucuca

SEQ ID NO: 10450 - RNA, 19 nt, Homo sapiens
uacauaguauuuaguggca

SEQ ID NO: 10451 - RNA, 23 nt, Homo sapiens
aggcauuguacaguaauggaaaa

SEQ ID NO: 10452 - RNA, 19 nt, Homo sapiens
ccauggcaaugaucugaug

SEQ ID NO: 10453 - RNA, 22 nt, Homo sapiens
ugcuaugucagccaggcugguc

SEQ ID NO: 10454 - RNA, 22 nt, Homo sapiens
uagagguagguguaugaacuag

SEQ ID NO: 10455 - RNA, 22 nt, Homo sapiens
uuuauggagagauauuuauggu

SEQ ID NO: 10456 - RNA, 22 nt, Homo sapiens
gcugagaucucuugccugaacu

SEQ ID NO: 10457 - RNA, 20 nt, Homo sapiens
ugugauuauuuaguugcaug

SEQ ID NO: 10458 - RNA, 22 nt, Homo sapiens
uugaaagucauuucuucuaagu

SEQ ID NO: 10459 - RNA, 22 nt, Homo sapiens
agugccaaaucgagggcucuga

SEQ ID NO: 10460 - RNA, 22 nt, Homo sapiens
uugugaucauugucaaauagug

SEQ ID NO: 10461 - RNA, 22 nt, Homo sapiens
aucaugucuucccagugauucu

SEQ ID NO: 10462 - RNA, 18 nt, Homo sapiens
aaaaagugcucaggccua

SEQ ID NO: 10463 - RNA, 22 nt, Homo sapiens
auccuuuagacuguccaguuga

SEQ ID NO: 10464 - RNA, 22 nt, Homo sapiens
auagcagugugaaaacagacug

SEQ ID NO: 10465 - RNA, 22 nt, Homo sapiens
aaagugcuaggauuaccugggg

SEQ ID NO: 10466 - RNA, 22 nt, Homo sapiens
uagcaguaccccaguauccugg

SEQ ID NO: 10467 - RNA, 22 nt, Homo sapiens
ugugaacacagaggcuauggca

SEQ ID NO: 10468 - RNA, 22 nt, Homo sapiens
gcaccaugguagaauaauggua

SEQ ID NO: 10469 - RNA, 22 nt, Homo sapiens
cccugagagcagggucuuucuc

SEQ ID NO: 10470 - RNA, 22 nt, Homo sapiens
aacacggcccgcagagcaagcu

SEQ ID NO: 10471 - RNA, 22 nt, Homo sapiens
aguggaaucuguuauacuaacu

SEQ ID NO: 10472 - RNA, 22 nt, Homo sapiens
uuaggcuuuauugaaaacaaua

SEQ ID NO: 10473 - RNA, 22 nt, Homo sapiens
uucaacagugauggccuuugua

SEQ ID NO: 10474 - RNA, 22 nt, Homo sapiens
uaaagugaggauggcaguaggu

SEQ ID NO: 10475 - RNA, 22 nt, Homo sapiens
ucuccauuguccagaugaggaa

SEQ ID NO: 10476 - RNA, 22 nt, Homo sapiens
ugagaugugugcauucaacuca

SEQ ID NO: 10477 - RNA, 22 nt, Homo sapiens
cauugcacugcagcccgggcaa

SEQ ID NO: 10478 - RNA, 22 nt, Homo sapiens
ugagauaggaucuugcucuguu

SEQ ID NO: 10479 - RNA, 22 nt, Homo sapiens
gagauauucugguuuacuaaau

SEQ ID NO: 10480 - RNA, 22 nt, Homo sapiens
aaggugcuguaagcauccaugu

SEQ ID NO: 10481 - RNA, 22 nt, Homo sapiens
aacagugcauuccuguccauau

SEQ ID NO: 10482 - RNA, 22 nt, Homo sapiens
uggucaccugaauuaugcaugu

SEQ ID NO: 10483 - RNA, 22 nt, Homo sapiens
ugcgccauugcacuccagccug

SEQ ID NO: 10484 - RNA, 22 nt, Homo sapiens
cauugcacuccagccuagccaa

SEQ ID NO: 10485 - RNA, 22 nt, Homo sapiens
aagugcuucagaagacaauauu

SEQ ID NO: 10486 - RNA, 20 nt, Homo sapiens
aucacuggagaaggaaaccu

SEQ ID NO: 10487 - RNA, 22 nt, Homo sapiens
aauaaagucugaagugugcuua

SEQ ID NO: 10488 - RNA, 16 nt, Homo sapiens
aucacuugcuucuuuu

SEQ ID NO: 10489 - RNA, 22 nt, Homo sapiens
cuuucugaggagaauagagaac

SEQ ID NO: 10490 - RNA, 22 nt, Homo sapiens
uaucacagugcuggaguauucc

SEQ ID NO: 10491 - RNA, 22 nt, Homo sapiens
gugccacugcacuccggccugg

SEQ ID NO: 10492 - RNA, 22 nt, Homo sapiens
cauugcacugcauucugggcaa

SEQ ID NO: 10493 - RNA, 22 nt, Homo sapiens
ggcacuguggcucaagccugua

SEQ ID NO: 10494 - RNA, 22 nt, Homo sapiens
aauugcauugaauuuguagcuu

SEQ ID NO: 10495 - RNA, 22 nt, Homo sapiens
ucaagcaauucuccucucagcc

SEQ ID NO: 10496 - RNA, 22 nt, Homo sapiens
uguacuucaagauuaugguuua

SEQ ID NO: 10497 - RNA, 22 nt, Homo sapiens
augauagucuugagaagcauuu

SEQ ID NO: 10498 - RNA, 22 nt, Homo sapiens
guaaucucagcuacucgggaga

SEQ ID NO: 10499 - RNA, 22 nt, Homo sapiens
uagcaguauugaaagaugaggg

SEQ ID NO: 10500 - RNA, 22 nt, Homo sapiens
acugcacuccaguuugggcagc

SEQ ID NO: 10501 - RNA, 22 nt, Homo sapiens
auucagaggggcagcugucuug

SEQ ID NO: 10502 - RNA, 22 nt, Homo sapiens
ucucagugaauguggaaaaagc

SEQ ID NO: 10503 - RNA, 22 nt, Homo sapiens
ucaugucuuguuguauuuauuu

SEQ ID NO: 10504 - RNA, 22 nt, Homo sapiens
aagagguagaagcuugccuucu

SEQ ID NO: 10505 - RNA, 22 nt, Homo sapiens
guaauaacuguggaaaaagguu

SEQ ID NO: 10506 - RNA, 22 nt, Homo sapiens
uggaaugguaucuuguuggggu

SEQ ID NO: 10507 - RNA, 22 nt, Homo sapiens
augagauaaaccaucucuuaag

SEQ ID NO: 10508 - RNA, 22 nt, Homo sapiens
guugcucaggcuggagugcagu

SEQ ID NO: 10509 - RNA, 22 nt, Homo sapiens
acaagcacaaauuuaauccugu

SEQ ID NO: 10510 - RNA, 22 nt, Homo sapiens
ucugucuugugguuugagugcc

SEQ ID NO: 10511 - RNA, 22 nt, Homo sapiens
gugucucagcccagaccuauuu

SEQ ID NO: 10512 - RNA, 22 nt, Homo sapiens
ucacaugggugcaauauaauca

SEQ ID NO: 10513 - RNA, 22 nt, Homo sapiens
gagauauuuagaaauguguucu

SEQ ID NO: 10514 - RNA, 22 nt, Homo sapiens
uucaaaguguugguuuugggcu

SEQ ID NO: 10515 - RNA, 22 nt, Homo sapiens
ccugagacuugagggggcuucu

SEQ ID NO: 10516 - RNA, 22 nt, Homo sapiens
uucuccugguggacccuaaacg

SEQ ID NO: 10517 - RNA, 22 nt, Homo sapiens
uugcaucagcaggcauaauugg

SEQ ID NO: 10518 - RNA, 22 nt, Homo sapiens
uacauacuucacagacuuuaaa

SEQ ID NO: 10519 - RNA, 22 nt, Homo sapiens
ucacuaaagaaaauggcaugga

SEQ ID NO: 10520 - RNA, 22 nt, Homo sapiens
uugagauaggagcuguuguucu

SEQ ID NO: 10521 - RNA, 22 nt, Homo sapiens
auugcacaaagagggaaacuga

SEQ ID NO: 10522 - RNA, 22 nt, Homo sapiens
ucacuagggagaaacugaggcu

SEQ ID NO: 10523 - RNA, 22 nt, Homo sapiens
auaagauaguggaagugggauu

SEQ ID NO: 10524 - RNA, 22 nt, Homo sapiens
uuaaguuaggcuucagcagucu

SEQ ID NO: 10525 - RNA, 22 nt, Homo sapiens
gucagugugauaucugcagggg

SEQ ID NO: 10526 - RNA, 22 nt, Homo sapiens
guucaagugauucuacugccuc

SEQ ID NO: 10527 - RNA, 22 nt, Homo sapiens
uaucaugucuguguguaccuag

SEQ ID NO: 10528 - RNA, 22 nt, Homo sapiens
uguaauuuaaaugauccuugga

SEQ ID NO: 10529 - RNA, 22 nt, Homo sapiens
aaagugaauguaucccguaagu

SEQ ID NO: 10530 - RNA, 22 nt, Homo sapiens
uaacagcucuacagcugcucuu

SEQ ID NO: 10531 - RNA, 22 nt, Homo sapiens
gauuuuccaguggcccugauca

SEQ ID NO: 10532 - RNA, 22 nt, Homo sapiens
agacacuguugaaaaggcccca

SEQ ID NO: 10533 - RNA, 22 nt, Homo sapiens
uucaagcuauggugaucuuuuc

SEQ ID NO: 10534 - RNA, 20 nt, Homo sapiens
uauugcacuccagucugggc

SEQ ID NO: 10535 - RNA, 17 nt, Homo sapiens
ucuaauaauaugcauuu

SEQ ID NO: 10536 - RNA, 22 nt, Homo sapiens
ucugccuuuucaugugggaugg

SEQ ID NO: 10537 - RNA, 19 nt, Homo sapiens
cauugcacuccacccuggg

SEQ ID NO: 10538 - RNA, 21 nt, Homo sapiens
ucacugagcaucaugguuuca

SEQ ID NO: 10539 - RNA, 22 nt, Homo sapiens
aucaccuggaggugaucacuug

SEQ ID NO: 10540 - RNA, 22 nt, Homo sapiens
aagucaaggagagaagcuucag

SEQ ID NO: 10541 - RNA, 22 nt, Homo sapiens
uaugucuucuuuagagaaaugu

SEQ ID NO: 10542 - RNA, 22 nt, Homo sapiens
aacaccauucucuguaacaaga

SEQ ID NO: 10543 - RNA, 22 nt, Homo sapiens
uugucuccuagacgaccaggcg

SEQ ID NO: 10544 - RNA, 22 nt, Homo sapiens
ugugaacaaaauuuguugcaua

SEQ ID NO: 10545 - RNA, 22 nt, Homo sapiens
uuaaauacagcaugguguuucu

SEQ ID NO: 10546 - RNA, 22 nt, Homo sapiens
auagcagugugaaaauguacua

SEQ ID NO: 10547 - RNA, 22 nt, Homo sapiens
uauuacauccauaggcucugcu

SEQ ID NO: 10548 - RNA, 18 nt, Homo sapiens
acugcacuccaccuuggg

SEQ ID NO: 10549 - RNA, 18 nt, Homo sapiens
ugcauacuaucugauuuu

SEQ ID NO: 10550 - RNA, 22 nt, Homo sapiens
gugaaaagaugagcaccauaca

SEQ ID NO: 10551 - RNA, 22 nt, Homo sapiens
uucauggaacaaguggguucaa

SEQ ID NO: 10552 - RNA, 22 nt, Homo sapiens
uagagguauguauaguauucuu

SEQ ID NO: 10553 - RNA, 22 nt, Homo sapiens
uuauacucgucugaaugauucu

SEQ ID NO: 10554 - RNA, 22 nt, Homo sapiens
acauguaauugauuuuguguua

SEQ ID NO: 10555 - RNA, 22 nt, Homo sapiens
aacacuaucugccuuacaggga

SEQ ID NO: 10556 - RNA, 22 nt, Homo sapiens
ggcacaaugucagcucacugca

SEQ ID NO: 10557 - RNA, 22 nt, Homo sapiens
guacaugcaugcaugggugugc

SEQ ID NO: 10558 - RNA, 22 nt, Homo sapiens
aucacuguuuugaugcucggac

SEQ ID NO: 10559 - RNA, 22 nt, Homo sapiens
guacaguaguaaaagugaauga

SEQ ID NO: 10560 - RNA, 23 nt, Homo sapiens
uggguucauucuugaagucagug

SEQ ID NO: 10561 - RNA, 22 nt, Homo sapiens
augauaaguuauuagaagaaga

SEQ ID NO: 10562 - RNA, 18 nt, Homo sapiens
uagaauauaggucauucu

SEQ ID NO: 10563 - RNA, 20 nt, Homo sapiens
guucauguaauuaguucagg

SEQ ID NO: 10564 - RNA, 22 nt, Homo sapiens
ugaaagcuacaggaaaguauuu

SEQ ID NO: 10565 - RNA, 22 nt, Homo sapiens
uugcacauugcaccuuuuguau

SEQ ID NO: 10566 - RNA, 22 nt, Homo sapiens
gacauguaaggcucucucuguu

SEQ ID NO: 10567 - RNA, 22 nt, Homo sapiens
uacgccuguaauaucagcauuu

SEQ ID NO: 10568 - RNA, 18 nt, Homo sapiens
uaaauugcuucaccugag

SEQ ID NO: 10569 - RNA, 20 nt, Homo sapiens
aagugcuuccuuuuagaggg

SEQ ID NO: 10570 - RNA, 22 nt, Homo sapiens
ugagauuaaucuuuaaguaaga

SEQ ID NO: 10571 - RNA, 22 nt, Homo sapiens
ugucauucaggaaauucuaagu

SEQ ID NO: 10572 - RNA, 21 nt, Homo sapiens
guucaagugauccuccugucu

SEQ ID NO: 10573 - RNA, 22 nt, Homo sapiens
gaugaggcuagagacaugugua

SEQ ID NO: 10574 - RNA, 22 nt, Homo sapiens
cagucacagugacaggaugugg

SEQ ID NO: 10575 - RNA, 18 nt, Homo sapiens
uugaauaguguccaaucu

SEQ ID NO: 10576 - RNA, 22 nt, Homo sapiens
caauacuguguugaauaagagu

SEQ ID NO: 10577 - RNA, 22 nt, Homo sapiens
uuccaguguguucauccucaga

SEQ ID NO: 10578 - RNA, 22 nt, Homo sapiens
ucacugaaaccacugccuccug

SEQ ID NO: 10579 - RNA, 23 nt, Homo sapiens
gagaccagcuucagaaagcacga

SEQ ID NO: 10580 - RNA, 22 nt, Homo sapiens
cuaugucuuucauauuuugggg

SEQ ID NO: 10581 - RNA, 22 nt, Homo sapiens
uuugcuauagugaauagugcug

SEQ ID NO: 10582 - RNA, 20 nt, Homo sapiens
uggugguuuuaugugguuua

SEQ ID NO: 10583 - RNA, 22 nt, Homo sapiens
ugugaagaaagucauugguagc

SEQ ID NO: 10584 - RNA, 22 nt, Homo sapiens
aggcaugauuguauuuugcucu

SEQ ID NO: 10585 - RNA, 22 nt, Homo sapiens
accuggcacuuagcaaaucuga

SEQ ID NO: 10586 - RNA, 22 nt, Homo sapiens
uguagcagccauaaacacagug

SEQ ID NO: 10587 - RNA, 22 nt, Homo sapiens
uucacagagagaacucaaacca

SEQ ID NO: 10588 - RNA, 22 nt, Homo sapiens
uaugcagacauuguuccaacca

SEQ ID NO: 10589 - RNA, 22 nt, Homo sapiens
uugacuucagagcugauucaag

SEQ ID NO: 10590 - RNA, 22 nt, Homo sapiens
gugagguacgugucaagaacca

SEQ ID NO: 10591 - RNA, 22 nt, Homo sapiens
acugcacuccacccuuggcagc

SEQ ID NO: 10592 - RNA, 23 nt, Homo sapiens
augacacuccugugcgcacccug

SEQ ID NO: 10593 - RNA, 22 nt, Homo sapiens
uaugucuggaguuacugagcug

SEQ ID NO: 10594 - RNA, 22 nt, Homo sapiens
auucacuuuuauagacaggucu

SEQ ID NO: 10595 - RNA, 22 nt, Homo sapiens
uuagggaguaaucuaaaaaugg

SEQ ID NO: 10596 - RNA, 22 nt, Homo sapiens
aaagugcugggauuuuaggcau

SEQ ID NO: 10597 - RNA, 22 nt, Homo sapiens
ugucaguuucuugagauggaac

SEQ ID NO: 10598 - RNA, 22 nt, Homo sapiens
uccaguuuuguuaacauauggu

SEQ ID NO: 10599 - RNA, 22 nt, Homo sapiens
uuggcagcauuccagccaagca

SEQ ID NO: 10600 - RNA, 22 nt, Homo sapiens
guaugucuuuauagcagugugg

SEQ ID NO: 10601 - RNA, 22 nt, Homo sapiens
auaaaugccuguuguuuuaagc

SEQ ID NO: 10602 - RNA, 22 nt, Homo sapiens
uuggucucaucaagagcagcuu

SEQ ID NO: 10603 - RNA, 22 nt, Homo sapiens
gugggcucguucguguuagaca

SEQ ID NO: 10604 - RNA, 22 nt, Homo sapiens
auaugcauacauguaugcagga

SEQ ID NO: 10605 - RNA, 19 nt, Homo sapiens
acugcacuccuccuugggu

SEQ ID NO: 10606 - RNA, 22 nt, Homo sapiens
ugaaaguuauauugugaaauuc

SEQ ID NO: 10607 - RNA, 22 nt, Homo sapiens
uagagguauaccaaaaaggcau

SEQ ID NO: 10608 - RNA, 22 nt, Homo sapiens
agaacuguccauucagcaugaa

SEQ ID NO: 10609 - RNA, 22 nt, Homo sapiens
aguggaauuaagaaacugaauu

SEQ ID NO: 10610 - RNA, 22 nt, Homo sapiens
uugucauuuucagaguguuacg

SEQ ID NO: 10611 - RNA, 22 nt, Homo sapiens
ggguucaaaucuuggcucuuac

SEQ ID NO: 10612 - RNA, 22 nt, Homo sapiens
uauugcacgccagccugagcaa

SEQ ID NO: 10613 - RNA, 22 nt, Homo sapiens
acugcacuccagccuuggcaac

SEQ ID NO: 10614 - RNA, 22 nt, Homo sapiens
agucacagguucuugggauuag

SEQ ID NO: 10615 - RNA, 23 nt, Homo sapiens
uucaccguguuggccaggcuggu

SEQ ID NO: 10616 - RNA, 22 nt, Homo sapiens
aaaugcauaucaagauugcccu

SEQ ID NO: 10617 - RNA, 22 nt, Homo sapiens
ugaugucuugcaggcacgagau

SEQ ID NO: 10618 - RNA, 20 nt, Homo sapiens
cuggaugucgaggcagaggu

SEQ ID NO: 10619 - RNA, 22 nt, Homo sapiens
ucacugugugucucuguaucug

SEQ ID NO: 10620 - RNA, 22 nt, Homo sapiens
uugcacauugauuuuguauccu

SEQ ID NO: 10621 - RNA, 22 nt, Homo sapiens
uuagugaaugcaccacuucuga

SEQ ID NO: 10622 - RNA, 22 nt, Homo sapiens
uuuuggcucugucuguaucuuu

SEQ ID NO: 10623 - RNA, 22 nt, Homo sapiens
aauaauggcaccaaagcacaag

SEQ ID NO: 10624 - RNA, 22 nt, Homo sapiens
caggugcauuggcugacaccug

SEQ ID NO: 10625 - RNA, 22 nt, Homo sapiens
ggagcugugauuugaguccaga

SEQ ID NO: 10626 - RNA, 22 nt, Homo sapiens
ugaaguaauguuuuauucuauu

SEQ ID NO: 10627 - RNA, 22 nt, Homo sapiens
ucagcagugugaaaacaaacua

SEQ ID NO: 10628 - RNA, 22 nt, Homo sapiens
cccugagaaaacuuuguccuua

SEQ ID NO: 10629 - RNA, 22 nt, Homo sapiens
uucuauguuugaaaaugccaaa

SEQ ID NO: 10630 - RNA, 20 nt, Homo sapiens
auugcagcaugauuuauaau

SEQ ID NO: 10631 - RNA, 22 nt, Homo sapiens
uccugagacugaggagcuuugg

SEQ ID NO: 10632 - RNA, 22 nt, Homo sapiens
guaugucuugucuauggcugcu

SEQ ID NO: 10633 - RNA, 22 nt, Homo sapiens
gugaaagauuaaaccagugugu

SEQ ID NO: 10634 - RNA, 22 nt, Homo sapiens
cucagcuacuugggaagcugag

SEQ ID NO: 10635 - RNA, 20 nt, Homo sapiens
auuguccuugauuacacaga

SEQ ID NO: 10636 - RNA, 22 nt, Homo sapiens
ggaaauguuuagcauccacuuu

SEQ ID NO: 10637 - RNA, 22 nt, Homo sapiens
uaucacuguuguuuguuuaagg

SEQ ID NO: 10638 - RNA, 22 nt, Homo sapiens
ucacuguugaugggcaugcagg

SEQ ID NO: 10639 - RNA, 21 nt, Homo sapiens
uaacagcuccacuccauucuc

SEQ ID NO: 10640 - RNA, 22 nt, Homo sapiens
uuauuagguuagugcaaaaguu

SEQ ID NO: 10641 - RNA, 22 nt, Homo sapiens
auguagugugauuuucacuaga

SEQ ID NO: 10642 - RNA, 22 nt, Homo sapiens
caacauccaccuccuggguuca

SEQ ID NO: 10643 - RNA, 22 nt, Homo sapiens
cucauugcaaucucugccuccc

SEQ ID NO: 10644 - RNA, 18 nt, Homo sapiens
uuuggcuguucaugacuc

SEQ ID NO: 10645 - RNA, 22 nt, Homo sapiens
caugucuuuuauucugugugau

SEQ ID NO: 10646 - RNA, 22 nt, Homo sapiens
caagagaccugagugucauucu

SEQ ID NO: 10647 - RNA, 22 nt, Homo sapiens
uagacacuagauaugugacuga

SEQ ID NO: 10648 - RNA, 22 nt, Homo sapiens
augaaauugcuaucgcaguacu

SEQ ID NO: 10649 - RNA, 22 nt, Homo sapiens
gugugcucaucacaugcaauag

SEQ ID NO: 10650 - RNA, 18 nt, Homo sapiens
ucagucacugccuggcuu

SEQ ID NO: 10651 - RNA, 22 nt, Homo sapiens
ccaguguucuggaaggcugagu

SEQ ID NO: 10652 - RNA, 21 nt, Homo sapiens
ucaucagucaaagacaauggu

SEQ ID NO: 10653 - RNA, 22 nt, Homo sapiens
uugugaaugaugucgcaguaaa

SEQ ID NO: 10654 - RNA, 22 nt, Homo sapiens
acccgcccagguguggccggga

SEQ ID NO: 10655 - RNA, 23 nt, Homo sapiens
aaauuugccuauuauuccuaugg

SEQ ID NO: 10656 - RNA, 22 nt, Homo sapiens
uaagugcuguguuguuaccuaa

SEQ ID NO: 10657 - RNA, 22 nt, Homo sapiens
gaugugaaaucauaguuucuag

SEQ ID NO: 10658 - RNA, 20 nt, Homo sapiens
guucacaggcuuccuuucag

SEQ ID NO: 10659 - RNA, 22 nt, Homo sapiens
uucucaguuccuacuuugguga

SEQ ID NO: 10660 - RNA, 19 nt, Homo sapiens
uggaaugaaauguuagggg

SEQ ID NO: 10661 - RNA, 22 nt, Homo sapiens
aagugacauugugcccauuuga

SEQ ID NO: 10662 - RNA, 22 nt, Homo sapiens
auacaguugccauuucuugugc

SEQ ID NO: 10663 - RNA, 20 nt, Homo sapiens
auaugcagacacauacauac

SEQ ID NO: 10664 - RNA, 22 nt, Homo sapiens
ucagugucugugauggagaggu

SEQ ID NO: 10665 - RNA, 22 nt, Homo sapiens
cucacaugcucaccugguguuc

SEQ ID NO: 10666 - RNA, 22 nt, Homo sapiens
auggaagaaaguuggguucuug

SEQ ID NO: 10667 - RNA, 22 nt, Homo sapiens
uggacauguacauauguguaug

SEQ ID NO: 10668 - RNA, 22 nt, Homo sapiens
cuaugagucugcagaucuauua

SEQ ID NO: 10669 - RNA, 22 nt, Homo sapiens
uaagucacuccagguuaaagug

SEQ ID NO: 10670 - RNA, 22 nt, Homo sapiens
aaagugauguccaggcuuucag

SEQ ID NO: 10671 - RNA, 22 nt, Homo sapiens
gcagaauugguuucuucuaagg

SEQ ID NO: 10672 - RNA, 22 nt, Homo sapiens
uaaaugcucuuuaaaagugcuu

SEQ ID NO: 10673 - RNA, 22 nt, Homo sapiens
gucaggcaccgauacaguuuuu

SEQ ID NO: 10674 - RNA, 23 nt, Homo sapiens
ucucauuccuugaaaauaaugac

SEQ ID NO: 10675 - RNA, 22 nt, Homo sapiens
ugugccacugcacucuggccug

SEQ ID NO: 10676 - RNA, 22 nt, Homo sapiens
ucaggcaccuuccucuuaucug

SEQ ID NO: 10677 - RNA, 17 nt, Homo sapiens
augugaauguucaaaua

SEQ ID NO: 10678 - RNA, 22 nt, Homo sapiens
augacauugaugcucuggcugg

SEQ ID NO: 10679 - RNA, 22 nt, Homo sapiens
uguaacacacacuguuuacucc

SEQ ID NO: 10680 - RNA, 22 nt, Homo sapiens
ucagcagugugaaaauggacua

SEQ ID NO: 10681 - RNA, 22 nt, Homo sapiens
auagcagugugaaaacagacua

SEQ ID NO: 10682 - RNA, 22 nt, Homo sapiens
guaaucucagcuacuugggagu

SEQ ID NO: 10683 - RNA, 22 nt, Homo sapiens
augcagugugcaacagauuaag

SEQ ID NO: 10684 - RNA, 22 nt, Homo sapiens
uuguaaagaucauaugcuguuc

SEQ ID NO: 10685 - RNA, 22 nt, Homo sapiens
ccuucuuuuguaaggcugaaua

SEQ ID NO: 10686 - RNA, 23 nt, Homo sapiens
aucacuguuaacaauuucuuccu

SEQ ID NO: 10687 - RNA, 22 nt, Homo sapiens
auucccuuagcugccucagccu

SEQ ID NO: 10688 - RNA, 22 nt, Homo sapiens
cuggaguaugaaccauguauca

SEQ ID NO: 10689 - RNA, 22 nt, Homo sapiens
cauugcacuuagacaacuuuug

SEQ ID NO: 10690 - RNA, 22 nt, Homo sapiens
cccagaguucuuaaauacugag

SEQ ID NO: 10691 - RNA, 18 nt, Homo sapiens
cuggaugucgaguguguu

SEQ ID NO: 10692 - RNA, 22 nt, Homo sapiens
uugccuaggcuggauugcagug

SEQ ID NO: 10693 - RNA, 22 nt, Homo sapiens
aguccauuugaugaugauucca

SEQ ID NO: 10694 - RNA, 22 nt, Homo sapiens
cuucaaaguuggcuaggagaca

SEQ ID NO: 10695 - RNA, 22 nt, Homo sapiens
uaacauuguugauuauacuaag

SEQ ID NO: 10696 - RNA, 22 nt, Homo sapiens
ugaaucauuucuugucuucagu

SEQ ID NO: 10697 - RNA, 22 nt, Homo sapiens
uaagugaaggaaguguguuuac

SEQ ID NO: 10698 - RNA, 20 nt, Homo sapiens
aguauucacuuuuuucaugg

SEQ ID NO: 10699 - RNA, 22 nt, Homo sapiens
augagauucuuagagaagucug

SEQ ID NO: 10700 - RNA, 22 nt, Homo sapiens
uauugcacuccucaugcauuug

SEQ ID NO: 10701 - RNA, 22 nt, Homo sapiens
aaagugcuuccuuuuugagggu

SEQ ID NO: 10702 - RNA, 21 nt, Homo sapiens
aauacucuagguuaagagagc

SEQ ID NO: 10703 - RNA, 22 nt, Homo sapiens
uuauuagagauauuugguuagg

SEQ ID NO: 10704 - RNA, 22 nt, Homo sapiens
gugcaaauuccagcucaacucc

SEQ ID NO: 10705 - RNA, 22 nt, Homo sapiens
acaagacuucuuguauucuagu

SEQ ID NO: 10706 - RNA, 22 nt, Homo sapiens
aaaugccucccauucuacugac

SEQ ID NO: 10707 - RNA, 22 nt, Homo sapiens
agcagagcaguggauuuuguga

SEQ ID NO: 10708 - RNA, 22 nt, Homo sapiens
uugaauagaaguguugaaagug

SEQ ID NO: 10709 - RNA, 22 nt, Homo sapiens
cccugagaugcuguuaaucugu

SEQ ID NO: 10710 - RNA, 22 nt, Homo sapiens
uaauccuagcacuuuggaagac

SEQ ID NO: 10711 - RNA, 21 nt, Homo sapiens
gaccacagcagggaaugucag

SEQ ID NO: 10712 - RNA, 22 nt, Homo sapiens
cucaguuuugccuuguuuaagg

SEQ ID NO: 10713 - RNA, 22 nt, Homo sapiens
uaaguagaggaaucauuuugug

SEQ ID NO: 10714 - RNA, 22 nt, Homo sapiens
augugaaugugaucggauaguc

SEQ ID NO: 10715 - RNA, 22 nt, Homo sapiens
caagugcuacagagaaaucuuu

SEQ ID NO: 10716 - RNA, 22 nt, Homo sapiens
cagagguaagcaagucagcauu

SEQ ID NO: 10717 - RNA, 22 nt, Homo sapiens
ccugagacgaauggagugaaca

SEQ ID NO: 10718 - RNA, 22 nt, Homo sapiens
uuacagauggauggcagcuggc

SEQ ID NO: 10719 - RNA, 22 nt, Homo sapiens
ugucacaguuuguacuuuauag

SEQ ID NO: 10720 - RNA, 22 nt, Homo sapiens
uugcaaagaccucuucacuucc

SEQ ID NO: 10721 - RNA, 22 nt, Homo sapiens
agagugaagcuuuuuauauucu

SEQ ID NO: 10722 - RNA, 22 nt, Homo sapiens
auacuguacugaaguacccauu

SEQ ID NO: 10723 - RNA, 22 nt, Homo sapiens
aaagugcuguagacugggcgca

SEQ ID NO: 10724 - RNA, 22 nt, Homo sapiens
gauggcacuuaagagcaagagc

SEQ ID NO: 10725 - RNA, 22 nt, Homo sapiens
aagagaugaagguccugacugu

SEQ ID NO: 10726 - RNA, 22 nt, Homo sapiens
ucagacacuguggccuuuggac

SEQ ID NO: 10727 - RNA, 22 nt, Homo sapiens
uuauucauuaacagggaccaaa

SEQ ID NO: 10728 - RNA, 22 nt, Homo sapiens
cuggugauugguuucauucagu

SEQ ID NO: 10729 - RNA, 22 nt, Homo sapiens
ucucauggagucaggagcagaa

SEQ ID NO: 10730 - RNA, 22 nt, Homo sapiens
ugugccacugcacucccgccug

SEQ ID NO: 10731 - RNA, 22 nt, Homo sapiens
ugagaucacuaagagguaaugg

SEQ ID NO: 10732 - RNA, 22 nt, Homo sapiens
uucacuguuaagcaguuaaacu

SEQ ID NO: 10733 - RNA, 18 nt, Homo sapiens
auauugcauuggauggau

SEQ ID NO: 10734 - RNA, 22 nt, Homo sapiens
ucucaaccucccaaguagcugg

SEQ ID NO: 10735 - RNA, 22 nt, Homo sapiens
cuugcacucagaagauucaguu

SEQ ID NO: 10736 - RNA, 22 nt, Homo sapiens
cauugcacacauuuaccuaugu

SEQ ID NO: 10737 - RNA, 22 nt, Homo sapiens
uacaaagcuuucugcaaaucau

SEQ ID NO: 10738 - RNA, 22 nt, Homo sapiens
uuguacuuuuaguagagacggg

SEQ ID NO: 10739 - RNA, 22 nt, Homo sapiens
acugagaucuuuaaauaaauaa

SEQ ID NO: 10740 - RNA, 20 nt, Homo sapiens
uaagugcuugagacuucuga

SEQ ID NO: 10741 - RNA, 22 nt, Homo sapiens
gagaacauuuaagccacucagg

SEQ ID NO: 10742 - RNA, 22 nt, Homo sapiens
auagcagugugagaaugaacua

SEQ ID NO: 10743 - RNA, 22 nt, Homo sapiens
ugugaauguaagaaaauccaac

SEQ ID NO: 10744 - RNA, 22 nt, Homo sapiens
guguccucgaguacacaucagg

SEQ ID NO: 10745 - RNA, 23 nt, Homo sapiens
ugagauuauaaucuuuuacuucu

SEQ ID NO: 10746 - RNA, 22 nt, Homo sapiens
uugccuaggcuggaguucagug

SEQ ID NO: 10747 - RNA, 22 nt, Homo sapiens
gagacggagucucgcucugucg

SEQ ID NO: 10748 - RNA, 22 nt, Homo sapiens
gagacggagucuugcucuguug

SEQ ID NO: 10749 - RNA, 22 nt, Homo sapiens
gagcacugauuuauuuuugucu

SEQ ID NO: 10750 - RNA, 22 nt, Homo sapiens
uucacuguagccucagccucuu

SEQ ID NO: 10751 - RNA, 22 nt, Homo sapiens
uugaugauguuucugccuugcc

SEQ ID NO: 10752 - RNA, 18 nt, Homo sapiens
ucacagguaaaguugaca

SEQ ID NO: 10753 - RNA, 22 nt, Homo sapiens
cagcuaaauuguuaaauccaag

SEQ ID NO: 10754 - RNA, 22 nt, Homo sapiens
gcagagaaacaggucuaaggag

SEQ ID NO: 10755 - RNA, 22 nt, Homo sapiens
guuggcaaguggcugagcuggg

SEQ ID NO: 10756 - RNA, 22 nt, Homo sapiens
acugcacuucagccuugggaaa

SEQ ID NO: 10757 - RNA, 22 nt, Homo sapiens
guaaucucaccuacuugggagg

SEQ ID NO: 10758 - RNA, 22 nt, Homo sapiens
gagguaucauuauguugcccag

SEQ ID NO: 10759 - RNA, 22 nt, Homo sapiens
aaagugcugggauuggccgggc

SEQ ID NO: 10760 - RNA, 22 nt, Homo sapiens
auacaagugccauguuggugug

SEQ ID NO: 10761 - RNA, 22 nt, Homo sapiens
uaugucuuuugcuugcaaauag

SEQ ID NO: 10762 - RNA, 18 nt, Homo sapiens
ucacggggagcagcagcc

SEQ ID NO: 10763 - RNA, 18 nt, Homo sapiens
uugcaaauucuucccugu

SEQ ID NO: 10764 - RNA, 21 nt, Homo sapiens
ugagaugugaccagggcauca

SEQ ID NO: 10765 - RNA, 22 nt, Homo sapiens
cauugcacuccagcccagguga

SEQ ID NO: 10766 - RNA, 21 nt, Homo sapiens
uaaagcuuagcuauaguggcu

SEQ ID NO: 10767 - RNA, 20 nt, Homo sapiens
ucaaggcacgaauaaaaguu

SEQ ID NO: 10768 - RNA, 23 nt, Homo sapiens
ggaguguaaugacucgaucucgg

SEQ ID NO: 10769 - RNA, 22 nt, Homo sapiens
augucaaagaggaaaacuggau

SEQ ID NO: 10770 - RNA, 22 nt, Homo sapiens
gaauuguacugcaaucagggga

SEQ ID NO: 10771 - RNA, 21 nt, Homo sapiens
ugcauauuggaacuuucucuc

SEQ ID NO: 10772 - RNA, 19 nt, Homo sapiens
cuaaguccccuugauuaga

SEQ ID NO: 10773 - RNA, 22 nt, Homo sapiens
uccugagacucacaggcucccc

SEQ ID NO: 10774 - RNA, 22 nt, Homo sapiens
aauugcacuggaaguaacugag

SEQ ID NO: 10775 - RNA, 22 nt, Homo sapiens
aagugcuuacagggaacaugau

SEQ ID NO: 10776 - RNA, 22 nt, Homo sapiens
ucaugugaggauaacaauagug

SEQ ID NO: 10777 - RNA, 22 nt, Homo sapiens
uuucauggaggauuugcuucuu

SEQ ID NO: 10778 - RNA, 22 nt, Homo sapiens
aaagugcugggauuggcugggc

SEQ ID NO: 10779 - RNA, 19 nt, Homo sapiens
ugacaugaaacccaagauc

SEQ ID NO: 10780 - RNA, 22 nt, Homo sapiens
gugcacauauggugcauaagug

SEQ ID NO: 10781 - RNA, 22 nt, Homo sapiens
agcucuuguuaguauuagcagu

SEQ ID NO: 10782 - RNA, 22 nt, Homo sapiens
ucucaaguggucgcaguuagau

SEQ ID NO: 10783 - RNA, 22 nt, Homo sapiens
gugaggcacugcugcuuuccag

SEQ ID NO: 10784 - RNA, 22 nt, Homo sapiens
uuguaacaugcuuucacuucag

SEQ ID NO: 10785 - RNA, 22 nt, Homo sapiens
uuuuaguggacaaagguauuua

SEQ ID NO: 10786 - RNA, 22 nt, Homo sapiens
uaacauagucauauacuugcuu

SEQ ID NO: 10787 - RNA, 22 nt, Homo sapiens
gcaguggugugugccagccuag

SEQ ID NO: 10788 - RNA, 22 nt, Homo sapiens
auggaagaauugucggggaugu

SEQ ID NO: 10789 - RNA, 22 nt, Homo sapiens
acaccaugucuguuucugguuu

SEQ ID NO: 10790 - RNA, 23 nt, Homo sapiens
auaagccuuuucuuucugcccca

SEQ ID NO: 10791 - RNA, 22 nt, Homo sapiens
cugguuuguaaaguuccugaga

SEQ ID NO: 10792 - RNA, 22 nt, Homo sapiens
uaagguccuuaaauguguaacc

SEQ ID NO: 10793 - RNA, 21 nt, Homo sapiens
cauaaugcuacuuauuuuaug

SEQ ID NO: 10794 - RNA, 22 nt, Homo sapiens
gagaaugaugauuuccaauuuc

SEQ ID NO: 10795 - RNA, 22 nt, Homo sapiens
uaaucacagagguuuggccuca

SEQ ID NO: 10796 - RNA, 22 nt, Homo sapiens
uuuaucuguuuaaaacuguuca

SEQ ID NO: 10797 - RNA, 23 nt, Homo sapiens
aauugcacauuccuugcuggcag

SEQ ID NO: 10798 - RNA, 22 nt, Homo sapiens
uuuaaagcaugacgagaagaag

SEQ ID NO: 10799 - RNA, 22 nt, Homo sapiens
aaagucuguuacagcuauuucu

SEQ ID NO: 10800 - RNA, 22 nt, Homo sapiens
auccaucagacggcaggcguug

SEQ ID NO: 10801 - RNA, 22 nt, Homo sapiens
aagugcuuuuuagauaugguuu

SEQ ID NO: 10802 - RNA, 22 nt, Homo sapiens
ugccuaguagaaggugaacaug

SEQ ID NO: 10803 - RNA, 22 nt, Homo sapiens
aagagguaauaacaaagcuucu

SEQ ID NO: 10804 - RNA, 22 nt, Homo sapiens
auagcagugugaaaauugacug

SEQ ID NO: 10805 - RNA, 22 nt, Homo sapiens
cccagagacagaaugauaaacu

SEQ ID NO: 10806 - RNA, 20 nt, Homo sapiens
uggucaccuucaggagguuc

SEQ ID NO: 10807 - RNA, 22 nt, Homo sapiens
uugugaaugaugucgcaauaaa

SEQ ID NO: 10808 - RNA, 21 nt, Homo sapiens
auuguauguaaaccaaaugag

SEQ ID NO: 10809 - RNA, 20 nt, Homo sapiens
cauugcacuccagccugcug

SEQ ID NO: 10810 - RNA, 22 nt, Homo sapiens
ucaucuggcgaaugugaagagu

SEQ ID NO: 10811 - RNA, 22 nt, Homo sapiens
auuuguccugccuuuuccuccu

SEQ ID NO: 10812 - RNA, 22 nt, Homo sapiens
augcacauggcuaacuuuuuuc

SEQ ID NO: 10813 - RNA, 22 nt, Homo sapiens
aaucacacuugauguugagcaa

SEQ ID NO: 10814 - RNA, 22 nt, Homo sapiens
ugcauccauucuagacucaucu

SEQ ID NO: 10815 - RNA, 22 nt, Homo sapiens
ucacugaggucugagcuuuaug

SEQ ID NO: 10816 - RNA, 22 nt, Homo sapiens
gucuggcuuaucucacuuacca

SEQ ID NO: 10817 - RNA, 19 nt, Homo sapiens
ucauagucuaagaugagaa

SEQ ID NO: 10818 - RNA, 22 nt, Homo sapiens
uugaaagucuaggcuuacagua

SEQ ID NO: 10819 - RNA, 22 nt, Homo sapiens
agcagagcauauucauucgggg

SEQ ID NO: 10820 - RNA, 19 nt, Homo sapiens
uggcacauguauacauaug

SEQ ID NO: 10821 - RNA, 22 nt, Homo sapiens
ugaacagcacguuuauucagaa

SEQ ID NO: 10822 - RNA, 23 nt, Homo sapiens
ggcaagaucucagcucacugcaa

SEQ ID NO: 10823 - RNA, 17 nt, Homo sapiens
uucucaguucugaucuc

SEQ ID NO: 10824 - RNA, 22 nt, Homo sapiens
uugcacauggcaggugcucaau

SEQ ID NO: 10825 - RNA, 22 nt, Homo sapiens
accaguuuuuuauacaucuucu

SEQ ID NO: 10826 - RNA, 22 nt, Homo sapiens
uaucagagcugucagccuaccu

SEQ ID NO: 10827 - RNA, 22 nt, Homo sapiens
uugaaccauucuuuugauagag

SEQ ID NO: 10828 - RNA, 20 nt, Homo sapiens
cuugccuagcccuuugccuc

SEQ ID NO: 10829 - RNA, 22 nt, Homo sapiens
cauugcacugcuucuugggugu

SEQ ID NO: 10830 - RNA, 22 nt, Homo sapiens
augaccaaugggcagagcuaga

SEQ ID NO: 10831 - RNA, 22 nt, Homo sapiens
gagaacauuaauaguuaauuuu

SEQ ID NO: 10832 - RNA, 22 nt, Homo sapiens
auacuguauaggauuguagccu

SEQ ID NO: 10833 - RNA, 22 nt, Homo sapiens
uagcagguguuccacaaauauu

SEQ ID NO: 10834 - RNA, 22 nt, Homo sapiens
aauugcacuacugcacucccac

SEQ ID NO: 10835 - RNA, 22 nt, Homo sapiens
uguguaauaccuuugacuauau

SEQ ID NO: 10836 - RNA, 22 nt, Homo sapiens
uuuuuggauaaugguacaugua

SEQ ID NO: 10837 - RNA, 22 nt, Homo sapiens
caaagucuauucuacccuuacc

SEQ ID NO: 10838 - RNA, 22 nt, Homo sapiens
cauugcacuccagccugaguga

SEQ ID NO: 10839 - RNA, 22 nt, Homo sapiens
auugcacaccagucugggcaaa

SEQ ID NO: 10840 - RNA, 22 nt, Homo sapiens
uggagugcaauggcaccaucuu

SEQ ID NO: 10841 - RNA, 22 nt, Homo sapiens
ggagaauguaauugguauuuug

SEQ ID NO: 10842 - RNA, 22 nt, Homo sapiens
gagagguaguuuuuuggucguc

SEQ ID NO: 10843 - RNA, 22 nt, Homo sapiens
cagagaaugucuuuuuuaacca

SEQ ID NO: 10844 - RNA, 22 nt, Homo sapiens
gugagauaucuagacuagggaa

SEQ ID NO: 10845 - RNA, 22 nt, Homo sapiens
auaaaugcuuagaucuguauau

SEQ ID NO: 10846 - RNA, 22 nt, Homo sapiens
aagugcuucuuuccucgagaag

SEQ ID NO: 10847 - RNA, 22 nt, Homo sapiens
cagugcuuguuauuguucuauu

SEQ ID NO: 10848 - RNA, 22 nt, Homo sapiens
uuauuagguuaaccuauagcua

SEQ ID NO: 10849 - RNA, 22 nt, Homo sapiens
uccuucaguccaguggguuuug

SEQ ID NO: 10850 - RNA, 22 nt, Homo sapiens
uggcaccauccaggugucucua

SEQ ID NO: 10851 - RNA, 22 nt, Homo sapiens
aaagugcugagacagacuggga

SEQ ID NO: 10852 - RNA, 22 nt, Homo sapiens
acugcacucuagccuuggcaac

SEQ ID NO: 10853 - RNA, 22 nt, Homo sapiens
aaagugcugagucuaggcgggg

SEQ ID NO: 10854 - RNA, 22 nt, Homo sapiens
guguauauccuauuaguucugu

SEQ ID NO: 10855 - RNA, 22 nt, Homo sapiens
gcacauauguaaauagcugccu

SEQ ID NO: 10856 - RNA, 22 nt, Homo sapiens
uauugcacuuuuccauaggagu

SEQ ID NO: 10857 - RNA, 22 nt, Homo sapiens
uaucaagaugacaaacuuugcu

SEQ ID NO: 10858 - RNA, 22 nt, Homo sapiens
ucuggagugugaaguggauaug

SEQ ID NO: 10859 - RNA, 22 nt, Homo sapiens
aagugcucuugaaacugccuua

SEQ ID NO: 10860 - RNA, 22 nt, Homo sapiens
caagugcucuaggauccugagu

SEQ ID NO: 10861 - RNA, 22 nt, Homo sapiens
cugaaagagcauguaacacagu

SEQ ID NO: 10862 - RNA, 22 nt, Homo sapiens
uuuugcaccauccuaauaguau

SEQ ID NO: 10863 - RNA, 22 nt, Homo sapiens
cuucaugucuucaauggggggg

SEQ ID NO: 10864 - RNA, 22 nt, Homo sapiens
auugcacacagaaucaggguaa

SEQ ID NO: 10865 - RNA, 22 nt, Homo sapiens
ggcagcauugccuuugcaguga

SEQ ID NO: 10866 - RNA, 22 nt, Homo sapiens
ucacugcgaccucugccucccg

SEQ ID NO: 10867 - RNA, 21 nt, Homo sapiens
caugucacugcacucuagccu

SEQ ID NO: 10868 - RNA, 22 nt, Homo sapiens
cauugcacuccagccuggccaa

SEQ ID NO: 10869 - RNA, 22 nt, Homo sapiens
aaaagucuguagugaaagguga

SEQ ID NO: 10870 - RNA, 22 nt, Homo sapiens
uuccuggagaguuuucccaaag

SEQ ID NO: 10871 - RNA, 22 nt, Homo sapiens
uugugaaaaaccucucguggaa

SEQ ID NO: 10872 - RNA, 22 nt, Homo sapiens
uucuggaaaucagcagagggug

SEQ ID NO: 10873 - RNA, 22 nt, Homo sapiens
cauugcacuccagccugccugg

SEQ ID NO: 10874 - RNA, 22 nt, Homo sapiens
ugacauuacagucacuugcugu

SEQ ID NO: 10875 - RNA, 22 nt, Homo sapiens
ugaggaacuagcuacccuaaua

SEQ ID NO: 10876 - RNA, 22 nt, Homo sapiens
ugaugacauugucacagucuga

SEQ ID NO: 10877 - RNA, 22 nt, Homo sapiens
gagagugcuuggcaucugcuga

SEQ ID NO: 10878 - RNA, 22 nt, Homo sapiens
acaguaaugggccccuuuuccu

SEQ ID NO: 10879 - RNA, 22 nt, Homo sapiens
gugccuuuucugagcaaugagc

SEQ ID NO: 10880 - RNA, 22 nt, Homo sapiens
ucuuuggucuacuuucauaugu

SEQ ID NO: 10881 - RNA, 16 nt, Homo sapiens
uuauugcauucuucuc

SEQ ID NO: 10882 - RNA, 22 nt, Homo sapiens
uucucuguggauugggugagag

SEQ ID NO: 10883 - RNA, 22 nt, Homo sapiens
augggaaaaucagaaggccugg

SEQ ID NO: 10884 - RNA, 22 nt, Homo sapiens
uaaagcuuagauccaugguggc

SEQ ID NO: 10885 - RNA, 22 nt, Homo sapiens
aaagugcugggaucacacugaa

SEQ ID NO: 10886 - RNA, 20 nt, Homo sapiens
uucaucaggauauuggucua

SEQ ID NO: 10887 - RNA, 22 nt, Homo sapiens
ugcgccauugcauuccagccug

SEQ ID NO: 10888 - RNA, 22 nt, Homo sapiens
uauacugucuuuguaugccuag

SEQ ID NO: 10889 - RNA, 19 nt, Homo sapiens
uuucaauguaaggauggag

SEQ ID NO: 10890 - RNA, 22 nt, Homo sapiens
auaugucuauuauuagggcagg

SEQ ID NO: 10891 - RNA, 22 nt, Homo sapiens
aagaguuaguaaaauuuccucu

SEQ ID NO: 10892 - RNA, 23 nt, Homo sapiens
cuuuguccccacccaaaucucau

SEQ ID NO: 10893 - RNA, 20 nt, Homo sapiens
guccauuugcugccauugcu

SEQ ID NO: 10894 - RNA, 22 nt, Homo sapiens
uuccaguuauuauaccucuuaa

SEQ ID NO: 10895 - RNA, 22 nt, Homo sapiens
acugcacuccagccuuggcggc

SEQ ID NO: 10896 - RNA, 22 nt, Homo sapiens
uuauuagguugguggaaaagua

SEQ ID NO: 10897 - RNA, 22 nt, Homo sapiens
ucauggcauuguuaaggguuuu

SEQ ID NO: 10898 - RNA, 20 nt, Homo sapiens
ugacaagugagaauuauggg

SEQ ID NO: 10899 - RNA, 22 nt, Homo sapiens
uugaaagaaaggagacugaguu

SEQ ID NO: 10900 - RNA, 22 nt, Homo sapiens
ggagaugauuaugaaucacuua

SEQ ID NO: 10901 - RNA, 20 nt, Homo sapiens
uuccagcacauuagggaagc

SEQ ID NO: 10902 - RNA, 22 nt, Homo sapiens
uaucacagaggguauccuagag

SEQ ID NO: 10903 - RNA, 22 nt, Homo sapiens
uuuguccccgcccagaucucau

SEQ ID NO: 10904 - RNA, 22 nt, Homo sapiens
uacagucacauuccugaccaua

SEQ ID NO: 10905 - RNA, 22 nt, Homo sapiens
ggaucacuugagaccaggaguu

SEQ ID NO: 10906 - RNA, 22 nt, Homo sapiens
ucuuuuggguauggagccauca

SEQ ID NO: 10907 - RNA, 22 nt, Homo sapiens
cauugcacuccagcuugggcga

SEQ ID NO: 10908 - RNA, 23 nt, Homo sapiens
uaagucacacagauuaauuuauu

SEQ ID NO: 10909 - RNA, 22 nt, Homo sapiens
uaagugaauauggacaguuagc

SEQ ID NO: 10910 - RNA, 22 nt, Homo sapiens
augauguaggccauggguuucu

SEQ ID NO: 10911 - RNA, 22 nt, Homo sapiens
acugcacuccagccuuggccac

SEQ ID NO: 10912 - RNA, 22 nt, Homo sapiens
ugucacccuuuauccauuuccu

SEQ ID NO: 10913 - RNA, 22 nt, Homo sapiens
uauuccacaauaugauuuuuaa

SEQ ID NO: 10914 - RNA, 22 nt, Homo sapiens
gccugagaggauaugauccccu

SEQ ID NO: 10915 - RNA, 22 nt, Homo sapiens
guucaaguuuucucuugugggu

SEQ ID NO: 10916 - RNA, 21 nt, Homo sapiens
uuggggaauggagagguuuuc

SEQ ID NO: 10917 - RNA, 22 nt, Homo sapiens
auucaaagugcauguucccacu

SEQ ID NO: 10918 - RNA, 23 nt, Homo sapiens
aggaauggaaaaccaaguaucau

SEQ ID NO: 10919 - RNA, 22 nt, Homo sapiens
caugacacuggcauguuucuuu

SEQ ID NO: 10920 - RNA, 22 nt, Homo sapiens
ucugacacagugauuaguaaau

SEQ ID NO: 10921 - RNA, 22 nt, Homo sapiens
uugauauguuguuagauucagu

SEQ ID NO: 10922 - RNA, 22 nt, Homo sapiens
cauugcacuccaccuuggguaa

SEQ ID NO: 10923 - RNA, 22 nt, Homo sapiens
ugagaugugaagaucacaugaa

SEQ ID NO: 10924 - RNA, 18 nt, Homo sapiens
auugcacaccagccuggg

SEQ ID NO: 10925 - RNA, 22 nt, Homo sapiens
cauacagcuaguaaguguaaga

SEQ ID NO: 10926 - RNA, 22 nt, Homo sapiens
ucuaauguaaccugcaaauauu

SEQ ID NO: 10927 - RNA, 22 nt, Homo sapiens
agaaacauucucuugccuccuu

SEQ ID NO: 10928 - RNA, 22 nt, Homo sapiens
cuugcacuccacuguucuccug

SEQ ID NO: 10929 - RNA, 22 nt, Homo sapiens
aagugcuuuguacagggguuga

SEQ ID NO: 10930 - RNA, 22 nt, Homo sapiens
uucauagucuaugcaaguaaga

SEQ ID NO: 10931 - RNA, 22 nt, Homo sapiens
aaagugcuucucuuuggugggu

SEQ ID NO: 10932 - RNA, 22 nt, Homo sapiens
caggugcuuacuuaauagccau

SEQ ID NO: 10933 - RNA, 22 nt, Homo sapiens
ugggagacuacauuuuuaacaa

SEQ ID NO: 10934 - RNA, 21 nt, Homo sapiens
auugcacaauauacccaugua

SEQ ID NO: 10935 - RNA, 22 nt, Homo sapiens
uauugauuaauugugauuaggc

SEQ ID NO: 10936 - RNA, 22 nt, Homo sapiens
auugucacccgggcaguaagca

SEQ ID NO: 10937 - RNA, 22 nt, Homo sapiens
gugcacauuguuuaugucuguu

SEQ ID NO: 10938 - RNA, 22 nt, Homo sapiens
auaagugagugauucaguguua

SEQ ID NO: 10939 - RNA, 22 nt, Homo sapiens
uaugacauaguccuuaacccuc

SEQ ID NO: 10940 - RNA, 22 nt, Homo sapiens
cagagguauugcaaaagccuag

SEQ ID NO: 10941 - RNA, 22 nt, Homo sapiens
agacacugaaauguauugaaga

SEQ ID NO: 10942 - RNA, 22 nt, Homo sapiens
aaauugcuuuugaagacuuagu

SEQ ID NO: 10943 - RNA, 22 nt, Homo sapiens
cugagauggagucucgcauugu

SEQ ID NO: 10944 - RNA, 22 nt, Homo sapiens
auggcuauuccauaggcagagc

SEQ ID NO: 10945 - RNA, 22 nt, Homo sapiens
uugcaaugugaugugauuugga

SEQ ID NO: 10946 - RNA, 22 nt, Homo sapiens
uggucuucuggccuccagaacc

SEQ ID NO: 10947 - RNA, 22 nt, Homo sapiens
aauaaagcagcuuuuugggacu

SEQ ID NO: 10948 - RNA, 19 nt, Homo sapiens
uccaccgcgugcaccucua

SEQ ID NO: 10949 - RNA, 22 nt, Homo sapiens
uugagcccuggagguggaggcu

SEQ ID NO: 10950 - RNA, 18 nt, Homo sapiens
guaaauguaucuauugcc

SEQ ID NO: 10951 - RNA, 22 nt, Homo sapiens
guggaaaaguaguugcgguuuu

SEQ ID NO: 10952 - RNA, 22 nt, Homo sapiens
uuaaucaggccguuuccuaaga

SEQ ID NO: 10953 - RNA, 22 nt, Homo sapiens
caagugaauaguugcucucaga

SEQ ID NO: 10954 - RNA, 22 nt, Homo sapiens
guggaauggaaugauuguguau

SEQ ID NO: 10955 - RNA, 22 nt, Homo sapiens
gagauauuauuucccuuucaca

SEQ ID NO: 10956 - RNA, 22 nt, Homo sapiens
gcagucacagggagauggugac

SEQ ID NO: 10957 - RNA, 22 nt, Homo sapiens
guggaaugauaucucauugugg

SEQ ID NO: 10958 - RNA, 22 nt, Homo sapiens
cccugagaugugaauuucagag

SEQ ID NO: 10959 - RNA, 22 nt, Homo sapiens
auuacaugucuauccaugaaca

SEQ ID NO: 10960 - RNA, 22 nt, Homo sapiens
ugaaacauacacucugaugggg

SEQ ID NO: 10961 - RNA, 22 nt, Homo sapiens
caaaagugauugcgguuuuugc

SEQ ID NO: 10962 - RNA, 22 nt, Homo sapiens
uggucaccuucuugcucugucu

SEQ ID NO: 10963 - RNA, 22 nt, Homo sapiens
ugaauguaagaugucugcuggu

SEQ ID NO: 10964 - RNA, 20 nt, Homo sapiens
augaagugaaguuagggaac

SEQ ID NO: 10965 - RNA, 22 nt, Homo sapiens
acauaguagacacugaaaauau

SEQ ID NO: 10966 - RNA, 22 nt, Homo sapiens
uugaauagaagguuuuuuguuc

SEQ ID NO: 10967 - RNA, 22 nt, Homo sapiens
cucucaagaugcugggauuaca

SEQ ID NO: 10968 - RNA, 22 nt, Homo sapiens
cacagaauucauuggauuaccu

SEQ ID NO: 10969 - RNA, 17 nt, Homo sapiens
uuucagaguggaagugu

SEQ ID NO: 10970 - RNA, 22 nt, Homo sapiens
gcaaagaaugcagauuugccuc

SEQ ID NO: 10971 - RNA, 21 nt, Homo sapiens
uaucacaguagaauaggaucu

SEQ ID NO: 10972 - RNA, 22 nt, Homo sapiens
ggaaucugaaccaugggaaugg

SEQ ID NO: 10973 - RNA, 22 nt, Homo sapiens
ucuagccuaugaagcuugucca

SEQ ID NO: 10974 - RNA, 22 nt, Homo sapiens
agaucauaugcaguaaugaacu

SEQ ID NO: 10975 - RNA, 22 nt, Homo sapiens
cauugcacuccagccuggcaac

SEQ ID NO: 10976 - RNA, 22 nt, Homo sapiens
uuaucauagugcaguuuucuga

SEQ ID NO: 10977 - RNA, 19 nt, Homo sapiens
uuuugcucuuuauaccuau

SEQ ID NO: 10978 - RNA, 22 nt, Homo sapiens
aggugaaugcucacauucuaau

SEQ ID NO: 10979 - RNA, 22 nt, Homo sapiens
uggauaguaauaaacauauagg

SEQ ID NO: 10980 - RNA, 22 nt, Homo sapiens
uucaagaauuaaaguggcuuuu

SEQ ID NO: 10981 - RNA, 22 nt, Homo sapiens
auuguaauuuuagagaaagugg

SEQ ID NO: 10982 - RNA, 22 nt, Homo sapiens
gucacauugaugcccauggugg

SEQ ID NO: 10983 - RNA, 22 nt, Homo sapiens
uugaguuugaguauucuaaagc

SEQ ID NO: 10984 - RNA, 22 nt, Homo sapiens
ugccuaguggaaggagagcaaa

SEQ ID NO: 10985 - RNA, 22 nt, Homo sapiens
auuaagugcuugccagugcugg

SEQ ID NO: 10986 - RNA, 22 nt, Homo sapiens
uacuguacugcaguucugcaaa

SEQ ID NO: 10987 - RNA, 22 nt, Homo sapiens
aagugcuuaggauagugugugg

SEQ ID NO: 10988 - RNA, 22 nt, Homo sapiens
acccugugaauauuuaaacuuc

SEQ ID NO: 10989 - RNA, 22 nt, Homo sapiens
cucaaguacaugggauuacagg

SEQ ID NO: 10990 - RNA, 22 nt, Homo sapiens
ugagauguggcuagagagguug

SEQ ID NO: 10991 - RNA, 22 nt, Homo sapiens
aucaaaguuucccagaaguugu

SEQ ID NO: 10992 - RNA, 22 nt, Homo sapiens
uccugagaauagaguugcaugu

SEQ ID NO: 10993 - RNA, 22 nt, Homo sapiens
aauaaagcauggcuacuccaua

SEQ ID NO: 10994 - RNA, 22 nt, Homo sapiens
gugugauuguuaauuuuaggug

SEQ ID NO: 10995 - RNA, 22 nt, Homo sapiens
ucauucauucauccagcuugag

SEQ ID NO: 10996 - RNA, 22 nt, Homo sapiens
aaagugcugagauuguaggcau

SEQ ID NO: 10997 - RNA, 22 nt, Homo sapiens
ugcaugaugcugagauuuggga

SEQ ID NO: 10998 - RNA, 21 nt, Homo sapiens
caauggcacaaucucugcuca

SEQ ID NO: 10999 - RNA, 22 nt, Homo sapiens
uucucaauggcaacuuguugcu

SEQ ID NO: 11000 - RNA, 20 nt, Homo sapiens
uauucacucuccagucuugc

SEQ ID NO: 11001 - RNA, 22 nt, Homo sapiens
ucucuguuugucuguuacuggu

SEQ ID NO: 11002 - RNA, 22 nt, Homo sapiens
auuauugcucccaauuuuucac

SEQ ID NO: 11003 - RNA, 22 nt, Homo sapiens
cugugcuugagagaugacacag

SEQ ID NO: 11004 - RNA, 22 nt, Homo sapiens
auggcuuuuuaaaucauguugu

SEQ ID NO: 11005 - RNA, 22 nt, Homo sapiens
gugccacugcaccuggccuaag

SEQ ID NO: 11006 - RNA, 22 nt, Homo sapiens
uucauguaauauuucacagcuu

SEQ ID NO: 11007 - RNA, 22 nt, Homo sapiens
auaacucuguuuuuuucaugca

SEQ ID NO: 11008 - RNA, 22 nt, Homo sapiens
acagaacugggcuugcuuuugg

SEQ ID NO: 11009 - RNA, 22 nt, Homo sapiens
uugccuaggcuggagugcagua

SEQ ID NO: 11010 - RNA, 22 nt, Homo sapiens
cauugcacuccagucugggcaa

SEQ ID NO: 11011 - RNA, 22 nt, Homo sapiens
aagggaaugugguagcugguuu

SEQ ID NO: 11012 - RNA, 22 nt, Homo sapiens
ugagauuguaucugcaaugugu

SEQ ID NO: 11013 - RNA, 22 nt, Homo sapiens
aauugcacuaagcauaguccag

SEQ ID NO: 11014 - RNA, 22 nt, Homo sapiens
ugaguucuuuguagauucugug

SEQ ID NO: 11015 - RNA, 22 nt, Homo sapiens
aguaacaggauccaaagaaugu

SEQ ID NO: 11016 - RNA, 22 nt, Homo sapiens
ccugagaucauacuguuaguaa

SEQ ID NO: 11017 - RNA, 22 nt, Homo sapiens
aagagguagucugucccuuagc

SEQ ID NO: 11018 - RNA, 22 nt, Homo sapiens
uugcacauugauuuuguaucuu

SEQ ID NO: 11019 - RNA, 22 nt, Homo sapiens
cagugcuuuaucaaguccucca

SEQ ID NO: 11020 - RNA, 22 nt, Homo sapiens
ugaagugaagacucacagaagg

SEQ ID NO: 11021 - RNA, 22 nt, Homo sapiens
uucaguccauuuccuuggucac

SEQ ID NO: 11022 - RNA, 23 nt, Homo sapiens
uggcaagaauucuuaccgugugg

SEQ ID NO: 11023 - RNA, 20 nt, Homo sapiens
gugagguagaggguuaccug

SEQ ID NO: 11024 - RNA, 22 nt, Homo sapiens
uggcaaaaaucacaaguaccuu

SEQ ID NO: 11025 - RNA, 22 nt, Homo sapiens
aacugguauuucccaugaauuu

SEQ ID NO: 11026 - RNA, 19 nt, Homo sapiens
gacuccagaguugugugcu

SEQ ID NO: 11027 - RNA, 22 nt, Homo sapiens
ccaggguuccacgccuggcugu

SEQ ID NO: 11028 - RNA, 22 nt, Homo sapiens
ugucaugaacucacauucuggg

SEQ ID NO: 11029 - RNA, 22 nt, Homo sapiens
uuaaaagcuaucuccaagguca

SEQ ID NO: 11030 - RNA, 22 nt, Homo sapiens
ugugcucaucucagucaacugu

SEQ ID NO: 11031 - RNA, 22 nt, Homo sapiens
uugugaaaucuaggcagagguu

SEQ ID NO: 11032 - RNA, 22 nt, Homo sapiens
uuguaaacaucuguacauugcu

SEQ ID NO: 11033 - RNA, 22 nt, Homo sapiens
aucccagaaacucggguuucuc

SEQ ID NO: 11034 - RNA, 22 nt, Homo sapiens
uugaaauguuuagaaguuugga

SEQ ID NO: 11035 - RNA, 21 nt, Homo sapiens
uuacaauggcuccuugaaggu

SEQ ID NO: 11036 - RNA, 22 nt, Homo sapiens
augagguaguagaaagucaggu

SEQ ID NO: 11037 - RNA, 22 nt, Homo sapiens
aaguggaauguuuguggcacaa

SEQ ID NO: 11038 - RNA, 22 nt, Homo sapiens
uuuuggcuagaaauauaccucc

SEQ ID NO: 11039 - RNA, 18 nt, Homo sapiens
uguugguguucacucacu

SEQ ID NO: 11040 - RNA, 22 nt, Homo sapiens
uagcaguauggagcgaggccca

SEQ ID NO: 11041 - RNA, 22 nt, Homo sapiens
auaugcauguacccacacaggc

SEQ ID NO: 11042 - RNA, 22 nt, Homo sapiens
gugcaaugagaaggggcucugg

SEQ ID NO: 11043 - RNA, 22 nt, Homo sapiens
ggcaagaucuuggcucacugaa

SEQ ID NO: 11044 - RNA, 22 nt, Homo sapiens
ucagacacugcccuccaccugu

SEQ ID NO: 11045 - RNA, 22 nt, Homo sapiens
uugcacauguugaaccagcaaa

SEQ ID NO: 11046 - RNA, 20 nt, Homo sapiens
aagacacuguccccacugga

SEQ ID NO: 11047 - RNA, 22 nt, Homo sapiens
auugcaaagcguagacucuaaa

SEQ ID NO: 11048 - RNA, 22 nt, Homo sapiens
ugugcauaugucuuuauaguag

SEQ ID NO: 11049 - RNA, 22 nt, Homo sapiens
caugucuuuuaaacauucaacu

SEQ ID NO: 11050 - RNA, 22 nt, Homo sapiens
uuaugucuuugagcaaugcugu

SEQ ID NO: 11051 - RNA, 22 nt, Homo sapiens
uucugaguggcuuucaacacug

SEQ ID NO: 11052 - RNA, 22 nt, Homo sapiens
aaucacauugaaucugcuaccu

SEQ ID NO: 11053 - RNA, 22 nt, Homo sapiens
uggagucuugaugauuuucaaa

SEQ ID NO: 11054 - RNA, 22 nt, Homo sapiens
gaaaacugcuucucuggguuuc

SEQ ID NO: 11055 - RNA, 22 nt, Homo sapiens
uucuggccccucccaaucucau

SEQ ID NO: 11056 - RNA, 22 nt, Homo sapiens
auggccgggugcgguggcucac

SEQ ID NO: 11057 - RNA, 22 nt, Homo sapiens
uuucagagucaucugcccaagu

SEQ ID NO: 11058 - RNA, 20 nt, Homo sapiens
uaagugcuugaugaaugaac

SEQ ID NO: 11059 - RNA, 22 nt, Homo sapiens
aguauugcuaauaagagauuug

SEQ ID NO: 11060 - RNA, 22 nt, Homo sapiens
aaguagcuggaugcaguggcac

SEQ ID NO: 11061 - RNA, 16 nt, Homo sapiens
uguauugcuaaaaaga

SEQ ID NO: 11062 - RNA, 22 nt, Homo sapiens
uugaaagacagaggggcaaguu

SEQ ID NO: 11063 - RNA, 22 nt, Homo sapiens
uugaggaaugugauuucaaaua

SEQ ID NO: 11064 - RNA, 22 nt, Homo sapiens
cuccuguagccccaucaucuuu

SEQ ID NO: 11065 - RNA, 22 nt, Homo sapiens
augaguaugagaauacauuaag

SEQ ID NO: 11066 - RNA, 22 nt, Homo sapiens
cuuuuggcuuagaauugucuug

SEQ ID NO: 11067 - RNA, 22 nt, Homo sapiens
uugagauuuuccucaaauauuu

SEQ ID NO: 11068 - RNA, 22 nt, Homo sapiens
cuggauauguugcaacauuucc

SEQ ID NO: 11069 - RNA, 18 nt, Homo sapiens
uuugguccuuuauaaaca

SEQ ID NO: 11070 - RNA, 22 nt, Homo sapiens
cucaaguaauccucccgccuug

SEQ ID NO: 11071 - RNA, 22 nt, Homo sapiens
aguagcaauggcucugagcuau

SEQ ID NO: 11072 - RNA, 18 nt, Homo sapiens
ccuuaguuauagagaguc

SEQ ID NO: 11073 - RNA, 22 nt, Homo sapiens
uaugucaugggguuuuugagau

SEQ ID NO: 11074 - RNA, 22 nt, Homo sapiens
gagauacuugguuucuguuucu

SEQ ID NO: 11075 - RNA, 22 nt, Homo sapiens
guauggaagucaguuuguuggc

SEQ ID NO: 11076 - RNA, 22 nt, Homo sapiens
uuugaauggaaguuuugugaaa

SEQ ID NO: 11077 - RNA, 22 nt, Homo sapiens
cuccauuuggaacagauguccu

SEQ ID NO: 11078 - RNA, 22 nt, Homo sapiens
gagacugagucuugcucuguca

SEQ ID NO: 11079 - RNA, 22 nt, Homo sapiens
auaucugcauugccauuuaugu

SEQ ID NO: 11080 - RNA, 22 nt, Homo sapiens
ucuucaugcuugaaauaauagc

SEQ ID NO: 11081 - RNA, 22 nt, Homo sapiens
agccauacaacguaugcaugua

SEQ ID NO: 11082 - RNA, 22 nt, Homo sapiens
agcaguguggccuuagacccgg

SEQ ID NO: 11083 - RNA, 22 nt, Homo sapiens
auggaagacuccucuuugggua

SEQ ID NO: 11084 - RNA, 22 nt, Homo sapiens
ucacuguguauguauaugcagg

SEQ ID NO: 11085 - RNA, 22 nt, Homo sapiens
ugugauaguuggcuaaagcagu

SEQ ID NO: 11086 - RNA, 22 nt, Homo sapiens
uuggaagagaagggagauaaac

SEQ ID NO: 11087 - RNA, 18 nt, Homo sapiens
ugugacauugagcauguc

SEQ ID NO: 11088 - RNA, 23 nt, Homo sapiens
ugagauuacccagaaagaguaua

SEQ ID NO: 11089 - RNA, 22 nt, Homo sapiens
uuaugcagcaaagugcuugaaa

SEQ ID NO: 11090 - RNA, 22 nt, Homo sapiens
ucugagaucaugucugugcugu

SEQ ID NO: 11091 - RNA, 20 nt, Homo sapiens
uaagugcauaggauauuucu

SEQ ID NO: 11092 - RNA, 22 nt, Homo sapiens
caaaagugguucuuauccuuuu

SEQ ID NO: 11093 - RNA, 19 nt, Homo sapiens
cauggcuuauaauuuuaau

SEQ ID NO: 11094 - RNA, 22 nt, Homo sapiens
ugacaugaugagcaauaauggc

SEQ ID NO: 11095 - RNA, 22 nt, Homo sapiens
aaaugcuuucuuggaccauuug

SEQ ID NO: 11096 - RNA, 18 nt, Homo sapiens
ccauucaacagauuuguc

SEQ ID NO: 11097 - RNA, 21 nt, Homo sapiens
aggauaguagauuaaauauuu

SEQ ID NO: 11098 - RNA, 22 nt, Homo sapiens
ugaugguuuuaaaaagaggagu

SEQ ID NO: 11099 - RNA, 19 nt, Homo sapiens
cuauugcacauagcugaag

SEQ ID NO: 11100 - RNA, 22 nt, Homo sapiens
auuuggguaaugagugcaaggg

SEQ ID NO: 11101 - RNA, 22 nt, Homo sapiens
cauugcacuccagccugaggga

SEQ ID NO: 11102 - RNA, 22 nt, Homo sapiens
ucacugagaaugauguuucuga

SEQ ID NO: 11103 - RNA, 22 nt, Homo sapiens
guaaucucagcuacucgggagg

SEQ ID NO: 11104 - RNA, 22 nt, Homo sapiens
uugugaauggaguagcaggauc

SEQ ID NO: 11105 - RNA, 22 nt, Homo sapiens
cuuucucagugagacccgagau

SEQ ID NO: 11106 - RNA, 22 nt, Homo sapiens
uaacaggcaaggucacaccuug

SEQ ID NO: 11107 - RNA, 22 nt, Homo sapiens
uagcaguauacguacugggucc

SEQ ID NO: 11108 - RNA, 22 nt, Homo sapiens
acugcacuccagccucggcaau

SEQ ID NO: 11109 - RNA, 22 nt, Homo sapiens
uuggccagugucuuuuuuuccu

SEQ ID NO: 11110 - RNA, 22 nt, Homo sapiens
uaggaaguuucuugauuacuua

SEQ ID NO: 11111 - RNA, 22 nt, Homo sapiens
ucaucagugcuugcaaauuauu

SEQ ID NO: 11112 - RNA, 22 nt, Homo sapiens
cacugcacuccagucccgucuc

SEQ ID NO: 11113 - RNA, 22 nt, Homo sapiens
auacaagcaguccaacuccaua

SEQ ID NO: 11114 - RNA, 22 nt, Homo sapiens
uuuuuggaggagguuagaucau

SEQ ID NO: 11115 - RNA, 18 nt, Homo sapiens
ucacaaccacagugcugu

SEQ ID NO: 11116 - RNA, 22 nt, Homo sapiens
ugagacggagucuugcucuguc

SEQ ID NO: 11117 - RNA, 22 nt, Homo sapiens
uagagguagagugacuucccca

SEQ ID NO: 11118 - RNA, 22 nt, Homo sapiens
uugagacggaguuuugcucuug

SEQ ID NO: 11119 - RNA, 22 nt, Homo sapiens
uuuguauguuggagauuggaga

SEQ ID NO: 11120 - RNA, 22 nt, Homo sapiens
gucuggcacagggaaaguacaa

SEQ ID NO: 11121 - RNA, 17 nt, Homo sapiens
aaggugcuucgaccucc

SEQ ID NO: 11122 - RNA, 22 nt, Homo sapiens
aauggcaagagccacagaggcg

SEQ ID NO: 11123 - RNA, 22 nt, Homo sapiens
auuacauagucaaggugucuca

SEQ ID NO: 11124 - RNA, 22 nt, Homo sapiens
gggaucaacuuauacuaaaauu

SEQ ID NO: 11125 - RNA, 22 nt, Homo sapiens
ucaagcaauucugcugccucag

SEQ ID NO: 11126 - RNA, 22 nt, Homo sapiens
cugucucagccucuccaguagc

SEQ ID NO: 11127 - RNA, 22 nt, Homo sapiens
uaagugaauuucacuacugagu

SEQ ID NO: 11128 - RNA, 21 nt, Homo sapiens
uggaauuaauggagagguguu

SEQ ID NO: 11129 - RNA, 23 nt, Homo sapiens
ggaguguauuggcacgaucucag

SEQ ID NO: 11130 - RNA, 22 nt, Homo sapiens
ugugccacuccagcucuagcuu

SEQ ID NO: 11131 - RNA, 22 nt, Homo sapiens
agaaccaaucccacauggauac

SEQ ID NO: 11132 - RNA, 21 nt, Homo sapiens
ugaaaugcaugugcacauuaa

SEQ ID NO: 11133 - RNA, 22 nt, Homo sapiens
uggcaaaucagaggcauggaca

SEQ ID NO: 11134 - RNA, 22 nt, Homo sapiens
gaggugaaggucucaauaaaua

SEQ ID NO: 11135 - RNA, 22 nt, Homo sapiens
agcgccacugcacuccagccug

SEQ ID NO: 11136 - RNA, 23 nt, Homo sapiens
ugagaugucugauugcgaggguc

SEQ ID NO: 11137 - RNA, 22 nt, Homo sapiens
aacagugcuguuauaaauguac

SEQ ID NO: 11138 - RNA, 22 nt, Homo sapiens
auaugucuuaguuaccuugggc

SEQ ID NO: 11139 - RNA, 22 nt, Homo sapiens
agaauguaaacagaauagagga

SEQ ID NO: 11140 - RNA, 22 nt, Homo sapiens
ugcauauucgaguuauuuuggg

SEQ ID NO: 11141 - RNA, 22 nt, Homo sapiens
uggaagccuagauucuuuucuu

SEQ ID NO: 11142 - RNA, 22 nt, Homo sapiens
ugaaauuguuugcaaggauagg

SEQ ID NO: 11143 - RNA, 22 nt, Homo sapiens
guauggguuuuguuucuucugg

SEQ ID NO: 11144 - RNA, 22 nt, Homo sapiens
uucuauggucacagaugcuuga

SEQ ID NO: 11145 - RNA, 19 nt, Homo sapiens
uaugcuauuuauuagaagu

SEQ ID NO: 11146 - RNA, 22 nt, Homo sapiens
agcaguacauaaaaagcauccu

SEQ ID NO: 11147 - RNA, 22 nt, Homo sapiens
uacaaagugggaaacgaagguu

SEQ ID NO: 11148 - RNA, 22 nt, Homo sapiens
aucuggguccguucugcuucuc

SEQ ID NO: 11149 - RNA, 22 nt, Homo sapiens
caucagagugagauauaagauc

SEQ ID NO: 11150 - RNA, 22 nt, Homo sapiens
guggaaaauuauugcuguuuuu

SEQ ID NO: 11151 - RNA, 22 nt, Homo sapiens
caagugcuugaugaaugaucaa

SEQ ID NO: 11152 - RNA, 22 nt, Homo sapiens
uuauugcacuccagccugggua

SEQ ID NO: 11153 - RNA, 22 nt, Homo sapiens
uggaauuaauuaaaauauacug

SEQ ID NO: 11154 - RNA, 22 nt, Homo sapiens
cauugcacuccagcccuggcaa

SEQ ID NO: 11155 - RNA, 22 nt, Homo sapiens
uuugguaguuuguugggaccca

SEQ ID NO: 11156 - RNA, 22 nt, Homo sapiens
cugccacugacaccucaaggac

SEQ ID NO: 11157 - RNA, 22 nt, Homo sapiens
aagugcuuuacacaugcaugau

SEQ ID NO: 11158 - RNA, 22 nt, Homo sapiens
ucacuuugacggccaacuucua

SEQ ID NO: 11159 - RNA, 22 nt, Homo sapiens
guugcucaggccggagugcagu

SEQ ID NO: 11160 - RNA, 22 nt, Homo sapiens
ugagacauauuauacugcuuuu

SEQ ID NO: 11161 - RNA, 22 nt, Homo sapiens
ugagaaugcagaaucucgugca

SEQ ID NO: 11162 - RNA, 22 nt, Homo sapiens
ucaguguuuggaaucucaauuu

SEQ ID NO: 11163 - RNA, 22 nt, Homo sapiens
uugccuaggcuggagugcagug

SEQ ID NO: 11164 - RNA, 22 nt, Homo sapiens
uaucacuuugauaguuuaaaug

SEQ ID NO: 11165 - RNA, 22 nt, Homo sapiens
acacuggaguuaaaggugauuu

SEQ ID NO: 11166 - RNA, 21 nt, Homo sapiens
aagcacauugaguguguguga

SEQ ID NO: 11167 - RNA, 22 nt, Homo sapiens
uucaucaguugagcugguugcu

SEQ ID NO: 11168 - RNA, 22 nt, Homo sapiens
cuugcacuugaaauuccaguuu

SEQ ID NO: 11169 - RNA, 22 nt, Homo sapiens
ucgcgccauucuccugccucag

SEQ ID NO: 11170 - RNA, 20 nt, Homo sapiens
cauugcacuccagcuugggc

SEQ ID NO: 11171 - RNA, 22 nt, Homo sapiens
guguaaaacaauuagaggauuu

SEQ ID NO: 11172 - RNA, 22 nt, Homo sapiens
ugagaugcuccucuugcaaagc

SEQ ID NO: 11173 - RNA, 22 nt, Homo sapiens
cauugcaacuucugccucccag

SEQ ID NO: 11174 - RNA, 22 nt, Homo sapiens
guaaucucagcuacucaggagg

SEQ ID NO: 11175 - RNA, 22 nt, Homo sapiens
uugagccaaggauugucuuucc

SEQ ID NO: 11176 - RNA, 22 nt, Homo sapiens
uuacuguauagaaucaucuuga

SEQ ID NO: 11177 - RNA, 22 nt, Homo sapiens
uaaacugucuugcaguuacaug

SEQ ID NO: 11178 - RNA, 22 nt, Homo sapiens
agucacagccuuuuacuuuaga

SEQ ID NO: 11179 - RNA, 22 nt, Homo sapiens
uacagccacauaauguaugauu

SEQ ID NO: 11180 - RNA, 22 nt, Homo sapiens
cucccagagccaguuauaggcu

SEQ ID NO: 11181 - RNA, 22 nt, Homo sapiens
uuuuccagugggacucccauua

SEQ ID NO: 11182 - RNA, 22 nt, Homo sapiens
aaaggcuucggaucagaaggua

SEQ ID NO: 11183 - RNA, 22 nt, Homo sapiens
ucagaguagaaacacuuccaua

SEQ ID NO: 11184 - RNA, 22 nt, Homo sapiens
guaugauacuguaacagugggu

SEQ ID NO: 11185 - RNA, 21 nt, Homo sapiens
gagguaccucauguaagugga

SEQ ID NO: 11186 - RNA, 22 nt, Homo sapiens
uuccaguugugagcuauccggg

SEQ ID NO: 11187 - RNA, 22 nt, Homo sapiens
auugcacaucugcacuacagcc

SEQ ID NO: 11188 - RNA, 22 nt, Homo sapiens
aauacagcacacagaugggucu

SEQ ID NO: 11189 - RNA, 22 nt, Homo sapiens
ucugugaaugaacacuugaaaa

SEQ ID NO: 11190 - RNA, 19 nt, Homo sapiens
uguugcacauaucaauaug

SEQ ID NO: 11191 - RNA, 22 nt, Homo sapiens
cuuugguguauuuucagagacc

SEQ ID NO: 11192 - RNA, 22 nt, Homo sapiens
auauguauuuuaacguguaagg

SEQ ID NO: 11193 - RNA, 22 nt, Homo sapiens
agcuggucuacguguguaugag

SEQ ID NO: 11194 - RNA, 22 nt, Homo sapiens
cauugcacuccaucuugggcaa

SEQ ID NO: 11195 - RNA, 22 nt, Homo sapiens
ugcaaauguuaggugucauuau

SEQ ID NO: 11196 - RNA, 22 nt, Homo sapiens
uugagcaauccuccugccaugu

SEQ ID NO: 11197 - RNA, 22 nt, Homo sapiens
uugaggaaugucauuuguguuu

SEQ ID NO: 11198 - RNA, 18 nt, Homo sapiens
ugacuguccagguggacc

SEQ ID NO: 11199 - RNA, 22 nt, Homo sapiens
cauugcacucuagucuggguga

SEQ ID NO: 11200 - RNA, 19 nt, Homo sapiens
ugacacuguuggugggagg

SEQ ID NO: 11201 - RNA, 22 nt, Homo sapiens
acuggcuuauuucacuuagcau

SEQ ID NO: 11202 - RNA, 22 nt, Homo sapiens
aucccuugacguggagucucug

SEQ ID NO: 11203 - RNA, 22 nt, Homo sapiens
acugcacuucagccuuggcuac

SEQ ID NO: 11204 - RNA, 22 nt, Homo sapiens
auacuguuuuacaucauugccu

SEQ ID NO: 11205 - RNA, 22 nt, Homo sapiens
auccacaugcaguuggaaacag

SEQ ID NO: 11206 - RNA, 22 nt, Homo sapiens
uuucuauguugaccagucuaga

SEQ ID NO: 11207 - RNA, 22 nt, Homo sapiens
guuuuuggggucacuauuaccg

SEQ ID NO: 11208 - RNA, 22 nt, Homo sapiens
uccaguuuggaggcuugaugug

SEQ ID NO: 11209 - RNA, 22 nt, Homo sapiens
cauugcacuccauccuuggcaa

SEQ ID NO: 11210 - RNA, 22 nt, Homo sapiens
auugcagcccacccugggugau

SEQ ID NO: 11211 - RNA, 22 nt, Homo sapiens
aauugcaccaucuagaucaaga

SEQ ID NO: 11212 - RNA, 22 nt, Homo sapiens
uagcagcauaaauggacuaaga

SEQ ID NO: 11213 - RNA, 22 nt, Homo sapiens
cauugcacuccacuccugaaca

SEQ ID NO: 11214 - RNA, 22 nt, Homo sapiens
ugguauguaugauuaacaugga

SEQ ID NO: 11215 - RNA, 22 nt, Homo sapiens
caaagucuucucauuaugucuu

SEQ ID NO: 11216 - RNA, 22 nt, Homo sapiens
gugagauacuagagauauagug

SEQ ID NO: 11217 - RNA, 21 nt, Homo sapiens
uaaaacuguaacuuuguccug

SEQ ID NO: 11218 - RNA, 22 nt, Homo sapiens
ugaaauuauucuuaccaaggug

SEQ ID NO: 11219 - RNA, 22 nt, Homo sapiens
uuacugcucuuuugucaugagu

SEQ ID NO: 11220 - RNA, 18 nt, Homo sapiens
uuucaagucuuaggugac

SEQ ID NO: 11221 - RNA, 22 nt, Homo sapiens
uacucuuuagcuccuuaaggaa

SEQ ID NO: 11222 - RNA, 22 nt, Homo sapiens
gcaggcaugacauuucacucuu

SEQ ID NO: 11223 - RNA, 22 nt, Homo sapiens
acaccuguggucccaguaacuu

SEQ ID NO: 11224 - RNA, 22 nt, Homo sapiens
uuggcagcacgcaguccagagg

SEQ ID NO: 11225 - RNA, 22 nt, Homo sapiens
aauacugugauaucgagcgauu

SEQ ID NO: 11226 - RNA, 22 nt, Homo sapiens
uugugaauggugccgcgauaaa

SEQ ID NO: 11227 - RNA, 22 nt, Homo sapiens
guaaucucagcuacuugggagg

SEQ ID NO: 11228 - RNA, 20 nt, Homo sapiens
uucuauggugaugaguccug

SEQ ID NO: 11229 - RNA, 22 nt, Homo sapiens
aucgcgccauuguacuccagcc

SEQ ID NO: 11230 - RNA, 22 nt, Homo sapiens
uucuggccuccauuuuucuccu

SEQ ID NO: 11231 - RNA, 22 nt, Homo sapiens
auuggcagaaaucuuuauagua

SEQ ID NO: 11232 - RNA, 22 nt, Homo sapiens
uagaaagcaugaccuucagaua

SEQ ID NO: 11233 - RNA, 22 nt, Homo sapiens
auguauacaugcaggucacagg

SEQ ID NO: 11234 - RNA, 22 nt, Homo sapiens
gaaagauuuccugagcuagaaa

SEQ ID NO: 11235 - RNA, 22 nt, Homo sapiens
ugagauagggucucacucuguc

SEQ ID NO: 11236 - RNA, 22 nt, Homo sapiens
uugagacggagucuugcucuuu

SEQ ID NO: 11237 - RNA, 22 nt, Homo sapiens
uugauaguuuuaaaauuaaucu

SEQ ID NO: 11238 - RNA, 22 nt, Homo sapiens
aaagugcugagaguucuaacuu

SEQ ID NO: 11239 - RNA, 22 nt, Homo sapiens
uuggaaaaauccaccuugaucu

SEQ ID NO: 11240 - RNA, 22 nt, Homo sapiens
aucaaaguaucucaauauggua

SEQ ID NO: 11241 - RNA, 22 nt, Homo sapiens
ccuguguuaugguuucuaaugu

SEQ ID NO: 11242 - RNA, 22 nt, Homo sapiens
acuuuuugaugaggucguuugu

SEQ ID NO: 11243 - RNA, 22 nt, Homo sapiens
auagcagugugaggacagacua

SEQ ID NO: 11244 - RNA, 22 nt, Homo sapiens
auugcagcuugcagggugugua

SEQ ID NO: 11245 - RNA, 22 nt, Homo sapiens
agaauguauauucuguaguugu

SEQ ID NO: 11246 - RNA, 22 nt, Homo sapiens
caugcauuggucuauuauguga

SEQ ID NO: 11247 - RNA, 22 nt, Homo sapiens
acccaguagccagauguagcug

SEQ ID NO: 11248 - RNA, 22 nt, Homo sapiens
uaucagcagagucauacuucaa

SEQ ID NO: 11249 - RNA, 22 nt, Homo sapiens
acauggcacugcgggcuucuug

SEQ ID NO: 11250 - RNA, 22 nt, Homo sapiens
ugucacagagauuuugguaugu

SEQ ID NO: 11251 - RNA, 22 nt, Homo sapiens
gucacuguggagaagaaagugg

SEQ ID NO: 11252 - RNA, 18 nt, Homo sapiens
agagcacugaguuuuaga

SEQ ID NO: 11253 - RNA, 22 nt, Homo sapiens
acugcacuccaccuugggcaac

SEQ ID NO: 11254 - RNA, 22 nt, Homo sapiens
aggacacugauguaugcugugg

SEQ ID NO: 11255 - RNA, 22 nt, Homo sapiens
uuggaagauuacuuaguuuucu

SEQ ID NO: 11256 - RNA, 22 nt, Homo sapiens
uagaucauauacuugccaugac

SEQ ID NO: 11257 - RNA, 22 nt, Homo sapiens
ccauggcaauggucagucuauu

SEQ ID NO: 11258 - RNA, 22 nt, Homo sapiens
ucaggcuuuucccagagugaug

SEQ ID NO: 11259 - RNA, 22 nt, Homo sapiens
uggaaugugaauaacuuccuuc

SEQ ID NO: 11260 - RNA, 22 nt, Homo sapiens
ucauacaguaguccucacuugu

SEQ ID NO: 11261 - RNA, 22 nt, Homo sapiens
cauugcacuccagccucggcaa

SEQ ID NO: 11262 - RNA, 22 nt, Homo sapiens
uauugcacuccagccuuggcaa

SEQ ID NO: 11263 - RNA, 22 nt, Homo sapiens
uuggaagacauucugucugcua

SEQ ID NO: 11264 - RNA, 22 nt, Homo sapiens
aagagguaggaaauggucauuu

SEQ ID NO: 11265 - RNA, 22 nt, Homo sapiens
uucaucaguuauauuggccuga

SEQ ID NO: 11266 - RNA, 22 nt, Homo sapiens
auuaagugcuugcagaagucca

SEQ ID NO: 11267 - RNA, 22 nt, Homo sapiens
uuaugucuuuuguguucagcua

SEQ ID NO: 11268 - RNA, 22 nt, Homo sapiens
gucaucaggacgggucaucugc

SEQ ID NO: 11269 - RNA, 20 nt, Homo sapiens
guggaagauaaguagccuga

SEQ ID NO: 11270 - RNA, 22 nt, Homo sapiens
cauugcacuccagccuuggcaa

SEQ ID NO: 11271 - RNA, 22 nt, Homo sapiens
uugucaacaugaaacuguguuu

SEQ ID NO: 11272 - RNA, 22 nt, Homo sapiens
augguuuauuuguaagcagagu

SEQ ID NO: 11273 - RNA, 22 nt, Homo sapiens
gcuggguucagagugggcugcg

SEQ ID NO: 11274 - RNA, 22 nt, Homo sapiens
augacauguauuuccaggauuu

SEQ ID NO: 11275 - RNA, 22 nt, Homo sapiens
guaaauaccaguuucuggaaca

SEQ ID NO: 11276 - RNA, 22 nt, Homo sapiens
acccagaguuccuugucuuuca

SEQ ID NO: 11277 - RNA, 22 nt, Homo sapiens
ugagacgaagucuugcucuguu

SEQ ID NO: 11278 - RNA, 22 nt, Homo sapiens
uaucacaggucaggaaucuugc

SEQ ID NO: 11279 - RNA, 22 nt, Homo sapiens
ugagacacuucccagaucccuu

SEQ ID NO: 11280 - RNA, 20 nt, Homo sapiens
auucaaguaugccuugagaa

SEQ ID NO: 11281 - RNA, 22 nt, Homo sapiens
aagggaauguuguagcugguuu

SEQ ID NO: 11282 - RNA, 22 nt, Homo sapiens
uggcaagagauaugugucuaua

SEQ ID NO: 11283 - RNA, 19 nt, Homo sapiens
uacccagaagcagcauugu

SEQ ID NO: 11284 - RNA, 22 nt, Homo sapiens
ucauugcaaucucugccucccg

SEQ ID NO: 11285 - RNA, 22 nt, Homo sapiens
uuaagucacacuagacaacuga

SEQ ID NO: 11286 - RNA, 22 nt, Homo sapiens
aaaugcagucuuuguucugggc

SEQ ID NO: 11287 - RNA, 22 nt, Homo sapiens
aguacaauguugaguagaagug

SEQ ID NO: 11288 - RNA, 22 nt, Homo sapiens
ucuugggugaguuugugaauaa

SEQ ID NO: 11289 - RNA, 22 nt, Homo sapiens
augugaacaucauagaaugcac

SEQ ID NO: 11290 - RNA, 22 nt, Homo sapiens
uugugaauggugccgcaauaaa

SEQ ID NO: 11291 - RNA, 22 nt, Homo sapiens
gugcacaugguagguauugagu

SEQ ID NO: 11292 - RNA, 22 nt, Homo sapiens
ucauagucuaagguucuuuugc

SEQ ID NO: 11293 - RNA, 22 nt, Homo sapiens
uauugcucaugcauuuaauuuc

SEQ ID NO: 11294 - RNA, 22 nt, Homo sapiens
ugagaaugacugggcaugcugc

SEQ ID NO: 11295 - RNA, 22 nt, Homo sapiens
cugaaagagcauuugaaugggu

SEQ ID NO: 11296 - RNA, 20 nt, Homo sapiens
uuccuuaggcauuggaagaa

SEQ ID NO: 11297 - RNA, 22 nt, Homo sapiens
ucaucagaguuuacaagcucag

SEQ ID NO: 11298 - RNA, 22 nt, Homo sapiens
uagcaguagacagacuuuggcu

SEQ ID NO: 11299 - RNA, 22 nt, Homo sapiens
guaaaguaaagcacaucaaggu

SEQ ID NO: 11300 - RNA, 22 nt, Homo sapiens
cauugcacuccagccuugguga

SEQ ID NO: 11301 - RNA, 21 nt, Homo sapiens
ugcuauguuguccaggcuggc

SEQ ID NO: 11302 - RNA, 22 nt, Homo sapiens
uucauaguucuuuuagucauua

SEQ ID NO: 11303 - RNA, 22 nt, Homo sapiens
ggucacauuggacuaucaaguu

SEQ ID NO: 11304 - RNA, 22 nt, Homo sapiens
cccaguuuugcuucucaugagg

SEQ ID NO: 11305 - RNA, 22 nt, Homo sapiens
cacuuugguucaccugaguuuc

SEQ ID NO: 11306 - RNA, 22 nt, Homo sapiens
guucuggagauaaagccaaggu

SEQ ID NO: 11307 - RNA, 22 nt, Homo sapiens
cauugcacuccagcuugggcaa

SEQ ID NO: 11308 - RNA, 23 nt, Homo sapiens
ggaaacauccagucuuucaccau

SEQ ID NO: 11309 - RNA, 22 nt, Homo sapiens
uuguaaucaacacaucauuggg

SEQ ID NO: 11310 - RNA, 20 nt, Homo sapiens
ggaauagucuacacucugac

SEQ ID NO: 11311 - RNA, 20 nt, Homo sapiens
uccugagauucccaguucuc

SEQ ID NO: 11312 - RNA, 22 nt, Homo sapiens
auaugcuuauuagcaagaaaua

SEQ ID NO: 11313 - RNA, 22 nt, Homo sapiens
uaggcagccagcuguggauuga

SEQ ID NO: 11314 - RNA, 22 nt, Homo sapiens
cacaaaguagauuagucuucca

SEQ ID NO: 11315 - RNA, 22 nt, Homo sapiens
cauugcacuccagccuaggcaa

SEQ ID NO: 11316 - RNA, 22 nt, Homo sapiens
caauggcacgaucucgucucac

SEQ ID NO: 11317 - RNA, 22 nt, Homo sapiens
agucacagugaccuugucugac

SEQ ID NO: 11318 - RNA, 22 nt, Homo sapiens
agagugcuauagauuagauuuc

SEQ ID NO: 11319 - RNA, 21 nt, Homo sapiens
gacauggcgauacuccgucuc

SEQ ID NO: 11320 - RNA, 19 nt, Homo sapiens
ugccauguagcacaugguc

SEQ ID NO: 11321 - RNA, 17 nt, Homo sapiens
aaucagauuucugagga

SEQ ID NO: 11322 - RNA, 22 nt, Homo sapiens
auauuggccuaaaauucucuuu

SEQ ID NO: 11323 - RNA, 22 nt, Homo sapiens
uagcagaauauaccucuuacuu

SEQ ID NO: 11324 - RNA, 18 nt, Homo sapiens
uucuuguguugauauuuu

SEQ ID NO: 11325 - RNA, 22 nt, Homo sapiens
ugauugcacaccugcacucaag

SEQ ID NO: 11326 - RNA, 18 nt, Homo sapiens
uaagugcuuuaaacacau

SEQ ID NO: 11327 - RNA, 22 nt, Homo sapiens
guacaguauaguaauaggauuu

SEQ ID NO: 11328 - RNA, 22 nt, Homo sapiens
ucaggcaugcagcaaugcagug

SEQ ID NO: 11329 - RNA, 22 nt, Homo sapiens
ucaaagugagcuccuucucacu

SEQ ID NO: 11330 - RNA, 22 nt, Homo sapiens
ucugagaugagacuuugaauuu

SEQ ID NO: 11331 - RNA, 22 nt, Homo sapiens
uaagugcuugacuuugauguuu

SEQ ID NO: 11332 - RNA, 22 nt, Homo sapiens
uccugagagcagacccucuaua

SEQ ID NO: 11333 - RNA, 22 nt, Homo sapiens
gaaucacaguuauuagagcagc

SEQ ID NO: 11334 - RNA, 22 nt, Homo sapiens
gugacugcauccauccaggcuu

SEQ ID NO: 11335 - RNA, 22 nt, Homo sapiens
ggaucauaugauagcucaauuu

SEQ ID NO: 11336 - RNA, 22 nt, Homo sapiens
ucauucauuugcucacuccaca

SEQ ID NO: 11337 - RNA, 22 nt, Homo sapiens
uauggcacuaguacuggaaagc

SEQ ID NO: 11338 - RNA, 22 nt, Homo sapiens
uugucccauggggucuuccuuu

SEQ ID NO: 11339 - RNA, 22 nt, Homo sapiens
uuacaugucuugguaagguuag

SEQ ID NO: 11340 - RNA, 20 nt, Homo sapiens
uccaguuuuggagacauucu

SEQ ID NO: 11341 - RNA, 22 nt, Homo sapiens
uuugugaaugucauaagcucca

SEQ ID NO: 11342 - RNA, 22 nt, Homo sapiens
uucauaguaacaguaacuaugg

SEQ ID NO: 11343 - RNA, 19 nt, Homo sapiens
ucgcgccauucuccugccu

SEQ ID NO: 11344 - RNA, 22 nt, Homo sapiens
augagacauuaaaguguguuug

SEQ ID NO: 11345 - RNA, 22 nt, Homo sapiens
auguaauguuaaauugcuaauu

SEQ ID NO: 11346 - RNA, 22 nt, Homo sapiens
ugacaugauuguauauuuagaa

SEQ ID NO: 11347 - RNA, 22 nt, Homo sapiens
aagacuguaauccaucuugagu

SEQ ID NO: 11348 - RNA, 22 nt, Homo sapiens
gaaucacugugguaucccaugc

SEQ ID NO: 11349 - RNA, 22 nt, Homo sapiens
ugacagagaagcauugaguuca

SEQ ID NO: 11350 - RNA, 22 nt, Homo sapiens
ucagaguagcugucugaggugc

SEQ ID NO: 11351 - RNA, 22 nt, Homo sapiens
auagcagaacagugucucacug

SEQ ID NO: 11352 - RNA, 22 nt, Homo sapiens
aggaucauugacuauuauaagg

SEQ ID NO: 11353 - RNA, 22 nt, Homo sapiens
uagagguaggucuucgagucuc

SEQ ID NO: 11354 - RNA, 22 nt, Homo sapiens
aucacuguaaguuuacacuuug

SEQ ID NO: 11355 - RNA, 22 nt, Homo sapiens
auggaagaaacgauuuucugga

SEQ ID NO: 11356 - RNA, 22 nt, Homo sapiens
guggacaugaauuuuggaggca

SEQ ID NO: 11357 - RNA, 22 nt, Homo sapiens
auaucacucccaauaucgcagg

SEQ ID NO: 11358 - RNA, 22 nt, Homo sapiens
uaggucaguuuuggcuuggcuu

SEQ ID NO: 11359 - RNA, 22 nt, Homo sapiens
aaagugcuuacuaaguugccaa

SEQ ID NO: 11360 - RNA, 22 nt, Homo sapiens
uggaauguaacuugaaacuuuu

SEQ ID NO: 11361 - RNA, 22 nt, Homo sapiens
accugagacuaggcauuuuaua

SEQ ID NO: 11362 - RNA, 22 nt, Homo sapiens
ucaucaggcucauucaagcuga

SEQ ID NO: 11363 - RNA, 22 nt, Homo sapiens
gucaugucugcacauaguaaaa

SEQ ID NO: 11364 - RNA, 22 nt, Homo sapiens
gugucuccugccuucaugcagc

SEQ ID NO: 11365 - RNA, 22 nt, Homo sapiens
gucacuguuuccuauuauauuu

SEQ ID NO: 11366 - RNA, 22 nt, Homo sapiens
gucacugucuacuguaauagcc

SEQ ID NO: 11367 - RNA, 22 nt, Homo sapiens
caaaggauucauuuccaggagu

SEQ ID NO: 11368 - RNA, 22 nt, Homo sapiens
ugaguuagguaauaauaaauau

SEQ ID NO: 11369 - RNA, 21 nt, Homo sapiens
ucaguuacugagagagaagug

SEQ ID NO: 11370 - RNA, 22 nt, Homo sapiens
uagcaguauaugagagcuauug

SEQ ID NO: 11371 - RNA, 22 nt, Homo sapiens
uuucugaggccucaccagaagc

SEQ ID NO: 11372 - RNA, 22 nt, Homo sapiens
aaguaaauauccgguaguccca

SEQ ID NO: 11373 - RNA, 22 nt, Homo sapiens
uugaaagcuaucucaaaucgcu

SEQ ID NO: 11374 - RNA, 22 nt, Homo sapiens
auagugcagugaugaaccuagg

SEQ ID NO: 11375 - RNA, 19 nt, Homo sapiens
auaaaugccuacaagggug

SEQ ID NO: 11376 - RNA, 22 nt, Homo sapiens
ugagaugugaucaccugaaggg

SEQ ID NO: 11377 - RNA, 22 nt, Homo sapiens
cauugcacuccagccugaccaa

SEQ ID NO: 11378 - RNA, 23 nt, Homo sapiens
uucaucagggauauuggccugaa

SEQ ID NO: 11379 - RNA, 22 nt, Homo sapiens
auacacgguaggcacauauuua

SEQ ID NO: 11380 - RNA, 22 nt, Homo sapiens
uauacagcaaguuacugugcug

SEQ ID NO: 11381 - RNA, 22 nt, Homo sapiens
uuguguacuacaguaugccaca

SEQ ID NO: 11382 - RNA, 22 nt, Homo sapiens
uuucaagugcugucuuagcugu

SEQ ID NO: 11383 - RNA, 22 nt, Homo sapiens
ugucaguuuuaacuagggaaua

SEQ ID NO: 11384 - RNA, 22 nt, Homo sapiens
guggaagauaguguguuaaugu

SEQ ID NO: 11385 - RNA, 22 nt, Homo sapiens
cuggccagagacauucauuaaa

SEQ ID NO: 11386 - RNA, 22 nt, Homo sapiens
uuggcaaguccccaccucucuc

SEQ ID NO: 11387 - RNA, 22 nt, Homo sapiens
agaugguauuauagguuucugu

SEQ ID NO: 11388 - RNA, 22 nt, Homo sapiens
uugugaauggugccacaauaaa

SEQ ID NO: 11389 - RNA, 22 nt, Homo sapiens
uucacagucacccuucuccaug

SEQ ID NO: 11390 - RNA, 22 nt, Homo sapiens
aucucuugccagucagaauggu

SEQ ID NO: 11391 - RNA, 22 nt, Homo sapiens
cuguaauguaaugagacuacau

SEQ ID NO: 11392 - RNA, 22 nt, Homo sapiens
ucacugugguuuugaugugcau

SEQ ID NO: 11393 - RNA, 22 nt, Homo sapiens
uugugaauggugccucaguaaa

SEQ ID NO: 11394 - RNA, 22 nt, Homo sapiens
uucauggaauauugaccauuuu

SEQ ID NO: 11395 - RNA, 22 nt, Homo sapiens
aaucacuuugcuacaaggcagu

SEQ ID NO: 11396 - RNA, 22 nt, Homo sapiens
ugugaagauggacuaauauagu

SEQ ID NO: 11397 - RNA, 22 nt, Homo sapiens
acuccauuucauuuuagcucuu

SEQ ID NO: 11398 - RNA, 22 nt, Homo sapiens
auugcuauuauuugaccauugu

SEQ ID NO: 11399 - RNA, 22 nt, Homo sapiens
uuggcaacauagugagaccccc

SEQ ID NO: 11400 - RNA, 22 nt, Homo sapiens
ucaacaggucaauugcauagaa

SEQ ID NO: 11401 - RNA, 22 nt, Homo sapiens
uucaguauugcaccuggagucc

SEQ ID NO: 11402 - RNA, 22 nt, Homo sapiens
ggccggguggccauggcugccc

SEQ ID NO: 11403 - RNA, 22 nt, Homo sapiens
uaucacagcauugucuauaaua

SEQ ID NO: 11404 - RNA, 22 nt, Homo sapiens
cagcagguuuuuaucaguuaag

SEQ ID NO: 11405 - RNA, 22 nt, Homo sapiens
ugagaaugaugauuuccaguuu

SEQ ID NO: 11406 - RNA, 19 nt, Homo sapiens
auacacguguauacauaca

SEQ ID NO: 11407 - RNA, 20 nt, Homo sapiens
ucacugugaacuucuugagg

SEQ ID NO: 11408 - RNA, 18 nt, Homo sapiens
acauucagcuugaagaua

SEQ ID NO: 11409 - RNA, 22 nt, Homo sapiens
uaagcagugcaagaauggaaua

SEQ ID NO: 11410 - RNA, 23 nt, Homo sapiens
ucgcagcauucaauaccaggcag

SEQ ID NO: 11411 - RNA, 22 nt, Homo sapiens
uuagucaaguguacugugaaug

SEQ ID NO: 11412 - RNA, 22 nt, Homo sapiens
uauuccuuuugcauuuccacau

SEQ ID NO: 11413 - RNA, 22 nt, Homo sapiens
ugugccacugcacuccugccug

SEQ ID NO: 11414 - RNA, 22 nt, Homo sapiens
accaugcaguccaauaugcaca

SEQ ID NO: 11415 - RNA, 22 nt, Homo sapiens
acuggacuuaaugaugaauugu

SEQ ID NO: 11416 - RNA, 22 nt, Homo sapiens
auuccuuaggcccuuugguuag

SEQ ID NO: 11417 - RNA, 22 nt, Homo sapiens
uaauucacauaaagcacuuaga

SEQ ID NO: 11418 - RNA, 22 nt, Homo sapiens
uuacaguugugagccaccaugc

SEQ ID NO: 11419 - RNA, 22 nt, Homo sapiens
uuccaugugggcuugucaagua

SEQ ID NO: 11420 - RNA, 22 nt, Homo sapiens
aauuacauggcaauugggaaau

SEQ ID NO: 11421 - RNA, 22 nt, Homo sapiens
ugagauuaucuugaucuugaaa

SEQ ID NO: 11422 - RNA, 22 nt, Homo sapiens
uaaaagucaucacaacuggagu

SEQ ID NO: 11423 - RNA, 22 nt, Homo sapiens
agaacacugaguucagggucag

SEQ ID NO: 11424 - RNA, 22 nt, Homo sapiens
uugaaguagaaagacgaaauuu

SEQ ID NO: 11425 - RNA, 20 nt, Homo sapiens
cuuggcuuucuugguguuaa

SEQ ID NO: 11426 - RNA, 22 nt, Homo sapiens
cacugcgacguccgccucccgg

SEQ ID NO: 11427 - RNA, 22 nt, Homo sapiens
uauaagacgagcaaaaagcuug

SEQ ID NO: 11428 - RNA, 21 nt, Homo sapiens
ccauggcaaugguaaacugac

SEQ ID NO: 11429 - RNA, 22 nt, Homo sapiens
ucaagcaauucuccugccucag

SEQ ID NO: 11430 - RNA, 22 nt, Homo sapiens
agguagcauagcgggaauauca

SEQ ID NO: 11431 - RNA, 22 nt, Homo sapiens
aguggcaaugugauguccugaa

SEQ ID NO: 11432 - RNA, 22 nt, Homo sapiens
acugcacuccggccuggcaaca

SEQ ID NO: 11433 - RNA, 22 nt, Homo sapiens
uggaguguguugcagaugaagg

SEQ ID NO: 11434 - RNA, 22 nt, Homo sapiens
auagcagugugaaaauggacua

SEQ ID NO: 11435 - RNA, 22 nt, Homo sapiens
guggaaaacauaugcuuguuga

SEQ ID NO: 11436 - RNA, 22 nt, Homo sapiens
ucuacagccaguucaggaagaa

SEQ ID NO: 11437 - RNA, 22 nt, Homo sapiens
ugucauguuucuacugaccaaa

SEQ ID NO: 11438 - RNA, 22 nt, Homo sapiens
uaugcuuauaaacauuugucag

SEQ ID NO: 11439 - RNA, 22 nt, Homo sapiens
uauggcaaugcauaggaaggaa

SEQ ID NO: 11440 - RNA, 22 nt, Homo sapiens
uuggcuuggagaguugaaaugu

SEQ ID NO: 11441 - RNA, 22 nt, Homo sapiens
guagugcaguuugagaaucagu

SEQ ID NO: 11442 - RNA, 21 nt, Homo sapiens
agcagcuuugguugaagcaga

SEQ ID NO: 11443 - RNA, 22 nt, Homo sapiens
cauugcacuccagccugcacga

SEQ ID NO: 11444 - RNA, 22 nt, Homo sapiens
uguauguuguaagacuuagacc

SEQ ID NO: 11445 - RNA, 22 nt, Homo sapiens
uugucacccuacauaacaggga

SEQ ID NO: 11446 - RNA, 22 nt, Homo sapiens
gucacuggcugucuuguaugau

SEQ ID NO: 11447 - RNA, 22 nt, Homo sapiens
ucagaguagagcgacuucuccu

SEQ ID NO: 11448 - RNA, 22 nt, Homo sapiens
cauugcacucugcauuccaguc

SEQ ID NO: 11449 - RNA, 22 nt, Homo sapiens
gcugcacuuuaaggcauccccu

SEQ ID NO: 11450 - RNA, 22 nt, Homo sapiens
uuaccuuuuuaagacagguuag

SEQ ID NO: 11451 - RNA, 22 nt, Homo sapiens
augucuggcagaagacuucuca

SEQ ID NO: 11452 - RNA, 22 nt, Homo sapiens
ugagaucacgccacugcacucc

SEQ ID NO: 11453 - RNA, 22 nt, Homo sapiens
aagggaauguuguggcugguuu

SEQ ID NO: 11454 - RNA, 22 nt, Homo sapiens
uucauagucacauucgaugucu

SEQ ID NO: 11455 - RNA, 22 nt, Homo sapiens
uugagguaauaaacagccauuc

SEQ ID NO: 11456 - RNA, 22 nt, Homo sapiens
cagccgggugagguggcuuguu

SEQ ID NO: 11457 - RNA, 22 nt, Homo sapiens
uggaauguagcguugacacgag

SEQ ID NO: 11458 - RNA, 22 nt, Homo sapiens
cuguaugugagaaauaauaagu

SEQ ID NO: 11459 - RNA, 22 nt, Homo sapiens
uuggccauaugacuugcuuugg

SEQ ID NO: 11460 - RNA, 22 nt, Homo sapiens
guggaagaaaucagguuauuug

SEQ ID NO: 11461 - RNA, 22 nt, Homo sapiens
gcagcacauggcagaacauauu

SEQ ID NO: 11462 - RNA, 22 nt, Homo sapiens
ugugccacugcacuucagccug

SEQ ID NO: 11463 - RNA, 21 nt, Homo sapiens
uccugagagaggaguaacucu

SEQ ID NO: 11464 - RNA, 22 nt, Homo sapiens
cugacuuuagaacccaaaaagu

SEQ ID NO: 11465 - RNA, 22 nt, Homo sapiens
caagugcuuucuuggggauuua

SEQ ID NO: 11466 - RNA, 22 nt, Homo sapiens
ugcaaaugcugcuauuucucuu

SEQ ID NO: 11467 - RNA, 19 nt, Homo sapiens
ggucacagggguuacaagg

SEQ ID NO: 11468 - RNA, 22 nt, Homo sapiens
cauugcacucuagccucggcaa

SEQ ID NO: 11469 - RNA, 22 nt, Homo sapiens
uaucaacaggguggccagugua

SEQ ID NO: 11470 - RNA, 20 nt, Homo sapiens
ucucauggagggaaagagca

SEQ ID NO: 11471 - RNA, 22 nt, Homo sapiens
uuacuguagugucauaucguau

SEQ ID NO: 11472 - RNA, 22 nt, Homo sapiens
guggaagaccagacuuuccaac

SEQ ID NO: 11473 - RNA, 22 nt, Homo sapiens
agaguacaggcaaguuagucau

SEQ ID NO: 11474 - RNA, 22 nt, Homo sapiens
uuguaaaguucucucccgaaaa

SEQ ID NO: 11475 - RNA, 22 nt, Homo sapiens
cccugaagauacagaguuuggg

SEQ ID NO: 11476 - RNA, 22 nt, Homo sapiens
ggcuuggaggaaugugagggcu

SEQ ID NO: 11477 - RNA, 22 nt, Homo sapiens
acccugucauccacauggugcu

SEQ ID NO: 11478 - RNA, 22 nt, Homo sapiens
agugcaauaaggauguagaacu

SEQ ID NO: 11479 - RNA, 22 nt, Homo sapiens
uuaauuguccaaguucaucucu

SEQ ID NO: 11480 - RNA, 22 nt, Homo sapiens
uugaagugaagaacaauaucac

SEQ ID NO: 11481 - RNA, 22 nt, Homo sapiens
ucauugcauguuaauuaaacag

SEQ ID NO: 11482 - RNA, 22 nt, Homo sapiens
uucauaguuuauacugauauuu

SEQ ID NO: 11483 - RNA, 22 nt, Homo sapiens
aagcaggugucugugucuguaa

SEQ ID NO: 11484 - RNA, 22 nt, Mycobacterium bovis subsp bovis AF2122/97
uuucauucguugcgcgcagacc

SEQ ID NO: 11485 - RNA, 22 nt, Mycobacterium bovis subsp bovis AF2122/97
uuucauucagacgagaggcgug

SEQ ID NO: 11486 - RNA, 22 nt, Mycobacterium bovis subsp bovis AF2122/97
uuggucaccgcggcgcgggccg

SEQ ID NO: 11487 - RNA, 22 nt, Mycobacterium bovis subsp bovis AF2122/97
uuggccaaccugcugcacgaga

SEQ ID NO: 11488 - RNA, 22 nt, Mycobacterium bovis subsp bovis AF2122/97
uugggauuguugauuccgccga

SEQ ID NO: 11489 - RNA, 22 nt, Mycobacterium bovis subsp bovis AF2122/97
uugggcagacgcuggucaacga

SEQ ID NO: 11490 - RNA, 22 nt, Mycobacterium bovis subsp bovis AF2122/97
uuguggcugaucccggccaggc

SEQ ID NO: 11491 - RNA, 22 nt, Mycobacterium bovis subsp bovis AF2122/97
uugcgcaggggcaugucagcgu

SEQ ID NO: 11492 - RNA, 22 nt, Mycobacterium bovis subsp bovis AF2122/97
uguggaauacgcugcuggucuu

SEQ ID NO: 11493 - RNA, 18 nt, Mycobacterium bovis subsp bovis AF2122/97
uggugcaccuuguuuggg

SEQ ID NO: 11494 - RNA, 22 nt, Mycobacterium bovis subsp bovis AF2122/97
ugucccgcacucgauccgcaag

SEQ ID NO: 11495 - RNA, 22 nt, Mycobacterium bovis subsp bovis AF2122/97
ugggccaacacgugcgcggucg

SEQ ID NO: 11496 - RNA, 22 nt, Mycobacterium bovis subsp bovis AF2122/97
uggggcuggcucugcuugccgc

SEQ ID NO: 11497 - RNA, 22 nt, Mycobacterium bovis subsp bovis AF2122/97
uggguggcuucggcgcgcugaa

SEQ ID NO: 11498 - RNA, 22 nt, Mycobacterium bovis subsp bovis AF2122/97
uggucacguacggccgccgcgg

SEQ ID NO: 11499 - RNA, 22 nt, Mycobacterium bovis subsp bovis AF2122/97
uggucaggcggccgucgucggc

SEQ ID NO: 11500 - RNA, 22 nt, Mycobacterium bovis subsp bovis AF2122/97
uucaccuuccuugacgccauau

SEQ ID NO: 11501 - RNA, 22 nt, Mycobacterium bovis subsp bovis AF2122/97
uuagccuuaugccugucacacc

SEQ ID NO: 11502 - RNA, 22 nt, Mycobacterium bovis subsp bovis AF2122/97
uucaucaguuggucgagguuga

SEQ ID NO: 11503 - RNA, 22 nt, Mycobacterium bovis subsp bovis AF2122/97
uucguggcgaccaugcgccggu

SEQ ID NO: 11504 - RNA, 22 nt, Mycobacterium bovis subsp bovis AF2122/97
uucuagccgccccgggcgcagc

SEQ ID NO: 11505 - RNA, 22 nt, Mycobacterium bovis subsp bovis AF2122/97
ugggcugcugcgccgcaucggc

SEQ ID NO: 11506 - RNA, 22 nt, Mycobacterium bovis subsp bovis AF2122/97
uggcagcaaucggguauccgau

SEQ ID NO: 11507 - RNA, 22 nt, Mycobacterium bovis subsp bovis AF2122/97
uggccaagcggaccgucggcau

SEQ ID NO: 11508 - RNA, 22 nt, Mycobacterium bovis subsp bovis AF2122/97
uggcgagcagacgcaaaagccc

SEQ ID NO: 11509 - RNA, 21 nt, Mycobacterium bovis subsp bovis AF2122/97
uggcgagccgggccacgcccg

SEQ ID NO: 11510 - RNA, 22 nt, Mycobacterium bovis subsp bovis AF2122/97
ugcuccacugcugccaagucgg

SEQ ID NO: 11511 - RNA, 22 nt, Mycobacterium bovis subsp bovis AF2122/97
ugcgccagcgccucccgcagga

SEQ ID NO: 11512 - RNA, 18 nt, Mycobacterium bovis subsp bovis AF2122/97
ugcgcgccgccagcuauc

SEQ ID NO: 11513 - RNA, 22 nt, Mycobacterium bovis subsp bovis AF2122/97
ugcaggucgagguggucgguuu

SEQ ID NO: 11514 - RNA, 19 nt, Mycobacterium bovis subsp bovis AF2122/97
ugcaugagucguggaaugg

SEQ ID NO: 11515 - RNA, 22 nt, Mycobacterium bovis subsp bovis AF2122/97
ugagacccccgucgaagucuag

SEQ ID NO: 11516 - RNA, 22 nt, Mycobacterium bovis subsp bovis AF2122/97
ucugugcgcgguuugugcacag

SEQ ID NO: 11517 - RNA, 22 nt, Mycobacterium bovis subsp bovis AF2122/97
ucuuucccuccagaucggugcg

SEQ ID NO: 11518 - RNA, 22 nt, Mycobacterium bovis subsp bovis AF2122/97
ugacccaggcgccggucggugu

SEQ ID NO: 11519 - RNA, 22 nt, Mycobacterium bovis subsp bovis AF2122/97
ccugggcgacuuggcguugcug

SEQ ID NO: 11520 - RNA, 22 nt, Mycobacterium bovis subsp bovis AF2122/97
ccuggcgcgcagcacggccugc

SEQ ID NO: 11521 - RNA, 22 nt, Mycobacterium bovis subsp bovis AF2122/97
ccugggauggucaacaccguga

SEQ ID NO: 11522 - RNA, 22 nt, Mycobacterium bovis subsp bovis AF2122/97
ccugggauugugggcgggcguc

SEQ ID NO: 11523 - RNA, 21 nt, Mycobacterium bovis subsp bovis AF2122/97
cgagcucgcggcccagaguuc

SEQ ID NO: 11524 - RNA, 22 nt, Mycobacterium bovis subsp bovis AF2122/97
cgccacucuggucuugcaccug

SEQ ID NO: 11525 - RNA, 22 nt, Mycobacterium bovis subsp bovis AF2122/97
cgcagcaucggcgauugucggc

SEQ ID NO: 11526 - RNA, 22 nt, Mycobacterium bovis subsp bovis AF2122/97
cgcaggaugaggcuugccaccg

SEQ ID NO: 11527 - RNA, 22 nt, Mycobacterium bovis subsp bovis AF2122/97
cgagccuggccacugggaagga

SEQ ID NO: 11528 - RNA, 22 nt, Mycobacterium bovis subsp bovis AF2122/97
cuggcuugccuccugccgcgac

SEQ ID NO: 11529 - RNA, 22 nt, Mycobacterium bovis subsp bovis AF2122/97
cugguccagccgcagcgugcgc

SEQ ID NO: 11530 - RNA, 22 nt, Mycobacterium bovis subsp bovis AF2122/97
cuggguucgacccaguccaagc

SEQ ID NO: 11531 - RNA, 22 nt, Mycobacterium bovis subsp bovis AF2122/97
cugguggcgcgggaugccgacg

SEQ ID NO: 11532 - RNA, 22 nt, Mycobacterium bovis subsp bovis AF2122/97
cuugaccuugcaccauggcguc

SEQ ID NO: 11533 - RNA, 23 nt, Mycobacterium bovis subsp bovis AF2122/97
cuugacgugaucgcugagacccu

SEQ ID NO: 11534 - RNA, 22 nt, Mycobacterium bovis subsp bovis AF2122/97
cuugcugguaugccgggccacc

SEQ ID NO: 11535 - RNA, 22 nt, Mycobacterium bovis subsp bovis AF2122/97
cuuccuggaguugccggaccag

SEQ ID NO: 11536 - RNA, 22 nt, Mycobacterium bovis subsp bovis AF2122/97
gaacagcuugcccuggaugccg

SEQ ID NO: 11537 - RNA, 22 nt, Mycobacterium bovis subsp bovis AF2122/97
cggggcugccggugagugcgcg

SEQ ID NO: 11538 - RNA, 22 nt, Mycobacterium bovis subsp bovis AF2122/97
cgggucuauggguggaugcucg

SEQ ID NO: 11539 - RNA, 22 nt, Mycobacterium bovis subsp bovis AF2122/97
cggguuugguguccgcacugcu

SEQ ID NO: 11540 - RNA, 22 nt, Mycobacterium bovis subsp bovis AF2122/97
cgggcugcagcgguaguacuuu

SEQ ID NO: 11541 - RNA, 22 nt, Mycobacterium bovis subsp bovis AF2122/97
cggggaucggcacccuggccgc

SEQ ID NO: 11542 - RNA, 22 nt, Mycobacterium bovis subsp bovis AF2122/97
cgugauccacagccacccggug

SEQ ID NO: 11543 - RNA, 22 nt, Mycobacterium bovis subsp bovis AF2122/97
cggcucccgugccggugccgau

SEQ ID NO: 11544 - RNA, 22 nt, Mycobacterium bovis subsp bovis AF2122/97
cagccggcgcauggucaaagcg

SEQ ID NO: 11545 - RNA, 22 nt, Mycobacterium bovis subsp bovis AF2122/97
ccaccagcuggacgccgucgcg

SEQ ID NO: 11546 - RNA, 22 nt, Mycobacterium bovis subsp bovis AF2122/97
ccacccgcgccagccggacggc

SEQ ID NO: 11547 - RNA, 22 nt, Mycobacterium bovis subsp bovis AF2122/97
ccaccgccacggccagcaccgc

SEQ ID NO: 11548 - RNA, 22 nt, Mycobacterium bovis subsp bovis AF2122/97
cccagcaccgaccagugccggc

SEQ ID NO: 11549 - RNA, 22 nt, Mycobacterium bovis subsp bovis AF2122/97
cccagcaccugccaggacgggc

SEQ ID NO: 11550 - RNA, 22 nt, Mycobacterium bovis subsp bovis AF2122/97
ccaugccgaugacgcuguuggc

SEQ ID NO: 11551 - RNA, 22 nt, Mycobacterium bovis subsp bovis AF2122/97
ccaggccaccgcgcggccaccg

SEQ ID NO: 11552 - RNA, 22 nt, Mycobacterium bovis subsp bovis AF2122/97
ccagccugcgcaagacggugac

SEQ ID NO: 11553 - RNA, 23 nt, Mycobacterium bovis subsp bovis AF2122/97
cauccugcuggugcggaccggca

SEQ ID NO: 11554 - RNA, 22 nt, Mycobacterium bovis subsp bovis AF2122/97
ccaagcucuggauggccugccg

SEQ ID NO: 11555 - RNA, 23 nt, Mycobacterium bovis subsp bovis AF2122/97
ccagauccagccguacgacgggc

SEQ ID NO: 11556 - RNA, 22 nt, Mycobacterium bovis subsp bovis AF2122/97
cccuggugguccgaucguucau

SEQ ID NO: 11557 - RNA, 22 nt, Mycobacterium bovis subsp bovis AF2122/97
ccagcucaucgccguagcugag

SEQ ID NO: 11558 - RNA, 21 nt, Mycobacterium bovis subsp bovis AF2122/97
cccugggccgccucgcucacc

SEQ ID NO: 11559 - RNA, 22 nt, Mycobacterium bovis subsp bovis AF2122/97
ccgcccggggcauggccaagcu

SEQ ID NO: 11560 - RNA, 22 nt, Mycobacterium bovis subsp bovis AF2122/97
cccagccaggguaaggccuuug

SEQ ID NO: 11561 - RNA, 22 nt, Mycobacterium bovis subsp bovis AF2122/97
cccagcgccagcgugaucggca

SEQ ID NO: 11562 - RNA, 23 nt, Mycobacterium bovis subsp bovis AF2122/97
auggccucccggccgaugcgggc

SEQ ID NO: 11563 - RNA, 22 nt, Mycobacterium bovis subsp bovis AF2122/97
augguguacgccgcagcgcggg

SEQ ID NO: 11564 - RNA, 22 nt, Mycobacterium bovis subsp bovis AF2122/97
auuggccaggcugacagaggca

SEQ ID NO: 11565 - RNA, 22 nt, Mycobacterium bovis subsp bovis AF2122/97
cacgccggcgugcaucggugac

SEQ ID NO: 11566 - RNA, 22 nt, Mycobacterium bovis subsp bovis AF2122/97
auucucuucauggugguguuga

SEQ ID NO: 11567 - RNA, 22 nt, Mycobacterium bovis subsp bovis AF2122/97
caccugccgaucgcacagguug

SEQ ID NO: 11568 - RNA, 20 nt, Mycobacterium bovis subsp bovis AF2122/97
cacuccuggcuggauucggc

SEQ ID NO: 11569 - RNA, 22 nt, Mycobacterium bovis subsp bovis AF2122/97
caaguaguaggcgagaucaccg

SEQ ID NO: 11570 - RNA, 22 nt, Mycobacterium bovis subsp bovis AF2122/97
cacaccgcgaugacuccggcga

SEQ ID NO: 11571 - RNA, 22 nt, Mycobacterium bovis subsp bovis AF2122/97
caagaccaggacggcgccgucg

SEQ ID NO: 11572 - RNA, 22 nt, Mycobacterium bovis subsp bovis AF2122/97
agggcugccacagucgccuggg

SEQ ID NO: 11573 - RNA, 22 nt, Mycobacterium bovis subsp bovis AF2122/97
aggucaccgagaugacgucacc

SEQ ID NO: 11574 - RNA, 22 nt, Mycobacterium bovis subsp bovis AF2122/97
agucaccuacaacgggguggag

SEQ ID NO: 11575 - RNA, 22 nt, Mycobacterium bovis subsp bovis AF2122/97
agucagagucucgggcauguac

SEQ ID NO: 11576 - RNA, 22 nt, Mycobacterium bovis subsp bovis AF2122/97
aguccugggccaacugccggua

SEQ ID NO: 11577 - RNA, 22 nt, Mycobacterium bovis subsp bovis AF2122/97
agguggcgacggcguugaccga

SEQ ID NO: 11578 - RNA, 22 nt, Mycobacterium bovis subsp bovis AF2122/97
agguagacgugucccgcauggg

SEQ ID NO: 11579 - RNA, 22 nt, Mycobacterium bovis subsp bovis AF2122/97
agguugccgcacuagacugcug

SEQ ID NO: 11580 - RNA, 22 nt, Mycobacterium bovis subsp bovis AF2122/97
aguuucucagcgagcaggugcu

SEQ ID NO: 11581 - RNA, 22 nt, Mycobacterium bovis subsp bovis AF2122/97
auaccagcaauugcucgacgaa

SEQ ID NO: 11582 - RNA, 22 nt, Mycobacterium bovis subsp bovis AF2122/97
aucgcagccacggaguucgauu

SEQ ID NO: 11583 - RNA, 22 nt, Mycobacterium bovis subsp bovis AF2122/97
augaccuggcgggucgugguug

SEQ ID NO: 11584 - RNA, 22 nt, Mycobacterium bovis subsp bovis AF2122/97
auccaggcgaccggccggggua

SEQ ID NO: 11585 - RNA, 22 nt, Mycobacterium bovis subsp bovis AF2122/97
auccaggaauugucagacguua

SEQ ID NO: 11586 - RNA, 22 nt, Mycobacterium bovis subsp bovis AF2122/97
aucacgccucucgguggugggg

SEQ ID NO: 11587 - RNA, 22 nt, Mycobacterium bovis subsp bovis AF2122/97
agccaagccguaguccucgacg

SEQ ID NO: 11588 - RNA, 23 nt, Mycobacterium bovis subsp bovis AF2122/97
agauggagcucucgcuguaucgc

SEQ ID NO: 11589 - RNA, 22 nt, Mycobacterium bovis subsp bovis AF2122/97
acgccccaacaacguuucgguu

SEQ ID NO: 11590 - RNA, 22 nt, Mycobacterium bovis subsp bovis AF2122/97
acuccucagccggcggcccugg

SEQ ID NO: 11591 - RNA, 22 nt, Mycobacterium bovis subsp bovis AF2122/97
acguucugcacgcucgggccgg

SEQ ID NO: 11592 - RNA, 22 nt, Mycobacterium bovis subsp bovis AF2122/97
acugucccgagcgcaccaggaa

SEQ ID NO: 11593 - RNA, 22 nt, Mycobacterium bovis subsp bovis AF2122/97
acugcuuuccugucugggcggc

SEQ ID NO: 11594 - RNA, 22 nt, Mycobacterium bovis subsp bovis AF2122/97
acuggccagcccgcacaaccac

SEQ ID NO: 11595 - RNA, 23 nt, Mycobacterium bovis subsp bovis AF2122/97
agcaaugcgcacggcauccagcg

SEQ ID NO: 11596 - RNA, 22 nt, Mycobacterium bovis subsp bovis AF2122/97
acccagaggcuguugccgacgc

SEQ ID NO: 11597 - RNA, 22 nt, Mycobacterium bovis subsp bovis AF2122/97
acuacgucggugauuugguugc

SEQ ID NO: 11598 - RNA, 22 nt, Mycobacterium bovis subsp bovis AF2122/97
agccccagucgcuuugucucga

SEQ ID NO: 11599 - RNA, 22 nt, Mycobacterium bovis subsp bovis AF2122/97
agcucccggaugagccggcucg

SEQ ID NO: 11600 - RNA, 22 nt, Mycobacterium bovis subsp bovis AF2122/97
agccgggcaucuggaaguggcu

SEQ ID NO: 11601 - RNA, 22 nt, Mycobacterium bovis subsp bovis AF2122/97
agcccggcggugcucgaggaag

SEQ ID NO: 11602 - RNA, 22 nt, Mycobacterium bovis subsp bovis AF2122/97
aggugcgccguggcaucgccuc

SEQ ID NO: 11603 - RNA, 22 nt, Mycobacterium bovis subsp bovis AF2122/97
agcuuggaggcgaucgcgcggg

SEQ ID NO: 11604 - RNA, 22 nt, Mycobacterium bovis subsp bovis AF2122/97
aggucugucggaccuggccgcg

SEQ ID NO: 11605 - RNA, 22 nt, Mycobacterium bovis subsp bovis AF2122/97
agcagggccgcagcggcucggu

SEQ ID NO: 11606 - RNA, 22 nt, Mycobacterium bovis subsp bovis AF2122/97
agccuccagcucgcgaagccaa

SEQ ID NO: 11607 - RNA, 22 nt, Mycobacterium bovis subsp bovis AF2122/97
aacaggccuugcgagacagcac

SEQ ID NO: 11608 - RNA, 22 nt, Mycobacterium bovis subsp bovis AF2122/97
aaggcuggagcgcacagcgcgg

SEQ ID NO: 11609 - RNA, 22 nt, Mycobacterium bovis subsp bovis AF2122/97
aaguccagcagaucgaucucgc

SEQ ID NO: 11610 - RNA, 22 nt, Mycobacterium bovis subsp bovis AF2122/97
aagugcaacacgaacguuggau

SEQ ID NO: 11611 - RNA, 22 nt, Mycobacterium bovis subsp bovis AF2122/97
acaccaagcgcccgcagcuugc

SEQ ID NO: 11612 - RNA, 22 nt, Mycobacterium bovis subsp bovis AF2122/97
acaccaaggccgucagcuuggc

SEQ ID NO: 11613 - RNA, 22 nt, Mycobacterium bovis subsp bovis AF2122/97
acagcugcugguuugagucugc

SEQ ID NO: 11614 - RNA, 22 nt, Mycobacterium bovis subsp bovis AF2122/97
aaacugcaaccacgcaccgaug

SEQ ID NO: 11615 - RNA, 19 nt, Mycobacterium bovis subsp bovis AF2122/97
acccaggccgucacuucga

SEQ ID NO: 11616 - RNA, 19 nt, Mycobacterium bovis subsp bovis AF2122/97
acaggcccucgugaucacc

SEQ ID NO: 11617 - RNA, 22 nt, Mycobacterium bovis subsp bovis AF2122/97
accggccuggugcucaauagcc

SEQ ID NO: 11618 - RNA, 22 nt, Mycobacterium bovis subsp bovis AF2122/97
accaaguagcgcgacucccguu

SEQ ID NO: 11619 - RNA, 22 nt, Mycobacterium bovis subsp bovis AF2122/97
aauggggugucaccuaccugca

SEQ ID NO: 11620 - RNA, 22 nt, Mycobacterium bovis subsp bovis AF2122/97
aauccggccugugucgggucgu

SEQ ID NO: 11621 - RNA, 22 nt, Mycobacterium bovis subsp bovis AF2122/97
aauuuuacccacuugugcaucc

SEQ ID NO: 11622 - RNA, 22 nt, Mycobacterium bovis subsp bovis AF2122/97
acaagcccggcgcggugcuggu

SEQ ID NO: 11623 - RNA, 22 nt, Mycobacterium bovis subsp bovis AF2122/97
acacccaggggcugccgcagcg

SEQ ID NO: 11624 - RNA, 22 nt, Mycobacterium bovis subsp bovis AF2122/97
acagccagcugcccgguccgcc

SEQ ID NO: 11625 - RNA, 22 nt, Mycobacterium bovis subsp bovis AF2122/97
aacuccgguaguuucaacaccg

SEQ ID NO: 11626 - RNA, 22 nt, Mycobacterium bovis subsp bovis AF2122/97
aaggcagggaggaauucgacac

SEQ ID NO: 11627 - RNA, 22 nt, Mycobacterium bovis subsp bovis AF2122/97
aaggugaacucacggcgagguu

SEQ ID NO: 11628 - RNA, 22 nt, Mycobacterium bovis subsp bovis AF2122/97
aagccuuguggugcgcccauuu

SEQ ID NO: 11629 - RNA, 22 nt, Mycobacterium bovis subsp bovis AF2122/97
ggcugcgcuggcccgccgguuu

SEQ ID NO: 11630 - RNA, 22 nt, Mycobacterium bovis subsp bovis AF2122/97
ggccaggguggccuggaugagu

SEQ ID NO: 11631 - RNA, 22 nt, Mycobacterium bovis subsp bovis AF2122/97
ggcgagcagacacagagucgca

SEQ ID NO: 11632 - RNA, 22 nt, Mycobacterium bovis subsp bovis AF2122/97
ggccgcauccccgucguagcgg

SEQ ID NO: 11633 - RNA, 22 nt, Mycobacterium bovis subsp bovis AF2122/97
ggcaggaucgggaugcguccag

SEQ ID NO: 11634 - RNA, 22 nt, Mycobacterium bovis subsp bovis AF2122/97
ggccacgccgcccuugccggac

SEQ ID NO: 11635 - RNA, 22 nt, Mycobacterium bovis subsp bovis AF2122/97
ggcagcagcgagaagugcaggu

SEQ ID NO: 11636 - RNA, 22 nt, Mycobacterium bovis subsp bovis AF2122/97
ggacgaggugcgggcgcugcag

SEQ ID NO: 11637 - RNA, 22 nt, Mycobacterium bovis subsp bovis AF2122/97
ggaaguucuaucugccgccaaa

SEQ ID NO: 11638 - RNA, 22 nt, Mycobacterium bovis subsp bovis AF2122/97
ggcaccaagucaccggcaucca

SEQ ID NO: 11639 - RNA, 22 nt, Mycobacterium bovis subsp bovis AF2122/97
gcuggugguaucgcuggccaag

SEQ ID NO: 11640 - RNA, 22 nt, Mycobacterium bovis subsp bovis AF2122/97
gcugggccuuacgcaccugccg

SEQ ID NO: 11641 - RNA, 22 nt, Mycobacterium bovis subsp bovis AF2122/97
gcuggccaguucgcccugaccu

SEQ ID NO: 11642 - RNA, 22 nt, Mycobacterium bovis subsp bovis AF2122/97
gccuggacuccgcuuuuggcac

SEQ ID NO: 11643 - RNA, 22 nt, Mycobacterium bovis subsp bovis AF2122/97
gccuugaccgccuugauggcgg

SEQ ID NO: 11644 - RNA, 22 nt, Mycobacterium bovis subsp bovis AF2122/97
gccuugacgagcgggccggcaa

SEQ ID NO: 11645 - RNA, 22 nt, Mycobacterium bovis subsp bovis AF2122/97
gccuugucgagaucgucgccgu

SEQ ID NO: 11646 - RNA, 22 nt, Mycobacterium bovis subsp bovis AF2122/97
gccgccaccgcuaccacccgug

SEQ ID NO: 11647 - RNA, 22 nt, Mycobacterium bovis subsp bovis AF2122/97
gccgcccaauucuccggucgcg

SEQ ID NO: 11648 - RNA, 22 nt, Mycobacterium bovis subsp bovis AF2122/97
gcucagccgugugcggauacuu

SEQ ID NO: 11649 - RNA, 22 nt, Mycobacterium bovis subsp bovis AF2122/97
gcgaaacacgggaucgggcgag

SEQ ID NO: 11650 - RNA, 22 nt, Mycobacterium bovis subsp bovis AF2122/97
gcgauagccgaaccacccgccg

SEQ ID NO: 11651 - RNA, 22 nt, Mycobacterium bovis subsp bovis AF2122/97
gcgccacuggggucaccgacgg

SEQ ID NO: 11652 - RNA, 22 nt, Mycobacterium bovis subsp bovis AF2122/97
ucggggacuucugcgucugcuc

SEQ ID NO: 11653 - RNA, 22 nt, Mycobacterium bovis subsp bovis AF2122/97
ucggugacggacugcacagcga

SEQ ID NO: 11654 - RNA, 22 nt, Mycobacterium bovis subsp bovis AF2122/97
ucgguggcgccgacaugccggu

SEQ ID NO: 11655 - RNA, 22 nt, Mycobacterium bovis subsp bovis AF2122/97
ucggccucccaugcggcgaucu

SEQ ID NO: 11656 - RNA, 22 nt, Mycobacterium bovis subsp bovis AF2122/97
ucgauguuccgcagcuucgucg

SEQ ID NO: 11657 - RNA, 22 nt, Mycobacterium bovis subsp bovis AF2122/97
uccagcacugucuuggcuucgg

SEQ ID NO: 11658 - RNA, 22 nt, Mycobacterium bovis subsp bovis AF2122/97
uccugcgcgugguacucgucgg

SEQ ID NO: 11659 - RNA, 22 nt, Mycobacterium bovis subsp bovis AF2122/97
uccugcaggcgaucgcccuggc

SEQ ID NO: 11660 - RNA, 22 nt, Mycobacterium bovis subsp bovis AF2122/97
ucagcgucgaugaccaugucga

SEQ ID NO: 11661 - RNA, 22 nt, Mycobacterium bovis subsp bovis AF2122/97
ucaccugcccggcaccuggagc

SEQ ID NO: 11662 - RNA, 22 nt, Mycobacterium bovis subsp bovis AF2122/97
ucacgccggggcuggagucacc

SEQ ID NO: 11663 - RNA, 18 nt, Mycobacterium bovis subsp bovis AF2122/97
ucacugcugcggucuggg

SEQ ID NO: 11664 - RNA, 22 nt, Mycobacterium bovis subsp bovis AF2122/97
ucagccgcaagcaccgucagcg

SEQ ID NO: 11665 - RNA, 22 nt, Mycobacterium bovis subsp bovis AF2122/97
ucacccccgagguggccacgcg

SEQ ID NO: 11666 - RNA, 22 nt, Mycobacterium bovis subsp bovis AF2122/97
ucaccgccgcgguuggugcgca

SEQ ID NO: 11667 - RNA, 22 nt, Mycobacterium bovis subsp bovis AF2122/97
uaagcugcgccagccacgccgu

SEQ ID NO: 11668 - RNA, 22 nt, Mycobacterium bovis subsp bovis AF2122/97
uaaaagaacuuugcauccgugc

SEQ ID NO: 11669 - RNA, 22 nt, Mycobacterium bovis subsp bovis AF2122/97
uauguucaauaaaucauuaugu

SEQ ID NO: 11670 - RNA, 22 nt, Mycobacterium bovis subsp bovis AF2122/97
uauucaucgaguacagcugaau

SEQ ID NO: 11671 - RNA, 22 nt, Mycobacterium bovis subsp bovis AF2122/97
gugcugguggucagugacgccg

SEQ ID NO: 11672 - RNA, 22 nt, Mycobacterium bovis subsp bovis AF2122/97
gucgguggccgcugccaugucg

SEQ ID NO: 11673 - RNA, 22 nt, Mycobacterium bovis subsp bovis AF2122/97
guccucaagccggcguuccagc

SEQ ID NO: 11674 - RNA, 22 nt, Mycobacterium bovis subsp bovis AF2122/97
gucgaggugaccagcggugagg

SEQ ID NO: 11675 - RNA, 22 nt, Mycobacterium bovis subsp bovis AF2122/97
gucugagagccccggaaagcgc

SEQ ID NO: 11676 - RNA, 22 nt, Mycobacterium bovis subsp bovis AF2122/97
gucuggaugaaagccuuguuga

SEQ ID NO: 11677 - RNA, 22 nt, Mycobacterium bovis subsp bovis AF2122/97
guggugguguaggucucgaugc

SEQ ID NO: 11678 - RNA, 22 nt, Mycobacterium bovis subsp bovis AF2122/97
guggugggaaccgcuccagggc

SEQ ID NO: 11679 - RNA, 22 nt, Mycobacterium bovis subsp bovis AF2122/97
gugguggccguggccgcgucgu

SEQ ID NO: 11680 - RNA, 22 nt, Mycobacterium bovis subsp bovis AF2122/97
gugguggcgcaauucgaccagg

SEQ ID NO: 11681 - RNA, 22 nt, Mycobacterium bovis subsp bovis AF2122/97
guugucuugcucgcuuuggcug

SEQ ID NO: 11682 - RNA, 22 nt, Mycobacterium bovis subsp bovis AF2122/97
guugugaacggaaccgccggga

SEQ ID NO: 11683 - RNA, 22 nt, Mycobacterium bovis subsp bovis AF2122/97
guuguucaacgccgucaauguu

SEQ ID NO: 11684 - RNA, 22 nt, Mycobacterium bovis subsp bovis AF2122/97
guuugguugccuaccgcguggg

SEQ ID NO: 11685 - RNA, 22 nt, Mycobacterium bovis subsp bovis AF2122/97
gggcugcccaaucagcgcugcg

SEQ ID NO: 11686 - RNA, 22 nt, Mycobacterium bovis subsp bovis AF2122/97
gggcuggaccgcgaggagcugc

SEQ ID NO: 11687 - RNA, 22 nt, Mycobacterium bovis subsp bovis AF2122/97
ggcuggcuugccgacauucagc

SEQ ID NO: 11688 - RNA, 22 nt, Mycobacterium bovis subsp bovis AF2122/97
gggcucggccaguugcuccugg

SEQ ID NO: 11689 - RNA, 22 nt, Mycobacterium bovis subsp bovis AF2122/97
gggguggugaaguacacgcccg

SEQ ID NO: 11690 - RNA, 22 nt, Mycobacterium bovis subsp bovis AF2122/97
gggcacaggccgauggcgcuga

SEQ ID NO: 11691 - RNA, 22 nt, Mycobacterium bovis subsp bovis AF2122/97
gggcagcaggaugcgccugcga

SEQ ID NO: 11692 - RNA, 22 nt, Mycobacterium bovis subsp bovis AF2122/97
gggucacgaucgccgccggcgc

SEQ ID NO: 11693 - RNA, 22 nt, Mycobacterium bovis subsp bovis AF2122/97
ggucgcgcccgcagccgguggu

SEQ ID NO: 11694 - RNA, 20 nt, Mycobacterium bovis subsp bovis AF2122/97
ggucacccugggugagccgg

SEQ ID NO: 11695 - RNA, 22 nt, Mycobacterium bovis subsp bovis AF2122/97
ggugguggcccgugaccguacc

SEQ ID NO: 11696 - RNA, 22 nt, Mycobacterium bovis subsp bovis AF2122/97
ggugguggugccgucgucgcgc

SEQ ID NO: 11697 - RNA, 22 nt, Mycobacterium bovis subsp bovis AF2122/97
ggugguuucguggccggcgagc

SEQ ID NO: 11698 - RNA, 22 nt, Mycobacterium bovis subsp bovis AF2122/97
ggugcuuuugcgucugcucggc

SEQ ID NO: 11699 - RNA, 22 nt, Mycobacterium bovis subsp bovis AF2122/97
gguguaggucguugccgaccuc

SEQ ID NO: 11700 - RNA, 22 nt, Mycobacterium bovis subsp bovis AF2122/97
guccaagcagcgacuagucaag

SEQ ID NO: 11701 - RNA, 22 nt, Mycobacterium bovis subsp bovis AF2122/97
guccagcagcccggucuggugu

SEQ ID NO: 11702 - RNA, 22 nt, Mycobacterium bovis subsp bovis AF2122/97
gucaccuugcaccuggccgccg

SEQ ID NO: 11703 - RNA, 22 nt, Mycobacterium bovis subsp bovis AF2122/97
cgcccgccaaggacuuccgcgc

SEQ ID NO: 11704 - RNA, 21 nt, Mycobacterium bovis subsp bovis AF2122/97
cgccccagaugcacgcucggc

SEQ ID NO: 11705 - RNA, 22 nt, Mycobacterium bovis subsp bovis AF2122/97
cgccucccgggcugggcugguu

SEQ ID NO: 11706 - RNA, 17 nt, Mycobacterium bovis subsp bovis AF2122/97
cgccuggcgcugacccc

SEQ ID NO: 11707 - RNA, 22 nt, Mycobacterium bovis subsp bovis AF2122/97
cgccugggccagugccgacuuc

SEQ ID NO: 11708 - RNA, 22 nt, Mycobacterium bovis subsp bovis AF2122/97
cgcugggcagucucgaggaccu

SEQ ID NO: 11709 - RNA, 22 nt, Mycobacterium bovis subsp bovis AF2122/97
cgccuuggacgacgguuccgau

SEQ ID NO: 11710 - RNA, 22 nt, Mycobacterium bovis subsp bovis AF2122/97
cgcccggccgcuggucgcguac

SEQ ID NO: 11711 - RNA, 22 nt, Mycobacterium bovis subsp bovis AF2122/97
cgcucagggcgucaccgccccg

SEQ ID NO: 11712 - RNA, 22 nt, Mycobacterium bovis subsp bovis AF2122/97
cgcucgagauugcagcgggccc

SEQ ID NO: 11713 - RNA, 22 nt, Mycobacterium bovis subsp bovis AF2122/97
cgccagcaccaccugguugggc

SEQ ID NO: 11714 - RNA, 22 nt, Mycobacterium bovis subsp bovis AF2122/97
cgccaagccgcaaggcucggcg

SEQ ID NO: 11715 - RNA, 22 nt, Mycobacterium bovis subsp bovis AF2122/97
cgaccugccgcagcguugcuau

SEQ ID NO: 11716 - RNA, 22 nt, Mycobacterium bovis subsp bovis AF2122/97
ccugucucggcaagccuggucg

SEQ ID NO: 11717 - RNA, 22 nt, Mycobacterium bovis subsp bovis AF2122/97
ccugggaucgaggggucuucau

SEQ ID NO: 11718 - RNA, 22 nt, Mycobacterium bovis subsp bovis AF2122/97
ccguugacgaaccggaccaauc

SEQ ID NO: 11719 - RNA, 22 nt, Mycobacterium bovis subsp bovis AF2122/97
ccgcccaggcucccgcucgacg

SEQ ID NO: 11720 - RNA, 22 nt, Mycobacterium bovis subsp bovis AF2122/97
ccccuaccgucgauguggcggg

SEQ ID NO: 11721 - RNA, 22 nt, Mycobacterium bovis subsp bovis AF2122/97
ccagccgccagcaucucggauc

SEQ ID NO: 11722 - RNA, 22 nt, Mycobacterium bovis subsp bovis AF2122/97
ccagcagugcgggcgaucguga

SEQ ID NO: 11723 - RNA, 22 nt, Mycobacterium bovis subsp bovis AF2122/97
ccagcagcgcguacagcaucga

SEQ ID NO: 11724 - RNA, 22 nt, Mycobacterium bovis subsp bovis AF2122/97
ccaccaugcgcgccuacgcgaa

SEQ ID NO: 11725 - RNA, 22 nt, Mycobacterium bovis subsp bovis AF2122/97
cauggaaacgcaggugguguca

SEQ ID NO: 11726 - RNA, 22 nt, Mycobacterium bovis subsp bovis AF2122/97
ccaaugggauguugccgagcau

SEQ ID NO: 11727 - RNA, 22 nt, Mycobacterium bovis subsp bovis AF2122/97
caugcaucggaagaaccggcau

SEQ ID NO: 11728 - RNA, 22 nt, Mycobacterium bovis subsp bovis AF2122/97
cauugcaccggugcgcucggcg

SEQ ID NO: 11729 - RNA, 22 nt, Mycobacterium bovis subsp bovis AF2122/97
caugacuuccagcaacgccgac

SEQ ID NO: 11730 - RNA, 22 nt, Mycobacterium bovis subsp bovis AF2122/97
caggcgaaucaccccgccgcgc

SEQ ID NO: 11731 - RNA, 22 nt, Mycobacterium bovis subsp bovis AF2122/97
caggauauccaggcggcagcag

SEQ ID NO: 11732 - RNA, 22 nt, Mycobacterium bovis subsp bovis AF2122/97
caggggcucgauccggccgggc

SEQ ID NO: 11733 - RNA, 22 nt, Mycobacterium bovis subsp bovis AF2122/97
caguucggucucuauccgccgc

SEQ ID NO: 11734 - RNA, 22 nt, Mycobacterium bovis subsp bovis AF2122/97
cauccagcaguacgaggacggg

SEQ ID NO: 11735 - RNA, 22 nt, Mycobacterium bovis subsp bovis AF2122/97
cauccaggcgaugguggcaacc

SEQ ID NO: 11736 - RNA, 22 nt, Mycobacterium bovis subsp bovis AF2122/97
caucuguuggcgcucucggccu

SEQ ID NO: 11737 - RNA, 22 nt, Mycobacterium bovis subsp bovis AF2122/97
ccagcuugucgccacgaaccuu

SEQ ID NO: 11738 - RNA, 22 nt, Mycobacterium bovis subsp bovis AF2122/97
ccaugagcacccggauggccug

SEQ ID NO: 11739 - RNA, 22 nt, Mycobacterium bovis subsp bovis AF2122/97
ccaggugcauugugcaccacau

SEQ ID NO: 11740 - RNA, 22 nt, Mycobacterium bovis subsp bovis AF2122/97
ccaggugccgucggguuguucg

SEQ ID NO: 11741 - RNA, 22 nt, Mycobacterium bovis subsp bovis AF2122/97
cccgcgccgggauagucaccgc

SEQ ID NO: 11742 - RNA, 22 nt, Mycobacterium bovis subsp bovis AF2122/97
gcaccccagagcacugauacgc

SEQ ID NO: 11743 - RNA, 22 nt, Mycobacterium bovis subsp bovis AF2122/97
gcacggguucguugcugugcau

SEQ ID NO: 11744 - RNA, 22 nt, Mycobacterium bovis subsp bovis AF2122/97
gauggcgaugcgcaccccgucg

SEQ ID NO: 11745 - RNA, 22 nt, Mycobacterium bovis subsp bovis AF2122/97
gagaugagccgaaauuacccug

SEQ ID NO: 11746 - RNA, 22 nt, Mycobacterium bovis subsp bovis AF2122/97
gagggacuuaugcgucugcuag

SEQ ID NO: 11747 - RNA, 22 nt, Mycobacterium bovis subsp bovis AF2122/97
gagacccaucagagccgagucg

SEQ ID NO: 11748 - RNA, 22 nt, Mycobacterium bovis subsp bovis AF2122/97
gacugcccaggcugcgcguggc

SEQ ID NO: 11749 - RNA, 22 nt, Mycobacterium bovis subsp bovis AF2122/97
gccgcaccgacuaccaccgacu

SEQ ID NO: 11750 - RNA, 22 nt, Mycobacterium bovis subsp bovis AF2122/97
gcagagccgaucguccuguugc

SEQ ID NO: 11751 - RNA, 22 nt, Mycobacterium bovis subsp bovis AF2122/97
gcagaugagugcagaggaucuc

SEQ ID NO: 11752 - RNA, 22 nt, Mycobacterium bovis subsp bovis AF2122/97
gcagcgugucaccgucgaggac

SEQ ID NO: 11753 - RNA, 21 nt, Mycobacterium bovis subsp bovis AF2122/97
gccagcacgguguucaaguug

SEQ ID NO: 11754 - RNA, 22 nt, Mycobacterium bovis subsp bovis AF2122/97
gccagaacugccggccccaggg

SEQ ID NO: 11755 - RNA, 22 nt, Mycobacterium bovis subsp bovis AF2122/97
gccagcagcucggcgauaucgg

SEQ ID NO: 11756 - RNA, 22 nt, Mycobacterium bovis subsp bovis AF2122/97
gccaccacucaggccgcgguca

SEQ ID NO: 11757 - RNA, 22 nt, Mycobacterium bovis subsp bovis AF2122/97
gccaagacgcgucggggccacc

SEQ ID NO: 11758 - RNA, 22 nt, Mycobacterium bovis subsp bovis AF2122/97
gcauccagggggccgacgcauu

SEQ ID NO: 11759 - RNA, 22 nt, Mycobacterium bovis subsp bovis AF2122/97
cguggaaugcaugaucgucgcc

SEQ ID NO: 11760 - RNA, 22 nt, Mycobacterium bovis subsp bovis AF2122/97
cgugggccugagcagcgacgac

SEQ ID NO: 11761 - RNA, 22 nt, Mycobacterium bovis subsp bovis AF2122/97
cguucagcacggccgacagcga

SEQ ID NO: 11762 - RNA, 22 nt, Mycobacterium bovis subsp bovis AF2122/97
cuaccagccggcgcagcagcgc

SEQ ID NO: 11763 - RNA, 22 nt, Mycobacterium bovis subsp bovis AF2122/97
cggucaccuucgcaucggugau

SEQ ID NO: 11764 - RNA, 22 nt, Mycobacterium bovis subsp bovis AF2122/97
cggcagcacgagcucgucgugg

SEQ ID NO: 11765 - RNA, 22 nt, Mycobacterium bovis subsp bovis AF2122/97
cggcucaggcuuaugcagccgu

SEQ ID NO: 11766 - RNA, 22 nt, Mycobacterium bovis subsp bovis AF2122/97
cggcugcagugcgacgacgaga

SEQ ID NO: 11767 - RNA, 17 nt, Mycobacterium bovis subsp bovis AF2122/97
cuggucacgaucauggc

SEQ ID NO: 11768 - RNA, 22 nt, Mycobacterium bovis subsp bovis AF2122/97
cugccacuggugucacgucaug

SEQ ID NO: 11769 - RNA, 22 nt, Mycobacterium bovis subsp bovis AF2122/97
cggucaccaucucgcagacaua

SEQ ID NO: 11770 - RNA, 22 nt, Mycobacterium bovis subsp bovis AF2122/97
cuugggcguuugcguucgccgc

SEQ ID NO: 11771 - RNA, 22 nt, Mycobacterium bovis subsp bovis AF2122/97
cuguggaguucggcgguguccu

SEQ ID NO: 11772 - RNA, 22 nt, Mycobacterium bovis subsp bovis AF2122/97
gaagcugcugggccaguucgug

SEQ ID NO: 11773 - RNA, 22 nt, Mycobacterium bovis subsp bovis AF2122/97
gaagccagugugaccgccugga

SEQ ID NO: 11774 - RNA, 22 nt, Mycobacterium bovis subsp bovis AF2122/97
gacagcuuucagcgaaucaccg

SEQ ID NO: 11775 - RNA, 20 nt, Mycobacterium bovis subsp bovis AF2122/97
ucuggccaaggugucgagca

SEQ ID NO: 11776 - RNA, 22 nt, Mycobacterium bovis subsp bovis AF2122/97
ucuggccgggcggcauggagau

SEQ ID NO: 11777 - RNA, 22 nt, Mycobacterium bovis subsp bovis AF2122/97
ucgguggccagcgaggcgccgg

SEQ ID NO: 11778 - RNA, 19 nt, Mycobacterium bovis subsp bovis AF2122/97
ucguccugcugugggugac

SEQ ID NO: 11779 - RNA, 22 nt, Mycobacterium bovis subsp bovis AF2122/97
ucguggcccucccggcggccac

SEQ ID NO: 11780 - RNA, 22 nt, Mycobacterium bovis subsp bovis AF2122/97
ucccgggcaucggcauccccgg

SEQ ID NO: 11781 - RNA, 22 nt, Mycobacterium bovis subsp bovis AF2122/97
ucgagcucccggugagacgaga

SEQ ID NO: 11782 - RNA, 22 nt, Mycobacterium bovis subsp bovis AF2122/97
ucgaggacggugucgagccccg

SEQ ID NO: 11783 - RNA, 22 nt, Mycobacterium bovis subsp bovis AF2122/97
uccuuuccgucgaugcggaagc

SEQ ID NO: 11784 - RNA, 22 nt, Mycobacterium bovis subsp bovis AF2122/97
ucgaaacccagccaccucuugg

SEQ ID NO: 11785 - RNA, 22 nt, Mycobacterium bovis subsp bovis AF2122/97
ucgcgccaguguccgccgccga

SEQ ID NO: 11786 - RNA, 22 nt, Mycobacterium bovis subsp bovis AF2122/97
ucgcgccaucggcuacaccagc

SEQ ID NO: 11787 - RNA, 19 nt, Mycobacterium bovis subsp bovis AF2122/97
ucagcuguacucgaugaau

SEQ ID NO: 11788 - RNA, 22 nt, Mycobacterium bovis subsp bovis AF2122/97
ucagcugucaugguuggugauu

SEQ ID NO: 11789 - RNA, 22 nt, Mycobacterium bovis subsp bovis AF2122/97
ucagcuguguccgcacaaccgg

SEQ ID NO: 11790 - RNA, 22 nt, Mycobacterium bovis subsp bovis AF2122/97
ucaggcugggcgaaccugggca

SEQ ID NO: 11791 - RNA, 22 nt, Mycobacterium bovis subsp bovis AF2122/97
ucaccaccggcacccaaggcga

SEQ ID NO: 11792 - RNA, 22 nt, Mycobacterium bovis subsp bovis AF2122/97
uaucuggcccaaggggcgcuuc

SEQ ID NO: 11793 - RNA, 22 nt, Mycobacterium bovis subsp bovis AF2122/97
uccagcacuucuggggggaucc

SEQ ID NO: 11794 - RNA, 22 nt, Mycobacterium bovis subsp bovis AF2122/97
uccagcagcaacgccaagucgc

SEQ ID NO: 11795 - RNA, 22 nt, Mycobacterium bovis subsp bovis AF2122/97
uccagcagcacgucggugcgau

SEQ ID NO: 11796 - RNA, 23 nt, Mycobacterium bovis subsp bovis AF2122/97
ucccagaggcgagucaccuguuc

SEQ ID NO: 11797 - RNA, 23 nt, Mycobacterium bovis subsp bovis AF2122/97
ucccaggugccauacgagcugaa

SEQ ID NO: 11798 - RNA, 22 nt, Mycobacterium bovis subsp bovis AF2122/97
uagguaaauaaauccguguuug

SEQ ID NO: 11799 - RNA, 22 nt, Mycobacterium bovis subsp bovis AF2122/97
uggaaaaacggcggccccgacc

SEQ ID NO: 11800 - RNA, 22 nt, Mycobacterium bovis subsp bovis AF2122/97
uggcccacugcaaccggaccuc

SEQ ID NO: 11801 - RNA, 22 nt, Mycobacterium bovis subsp bovis AF2122/97
uggccagaucuccccgcgggcc

SEQ ID NO: 11802 - RNA, 22 nt, Mycobacterium bovis subsp bovis AF2122/97
uggcgcugugcugcucgacgug

SEQ ID NO: 11803 - RNA, 22 nt, Mycobacterium bovis subsp bovis AF2122/97
uggcugggcgaccgcggugucg

SEQ ID NO: 11804 - RNA, 22 nt, Mycobacterium bovis subsp bovis AF2122/97
uggcuggucggaccgucagcga

SEQ ID NO: 11805 - RNA, 22 nt, Mycobacterium bovis subsp bovis AF2122/97
uggcucagcgggucaacgaggc

SEQ ID NO: 11806 - RNA, 22 nt, Mycobacterium bovis subsp bovis AF2122/97
ugggacagcuggaaguuaucgg

SEQ ID NO: 11807 - RNA, 22 nt, Mycobacterium bovis subsp bovis AF2122/97
ugggcaugaucuguggaucagg

SEQ ID NO: 11808 - RNA, 22 nt, Mycobacterium bovis subsp bovis AF2122/97
uggucaccgucgccgcaaucga

SEQ ID NO: 11809 - RNA, 23 nt, Mycobacterium bovis subsp bovis AF2122/97
ugggcucaggauguggcugcgau

SEQ ID NO: 11810 - RNA, 22 nt, Mycobacterium bovis subsp bovis AF2122/97
ugggcugaacaggacggccgcc

SEQ ID NO: 11811 - RNA, 22 nt, Mycobacterium bovis subsp bovis AF2122/97
ugguggcgugcagcgccaucuc

SEQ ID NO: 11812 - RNA, 22 nt, Mycobacterium bovis subsp bovis AF2122/97
uggucggcgaguucgccgugca

SEQ ID NO: 11813 - RNA, 22 nt, Mycobacterium bovis subsp bovis AF2122/97
ugaccugacgcggcuccggcgc

SEQ ID NO: 11814 - RNA, 22 nt, Mycobacterium bovis subsp bovis AF2122/97
ugaaggucuugugcccguugag

SEQ ID NO: 11815 - RNA, 19 nt, Mycobacterium bovis subsp bovis AF2122/97
ugcacuccaccgcuggcgc

SEQ ID NO: 11816 - RNA, 22 nt, Mycobacterium bovis subsp bovis AF2122/97
ugcacuccgacccgccgacguu

SEQ ID NO: 11817 - RNA, 22 nt, Mycobacterium bovis subsp bovis AF2122/97
ugcacgccucaaagccgaugag

SEQ ID NO: 11818 - RNA, 22 nt, Mycobacterium bovis subsp bovis AF2122/97
ugcccaacucggccagaauguu

SEQ ID NO: 11819 - RNA, 22 nt, Mycobacterium bovis subsp bovis AF2122/97
ugaucucacccgaaguuguguc

SEQ ID NO: 11820 - RNA, 22 nt, Mycobacterium bovis subsp bovis AF2122/97
ugagguuucaucgaucggccug

SEQ ID NO: 11821 - RNA, 22 nt, Mycobacterium bovis subsp bovis AF2122/97
ugccgccaccaggcagccggug

SEQ ID NO: 11822 - RNA, 22 nt, Mycobacterium bovis subsp bovis AF2122/97
ugcgccaccgccagaggauaac

SEQ ID NO: 11823 - RNA, 22 nt, Mycobacterium bovis subsp bovis AF2122/97
ugcgcgccuugauccggcuguc

SEQ ID NO: 11824 - RNA, 22 nt, Mycobacterium bovis subsp bovis AF2122/97
cacugacuagugaagaaccuuu

SEQ ID NO: 11825 - RNA, 22 nt, Mycobacterium bovis subsp bovis AF2122/97
caggaugacgccgcagcgcucg

SEQ ID NO: 11826 - RNA, 22 nt, Mycobacterium bovis subsp bovis AF2122/97
cagcguugucucggcgaacacc

SEQ ID NO: 11827 - RNA, 22 nt, Mycobacterium bovis subsp bovis AF2122/97
cagccagggucagcacgcggau

SEQ ID NO: 11828 - RNA, 22 nt, Mycobacterium bovis subsp bovis AF2122/97
cagcucccaacgguggccccgg

SEQ ID NO: 11829 - RNA, 22 nt, Mycobacterium bovis subsp bovis AF2122/97
caccagggugcugccggugauu

SEQ ID NO: 11830 - RNA, 22 nt, Mycobacterium bovis subsp bovis AF2122/97
cacgagcguaaccccagugcga

SEQ ID NO: 11831 - RNA, 22 nt, Mycobacterium bovis subsp bovis AF2122/97
cacgccagcgucccggguugcu

SEQ ID NO: 11832 - RNA, 22 nt, Mycobacterium bovis subsp bovis AF2122/97
caauguuucgacgggcaccaaa

SEQ ID NO: 11833 - RNA, 22 nt, Mycobacterium bovis subsp bovis AF2122/97
caaauauuucguggcgaugcgc

SEQ ID NO: 11834 - RNA, 21 nt, Mycobacterium bovis subsp bovis AF2122/97
auuugcaacgcaacggcgugc

SEQ ID NO: 11835 - RNA, 22 nt, Mycobacterium bovis subsp bovis AF2122/97
auuccguugcgccuauuugaaa

SEQ ID NO: 11836 - RNA, 22 nt, Mycobacterium bovis subsp bovis AF2122/97
augguguagaucuuggucgggu

SEQ ID NO: 11837 - RNA, 22 nt, Mycobacterium bovis subsp bovis AF2122/97
auggccaaccucccgacuggua

SEQ ID NO: 11838 - RNA, 22 nt, Mycobacterium bovis subsp bovis AF2122/97
augaggcgauuuugcgucugcu

SEQ ID NO: 11839 - RNA, 22 nt, Mycobacterium bovis subsp bovis AF2122/97
augaaaccgguggccaugccgc

SEQ ID NO: 11840 - RNA, 22 nt, Mycobacterium bovis subsp bovis AF2122/97
aucugcagguuccuggguugac

SEQ ID NO: 11841 - RNA, 22 nt, Mycobacterium bovis subsp bovis AF2122/97
aucuaaaccgacgcgcacgaga

SEQ ID NO: 11842 - RNA, 22 nt, Mycobacterium bovis subsp bovis AF2122/97
aucaccuuccucggcaugagau

SEQ ID NO: 11843 - RNA, 22 nt, Mycobacterium bovis subsp bovis AF2122/97
aucaccaccgagaugccgaacc

SEQ ID NO: 11844 - RNA, 23 nt, Mycobacterium bovis subsp bovis AF2122/97
ugguggucaccccgacgacgcuc

SEQ ID NO: 11845 - RNA, 22 nt, Mycobacterium bovis subsp bovis AF2122/97
ugguggcugugucgaccgggaa

SEQ ID NO: 11846 - RNA, 22 nt, Mycobacterium bovis subsp bovis AF2122/97
ugguuggugccgaacugcaucu

SEQ ID NO: 11847 - RNA, 22 nt, Mycobacterium bovis subsp bovis AF2122/97
ugguuucccgugaggugaucgc

SEQ ID NO: 11848 - RNA, 22 nt, Mycobacterium bovis subsp bovis AF2122/97
ugguuucccuacccgggcagca

SEQ ID NO: 11849 - RNA, 22 nt, Mycobacterium bovis subsp bovis AF2122/97
ugucgcgcaagcucuccggcac

SEQ ID NO: 11850 - RNA, 22 nt, Mycobacterium bovis subsp bovis AF2122/97
uuccagccacagcccggcggcg

SEQ ID NO: 11851 - RNA, 22 nt, Mycobacterium bovis subsp bovis AF2122/97
uucagcagggugauguccagcc

SEQ ID NO: 11852 - RNA, 22 nt, Mycobacterium bovis subsp bovis AF2122/97
uucaggcuacgguagcggugcg

SEQ ID NO: 11853 - RNA, 22 nt, Mycobacterium bovis subsp bovis AF2122/97
uugaggaucagguucagcuggc

SEQ ID NO: 11854 - RNA, 22 nt, Mycobacterium bovis subsp bovis AF2122/97
uugauccagggugcgugguugg

SEQ ID NO: 11855 - RNA, 22 nt, Mycobacterium bovis subsp bovis AF2122/97
uugaugaugcggauccggauuc

SEQ ID NO: 11856 - RNA, 22 nt, Mycobacterium bovis subsp bovis AF2122/97
uuugauauccgcaaccugcggu

SEQ ID NO: 11857 - RNA, 22 nt, Mycobacterium bovis subsp bovis AF2122/97
uuucagguccagcuuccgucga

SEQ ID NO: 11858 - RNA, 22 nt, Mycobacterium bovis subsp bovis AF2122/97
uugucgccgucucgguccagcu

SEQ ID NO: 11859 - RNA, 22 nt, Mycobacterium bovis subsp bovis AF2122/97
uugucgccgugcaccaccugga

SEQ ID NO: 11860 - RNA, 22 nt, Mycobacterium bovis subsp bovis AF2122/97
uugucaccgcuuccauggcguu

SEQ ID NO: 11861 - RNA, 22 nt, Mycobacterium bovis subsp bovis AF2122/97
uuggucaccuccgagcccacgg

SEQ ID NO: 11862 - RNA, 22 nt, Mycobacterium bovis subsp bovis AF2122/97
uuggcagcgugaaguguucggg

SEQ ID NO: 11863 - RNA, 22 nt, Mycobacterium bovis subsp bovis AF2122/97
uuggcaguccagccgggugccg

SEQ ID NO: 11864 - RNA, 22 nt, Mycobacterium bovis subsp bovis AF2122/97
uuggccaacccgguguuggcau

SEQ ID NO: 11865 - RNA, 22 nt, Mycobacterium bovis subsp bovis AF2122/97
uuggccgcggcccaugcuggcg

SEQ ID NO: 11866 - RNA, 22 nt, Mycobacterium bovis subsp bovis AF2122/97
uugcccaagcccggcggaccgg

SEQ ID NO: 11867 - RNA, 19 nt, Mycobacterium bovis subsp bovis AF2122/97
gggaucuuggggcugcccc

SEQ ID NO: 11868 - RNA, 22 nt, Mycobacterium bovis subsp bovis AF2122/97
ggcccggcucgccacgaggagg

SEQ ID NO: 11869 - RNA, 22 nt, Mycobacterium bovis subsp bovis AF2122/97
ggcccggcugccggcuacggcg

SEQ ID NO: 11870 - RNA, 22 nt, Mycobacterium bovis subsp bovis AF2122/97
ggcccggcugcgcgucguguca

SEQ ID NO: 11871 - RNA, 22 nt, Mycobacterium bovis subsp bovis AF2122/97
ggcguggucaccggcguggucg

SEQ ID NO: 11872 - RNA, 22 nt, Mycobacterium bovis subsp bovis AF2122/97
ggcgugguuggcgauggcacgu

SEQ ID NO: 11873 - RNA, 22 nt, Mycobacterium bovis subsp bovis AF2122/97
ggccagggccgacggcacaucc

SEQ ID NO: 11874 - RNA, 22 nt, Mycobacterium bovis subsp bovis AF2122/97
ggccacucguccggcgauggcg

SEQ ID NO: 11875 - RNA, 23 nt, Mycobacterium bovis subsp bovis AF2122/97
ggccaaggagcacgaccucaacu

SEQ ID NO: 11876 - RNA, 22 nt, Mycobacterium bovis subsp bovis AF2122/97
ggauauugcccuggcgguggcu

SEQ ID NO: 11877 - RNA, 22 nt, Mycobacterium bovis subsp bovis AF2122/97
ggcaacaccuuucccccuucga

SEQ ID NO: 11878 - RNA, 22 nt, Mycobacterium bovis subsp bovis AF2122/97
ggcagcgcccgggucaccagcc

SEQ ID NO: 11879 - RNA, 22 nt, Mycobacterium bovis subsp bovis AF2122/97
ggcagagccagcgcacggaaau

SEQ ID NO: 11880 - RNA, 22 nt, Mycobacterium bovis subsp bovis AF2122/97
gcuggccagggcguuuccgcuc

SEQ ID NO: 11881 - RNA, 22 nt, Mycobacterium bovis subsp bovis AF2122/97
gcugcgucgggccucggaaugg

SEQ ID NO: 11882 - RNA, 22 nt, Mycobacterium bovis subsp bovis AF2122/97
gcuggccuuacugcccgacguc

SEQ ID NO: 11883 - RNA, 22 nt, Mycobacterium bovis subsp bovis AF2122/97
gcuuuuaugacugcucggcggg

SEQ ID NO: 11884 - RNA, 22 nt, Mycobacterium bovis subsp bovis AF2122/97
gcuuaugugacgacccccagcg

SEQ ID NO: 11885 - RNA, 22 nt, Mycobacterium bovis subsp bovis AF2122/97
gggcuacaccucgacgaggccg

SEQ ID NO: 11886 - RNA, 22 nt, Mycobacterium bovis subsp bovis AF2122/97
gggcgggucagggccugcacga

SEQ ID NO: 11887 - RNA, 22 nt, Mycobacterium bovis subsp bovis AF2122/97
ggguggugaaguuggcggccgg

SEQ ID NO: 11888 - RNA, 22 nt, Mycobacterium bovis subsp bovis AF2122/97
gggugguggucgccaacgccga

SEQ ID NO: 11889 - RNA, 22 nt, Mycobacterium bovis subsp bovis AF2122/97
gggguuggugauguagccgaua

SEQ ID NO: 11890 - RNA, 22 nt, Mycobacterium bovis subsp bovis AF2122/97
ggucagcacgcaugugcggugg

SEQ ID NO: 11891 - RNA, 22 nt, Mycobacterium bovis subsp bovis AF2122/97
ggucgugguggugcucaacucg

SEQ ID NO: 11892 - RNA, 22 nt, Mycobacterium bovis subsp bovis AF2122/97
gguggcgcacaucgccgugcac

SEQ ID NO: 11893 - RNA, 22 nt, Mycobacterium bovis subsp bovis AF2122/97
gguggcguggucgccgaugucc

SEQ ID NO: 11894 - RNA, 22 nt, Mycobacterium bovis subsp bovis AF2122/97
guaggucagggcguauuugucg

SEQ ID NO: 11895 - RNA, 22 nt, Mycobacterium bovis subsp bovis AF2122/97
gugaaauugaaaacgccguugc

SEQ ID NO: 11896 - RNA, 22 nt, Mycobacterium bovis subsp bovis AF2122/97
gucauugcgucauuuccuucga

SEQ ID NO: 11897 - RNA, 22 nt, Mycobacterium bovis subsp bovis AF2122/97
guccaagcaggcgaucggccgg

SEQ ID NO: 11898 - RNA, 22 nt, Mycobacterium bovis subsp bovis AF2122/97
gucgcuggugggaucgcagcgc

SEQ ID NO: 11899 - RNA, 22 nt, Mycobacterium bovis subsp bovis AF2122/97
guugaccagcacgacugcaucg

SEQ ID NO: 11900 - RNA, 22 nt, Mycobacterium bovis subsp bovis AF2122/97
guugaucagcuuguugagcugc

SEQ ID NO: 11901 - RNA, 21 nt, Mycobacterium bovis subsp bovis AF2122/97
guugguggacagcgcuucccg

SEQ ID NO: 11902 - RNA, 22 nt, Mycobacterium bovis subsp bovis AF2122/97
guugugaagacgccauucgcag

SEQ ID NO: 11903 - RNA, 22 nt, Mycobacterium bovis subsp bovis AF2122/97
guuucgggcgauuuugcguccu

SEQ ID NO: 11904 - RNA, 21 nt, Mycobacterium bovis subsp bovis AF2122/97
guuaggaucaucugcgccgcu

SEQ ID NO: 11905 - RNA, 22 nt, Mycobacterium bovis subsp bovis AF2122/97
guucauucccgaggugcugagc

SEQ ID NO: 11906 - RNA, 22 nt, Mycobacterium bovis subsp bovis AF2122/97
gugguggucuccagcgcgcucg

SEQ ID NO: 11907 - RNA, 22 nt, Mycobacterium bovis subsp bovis AF2122/97
guuuggcgcgcccacagcccgg

SEQ ID NO: 11908 - RNA, 22 nt, Mycobacterium bovis subsp bovis AF2122/97
guuuucagcguguaggaggugu

SEQ ID NO: 11909 - RNA, 22 nt, Mycobacterium bovis subsp bovis AF2122/97
guuuugggccucggcgagccga

SEQ ID NO: 11910 - RNA, 22 nt, Mycobacterium bovis subsp bovis AF2122/97
gugcuuucagcuugucucgacg

SEQ ID NO: 11911 - RNA, 22 nt, Mycobacterium bovis subsp bovis AF2122/97
gugcugggcaucaaccaggauc

SEQ ID NO: 11912 - RNA, 22 nt, Mycobacterium bovis subsp bovis AF2122/97
gugguggccaacuuccugcucg

SEQ ID NO: 11913 - RNA, 22 nt, Mycobacterium bovis subsp bovis AF2122/97
guggccaaggccaggucggccg

SEQ ID NO: 11914 - RNA, 22 nt, Mycobacterium bovis subsp bovis AF2122/97
gcugccccgcgagcuggugcug

SEQ ID NO: 11915 - RNA, 22 nt, Mycobacterium bovis subsp bovis AF2122/97
gcugaaccugauccucaagggc

SEQ ID NO: 11916 - RNA, 22 nt, Mycobacterium bovis subsp bovis AF2122/97
gcguggucggaugcaggccagc

SEQ ID NO: 11917 - RNA, 22 nt, Mycobacterium bovis subsp bovis AF2122/97
gcggcaugcgcgaucugcagag

SEQ ID NO: 11918 - RNA, 22 nt, Mycobacterium bovis subsp bovis AF2122/97
gcggccaacgaggcagcggcgg

SEQ ID NO: 11919 - RNA, 22 nt, Mycobacterium bovis subsp bovis AF2122/97
gcucaugucgccguagaccggg

SEQ ID NO: 11920 - RNA, 22 nt, Mycobacterium bovis subsp bovis AF2122/97
gcgcgcccgacgggcggugauc

SEQ ID NO: 11921 - RNA, 22 nt, Mycobacterium bovis subsp bovis AF2122/97
gcgccagugcugcgcgugcaca

SEQ ID NO: 11922 - RNA, 22 nt, Mycobacterium bovis subsp bovis AF2122/97
gcgcuuggccggcagcgagacc

SEQ ID NO: 11923 - RNA, 22 nt, Mycobacterium bovis subsp bovis AF2122/97
gccuggugcaccggucgccggg

SEQ ID NO: 11924 - RNA, 22 nt, Mycobacterium bovis subsp bovis AF2122/97
gccugguguccgagcggcccuu

SEQ ID NO: 11925 - RNA, 22 nt, Mycobacterium bovis subsp bovis AF2122/97
gccuugaauucgccccggccug

SEQ ID NO: 11926 - RNA, 22 nt, Mycobacterium bovis subsp bovis AF2122/97
gcgcacgcccuugcgcugcaau

SEQ ID NO: 11927 - RNA, 22 nt, Mycobacterium bovis subsp bovis AF2122/97
gcgcagcagcgacaggguggcg

SEQ ID NO: 11928 - RNA, 21 nt, Mycobacterium bovis subsp bovis AF2122/97
gcgcagcaucucagccagugc

SEQ ID NO: 11929 - RNA, 22 nt, Mycobacterium bovis subsp bovis AF2122/97
gcgccgccggggaucccgaccu

SEQ ID NO: 11930 - RNA, 22 nt, Mycobacterium bovis subsp bovis AF2122/97
gccagguugacguugguuucgg

SEQ ID NO: 11931 - RNA, 22 nt, Mycobacterium bovis subsp bovis AF2122/97
gccucagcguugcggcggguac

SEQ ID NO: 11932 - RNA, 22 nt, Mycobacterium bovis subsp bovis AF2122/97
gccgaagccgaccggcccagcg

SEQ ID NO: 11933 - RNA, 22 nt, Mycobacterium bovis subsp bovis AF2122/97
gcacggccaaaggcaucgccga

SEQ ID NO: 11934 - RNA, 22 nt, Mycobacterium bovis subsp bovis AF2122/97
gcacggccuccggaccgagcaa

SEQ ID NO: 11935 - RNA, 22 nt, Mycobacterium bovis subsp bovis AF2122/97
gcagacacggcggugacgcgag

SEQ ID NO: 11936 - RNA, 22 nt, Mycobacterium bovis subsp bovis AF2122/97
gcagcgugaucaccgaaccugg

SEQ ID NO: 11937 - RNA, 22 nt, Mycobacterium bovis subsp bovis AF2122/97
gcccagagugcgcaggcucucg

SEQ ID NO: 11938 - RNA, 22 nt, Mycobacterium bovis subsp bovis AF2122/97
gccaggcuagguacuggguugc

SEQ ID NO: 11939 - RNA, 22 nt, Mycobacterium bovis subsp bovis AF2122/97
gccagcaccaucugcgaucccg

SEQ ID NO: 11940 - RNA, 22 nt, Mycobacterium bovis subsp bovis AF2122/97
gccagcacgucacgcaggccga

SEQ ID NO: 11941 - RNA, 21 nt, Mycobacterium bovis subsp bovis AF2122/97
gccaacucaggcggacgaauc

SEQ ID NO: 11942 - RNA, 22 nt, Mycobacterium bovis subsp bovis AF2122/97
gccacucggggccgcugcggcc

SEQ ID NO: 11943 - RNA, 22 nt, Mycobacterium bovis subsp bovis AF2122/97
gcauggcagcaggcccgucccg

SEQ ID NO: 11944 - RNA, 21 nt, Mycobacterium bovis subsp bovis AF2122/97
gccagcauggucgaggaugca

SEQ ID NO: 11945 - RNA, 22 nt, Mycobacterium bovis subsp bovis AF2122/97
gaauacaucggugucggcggcc

SEQ ID NO: 11946 - RNA, 22 nt, Mycobacterium bovis subsp bovis AF2122/97
gaaucauugcccggcuccuggc

SEQ ID NO: 11947 - RNA, 22 nt, Mycobacterium bovis subsp bovis AF2122/97
gacaaaguuccacccgccgucc

SEQ ID NO: 11948 - RNA, 22 nt, Mycobacterium bovis subsp bovis AF2122/97
gaggggcagcucggcuccgcgu

SEQ ID NO: 11949 - RNA, 22 nt, Mycobacterium bovis subsp bovis AF2122/97
gaucucugcgggguaguucggc

SEQ ID NO: 11950 - RNA, 22 nt, Mycobacterium bovis subsp bovis AF2122/97
gaugacagcgaggugcacucgg

SEQ ID NO: 11951 - RNA, 22 nt, Mycobacterium bovis subsp bovis AF2122/97
gagcaugggcguggacguuguc

SEQ ID NO: 11952 - RNA, 23 nt, Mycobacterium bovis subsp bovis AF2122/97
gauguuaacgcgagucagacaug

SEQ ID NO: 11953 - RNA, 22 nt, Mycobacterium bovis subsp bovis AF2122/97
gaguaccugcaggugccgucgc

SEQ ID NO: 11954 - RNA, 22 nt, Homo sapiens
ugaacagcacguuuauucagaa

SEQ ID NO: 11955 - RNA, 22 nt, Homo sapiens
cuuugauuauaaaaggguguuu

SEQ ID NO: 11956 - RNA, 22 nt, Homo sapiens
ugcagugucaauaauaauuagu

SEQ ID NO: 11957 - RNA, 22 nt, Homo sapiens
ugacuaggaaauuagaacuuuu

SEQ ID NO: 11958 - RNA, 22 nt, Homo sapiens
uaucaacaggguggccagugua

SEQ ID NO: 11959 - RNA, 22 nt, Homo sapiens
uaauccuagcacuuuggaagac

SEQ ID NO: 11960 - RNA, 22 nt, Homo sapiens
augguauggaaggucuggagga

SEQ ID NO: 11961 - RNA, 22 nt, Homo sapiens
cuuuuggcuuagaauugucuug

SEQ ID NO: 11962 - RNA, 22 nt, Homo sapiens
aagagaugaagguccugacugu

SEQ ID NO: 11963 - RNA, 22 nt, Homo sapiens
ugagaugugaucaccugaaggg

SEQ ID NO: 11964 - RNA, 22 nt, Homo sapiens
cugauugucaucaauauuauua

SEQ ID NO: 11965 - RNA, 22 nt, Homo sapiens
aaaggcuucggaucagaaggua

SEQ ID NO: 11966 - RNA, 22 nt, Homo sapiens
guacaguaguaaaagugaauga

SEQ ID NO: 11967 - RNA, 22 nt, Homo sapiens
uaucccaauguaauaucacaaa

SEQ ID NO: 11968 - RNA, 22 nt, Homo sapiens
aucccuuucugauacuuucccu

SEQ ID NO: 11969 - RNA, 22 nt, Homo sapiens
caugcauuggucuauuauguga

SEQ ID NO: 11970 - RNA, 22 nt, Homo sapiens
aggaucauugacuauuauaagg

SEQ ID NO: 11971 - RNA, 22 nt, Homo sapiens
uugagaugauggauaugcuaau

SEQ ID NO: 11972 - RNA, 22 nt, Homo sapiens
uucccuuucugccuugaaucuu

SEQ ID NO: 11973 - RNA, 22 nt, Homo sapiens
gcagagaaacaggucuaaggag

SEQ ID NO: 11974 - RNA, 22 nt, Homo sapiens
uaagugaaggaaguguguuuac

SEQ ID NO: 11975 - RNA, 22 nt, Homo sapiens
gugucaugagggggacaggaag

SEQ ID NO: 11976 - RNA, 22 nt, Homo sapiens
guggaaaacauaugcuuguuga

SEQ ID NO: 11977 - RNA, 22 nt, Homo sapiens
ucucauggagucaggagcagaa

SEQ ID NO: 11978 - RNA, 22 nt, Homo sapiens
ugcuuguguucagguaaccuuu

SEQ ID NO: 11979 - RNA, 22 nt, Homo sapiens
uauacugucuuuguaugccuag

SEQ ID NO: 11980 - RNA, 22 nt, Homo sapiens
uguaacacacacuguuuacucc

SEQ ID NO: 11981 - RNA, 22 nt, Homo sapiens
uuggaaaaauccaccuugaucu

SEQ ID NO: 11982 - RNA, 22 nt, Homo sapiens
auggcuuuuuaaaucauguugu

SEQ ID NO: 11983 - RNA, 22 nt, Homo sapiens
agaucauaugcaguaaugaacu

SEQ ID NO: 11984 - RNA, 22 nt, Homo sapiens
aauacuggcacugaagaccaug

SEQ ID NO: 11985 - RNA, 17 nt, Homo sapiens
augugaauguucaaaua

SEQ ID NO: 11986 - RNA, 22 nt, Homo sapiens
cuuguggugcuuuuacgugggc

SEQ ID NO: 11987 - RNA, 22 nt, Homo sapiens
auaugcauacauguaugcagga

SEQ ID NO: 11988 - RNA, 22 nt, Homo sapiens
auucaaagugcauguucccacu

SEQ ID NO: 11989 - RNA, 22 nt, Homo sapiens
gugaaagacagcauuaauggcu

SEQ ID NO: 11990 - RNA, 19 nt, Homo sapiens
gaucuguugaucaaugugu

SEQ ID NO: 11991 - RNA, 22 nt, Homo sapiens
uggauaguaauaaacauauagg

SEQ ID NO: 11992 - RNA, 22 nt, Homo sapiens
uguauguuguaagacuuagacc

SEQ ID NO: 11993 - RNA, 22 nt, Homo sapiens
uucauagucuaugcaaguaaga

SEQ ID NO: 11994 - RNA, 22 nt, Homo sapiens
augagauauguuaaaaguuaaa

SEQ ID NO: 11995 - RNA, 22 nt, Homo sapiens
agugcauuugcaucucaauaua

SEQ ID NO: 11996 - RNA, 22 nt, Homo sapiens
caaaagugauugcgguuuuugc

SEQ ID NO: 11997 - RNA, 18 nt, Homo sapiens
ccauucaacagauuuguc

SEQ ID NO: 11998 - RNA, 19 nt, Homo sapiens
uuugcauagugagaauaua

SEQ ID NO: 11999 - RNA, 18 nt, Homo sapiens
ucacagguaaaguugaca

SEQ ID NO: 12000 - RNA, 22 nt, Homo sapiens
auggaauguaaguuauguuugc

SEQ ID NO: 12001 - RNA, 22 nt, Homo sapiens
uuucccuuuagcuuagugauuu

SEQ ID NO: 12002 - RNA, 22 nt, Homo sapiens
uaaguaaaugaaagguugauuu

SEQ ID NO: 12003 - RNA, 22 nt, Homo sapiens
uugugaaugaugucgcaguaaa

SEQ ID NO: 12004 - RNA, 22 nt, Homo sapiens
cagugcuuguuauuguucuauu

SEQ ID NO: 12005 - RNA, 20 nt, Homo sapiens
gucugucuccgaguagaauu

SEQ ID NO: 12006 - RNA, 22 nt, Homo sapiens
uuugaauggaaguuuugugaaa

SEQ ID NO: 12007 - RNA, 22 nt, Homo sapiens
uuuuggcucugucuguaucuuu

SEQ ID NO: 12008 - RNA, 22 nt, Homo sapiens
uugagauguaagauguuaauau

SEQ ID NO: 12009 - RNA, 22 nt, Homo sapiens
uaaagugaggauggcaguaggu

SEQ ID NO: 12010 - RNA, 22 nt, Homo sapiens
aagggaauguuguggcugguuu

SEQ ID NO: 12011 - RNA, 22 nt, Homo sapiens
acauaguagacacugaaaauau

SEQ ID NO: 12012 - RNA, 22 nt, Homo sapiens
ugugaauguaagaaaauccaac

SEQ ID NO: 12013 - RNA, 22 nt, Homo sapiens
aauaauggcaccaaagcacaag

SEQ ID NO: 12014 - RNA, 22 nt, Homo sapiens
uucauguaauauuucacagcuu

SEQ ID NO: 12015 - RNA, 22 nt, Homo sapiens
uuuguauguuggagauuggaga

SEQ ID NO: 12016 - RNA, 21 nt, Homo sapiens
ugcuuuggucauacuucuucc

SEQ ID NO: 12017 - RNA, 22 nt, Homo sapiens
aaaugcuuucuuggaccauuug

SEQ ID NO: 12018 - RNA, 22 nt, Homo sapiens
ugauuuguuucaggaguuuucu

SEQ ID NO: 12019 - RNA, 22 nt, Homo sapiens
auagcacaugugcaaauggcug

SEQ ID NO: 12020 - RNA, 22 nt, Homo sapiens
ucagcagugugaaaacaaacua

SEQ ID NO: 12021 - RNA, 22 nt, Homo sapiens
acuuuuugaugaggucguuugu

SEQ ID NO: 12022 - RNA, 22 nt, Homo sapiens
augcagugugcaacagauuaag

SEQ ID NO: 12023 - RNA, 22 nt, Homo sapiens
uggaagucuucauuauguauag

SEQ ID NO: 12024 - RNA, 22 nt, Homo sapiens
gcuguguugugcccagcaucau

SEQ ID NO: 12025 - RNA, 22 nt, Homo sapiens
aagugacauugugcccauuuga

SEQ ID NO: 12026 - RNA, 22 nt, Homo sapiens
auacacgguaggcacauauuua

SEQ ID NO: 12027 - RNA, 22 nt, Homo sapiens
caagugaauaguugcucucaga

SEQ ID NO: 12028 - RNA, 22 nt, Homo sapiens
ucagucuuuuuuuggcaagcau

SEQ ID NO: 12029 - RNA, 22 nt, Homo sapiens
augugaacaucauagaaugcac

SEQ ID NO: 12030 - RNA, 22 nt, Homo sapiens
gugacaguggagacuuacuuca

SEQ ID NO: 12031 - RNA, 22 nt, Homo sapiens
guaaauaccaguuucuggaaca

SEQ ID NO: 12032 - RNA, 22 nt, Homo sapiens
aguguuuuuaacaagaaagggu

SEQ ID NO: 12033 - RNA, 22 nt, Homo sapiens
auuccuuaggcccuuugguuag

SEQ ID NO: 12034 - RNA, 22 nt, Homo sapiens
ugagaugaagugauguaaaaca

SEQ ID NO: 12035 - RNA, 22 nt, Homo sapiens
cuucuugagacuuaggcuuugg

SEQ ID NO: 12036 - RNA, 22 nt, Homo sapiens
ugaaaguuauauugugaaauuc

SEQ ID NO: 12037 - RNA, 22 nt, Homo sapiens
aaaucccuugcucucucagacc

SEQ ID NO: 12038 - RNA, 22 nt, Homo sapiens
augaagucguuacuaccaauug

SEQ ID NO: 12039 - RNA, 20 nt, Homo sapiens
uggcaccugacagauagcca

SEQ ID NO: 12040 - RNA, 22 nt, Homo sapiens
ugguauguaugauuaacaugga

SEQ ID NO: 12041 - RNA, 22 nt, Homo sapiens
uauuccauuugugaaaggaagu

SEQ ID NO: 12042 - RNA, 22 nt, Homo sapiens
ugaaagcuacaggaaaguauuu

SEQ ID NO: 12043 - RNA, 22 nt, Homo sapiens
gugacagucaaagacaugacuu

SEQ ID NO: 12044 - RNA, 22 nt, Homo sapiens
uauacagcaaguuacugugcug

SEQ ID NO: 12045 - RNA, 17 nt, Homo sapiens
ugcaauuuaagcuagau

SEQ ID NO: 12046 - RNA, 18 nt, Homo sapiens
ucuggcuucuuuguucca

SEQ ID NO: 12047 - RNA, 22 nt, Homo sapiens
uugucauuuucagaguguuacg

SEQ ID NO: 12048 - RNA, 22 nt, Homo sapiens
agguagcauagcgggaauauca

SEQ ID NO: 12049 - RNA, 22 nt, Homo sapiens
uuggcagugcccgaugcugggg

SEQ ID NO: 12050 - RNA, 22 nt, Homo sapiens
aaguauguaucaagucauacuu

SEQ ID NO: 12051 - RNA, 22 nt, Homo sapiens
gugccuuuucugagcaaugagc

SEQ ID NO: 12052 - RNA, 22 nt, Homo sapiens
ugagaugugaagaucacaugaa

SEQ ID NO: 12053 - RNA, 22 nt, Homo sapiens
accaugcaguccaauaugcaca

SEQ ID NO: 12054 - RNA, 22 nt, Homo sapiens
aauuacauggcaauugggaaau

SEQ ID NO: 12055 - RNA, 22 nt, Homo sapiens
uuggcuuggagaguugaaaugu

SEQ ID NO: 12056 - RNA, 22 nt, Homo sapiens
uagcagcauaaauggacuaaga

SEQ ID NO: 12057 - RNA, 22 nt, Homo sapiens
agcugugucuucuuaaagauuu

SEQ ID NO: 12058 - RNA, 22 nt, Homo sapiens
uuucuauguugaccagucuaga

SEQ ID NO: 12059 - RNA, 22 nt, Homo sapiens
agaauguauauucuguaguugu

SEQ ID NO: 12060 - RNA, 22 nt, Homo sapiens
uaagugaauauggacaguuagc

SEQ ID NO: 12061 - RNA, 22 nt, Homo sapiens
uuacaugucuugguaagguuag

SEQ ID NO: 12062 - RNA, 22 nt, Homo sapiens
uggaaguagauagauuguguca

SEQ ID NO: 12063 - RNA, 22 nt, Homo sapiens
augaggauagguuucuauuagg

SEQ ID NO: 12064 - RNA, 17 nt, Homo sapiens
ugacagaaacuuguugu

SEQ ID NO: 12065 - RNA, 22 nt, Homo sapiens
uaugcuuauaaacauuugucag

SEQ ID NO: 12066 - RNA, 22 nt, Homo sapiens
auacaguugccauuucuugugc

SEQ ID NO: 12067 - RNA, 22 nt, Homo sapiens
uagaaugucagcuucuugaggg

SEQ ID NO: 12068 - RNA, 22 nt, Homo sapiens
uuuccagguggccaacauuuua

SEQ ID NO: 12069 - RNA, 22 nt, Homo sapiens
gcagcacauggcagaacauauu

SEQ ID NO: 12070 - RNA, 22 nt, Homo sapiens
uaggcagccagcuguggauuga

SEQ ID NO: 12071 - RNA, 22 nt, Homo sapiens
ugcaguuuaggaacugguaaca

SEQ ID NO: 12072 - RNA, 22 nt, Homo sapiens
ucagaguagcugucugaggugc

SEQ ID NO: 12073 - RNA, 20 nt, Homo sapiens
ucaucaguuggugcucgcug

SEQ ID NO: 12074 - RNA, 22 nt, Homo sapiens
acuccauuucauuuuagcucuu

SEQ ID NO: 12075 - RNA, 22 nt, Homo sapiens
agaugauguuuacugagcauca

SEQ ID NO: 12076 - RNA, 22 nt, Homo sapiens
gagcacugauuuauuuuugucu

SEQ ID NO: 12077 - RNA, 22 nt, Homo sapiens
cacagaauucauuggauuaccu

SEQ ID NO: 12078 - RNA, 22 nt, Homo sapiens
uggaaguauagauaauugaaag

SEQ ID NO: 12079 - RNA, 22 nt, Homo sapiens
cucaguuuugccuuguuuaagg

SEQ ID NO: 12080 - RNA, 18 nt, Homo sapiens
aaacugcuuccuuggccu

SEQ ID NO: 12081 - RNA, 22 nt, Homo sapiens
ugguccuuuccauuggagacac

SEQ ID NO: 12082 - RNA, 22 nt, Homo sapiens
cuuuuggcuuaagauugucuug

SEQ ID NO: 12083 - RNA, 22 nt, Homo sapiens
uaaauggauauugccaucuccu

SEQ ID NO: 12084 - RNA, 22 nt, Homo sapiens
acaaaguauggaauguuggugu

SEQ ID NO: 12085 - RNA, 22 nt, Homo sapiens
ugcaaaugcugcuauuucucuu

SEQ ID NO: 12086 - RNA, 22 nt, Homo sapiens
uaaaagucaucacaacuggagu

SEQ ID NO: 12087 - RNA, 22 nt, Homo sapiens
ugagauuauauuucuuaacaga

SEQ ID NO: 12088 - RNA, 20 nt, Homo sapiens
cuuggcuuucuugguguuaa

SEQ ID NO: 12089 - RNA, 22 nt, Homo sapiens
gugguuuuuaaaguaccugugg

SEQ ID NO: 12090 - RNA, 22 nt, Homo sapiens
augucaaagaggaaaacuggau

SEQ ID NO: 12091 - RNA, 22 nt, Homo sapiens
guuggaauguauugcuacuucu

SEQ ID NO: 12092 - RNA, 22 nt, Homo sapiens
auuacacuuucuauucaaugag

SEQ ID NO: 12093 - RNA, 22 nt, Homo sapiens
ugacagguuggaauuaugggag

SEQ ID NO: 12094 - RNA, 22 nt, Homo sapiens
uuaucauagugcaguuuucuga

SEQ ID NO: 12095 - RNA, 22 nt, Homo sapiens
auguagugugauuuucacuaga

SEQ ID NO: 12096 - RNA, 22 nt, Homo sapiens
ucagugcuuuuuguugucauca

SEQ ID NO: 12097 - RNA, 22 nt, Homo sapiens
uauagcuaugggauguauuugc

SEQ ID NO: 12098 - RNA, 18 nt, Homo sapiens
ugcauacuaucugauuuu

SEQ ID NO: 12099 - RNA, 22 nt, Homo sapiens
uugugaauggugccgcgauaaa

SEQ ID NO: 12100 - RNA, 22 nt, Homo sapiens
uguaauuuaaaugauccuugga

SEQ ID NO: 12101 - RNA, 22 nt, Homo sapiens
ucauaguagucacuuaauaaau

SEQ ID NO: 12102 - RNA, 20 nt, Homo sapiens
uggaguuugaguucuuggag

SEQ ID NO: 12103 - RNA, 22 nt, Homo sapiens
augagaugcaagauuagauggg

SEQ ID NO: 12104 - RNA, 22 nt, Homo sapiens
ugugguuuuucacauuuagaga

SEQ ID NO: 12105 - RNA, 22 nt, Homo sapiens
gagcaucaguggccucaucuca

SEQ ID NO: 12106 - RNA, 22 nt, Homo sapiens
uagcaguaucccaccaucuggu

SEQ ID NO: 12107 - RNA, 22 nt, Homo sapiens
auggaauguauagucauguagg

SEQ ID NO: 12108 - RNA, 22 nt, Homo sapiens
agugacaugggaucaaaucuga

SEQ ID NO: 12109 - RNA, 22 nt, Homo sapiens
aagucaaggagagaagcuucag

SEQ ID NO: 12110 - RNA, 22 nt, Homo sapiens
auuacaugucuauccaugaaca

SEQ ID NO: 12111 - RNA, 22 nt, Homo sapiens
gagaacugagauaagugauauu

SEQ ID NO: 12112 - RNA, 22 nt, Homo sapiens
augucuggcagaagacuucuca

SEQ ID NO: 12113 - RNA, 22 nt, Homo sapiens
aaucccuuuguccagucucuuu

SEQ ID NO: 12114 - RNA, 22 nt, Homo sapiens
gaaucaauugaucuaugugucu

SEQ ID NO: 12115 - RNA, 22 nt, Homo sapiens
uugaguuugaguauucuaaagc

SEQ ID NO: 12116 - RNA, 22 nt, Homo sapiens
ucacugugugucucuguaucug

SEQ ID NO: 12117 - RNA, 22 nt, Homo sapiens
uugacauaaucauuucacagug

SEQ ID NO: 12118 - RNA, 22 nt, Homo sapiens
aaacugcuuuccaugguggcug

SEQ ID NO: 12119 - RNA, 22 nt, Homo sapiens
uaagucacuccagguuaaagug

SEQ ID NO: 12120 - RNA, 22 nt, Homo sapiens
uugugcauaucagagguuugcu

SEQ ID NO: 12121 - RNA, 22 nt, Homo sapiens
uuggaaauguguuugcauucag

SEQ ID NO: 12122 - RNA, 22 nt, Homo sapiens
auugcuauuauuugaccauugu

SEQ ID NO: 12123 - RNA, 23 nt, Homo sapiens
uugcauagacauccucauagauu

SEQ ID NO: 12124 - RNA, 22 nt, Homo sapiens
augaaauugcuaucgcaguacu

SEQ ID NO: 12125 - RNA, 20 nt, Homo sapiens
auaugcagacacauacauac

SEQ ID NO: 12126 - RNA, 22 nt, Homo sapiens
ucaaaugguccacgugaacauu

SEQ ID NO: 12127 - RNA, 22 nt, Homo sapiens
ugagaugaguugcgcucugucg

SEQ ID NO: 12128 - RNA, 22 nt, Homo sapiens
uucuaaguaauuuugcaugccu

SEQ ID NO: 12129 - RNA, 22 nt, Homo sapiens
uaucucauccuccuugauccca

SEQ ID NO: 12130 - RNA, 22 nt, Homo sapiens
uuaauuguccaaguucaucucu

SEQ ID NO: 12131 - RNA, 22 nt, Homo sapiens
aagacuguaauccaucuugagu

SEQ ID NO: 12132 - RNA, 22 nt, Homo sapiens
uggaauguaacuugaaacuuuu

SEQ ID NO: 12133 - RNA, 19 nt, Homo sapiens
uuuguauguuuccaguaau

SEQ ID NO: 12134 - RNA, 22 nt, Homo sapiens
ugagaaugacugggcaugcugc

SEQ ID NO: 12135 - RNA, 22 nt, Homo sapiens
uagcaccucuuuggccuuucgu

SEQ ID NO: 12136 - RNA, 22 nt, Homo sapiens
auguguucaucacagcacaauu

SEQ ID NO: 12137 - RNA, 22 nt, Homo sapiens
aaguacuguuuaaauugcagaa

SEQ ID NO: 12138 - RNA, 22 nt, Homo sapiens
cuguaauguaaugagacuacau

SEQ ID NO: 12139 - RNA, 22 nt, Homo sapiens
uugaaagacaucaccuacugcu

SEQ ID NO: 12140 - RNA, 22 nt, Homo sapiens
uuguaaaguucucucccgaaaa

SEQ ID NO: 12141 - RNA, 22 nt, Homo sapiens
uucucaauggcaacuuguugcu

SEQ ID NO: 12142 - RNA, 22 nt, Homo sapiens
ugucaguuucuugagauggaac

SEQ ID NO: 12143 - RNA, 22 nt, Homo sapiens
auucagaggggcagcugucuug

SEQ ID NO: 12144 - RNA, 22 nt, Homo sapiens
augaguauguucuguauuuuca

SEQ ID NO: 12145 - RNA, 22 nt, Homo sapiens
uuuuaguggaauauuuacaguu

SEQ ID NO: 12146 - RNA, 22 nt, Homo sapiens
uuucccauuguucugcucugug

SEQ ID NO: 12147 - RNA, 18 nt, Homo sapiens
uccaguuuucccagcauc

SEQ ID NO: 12148 - RNA, 22 nt, Homo sapiens
uugugcaugaugcauacauggu

SEQ ID NO: 12149 - RNA, 22 nt, Homo sapiens
uaaauggauaaaugaauaccua

SEQ ID NO: 12150 - RNA, 22 nt, Homo sapiens
cugugcaaagcgcucucggggu

SEQ ID NO: 12151 - RNA, 16 nt, Homo sapiens
gugcuguguuguuagg

SEQ ID NO: 12152 - RNA, 22 nt, Homo sapiens
ugaauguaagaugucugcuggu

SEQ ID NO: 12153 - RNA, 21 nt, Homo sapiens
aauacucuagguuaagagagc

SEQ ID NO: 12154 - RNA, 22 nt, Homo sapiens
ugagaacaugcacuugagguug

SEQ ID NO: 12155 - RNA, 19 nt, Homo sapiens
cuaaguccccuugauuaga

SEQ ID NO: 12156 - RNA, 22 nt, Homo sapiens
caacaguaaagcauuuuuaagu

SEQ ID NO: 12157 - RNA, 22 nt, Homo sapiens
uugaaagucuaggcuuacagua

SEQ ID NO: 12158 - RNA, 18 nt, Homo sapiens
guaaauguaucuauugcc

SEQ ID NO: 12159 - RNA, 22 nt, Homo sapiens
uucccugagcaucuguugagcc

SEQ ID NO: 12160 - RNA, 22 nt, Homo sapiens
gagcugaucuuuucugauucca

SEQ ID NO: 12161 - RNA, 22 nt, Homo sapiens
gagaaugaugauuuccaauuuc

SEQ ID NO: 12162 - RNA, 22 nt, Homo sapiens
ugucauguuucuacugaccaaa

SEQ ID NO: 12163 - RNA, 22 nt, Homo sapiens
agaugcauugguggcauauuca

SEQ ID NO: 12164 - RNA, 22 nt, Homo sapiens
gugguuuuuuucugccuuauag

SEQ ID NO: 12165 - RNA, 22 nt, Homo sapiens
ucagcagugugaaaauggacua

SEQ ID NO: 12166 - RNA, 22 nt, Homo sapiens
gagaacauuuaagccacucagg

SEQ ID NO: 12167 - RNA, 22 nt, Homo sapiens
auacuguauaggauuguagccu

SEQ ID NO: 12168 - RNA, 22 nt, Homo sapiens
uggagugagaacuucaaugaug

SEQ ID NO: 12169 - RNA, 22 nt, Homo sapiens
uugugaauggugccucaguaaa

SEQ ID NO: 12170 - RNA, 22 nt, Homo sapiens
uaaguauuaugugcugcauuuu

SEQ ID NO: 12171 - RNA, 22 nt, Homo sapiens
uaucaguauggauucauggauu

SEQ ID NO: 12172 - RNA, 22 nt, Homo sapiens
cugauacugagaccuuggguua

SEQ ID NO: 12173 - RNA, 23 nt, Homo sapiens
ugagauuauaaucuuuuacuucu

SEQ ID NO: 12174 - RNA, 22 nt, Homo sapiens
uaaaugcucuuuaaaagugcuu

SEQ ID NO: 12175 - RNA, 20 nt, Homo sapiens
cuggaugucgaggcagaggu

SEQ ID NO: 12176 - RNA, 22 nt, Homo sapiens
uuucccugaaggcucugaaguc

SEQ ID NO: 12177 - RNA, 22 nt, Homo sapiens
ggagaugauuaugaaucacuua

SEQ ID NO: 12178 - RNA, 22 nt, Homo sapiens
cagagaaugucuuuuuuaacca

SEQ ID NO: 12179 - RNA, 22 nt, Homo sapiens
gagaacauuaauaguuaauuuu

SEQ ID NO: 12180 - RNA, 22 nt, Homo sapiens
uggauggagaggcuugugaugc

SEQ ID NO: 12181 - RNA, 22 nt, Homo sapiens
uagcaguauugaaagaugaggg

SEQ ID NO: 12182 - RNA, 22 nt, Homo sapiens
agguaagaugugacuugguguu

SEQ ID NO: 12183 - RNA, 20 nt, Homo sapiens
ugaugcaaaucuuuaaaagu

SEQ ID NO: 12184 - RNA, 22 nt, Homo sapiens
uuucugagaccaaaacuuguaa

SEQ ID NO: 12185 - RNA, 22 nt, Homo sapiens
augagauacuacaaaugaguuu

SEQ ID NO: 12186 - RNA, 22 nt, Homo sapiens
agcuuguggugaauacugcuag

SEQ ID NO: 12187 - RNA, 22 nt, Homo sapiens
ugaugucuugcaggcacgagau

SEQ ID NO: 12188 - RNA, 22 nt, Homo sapiens
uaucacagugcuggaguauucc

SEQ ID NO: 12189 - RNA, 22 nt, Homo sapiens
caugacacuggcauguuucuuu

SEQ ID NO: 12190 - RNA, 22 nt, Homo sapiens
auagcagugugaaaauugacug

SEQ ID NO: 12191 - RNA, 22 nt, Homo sapiens
cuuucugaggagaauagagaac

SEQ ID NO: 12192 - RNA, 22 nt, Homo sapiens
uugugaaugaugucgcaauaaa

SEQ ID NO: 12193 - RNA, 22 nt, Homo sapiens
aauaaagucugaagugugcuua

SEQ ID NO: 12194 - RNA, 22 nt, Homo sapiens
ucagugucugugauggagaggu

SEQ ID NO: 12195 - RNA, 22 nt, Homo sapiens
agcugauggucuuguaugaugu

SEQ ID NO: 12196 - RNA, 22 nt, Homo sapiens
aagcaggugucugugucuguaa

SEQ ID NO: 12197 - RNA, 22 nt, Homo sapiens
auagcagugugaaaauggacua

SEQ ID NO: 12198 - RNA, 20 nt, Homo sapiens
uggucaccuucaggagguuc

SEQ ID NO: 12199 - RNA, 22 nt, Homo sapiens
auacaagugccauguuggugug

SEQ ID NO: 12200 - RNA, 22 nt, Homo sapiens
uugcaaagaccucuucacuucc

SEQ ID NO: 12201 - RNA, 22 nt, Homo sapiens
uaagcagugcaagaauggaaua

SEQ ID NO: 12202 - RNA, 22 nt, Homo sapiens
uugugaauggugccacaauaaa

SEQ ID NO: 12203 - RNA, 22 nt, Homo sapiens
ugagaugagucucgcucuguca

SEQ ID NO: 12204 - RNA, 18 nt, Homo sapiens
cugccagugugcucuccg

SEQ ID NO: 12205 - RNA, 18 nt, Homo sapiens
uccauuuguaugggaugg

SEQ ID NO: 12206 - RNA, 16 nt, Homo sapiens
aucacuugcuucuuuu

SEQ ID NO: 12207 - RNA, 22 nt, Homo sapiens
uagcaguaaagaaugugauguu

SEQ ID NO: 12208 - RNA, 22 nt, Homo sapiens
aaagugaauguaucccguaagu

SEQ ID NO: 12209 - RNA, 22 nt, Homo sapiens
uuauacucgucugaaugauucu

SEQ ID NO: 12210 - RNA, 22 nt, Homo sapiens
agugauuuuaacuuccagcaau

SEQ ID NO: 12211 - RNA, 22 nt, Homo sapiens
uucaguaaauguucuuacuaua

SEQ ID NO: 12212 - RNA, 22 nt, Homo sapiens
uguagcagccauaaacacagug

SEQ ID NO: 12213 - RNA, 22 nt, Homo sapiens
auccuuuagacuguccaguuga

SEQ ID NO: 12214 - RNA, 22 nt, Homo sapiens
uugcauaagugcauucugugau

SEQ ID NO: 12215 - RNA, 22 nt, Homo sapiens
augggaaaaucagaaggccugg

SEQ ID NO: 12216 - RNA, 22 nt, Homo sapiens
acuggauguuagggauuuuauu

SEQ ID NO: 12217 - RNA, 22 nt, Homo sapiens
uugauauguuguuagauucagu

SEQ ID NO: 12218 - RNA, 22 nt, Homo sapiens
ucuugccacuucauccccuuuc

SEQ ID NO: 12219 - RNA, 22 nt, Homo sapiens
agucaagaaucucagcaucuuu

SEQ ID NO: 12220 - RNA, 22 nt, Homo sapiens
ugagauguggcuagagagguug

SEQ ID NO: 12221 - RNA, 18 nt, Homo sapiens
augaagucaucacuuuua

SEQ ID NO: 12222 - RNA, 18 nt, Homo sapiens
acauucagcuugaagaua

SEQ ID NO: 12223 - RNA, 22 nt, Homo sapiens
auaacucuguuuuuuucaugca

SEQ ID NO: 12224 - RNA, 22 nt, Homo sapiens
uggaauguagcguugacacgag

SEQ ID NO: 12225 - RNA, 22 nt, Homo sapiens
gauguguuuuaggaucucagca

SEQ ID NO: 12226 - RNA, 22 nt, Homo sapiens
ugcuaugucagccaggcugguc

SEQ ID NO: 12227 - RNA, 22 nt, Homo sapiens
acauguaauugauuuuguguua

SEQ ID NO: 12228 - RNA, 22 nt, Homo sapiens
uggcagugggagauauuuuauu

SEQ ID NO: 12229 - RNA, 19 nt, Homo sapiens
uuuugcucuuuauaccuau

SEQ ID NO: 12230 - RNA, 22 nt, Homo sapiens
aagggaaugugguagcugguuu

SEQ ID NO: 12231 - RNA, 22 nt, Homo sapiens
agaacuguccauucagcaugaa

SEQ ID NO: 12232 - RNA, 23 nt, Homo sapiens
uaagucacacagauuaauuuauu

SEQ ID NO: 12233 - RNA, 22 nt, Homo sapiens
uccuucaguccaguggguuuug

SEQ ID NO: 12234 - RNA, 22 nt, Homo sapiens
ugaaagguauagguucuggagg

SEQ ID NO: 12235 - RNA, 22 nt, Homo sapiens
acaguaaugggccccuuuuccu

SEQ ID NO: 12236 - RNA, 22 nt, Homo sapiens
ucuuuggucuacuuucauaugu

SEQ ID NO: 12237 - RNA, 22 nt, Homo sapiens
uggaauaucaugagaguuuguu

SEQ ID NO: 12238 - RNA, 22 nt, Homo sapiens
auggcuauuccauaggcagagc

SEQ ID NO: 12239 - RNA, 21 nt, Homo sapiens
auauggaacuggugacguguu

SEQ ID NO: 12240 - RNA, 22 nt, Homo sapiens
uucuggaaaucagcagagggug

SEQ ID NO: 12241 - RNA, 18 nt, Homo sapiens
aaaaagugcucaggccua

SEQ ID NO: 12242 - RNA, 22 nt, Homo sapiens
aaaagucuguagugaaagguga

SEQ ID NO: 12243 - RNA, 22 nt, Homo sapiens
ugcaugaugcugagauuuggga

SEQ ID NO: 12244 - RNA, 22 nt, Homo sapiens
auaaguauuuggacuuuacugu

SEQ ID NO: 12245 - RNA, 22 nt, Homo sapiens
caaagucuauucuacccuuacc

SEQ ID NO: 12246 - RNA, 22 nt, Homo sapiens
ugaacagucaucucucuuguau

SEQ ID NO: 12247 - RNA, 22 nt, Homo sapiens
ugccuaguagaaggugaacaug

SEQ ID NO: 12248 - RNA, 19 nt, Homo sapiens
ccugcuguucuuuugcacc

SEQ ID NO: 12249 - RNA, 22 nt, Homo sapiens
uuagugaaugcaccacuucuga

SEQ ID NO: 12250 - RNA, 22 nt, Homo sapiens
uugaguuuaucuaaagaccugg

SEQ ID NO: 12251 - RNA, 22 nt, Homo sapiens
ucaucuggcgaaugugaagagu

SEQ ID NO: 12252 - RNA, 22 nt, Homo sapiens
gaauuguacugcaaucagggga

SEQ ID NO: 12253 - RNA, 22 nt, Homo sapiens
ggaaucugaaccaugggaaugg

SEQ ID NO: 12254 - RNA, 22 nt, Homo sapiens
aucagugcauguuuguugagcu

SEQ ID NO: 12255 - RNA, 22 nt, Homo sapiens
uugaauagaagguuuuuuguuc

SEQ ID NO: 12256 - RNA, 20 nt, Homo sapiens
gcugugcuuaauacacuuuc

SEQ ID NO: 12257 - RNA, 22 nt, Homo sapiens
augaaaacaugauuugccuguu

SEQ ID NO: 12258 - RNA, 22 nt, Homo sapiens
acaucccuuucccacccuucac

SEQ ID NO: 12259 - RNA, 22 nt, Homo sapiens
ugguguuugagaagcugauguc

SEQ ID NO: 12260 - RNA, 17 nt, Homo sapiens
uucucaguucugaucuc

SEQ ID NO: 12261 - RNA, 21 nt, Homo sapiens
ugagaugugaccagggcauca

SEQ ID NO: 12262 - RNA, 22 nt, Homo sapiens
uaucacaggucaggaaccuugu

SEQ ID NO: 12263 - RNA, 22 nt, Homo sapiens
ugcuguguugcuggcuuaaaga

SEQ ID NO: 12264 - RNA, 23 nt, Homo sapiens
agcaccuuuccuccacuaucugc

SEQ ID NO: 12265 - RNA, 22 nt, Homo sapiens
gauguguugggaagauuucaag

SEQ ID NO: 12266 - RNA, 22 nt, Homo sapiens
uuuaaagcaugacgagaagaag

SEQ ID NO: 12267 - RNA, 22 nt, Homo sapiens
caauacuguguugaauaagagu

SEQ ID NO: 12268 - RNA, 22 nt, Homo sapiens
uucucaguuccuacuuugguga

SEQ ID NO: 12269 - RNA, 22 nt, Homo sapiens
uaagguccuuaaauguguaacc

SEQ ID NO: 12270 - RNA, 22 nt, Homo sapiens
gcaaugcugucugugcacagau

SEQ ID NO: 12271 - RNA, 22 nt, Homo sapiens
uuuuaguggacaaagguauuua

SEQ ID NO: 12272 - RNA, 22 nt, Homo sapiens
uagaauggaaggcauguuugcc

SEQ ID NO: 12273 - RNA, 22 nt, Homo sapiens
cugagauggagucucgcauugu

SEQ ID NO: 12274 - RNA, 22 nt, Homo sapiens
uacaugcaugggcaugugugca

SEQ ID NO: 12275 - RNA, 22 nt, Homo sapiens
gcaaagaaugcagauuugccuc

SEQ ID NO: 12276 - RNA, 21 nt, Homo sapiens
auuguauguaaaccaaaugag

SEQ ID NO: 12277 - RNA, 20 nt, Homo sapiens
cuccuucauuccuuuggacc

SEQ ID NO: 12278 - RNA, 22 nt, Homo sapiens
uugugaaugaugccgcaauaaa

SEQ ID NO: 12279 - RNA, 22 nt, Homo sapiens
uugugaauggugccgcaguaaa

SEQ ID NO: 12280 - RNA, 22 nt, Homo sapiens
uaaagcuuagauccaugguggc

SEQ ID NO: 12281 - RNA, 22 nt, Homo sapiens
ggagaauguaauugguauuuug

SEQ ID NO: 12282 - RNA, 22 nt, Homo sapiens
uugaaagaaaggagacugaguu

SEQ ID NO: 12283 - RNA, 22 nt, Homo sapiens
guguauauccuauuaguucugu

SEQ ID NO: 12284 - RNA, 22 nt, Homo sapiens
ugauggcaauggcauucauuuu

SEQ ID NO: 12285 - RNA, 21 nt, Homo sapiens
uaaagcuuagcuauaguggcu

SEQ ID NO: 12286 - RNA, 22 nt, Homo sapiens
augugcaacugcuggaacaguc

SEQ ID NO: 12287 - RNA, 22 nt, Homo sapiens
cugaaagagcauguaacacagu

SEQ ID NO: 12288 - RNA, 21 nt, Homo sapiens
ugacagaaaauugaguuugcu

SEQ ID NO: 12289 - RNA, 22 nt, Homo sapiens
augaaaagcauaaacgcugaag

SEQ ID NO: 12290 - RNA, 22 nt, Homo sapiens
uuguaaagaucauaugcuguuc

SEQ ID NO: 12291 - RNA, 22 nt, Homo sapiens
aaagucuguuacagcuauuucu

SEQ ID NO: 12292 - RNA, 20 nt, Homo sapiens
uggaaaguaagucaugauau

SEQ ID NO: 12293 - RNA, 22 nt, Homo sapiens
uacaaagcuuucugcaaaucau

SEQ ID NO: 12294 - RNA, 22 nt, Homo sapiens
agugguuuuggaauggaauuca

SEQ ID NO: 12295 - RNA, 22 nt, Homo sapiens
augcagagaaaucuaaaauaug

SEQ ID NO: 12296 - RNA, 22 nt, Homo sapiens
auagcagugugaaaacagacug

SEQ ID NO: 12297 - RNA, 17 nt, Homo sapiens
uuucagaguggaagugu

SEQ ID NO: 12298 - RNA, 22 nt, Homo sapiens
uuaagaugcauuuugaaguuaa

SEQ ID NO: 12299 - RNA, 22 nt, Homo sapiens
uagcaguauacguacugggucc

SEQ ID NO: 12300 - RNA, 22 nt, Homo sapiens
gcugugauucuguguagauagu

SEQ ID NO: 12301 - RNA, 22 nt, Homo sapiens
cuuguuguggaggggagugcag

SEQ ID NO: 12302 - RNA, 20 nt, Homo sapiens
guccauuugcugccauugcu

SEQ ID NO: 12303 - RNA, 22 nt, Homo sapiens
acagaacugggcuugcuuuugg

SEQ ID NO: 12304 - RNA, 21 nt, Homo sapiens
ugugaccucugucucugaguc

SEQ ID NO: 12305 - RNA, 22 nt, Homo sapiens
uuaagucacacuagacaacuga

SEQ ID NO: 12306 - RNA, 22 nt, Homo sapiens
guggaaaaguaguugcgguuuu

SEQ ID NO: 12307 - RNA, 22 nt, Homo sapiens
aagggagcugcauaaucuugug

SEQ ID NO: 12308 - RNA, 22 nt, Homo sapiens
uauggauuuucagauucuuauc

SEQ ID NO: 12309 - RNA, 22 nt, Homo sapiens
ugacuagugcccuuugcugccu

SEQ ID NO: 12310 - RNA, 22 nt, Homo sapiens
uugugaaaaaccucucguggaa

SEQ ID NO: 12311 - RNA, 22 nt, Homo sapiens
uucaacagugauggccuuugua

SEQ ID NO: 12312 - RNA, 22 nt, Homo sapiens
ugagaugagaaucaguucuaau

SEQ ID NO: 12313 - RNA, 22 nt, Homo sapiens
uucaagucaacaagcacuugag

SEQ ID NO: 12314 - RNA, 22 nt, Homo sapiens
uuaaaagcuaucuccaagguca

SEQ ID NO: 12315 - RNA, 22 nt, Homo sapiens
uguacuucaagauuaugguuua

SEQ ID NO: 12316 - RNA, 22 nt, Homo sapiens
cuagcagacaugggcugaacca

SEQ ID NO: 12317 - RNA, 22 nt, Homo sapiens
aaucacaguguucuugugaggg

SEQ ID NO: 12318 - RNA, 22 nt, Homo sapiens
uggaaguaaccaugaauggaau

SEQ ID NO: 12319 - RNA, 22 nt, Homo sapiens
ugucaguuuuaacuagggaaua

SEQ ID NO: 12320 - RNA, 20 nt, Homo sapiens
auguaauguaugauauguac

SEQ ID NO: 12321 - RNA, 22 nt, Homo sapiens
ugaugacacugauuucuucaau

SEQ ID NO: 12322 - RNA, 22 nt, Homo sapiens
gagaucauguacuagaacaccu

SEQ ID NO: 12323 - RNA, 22 nt, Homo sapiens
auuccauuuguuaucacacccg

SEQ ID NO: 12324 - RNA, 22 nt, Homo sapiens
uuacugcucuuuugucaugagu

SEQ ID NO: 12325 - RNA, 22 nt, Homo sapiens
ugcagagaaacauuuuguauuu

SEQ ID NO: 12326 - RNA, 22 nt, Homo sapiens
augaccaaugggcagagcuaga

SEQ ID NO: 12327 - RNA, 22 nt, Homo sapiens
auaucccagugaugauugauag

SEQ ID NO: 12328 - RNA, 22 nt, Homo sapiens
aucaugucuucccagugauucu

SEQ ID NO: 12329 - RNA, 22 nt, Homo sapiens
ugaaauuauucuuaccaaggug

SEQ ID NO: 12330 - RNA, 22 nt, Homo sapiens
augcacuguauaggaucuugcg

SEQ ID NO: 12331 - RNA, 22 nt, Homo sapiens
gauguguuuccaggauuuguuu

SEQ ID NO: 12332 - RNA, 22 nt, Homo sapiens
gaucuguuuuccuauuguuugu

SEQ ID NO: 12333 - RNA, 22 nt, Homo sapiens
uggucuucuggccuccagaacc

SEQ ID NO: 12334 - RNA, 21 nt, Homo sapiens
uacaaugcacaggagagccuc

SEQ ID NO: 12335 - RNA, 22 nt, Homo sapiens
uggacuguaauagagaacagaa

SEQ ID NO: 12336 - RNA, 22 nt, Homo sapiens
ugagaugugugcauucaacuca

SEQ ID NO: 12337 - RNA, 22 nt, Homo sapiens
aagaucaucauagagggcauga

SEQ ID NO: 12338 - RNA, 22 nt, Homo sapiens
uauuaguuuucuguggauuaca

SEQ ID NO: 12339 - RNA, 22 nt, Homo sapiens
gagacugagucuugcucugucg

SEQ ID NO: 12340 - RNA, 22 nt, Homo sapiens
uaaagcuuggauuuaggcuaau

SEQ ID NO: 12341 - RNA, 18 nt, Homo sapiens
cuugucaaaucuuuccuc

SEQ ID NO: 12342 - RNA, 22 nt, Homo sapiens
gacauguaaggcucucucuguu

SEQ ID NO: 12343 - RNA, 22 nt, Homo sapiens
uugagauuuuccucaaauauuu

SEQ ID NO: 12344 - RNA, 18 nt, Homo sapiens
cuggaugucgaguguguu

SEQ ID NO: 12345 - RNA, 22 nt, Homo sapiens
uaagugaauuugacagguaaug

SEQ ID NO: 12346 - RNA, 22 nt, Homo sapiens
ucucaaguggucgcaguuagau

SEQ ID NO: 12347 - RNA, 22 nt, Homo sapiens
auucacuuuuauagacaggucu

SEQ ID NO: 12348 - RNA, 22 nt, Homo sapiens
agaaacauucucuugccuccuu

SEQ ID NO: 12349 - RNA, 22 nt, Homo sapiens
uugauauguaguuggacuugau

SEQ ID NO: 12350 - RNA, 22 nt, Homo sapiens
gugugauuauuucaauugaugc

SEQ ID NO: 12351 - RNA, 22 nt, Homo sapiens
uucaagucuuggcuuugccacc

SEQ ID NO: 12352 - RNA, 22 nt, Homo sapiens
ugagauggagucuugucgccua

SEQ ID NO: 12353 - RNA, 22 nt, Homo sapiens
uggaauuaauuaaaauauacug

SEQ ID NO: 12354 - RNA, 22 nt, Homo sapiens
caagagaccugagugucauucu

SEQ ID NO: 12355 - RNA, 22 nt, Homo sapiens
aacugcuguuuggguacuggug

SEQ ID NO: 12356 - RNA, 22 nt, Homo sapiens
aagugcaaauucccaggcucug

SEQ ID NO: 12357 - RNA, 22 nt, Homo sapiens
uaucacaggucaggaaucuugc

SEQ ID NO: 12358 - RNA, 22 nt, Homo sapiens
ucaguaaaugcuguucucuuuu

SEQ ID NO: 12359 - RNA, 22 nt, Homo sapiens
uagcacaucuucuuggccugca

SEQ ID NO: 12360 - RNA, 22 nt, Homo sapiens
ugaaacauacacucugaugggg

SEQ ID NO: 12361 - RNA, 22 nt, Homo sapiens
cauacagcuaguaaguguaaga

SEQ ID NO: 12362 - RNA, 22 nt, Homo sapiens
gugaaaagaugagcaccauaca

SEQ ID NO: 12363 - RNA, 22 nt, Homo sapiens
auagcagugugaggacagacua

SEQ ID NO: 12364 - RNA, 22 nt, Homo sapiens
ugugguuuuuuucuccaauagg

SEQ ID NO: 12365 - RNA, 22 nt, Homo sapiens
augauguaggccauggguuucu

SEQ ID NO: 12366 - RNA, 22 nt, Homo sapiens
uugaaagucauuucuucuaagu

SEQ ID NO: 12367 - RNA, 22 nt, Homo sapiens
augugaaugugaucggauaguc

SEQ ID NO: 12368 - RNA, 22 nt, Homo sapiens
ugagaacagauggcuuuauuau

SEQ ID NO: 12369 - RNA, 22 nt, Homo sapiens
uaucaagaugacaaacuuugcu

SEQ ID NO: 12370 - RNA, 22 nt, Homo sapiens
auagcagugugaaaauguacua

SEQ ID NO: 12371 - RNA, 22 nt, Homo sapiens
guacaugcaugcaugggugugc

SEQ ID NO: 12372 - RNA, 22 nt, Homo sapiens
auugcaugucauguuuagugua

SEQ ID NO: 12373 - RNA, 22 nt, Homo sapiens
uccauugucuagauguaacaca

SEQ ID NO: 12374 - RNA, 21 nt, Homo sapiens
ucaguuacugagagagaagug

SEQ ID NO: 12375 - RNA, 22 nt, Homo sapiens
auguaauguuaaauugcuaauu

SEQ ID NO: 12376 - RNA, 22 nt, Homo sapiens
aagaugauguucuuuuucuuag

SEQ ID NO: 12377 - RNA, 22 nt, Homo sapiens
uggagagucauuuauaguauuu

SEQ ID NO: 12378 - RNA, 22 nt, Homo sapiens
aagggaauguuguggcugguug

SEQ ID NO: 12379 - RNA, 22 nt, Homo sapiens
aucuugcauuugcuaaaaugca

SEQ ID NO: 12380 - RNA, 22 nt, Homo sapiens
uuaauguaauugauugauugac

SEQ ID NO: 12381 - RNA, 22 nt, Homo sapiens
ugagauuaaucuuuaaguaaga

SEQ ID NO: 12382 - RNA, 22 nt, Homo sapiens
auggaaugccauuuauaaugga

SEQ ID NO: 12383 - RNA, 22 nt, Homo sapiens
uagcaguauaugagagcuauug

SEQ ID NO: 12384 - RNA, 22 nt, Homo sapiens
gugaaagacauauaugguuuga

SEQ ID NO: 12385 - RNA, 19 nt, Homo sapiens
auacacguguauacauaca

SEQ ID NO: 12386 - RNA, 22 nt, Homo sapiens
ugacauuacagucacuugcugu

SEQ ID NO: 12387 - RNA, 22 nt, Homo sapiens
guacaguauaguaauaggauuu

SEQ ID NO: 12388 - RNA, 22 nt, Homo sapiens
agcuggauguauguuaagugaa

SEQ ID NO: 12389 - RNA, 19 nt, Homo sapiens
ugugaacaucacagagugu

SEQ ID NO: 12390 - RNA, 22 nt, Homo sapiens
ugcaaauguuaggugucauuau

SEQ ID NO: 12391 - RNA, 22 nt, Homo sapiens
uagcagaauauaccucuuacuu

SEQ ID NO: 12392 - RNA, 22 nt, Homo sapiens
cuguuugaggguuugcuuucag

SEQ ID NO: 12393 - RNA, 22 nt, Homo sapiens
uauuacauccauaggcucugcu

SEQ ID NO: 12394 - RNA, 22 nt, Homo sapiens
gucacuguuuccuauuauauuu

SEQ ID NO: 12395 - RNA, 22 nt, Homo sapiens
uugggauaaucacaaaguaaaa

SEQ ID NO: 12396 - RNA, 22 nt, Homo sapiens
ugagauuaucuugaucuugaaa

SEQ ID NO: 12397 - RNA, 22 nt, Homo sapiens
aguguuuuuacaagcacucugg

SEQ ID NO: 12398 - RNA, 22 nt, Homo sapiens
uuucugaggccucaccagaagc

SEQ ID NO: 12399 - RNA, 23 nt, Homo sapiens
ggaaugaaaccugguuaugauau

SEQ ID NO: 12400 - RNA, 22 nt, Homo sapiens
uuagaauggaaaugcgagguua

SEQ ID NO: 12401 - RNA, 22 nt, Homo sapiens
cuuaacagugguauugaugacc

SEQ ID NO: 12402 - RNA, 22 nt, Homo sapiens
agcugcauuuacuuuugcacaa

SEQ ID NO: 12403 - RNA, 22 nt, Homo sapiens
uaagugaauguuggcuacugaa

SEQ ID NO: 12404 - RNA, 22 nt, Homo sapiens
gagacugagucuugcuuuguca

SEQ ID NO: 12405 - RNA, 22 nt, Homo sapiens
ucaugucuuguuguauuuauuu

SEQ ID NO: 12406 - RNA, 22 nt, Homo sapiens
uucauaguaacaguaacuaugg

SEQ ID NO: 12407 - RNA, 22 nt, Homo sapiens
uuaggcuuuauugaaaacaaua

SEQ ID NO: 12408 - RNA, 22 nt, Homo sapiens
auagcacaguguguguacacca

SEQ ID NO: 12409 - RNA, 22 nt, Homo sapiens
uugugaauggugccgcaauaaa

SEQ ID NO: 12410 - RNA, 22 nt, Homo sapiens
uggaaaucuaaguuuggauuga

SEQ ID NO: 12411 - RNA, 22 nt, Homo sapiens
ggaucauaugauagcucaauuu

SEQ ID NO: 12412 - RNA, 20 nt, Homo sapiens
ucucauggagggaaagagca

SEQ ID NO: 12413 - RNA, 22 nt, Homo sapiens
ugagaugauagauauguuaauu

SEQ ID NO: 12414 - RNA, 22 nt, Homo sapiens
augauaaguuauuagaagaaga

SEQ ID NO: 12415 - RNA, 22 nt, Homo sapiens
uucauaguucuuuuagucauua

SEQ ID NO: 12416 - RNA, 22 nt, Homo sapiens
aauacugugauaucgagcgauu

SEQ ID NO: 12417 - RNA, 22 nt, Homo sapiens
uuugugaaugucauaagcucca

SEQ ID NO: 12418 - RNA, 22 nt, Homo sapiens
guauuuguugcagcagcacuau

SEQ ID NO: 12419 - RNA, 22 nt, Homo sapiens
guggcaguuuuaaauaugaaaa

SEQ ID NO: 12420 - RNA, 22 nt, Homo sapiens
ugagaugaagcuagaagaaugg

SEQ ID NO: 12421 - RNA, 22 nt, Homo sapiens
cagugcauaggaucuaaaauuu

SEQ ID NO: 12422 - RNA, 22 nt, Homo sapiens
cagccgggugagguggcuuguu

SEQ ID NO: 12423 - RNA, 22 nt, Homo sapiens
uggaaugucagcuacaagaggg

SEQ ID NO: 12424 - RNA, 22 nt, Homo sapiens
cuccauuuaucugaaauuuuau

SEQ ID NO: 12425 - RNA, 22 nt, Homo sapiens
ucucagugaauguggaaaaagc

SEQ ID NO: 12426 - RNA, 18 nt, Homo sapiens
uugaauaguguccaaucu

SEQ ID NO: 12427 - RNA, 22 nt, Homo sapiens
guauuugauuauagcaugcuua

SEQ ID NO: 12428 - RNA, 22 nt, Homo sapiens
aacacggcccgcagagcaagcu

SEQ ID NO: 12429 - RNA, 22 nt, Homo sapiens
ugcuuugguagaaaucuuuggu

SEQ ID NO: 12430 - RNA, 22 nt, Homo sapiens
ucaacaggucaauugcauagaa

SEQ ID NO: 12431 - RNA, 22 nt, Homo sapiens
uugaaagaugaacuggauugga

SEQ ID NO: 12432 - RNA, 22 nt, Homo sapiens
uuaaguuaggcuucagcagucu

SEQ ID NO: 12433 - RNA, 22 nt, Homo sapiens
aauacagcacacagaugggucu

SEQ ID NO: 12434 - RNA, 22 nt, Homo sapiens
acaagcacaaauuuaauccugu

SEQ ID NO: 12435 - RNA, 20 nt, Homo sapiens
uccaguuuuggagacauucu

SEQ ID NO: 12436 - RNA, 19 nt, Homo sapiens
ugcaaauucuaaaaacuga

SEQ ID NO: 12437 - RNA, 22 nt, Homo sapiens
gaauggaacugacuauagcuga

SEQ ID NO: 12438 - RNA, 22 nt, Homo sapiens
ggcucguguuuucuguccaguu

SEQ ID NO: 12439 - RNA, 22 nt, Homo sapiens
acagugcuguuguguuuucacg

SEQ ID NO: 12440 - RNA, 22 nt, Homo sapiens
ucaguagcauugcuuauacagu

SEQ ID NO: 12441 - RNA, 22 nt, Homo sapiens
guaauaacuguggaaaaagguu

SEQ ID NO: 12442 - RNA, 22 nt, Homo sapiens
gauaaagauagcaauagggaca

SEQ ID NO: 12443 - RNA, 22 nt, Homo sapiens
ugaguuagguaauaauaaauau

SEQ ID NO: 12444 - RNA, 22 nt, Homo sapiens
guauggaagucaguuuguuggc

SEQ ID NO: 12445 - RNA, 23 nt, Homo sapiens
aaauuugccuauuauuccuaugg

SEQ ID NO: 12446 - RNA, 22 nt, Homo sapiens
aagggaauguuguagcugguuu

SEQ ID NO: 12447 - RNA, 22 nt, Homo sapiens
aacugguauuucccaugaauuu

SEQ ID NO: 12448 - RNA, 22 nt, Homo sapiens
cugaaagagcauuugaaugggu

SEQ ID NO: 12449 - RNA, 22 nt, Homo sapiens
guucuggagauaaagccaaggu

SEQ ID NO: 12450 - RNA, 22 nt, Homo sapiens
uguauuuguuguuaaauggaga

SEQ ID NO: 12451 - RNA, 22 nt, Homo sapiens
uuugcuauagugaauagugcug

SEQ ID NO: 12452 - RNA, 22 nt, Homo sapiens
ugaaaucauguaguuauugcaa

SEQ ID NO: 12453 - RNA, 23 nt, Homo sapiens
ugacagucucccgauggcuaggc

SEQ ID NO: 12454 - RNA, 22 nt, Homo sapiens
gagacugagucucacucuguca

SEQ ID NO: 12455 - RNA, 22 nt, Homo sapiens
uacaagcacaggcagcaggcug

SEQ ID NO: 12456 - RNA, 22 nt, Homo sapiens
cugacagucucauugauuugcu

SEQ ID NO: 12457 - RNA, 22 nt, Homo sapiens
uccaguuuuguuaacauauggu

SEQ ID NO: 12458 - RNA, 18 nt, Homo sapiens
cuuugcagcuuccagagg

SEQ ID NO: 12459 - RNA, 22 nt, Homo sapiens
augagauucuuagagaagucug

SEQ ID NO: 12460 - RNA, 22 nt, Homo sapiens
ugugguuuuaguaaaacuaugu

SEQ ID NO: 12461 - RNA, 22 nt, Homo sapiens
uacucuuuagcuccuuaaggaa

SEQ ID NO: 12462 - RNA, 22 nt, Homo sapiens
uugugaauggugcugcaguaaa

SEQ ID NO: 12463 - RNA, 22 nt, Homo sapiens
aguagcaauggcucugagcuau

SEQ ID NO: 12464 - RNA, 22 nt, Homo sapiens
uucaaaguguugguuuugggcu

SEQ ID NO: 12465 - RNA, 22 nt, Homo sapiens
uugagauguauguauauaaugu

SEQ ID NO: 12466 - RNA, 22 nt, Homo sapiens
auguauacaugcaggucacagg

SEQ ID NO: 12467 - RNA, 22 nt, Homo sapiens
ugagaaugaugauuuccaguuu

SEQ ID NO: 12468 - RNA, 22 nt, Homo sapiens
aaaugcagucuuuguucugggc

SEQ ID NO: 12469 - RNA, 22 nt, Homo sapiens
acugaguguugauuuagauuaa

SEQ ID NO: 12470 - RNA, 22 nt, Homo sapiens
uucugaguggcuuucaacacug

SEQ ID NO: 12471 - RNA, 22 nt, Homo sapiens
cuggauauguugcaacauuucc

SEQ ID NO: 12472 - RNA, 22 nt, Homo sapiens
agugcauugcaucucugcuuca

SEQ ID NO: 12473 - RNA, 23 nt, Homo sapiens
gagaucauucuggaauuagagug

SEQ ID NO: 12474 - RNA, 22 nt, Homo sapiens
aagcuacauuuuauuuauguca

SEQ ID NO: 12475 - RNA, 20 nt, Homo sapiens
ggaauagucuacacucugac

SEQ ID NO: 12476 - RNA, 22 nt, Homo sapiens
gugguuuucaacuccaccugca

SEQ ID NO: 12477 - RNA, 22 nt, Homo sapiens
guggaaaauuauugcuguuuuu

SEQ ID NO: 12478 - RNA, 22 nt, Homo sapiens
uuaaauacagcaugguguuucu

SEQ ID NO: 12479 - RNA, 22 nt, Homo sapiens
auuccauuuguguggaauggcu

SEQ ID NO: 12480 - RNA, 17 nt, Homo sapiens
aaucagauuucugagga

SEQ ID NO: 12481 - RNA, 22 nt, Homo sapiens
aguguuuuuaucaugaaagggu

SEQ ID NO: 12482 - RNA, 22 nt, Homo sapiens
cuggcagucugccucuucacug

SEQ ID NO: 12483 - RNA, 22 nt, Homo sapiens
guuuuuggggucacuauuaccg

SEQ ID NO: 12484 - RNA, 21 nt, Homo sapiens
aacagugcuuaguagauguuc

SEQ ID NO: 12485 - RNA, 20 nt, Homo sapiens
uaucacaguucaggaacucu

SEQ ID NO: 12486 - RNA, 22 nt, Homo sapiens
auaugcuuauuagcaagaaaua

SEQ ID NO: 12487 - RNA, 22 nt, Homo sapiens
caaagucuucucauuaugucuu

SEQ ID NO: 12488 - RNA, 22 nt, Homo sapiens
acauucagcuguuguuucaaug

SEQ ID NO: 12489 - RNA, 22 nt, Homo sapiens
ucagaguagagcgacuucuccu

SEQ ID NO: 12490 - RNA, 23 nt, Homo sapiens
ggaaacauccagucuuucaccau

SEQ ID NO: 12491 - RNA, 22 nt, Homo sapiens
cuggaauguuccuaaagauuca

SEQ ID NO: 12492 - RNA, 22 nt, Homo sapiens
cuuuggcaaugucauuuucaau

SEQ ID NO: 12493 - RNA, 22 nt, Homo sapiens
ugcuguuguuugaugaaguaau

SEQ ID NO: 12494 - RNA, 22 nt, Homo sapiens
ugagaugaacuugauuguuuua

SEQ ID NO: 12495 - RNA, 22 nt, Homo sapiens
uugcuuuguuacugcaguuucc

SEQ ID NO: 12496 - RNA, 22 nt, Homo sapiens
uucaagcuauggugaucuuuuc

SEQ ID NO: 12497 - RNA, 22 nt, Homo sapiens
ucagaguagaaacacuuccaua

SEQ ID NO: 12498 - RNA, 22 nt, Homo sapiens
cuucaaaguuggcuaggagaca

SEQ ID NO: 12499 - RNA, 23 nt, Homo sapiens
ugagauuacccagaaagaguaua

SEQ ID NO: 12500 - RNA, 22 nt, Homo sapiens
gugaaagauuaaaccagugugu

SEQ ID NO: 12501 - RNA, 22 nt, Homo sapiens
cuguaugugagaaauaauaagu

SEQ ID NO: 12502 - RNA, 22 nt, Homo sapiens
uccaguuuggaggcuugaugug

SEQ ID NO: 12503 - RNA, 22 nt, Homo sapiens
uagcaguaccccaguauccugg

SEQ ID NO: 12504 - RNA, 22 nt, Homo sapiens
aagaugauguuguguuuucacu

SEQ ID NO: 12505 - RNA, 22 nt, Homo sapiens
uauuagugccuaagucuuaggg

SEQ ID NO: 12506 - RNA, 22 nt, Homo sapiens
guaaaguaaagcacaucaaggu

SEQ ID NO: 12507 - RNA, 22 nt, Homo sapiens
ugugauaguuggcuaaagcagu

SEQ ID NO: 12508 - RNA, 19 nt, Homo sapiens
cauggcuuauaauuuuaau

SEQ ID NO: 12509 - RNA, 22 nt, Homo sapiens
guguucaaagcugauugagauu

SEQ ID NO: 12510 - RNA, 22 nt, Homo sapiens
aguauguagugcaaucagucag

SEQ ID NO: 12511 - RNA, 22 nt, Homo sapiens
agcuguuguuuuaagauacuaa

SEQ ID NO: 12512 - RNA, 22 nt, Homo sapiens
ucugagaugagacuuugaauuu

SEQ ID NO: 12513 - RNA, 22 nt, Homo sapiens
gaugugaaaucauaguuucuag

SEQ ID NO: 12514 - RNA, 20 nt, Homo sapiens
uggagugaagguucuggacc

SEQ ID NO: 12515 - RNA, 22 nt, Homo sapiens
acagugcuuggcacacaguaau

SEQ ID NO: 12516 - RNA, 22 nt, Homo sapiens
cugacuuuagaacccaaaaagu

SEQ ID NO: 12517 - RNA, 22 nt, Homo sapiens
aucuucucuugaagggugggga

SEQ ID NO: 12518 - RNA, 22 nt, Homo sapiens
auagcagugugaaaacagacua

SEQ ID NO: 12519 - RNA, 22 nt, Homo sapiens
uauuugauugacuuuagcagga

SEQ ID NO: 12520 - RNA, 21 nt, Homo sapiens
uucucagaggcaggggauaaa

SEQ ID NO: 12521 - RNA, 22 nt, Homo sapiens
uugaauagaaguguugaaagug

SEQ ID NO: 12522 - RNA, 22 nt, Homo sapiens
uuugggaaugaguuuaucauuu

SEQ ID NO: 12523 - RNA, 22 nt, Homo sapiens
uuucacagcaauugccuauugu

SEQ ID NO: 12524 - RNA, 22 nt, Homo sapiens
guguucaaauucugacagagag

SEQ ID NO: 12525 - RNA, 22 nt, Homo sapiens
aauugcauugaauuuguagcuu

SEQ ID NO: 12526 - RNA, 19 nt, Homo sapiens
uuugaauauaaugcagcua

SEQ ID NO: 12527 - RNA, 22 nt, Homo sapiens
guggaagucuuugguauuggua

SEQ ID NO: 12528 - RNA, 22 nt, Homo sapiens
uagcaguagacagacuuuggcu

SEQ ID NO: 12529 - RNA, 22 nt, Homo sapiens
auaucugcauugccauuuaugu

SEQ ID NO: 12530 - RNA, 22 nt, Homo sapiens
uuacuguauagaaucaucuuga

SEQ ID NO: 12531 - RNA, 22 nt, Homo sapiens
uaucacuuugauaguuuaaaug

SEQ ID NO: 12532 - RNA, 22 nt, Homo sapiens
uaauauguuuugaaaucaggaa

SEQ ID NO: 12533 - RNA, 22 nt, Homo sapiens
guaugauacuguaacagugggu

SEQ ID NO: 12534 - RNA, 22 nt, Homo sapiens
uugcugagucuuucuagguugc

SEQ ID NO: 12535 - RNA, 22 nt, Homo sapiens
gucauguuuaacuucuugagga

SEQ ID NO: 12536 - RNA, 22 nt, Homo sapiens
agguauguauguaugggagaaa

SEQ ID NO: 12537 - RNA, 22 nt, Homo sapiens
gauuccauugcgaauuuucaga

SEQ ID NO: 12538 - RNA, 19 nt, Homo sapiens
uauguaguuuucucaauau

SEQ ID NO: 12539 - RNA, 22 nt, Homo sapiens
ucugugaaugaacacuugaaaa

SEQ ID NO: 12540 - RNA, 21 nt, Homo sapiens
uaaaacuguaacuuuguccug

SEQ ID NO: 12541 - RNA, 22 nt, Homo sapiens
uuacuguagugucauaucguau

SEQ ID NO: 12542 - RNA, 22 nt, Homo sapiens
uuuuccagugggacucccauua

SEQ ID NO: 12543 - RNA, 19 nt, Homo sapiens
uaugcuauuuauuagaagu

SEQ ID NO: 12544 - RNA, 22 nt, Homo sapiens
gagacugaguuuugcucuuguu

SEQ ID NO: 12545 - RNA, 22 nt, Homo sapiens
uugagauggaguuucaauauug

SEQ ID NO: 12546 - RNA, 22 nt, Homo sapiens
cagugcaugacuguauauuauc

SEQ ID NO: 12547 - RNA, 22 nt, Homo sapiens
ugaaagguuuaauucugugaga

SEQ ID NO: 12548 - RNA, 22 nt, Homo sapiens
uggcaaaaaucacaaguaccuu

SEQ ID NO: 12549 - RNA, 22 nt, Homo sapiens
ugugaacagaauuagucaccua

SEQ ID NO: 12550 - RNA, 22 nt, Homo sapiens
uuaugcagcaaagugcuugaaa

SEQ ID NO: 12551 - RNA, 22 nt, Homo sapiens
gucuggcacagggaaaguacaa

SEQ ID NO: 12552 - RNA, 22 nt, Homo sapiens
uauggauuugccuauucuguau

SEQ ID NO: 12553 - RNA, 22 nt, Homo sapiens
ugagaaugcagaaucucgugca

SEQ ID NO: 12554 - RNA, 22 nt, Homo sapiens
augacugaguagcauuccauua

SEQ ID NO: 12555 - RNA, 22 nt, Homo sapiens
ucucuggauaucuacuuauguu

SEQ ID NO: 12556 - RNA, 22 nt, Homo sapiens
aucucaguuaauuccaucuuuc

SEQ ID NO: 12557 - RNA, 22 nt, Homo sapiens
agcaguacauaaaaagcauccu

SEQ ID NO: 12558 - RNA, 22 nt, Homo sapiens
gaaaacugcuucucuggguuuc

SEQ ID NO: 12559 - RNA, 21 nt, Homo sapiens
aagcacauugaguguguguga

SEQ ID NO: 12560 - RNA, 22 nt, Homo sapiens
agacaguguguguauauauggu

SEQ ID NO: 12561 - RNA, 22 nt, Homo sapiens
auggaguguaauauugagagcu

SEQ ID NO: 12562 - RNA, 22 nt, Homo sapiens
uuggcaguaucuacuacagcua

SEQ ID NO: 12563 - RNA, 22 nt, Homo sapiens
gaaauggaucagagcaagcuuu

SEQ ID NO: 12564 - RNA, 20 nt, Homo sapiens
gcaaauggaucccacaagcc

SEQ ID NO: 12565 - RNA, 22 nt, Homo sapiens
cuguucaaauuguuugugaagu

SEQ ID NO: 12566 - RNA, 22 nt, Homo sapiens
auacuguacugaaguacccauu

SEQ ID NO: 12567 - RNA, 22 nt, Homo sapiens
acagugcuuucaauguucagua

SEQ ID NO: 12568 - RNA, 22 nt, Homo sapiens
ugaugguuuuaaaaagaggagu

SEQ ID NO: 12569 - RNA, 23 nt, Homo sapiens
ugagaugucugauugcgaggguc

SEQ ID NO: 12570 - RNA, 22 nt, Homo sapiens
guguaaaacaauuagaggauuu

SEQ ID NO: 12571 - RNA, 21 nt, Homo sapiens
uuacaauggcuccuugaaggu

SEQ ID NO: 12572 - RNA, 22 nt, Homo sapiens
auaugcauguacccacacaggc

SEQ ID NO: 12573 - RNA, 22 nt, Homo sapiens
uaaacugucuugcaguuacaug

SEQ ID NO: 12574 - RNA, 22 nt, Homo sapiens
uaguuauggaguaauuuuaagc

SEQ ID NO: 12575 - RNA, 22 nt, Homo sapiens
uuagggaguaaucuaaaaaugg

SEQ ID NO: 12576 - RNA, 22 nt, Homo sapiens
guguucaaacccaggucugucu

SEQ ID NO: 12577 - RNA, 22 nt, Homo sapiens
auacaagcaguccaacuccaua

SEQ ID NO: 12578 - RNA, 16 nt, Homo sapiens
uuucccuuugguguuu

SEQ ID NO: 12579 - RNA, 22 nt, Homo sapiens
uugugaauggaguagcaggauc

SEQ ID NO: 12580 - RNA, 22 nt, Homo sapiens
uacagccacauaauguaugauu

SEQ ID NO: 12581 - RNA, 22 nt, Homo sapiens
uuggucucaucaagagcagcuu

SEQ ID NO: 12582 - RNA, 22 nt, Homo sapiens
gcugcuguuucucuuucagcau

SEQ ID NO: 12583 - RNA, 22 nt, Homo sapiens
gagacugagucuugcucuguca

SEQ ID NO: 12584 - RNA, 22 nt, Homo sapiens
uggaaugugaauaacuuccuuc

SEQ ID NO: 12585 - RNA, 22 nt, Homo sapiens
uucuauguuugaaaaugccaaa

SEQ ID NO: 12586 - RNA, 22 nt, Homo sapiens
uagcaguauggagcgaggccca

SEQ ID NO: 12587 - RNA, 22 nt, Homo sapiens
auagcagugugagaaugaacua

SEQ ID NO: 12588 - RNA, 22 nt, Homo sapiens
uguagucauuccuuuuugcuuu

SEQ ID NO: 12589 - RNA, 22 nt, Homo sapiens
ucuucaugcuugaaauaauagc

SEQ ID NO: 12590 - RNA, 22 nt, Homo sapiens
uaagugaauuucacuacugagu

SEQ ID NO: 12591 - RNA, 22 nt, Homo sapiens
auggauugucuccuugugccau

SEQ ID NO: 12592 - RNA, 21 nt, Homo sapiens
ugaaaugcaugugcacauuaa

SEQ ID NO: 12593 - RNA, 22 nt, Homo sapiens
uuccaguugugagcuauccggg

SEQ ID NO: 12594 - RNA, 22 nt, Homo sapiens
ucuuuggaggcgaucuguuuga

SEQ ID NO: 12595 - RNA, 18 nt, Homo sapiens
ggaaaacuuuucuaagua

SEQ ID NO: 12596 - RNA, 22 nt, Homo sapiens
gcagaauugguuucuucuaagg

SEQ ID NO: 12597 - RNA, 22 nt, Homo sapiens
ucucugagaaaaguuucuccca

SEQ ID NO: 12598 - RNA, 22 nt, Homo sapiens
auuacauagucaaggugucuca

SEQ ID NO: 12599 - RNA, 22 nt, Homo sapiens
cugugcuugauuauaugagugu

SEQ ID NO: 12600 - RNA, 22 nt, Homo sapiens
cugucucagccucuccaguagc

SEQ ID NO: 12601 - RNA, 22 nt, Homo sapiens
uuuuggcuagaaauauaccucc

SEQ ID NO: 12602 - RNA, 22 nt, Homo sapiens
aguucaaaucgagccuggccau

SEQ ID NO: 12603 - RNA, 19 nt, Homo sapiens
uuuguccugcccuuucuca

SEQ ID NO: 12604 - RNA, 22 nt, Homo sapiens
auggauguucuagggaugugau

SEQ ID NO: 12605 - RNA, 22 nt, Homo sapiens
aaguggaauguuuguggcacaa

SEQ ID NO: 12606 - RNA, 22 nt, Homo sapiens
uugaaagacagaggggcaaguu

SEQ ID NO: 12607 - RNA, 22 nt, Homo sapiens
agcuugugauuuagagugagag

SEQ ID NO: 12608 - RNA, 22 nt, Homo sapiens
cugggaugugacuguugccccc

SEQ ID NO: 12609 - RNA, 22 nt, Homo sapiens
auggaacuggagaugguuauau

SEQ ID NO: 12610 - RNA, 22 nt, Homo sapiens
ugucaugaacucacauucuggg

SEQ ID NO: 12611 - RNA, 22 nt, Homo sapiens
cauaaagauggaggaggccagg

SEQ ID NO: 12612 - RNA, 22 nt, Homo sapiens
uagcaguaagaaacugacauug

SEQ ID NO: 12613 - RNA, 23 nt, Homo sapiens
ucaguacuccacuuucaauagug

SEQ ID NO: 12614 - RNA, 22 nt, Homo sapiens
uugugaaaucuaggcagagguu

SEQ ID NO: 12615 - RNA, 22 nt, Homo sapiens
uaguauguuuauagcauugagu

SEQ ID NO: 12616 - RNA, 22 nt, Homo sapiens
ugugaauggugcugcaaugaac

SEQ ID NO: 12617 - RNA, 22 nt, Homo sapiens
gagauugucaugauuacauugu

SEQ ID NO: 12618 - RNA, 22 nt, Homo sapiens
aguccauuugaugaugauucca

SEQ ID NO: 12619 - RNA, 22 nt, Homo sapiens
caugcacugaguccaccucugg

SEQ ID NO: 12620 - RNA, 22 nt, Homo sapiens
agaauguaaacagaauagagga

SEQ ID NO: 12621 - RNA, 22 nt, Homo sapiens
uuucagagucaucugcccaagu

SEQ ID NO: 12622 - RNA, 22 nt, Homo sapiens
ggcaguuuguuugugaggucca

SEQ ID NO: 12623 - RNA, 22 nt, Homo sapiens
auguggaaagcagcaugauaug

SEQ ID NO: 12624 - RNA, 22 nt, Homo sapiens
gcugauguugaccuugaucacc

SEQ ID NO: 12625 - RNA, 22 nt, Homo sapiens
cagagaucaugcaacugcucgc

SEQ ID NO: 12626 - RNA, 22 nt, Homo sapiens
ugugcauaugucuuuauaguag

SEQ ID NO: 12627 - RNA, 22 nt, Homo sapiens
caaaagugguucuuauccuuuu

SEQ ID NO: 12628 - RNA, 22 nt, Homo sapiens
cuccauuuggaacagauguccu

SEQ ID NO: 12629 - RNA, 22 nt, Homo sapiens
gugacugcauccauccaggcuu

SEQ ID NO: 12630 - RNA, 22 nt, Homo sapiens
ugagauaaggaaauugaggcuc

SEQ ID NO: 12631 - RNA, 21 nt, Mycobacterium leprae
ugaccuagauaugaccugagc

SEQ ID NO: 12632 - RNA, 22 nt, Mycobacterium leprae
ugaauuugaucuugucauuguu

SEQ ID NO: 12633 - RNA, 22 nt, Mycobacterium leprae
ucuuccugcaugggcugauccg

SEQ ID NO: 12634 - RNA, 20 nt, Mycobacterium leprae
ucuauuaagauuaacguggc

SEQ ID NO: 12635 - RNA, 22 nt, Mycobacterium leprae
ugagaaggugcgccagcgcagc

SEQ ID NO: 12636 - RNA, 22 nt, Mycobacterium leprae
ugaugaaguauugguaccaggc

SEQ ID NO: 12637 - RNA, 22 nt, Mycobacterium leprae
uggaggagaggucgcauguugg

SEQ ID NO: 12638 - RNA, 22 nt, Mycobacterium leprae
ugggaaaaugggcuucgucuuc

SEQ ID NO: 12639 - RNA, 22 nt, Mycobacterium leprae
uucugagugauccgcacgaugg

SEQ ID NO: 12640 - RNA, 22 nt, Mycobacterium leprae
uucgauuucggggaauucgaaa

SEQ ID NO: 12641 - RNA, 22 nt, Mycobacterium leprae
uuacugugccgcaacuguauuc

SEQ ID NO: 12642 - RNA, 22 nt, Mycobacterium leprae
uuaaaaccaucguggggcucga

SEQ ID NO: 12643 - RNA, 22 nt, Mycobacterium leprae
uugaggaucagguucagcuggc

SEQ ID NO: 12644 - RNA, 22 nt, Mycobacterium leprae
uucuugacuugcuugcgcguau

SEQ ID NO: 12645 - RNA, 22 nt, Mycobacterium leprae
gacaaauuccugggacagguac

SEQ ID NO: 12646 - RNA, 19 nt, Mycobacterium leprae
gaaaagugugauuuauuga

SEQ ID NO: 12647 - RNA, 22 nt, Mycobacterium leprae
gcagauugcccacuuuggcacg

SEQ ID NO: 12648 - RNA, 22 nt, Mycobacterium leprae
gcaguuucggauucgccgggac

SEQ ID NO: 12649 - RNA, 22 nt, Mycobacterium leprae
gcccacaacgcaacugagccga

SEQ ID NO: 12650 - RNA, 22 nt, Mycobacterium leprae
gucuacauguugaugaugccag

SEQ ID NO: 12651 - RNA, 22 nt, Mycobacterium leprae
gucuuguccggccaagcuagga

SEQ ID NO: 12652 - RNA, 22 nt, Mycobacterium leprae
gucuuugcuaacgguuuggucu

SEQ ID NO: 12653 - RNA, 22 nt, Mycobacterium leprae
ggguugauccgcgcgauggaga

SEQ ID NO: 12654 - RNA, 22 nt, Mycobacterium leprae
ggguugcauuucaucugucgcg

SEQ ID NO: 12655 - RNA, 22 nt, Mycobacterium leprae
gguaaugauugcguaacaacca

SEQ ID NO: 12656 - RNA, 22 nt, Mycobacterium leprae
gggguugcuggauugcccuggu

SEQ ID NO: 12657 - RNA, 22 nt, Mycobacterium leprae
ggaagaauggcuaccacgucga

SEQ ID NO: 12658 - RNA, 22 nt, Mycobacterium leprae
gcugguagcgaugucgagccug

SEQ ID NO: 12659 - RNA, 20 nt, Mycobacterium leprae
aguauuuugccgcaggccau

SEQ ID NO: 12660 - RNA, 22 nt, Mycobacterium leprae
agucagugacucgagcgauaca

SEQ ID NO: 12661 - RNA, 22 nt, Mycobacterium leprae
agugauuccuugccuggacguc

SEQ ID NO: 12662 - RNA, 22 nt, Mycobacterium leprae
uuuggcuugacgugcuuuagcu

SEQ ID NO: 12663 - RNA, 22 nt, Mycobacterium leprae
uucagacuaguaauuagaguua

SEQ ID NO: 12664 - RNA, 20 nt, Mycobacterium leprae
uucaucuugcaagucccggu

SEQ ID NO: 12665 - RNA, 21 nt, Mycobacterium leprae
ugucuugacuguuggacagga

SEQ ID NO: 12666 - RNA, 22 nt, Mycobacterium leprae
ugucaaggaugccaucgagugu

SEQ ID NO: 12667 - RNA, 20 nt, Mycobacterium leprae
ugguguagcgcacacccugu

SEQ ID NO: 12668 - RNA, 22 nt, Mycobacterium leprae
auauugucggcgaguuugaucc

SEQ ID NO: 12669 - RNA, 22 nt, Mycobacterium leprae
aucggcagcggugggggaucca

SEQ ID NO: 12670 - RNA, 22 nt, Mycobacterium leprae
augguaugugguguugagacau

SEQ ID NO: 12671 - RNA, 22 nt, Mycobacterium leprae
cagccaggcagcugcuaggcgg

SEQ ID NO: 12672 - RNA, 22 nt, Mycobacterium leprae
ugauaucuauacgcgaccaggu

SEQ ID NO: 12673 - RNA, 22 nt, Mycobacterium leprae
ugaugauuggcauggcagugaa

SEQ ID NO: 12674 - RNA, 22 nt, Mycobacterium leprae
ugauggcgguauguaauguugg

SEQ ID NO: 12675 - RNA, 23 nt, Mycobacterium leprae
ugaauagcggcagcuugggcuca

SEQ ID NO: 12676 - RNA, 22 nt, Mycobacterium leprae
ugaacugacuacgcucagagcg

SEQ ID NO: 12677 - RNA, 23 nt, Mycobacterium leprae
ugaagccacgugaucgcacaucc

SEQ ID NO: 12678 - RNA, 22 nt, Mycobacterium leprae
ucuuuugacuugucauguucau

SEQ ID NO: 12679 - RNA, 22 nt, Mycobacterium leprae
ugggcuaugugguucauucugg

SEQ ID NO: 12680 - RNA, 22 nt, Mycobacterium leprae
uggcuuuuggcugaaacugacc

SEQ ID NO: 12681 - RNA, 22 nt, Mycobacterium leprae
ugcugaugucgaagacaaugua

SEQ ID NO: 12682 - RNA, 23 nt, Mycobacterium leprae
ugcugcugaugaucgcauccagc

SEQ ID NO: 12683 - RNA, 22 nt, Mycobacterium leprae
uccugcucggcguggugcucgg

SEQ ID NO: 12684 - RNA, 22 nt, Mycobacterium leprae
ucuuguuugcgggauugucgug

SEQ ID NO: 12685 - RNA, 22 nt, Mycobacterium leprae
cugguuuugguccuggggcagg

SEQ ID NO: 12686 - RNA, 22 nt, Mycobacterium leprae
gaaaaugacgaugucgccgggc

SEQ ID NO: 12687 - RNA, 22 nt, Mycobacterium leprae
cucgaugucauccggauagugg

SEQ ID NO: 12688 - RNA, 22 nt, Mycobacterium leprae
cugcugcugccaggcaugcggu

SEQ ID NO: 12689 - RNA, 22 nt, Mycobacterium leprae
cuggcacccagggccugcuguc

SEQ ID NO: 12690 - RNA, 19 nt, Mycobacterium leprae
gcagugaucugggccaguu

SEQ ID NO: 12691 - RNA, 22 nt, Mycobacterium leprae
gaggaugaagucgacgagcuac

SEQ ID NO: 12692 - RNA, 22 nt, Mycobacterium leprae
cccugcucaucaugucggugga

SEQ ID NO: 12693 - RNA, 22 nt, Mycobacterium leprae
ccaucaccggcaguuuagaacu

SEQ ID NO: 12694 - RNA, 22 nt, Mycobacterium leprae
cagucaacuagcuuggcuucuc

SEQ ID NO: 12695 - RNA, 18 nt, Mycobacterium leprae
caggggcuucgaugcggu

SEQ ID NO: 12696 - RNA, 22 nt, Mycobacterium leprae
ccaagcugcuccggucggugcu

SEQ ID NO: 12697 - RNA, 22 nt, Mycobacterium leprae
ccacaucuggcagaagagcugu

SEQ ID NO: 12698 - RNA, 22 nt, Mycobacterium leprae
cgaccugcaggucguuaucgcg

SEQ ID NO: 12699 - RNA, 22 nt, Mycobacterium leprae
cgaaggaaugcaggcuucaguc

SEQ ID NO: 12700 - RNA, 22 nt, Mycobacterium leprae
cgccagugcgcuggcuaggcug

SEQ ID NO: 12701 - RNA, 22 nt, Mycobacterium leprae
cgcugauggugucgggcggcag

SEQ ID NO: 12702 - RNA, 22 nt, Mycobacterium leprae
guaaagcacacagcgucgcccc

SEQ ID NO: 12703 - RNA, 22 nt, Mycobacterium leprae
ggugauagugcugcuguuggca

SEQ ID NO: 12704 - RNA, 22 nt, Mycobacterium leprae
gggagcucaaguucuuuggcua

SEQ ID NO: 12705 - RNA, 22 nt, Mycobacterium leprae
guuugguuuuucaggcuauucu

SEQ ID NO: 12706 - RNA, 22 nt, Mycobacterium leprae
guuuuauuuaacuagacaucca

SEQ ID NO: 12707 - RNA, 22 nt, Mycobacterium leprae
gugcguugccguuauguuacgg

SEQ ID NO: 12708 - RNA, 22 nt, Mycobacterium leprae
uauuagcuugcacgguaacaac

SEQ ID NO: 12709 - RNA, 22 nt, Mycobacterium leprae
uaucucauugggcgacgacugc

SEQ ID NO: 12710 - RNA, 22 nt, Mycobacterium leprae
uagcaugccgguaggguuugug

SEQ ID NO: 12711 - RNA, 23 nt, Mycobacterium leprae
uagcugaugccaggcuccgggac

SEQ ID NO: 12712 - RNA, 22 nt, Mycobacterium leprae
ucccggcugcgagcauuugcaa

SEQ ID NO: 12713 - RNA, 22 nt, Mycobacterium leprae
gcugcugcuagggcacccguug

SEQ ID NO: 12714 - RNA, 22 nt, Mycobacterium leprae
ggaauuugcaacguagugcagg

SEQ ID NO: 12715 - RNA, 19 nt, Mycobacterium leprae
gcuugaggguuguccggug

SEQ ID NO: 12716 - RNA, 22 nt, Mycobacterium leprae
aacuuuugguugucgucuggcg

SEQ ID NO: 12717 - RNA, 22 nt, Mycobacterium leprae
acaagcuguguccgucggcaga

SEQ ID NO: 12718 - RNA, 22 nt, Mycobacterium leprae
aaugcuaugauaauuuggcuga

SEQ ID NO: 12719 - RNA, 22 nt, Mycobacterium leprae
aaauauuuugggcaagcaacag

SEQ ID NO: 12720 - RNA, 22 nt, Mycobacterium leprae
aaugugaacgugcaagaagcga

SEQ ID NO: 12721 - RNA, 22 nt, Mycobacterium leprae
aaauguucgaaguaguucgcgg

SEQ ID NO: 12722 - RNA, 22 nt, Mycobacterium leprae
agcagaucauguucgaacuugc

SEQ ID NO: 12723 - RNA, 22 nt, Mycobacterium leprae
agcugaugagcacgcgggcggg

SEQ ID NO: 12724 - RNA, 17 nt, Mycobacterium leprae
agcagggcagcgaucga

SEQ ID NO: 12725 - RNA, 22 nt, Mycobacterium leprae
agcugauagacggcggcagugg

SEQ ID NO: 12726 - RNA, 22 nt, Mycobacterium leprae
agccauccuggugagcuuucuu

SEQ ID NO: 12727 - RNA, 18 nt, Mycobacterium leprae
accugcucgaagcugaag

SEQ ID NO: 12728 - RNA, 22 nt, Mycobacterium leprae
acugaguuuaugcaguguuccg

SEQ ID NO: 12729 - RNA, 22 nt, Mycobacterium leprae
augccauugcuggaccuaaucc

SEQ ID NO: 12730 - RNA, 22 nt, Mycobacterium leprae
caacaucucggggugcaacuug

SEQ ID NO: 12731 - RNA, 22 nt, Mycobacterium leprae
cagcaacagcgcagaauuuucu

SEQ ID NO: 12732 - RNA, 22 nt, Mycobacterium leprae
augugguuggcagcgcuggaaa

SEQ ID NO: 12733 - RNA, 22 nt, Mycobacterium leprae
augugugaauuuaacauguuga

SEQ ID NO: 12734 - RNA, 22 nt, Mycobacterium leprae
auguauuggugcaaguguccug

SEQ ID NO: 12735 - RNA, 22 nt, Mycobacterium leprae
augucacuucccgugccgauuu

SEQ ID NO: 12736 - RNA, 22 nt, Mycobacterium leprae
auguucagaucggcaucgguua

SEQ ID NO: 12737 - RNA, 22 nt, Mycobacterium leprae
auggggguguucggugucaacc

SEQ ID NO: 12738 - RNA, 22 nt, Mycobacterium leprae
augcugaugcccacgcgucgac

SEQ ID NO: 12739 - RNA, 22 nt, Mycobacterium leprae
augcuguguuucaaccguauug

SEQ ID NO: 12740 - RNA, 22 nt, Mycobacterium leprae
cccugcucaguagucggacccg

SEQ ID NO: 12741 - RNA, 19 nt, Mycobacterium leprae
caugaugacguaccuaguc

SEQ ID NO: 12742 - RNA, 22 nt, Mycobacterium leprae
caugggauucgacguaguucac

SEQ ID NO: 12743 - RNA, 22 nt, Mycobacterium leprae
caggagcacgguaacucggugc

SEQ ID NO: 12744 - RNA, 22 nt, Mycobacterium leprae
cuuuggcuucggguagauugga

SEQ ID NO: 12745 - RNA, 22 nt, Mycobacterium leprae
cuuuugaagcugcuggcugagg

SEQ ID NO: 12746 - RNA, 22 nt, Mycobacterium leprae
cuuaauccgacgacccugccau

SEQ ID NO: 12747 - RNA, 22 nt, Mycobacterium leprae
cuaggcaguuuucgggguaucg

SEQ ID NO: 12748 - RNA, 22 nt, Mycobacterium leprae
cugaacaguucgucuuagccgc

SEQ ID NO: 12749 - RNA, 22 nt, Mycobacterium leprae
cugcugcugacacgccguuccg

SEQ ID NO: 12750 - RNA, 21 nt, Mycobacterium leprae
cgauggggguugaucuuugag

SEQ ID NO: 12751 - RNA, 22 nt, Mycobacterium leprae
cgcaaauggcguucauaauggg

SEQ ID NO: 12752 - RNA, 22 nt, Homo sapiens
uuucuauguugaccagucuaga

SEQ ID NO: 12753 - RNA, 22 nt, Homo sapiens
ucagaguagaaacacuuccaua

SEQ ID NO: 12754 - RNA, 22 nt, Homo sapiens
aaagugcugggauuggccgggc

SEQ ID NO: 12755 - RNA, 22 nt, Homo sapiens
uuaagucacacuagacaacuga

SEQ ID NO: 12756 - RNA, 22 nt, Homo sapiens
uggaaugguaucuuguuggggu

SEQ ID NO: 12757 - RNA, 22 nt, Homo sapiens
aauaaagucugaagugugcuua

SEQ ID NO: 12758 - RNA, 20 nt, Homo sapiens
guggaagauaaguagccuga

SEQ ID NO: 12759 - RNA, 22 nt, Homo sapiens
ucugacacagugauuaguaaau

SEQ ID NO: 12760 - RNA, 22 nt, Homo sapiens
aaagugcuucucuuuggugggu

SEQ ID NO: 12761 - RNA, 22 nt, Homo sapiens
auuaagugcuugcagaagucca

SEQ ID NO: 12762 - RNA, 22 nt, Homo sapiens
uugagauaggagcuguuguucu

SEQ ID NO: 12763 - RNA, 22 nt, Homo sapiens
augguuuauuuguaagcagagu

SEQ ID NO: 12764 - RNA, 22 nt, Homo sapiens
ugugaauggugcugcaaugaac

SEQ ID NO: 12765 - RNA, 18 nt, Homo sapiens
aaaaagugcucaggccua

SEQ ID NO: 12766 - RNA, 22 nt, Homo sapiens
agaaccaaucccacauggauac

SEQ ID NO: 12767 - RNA, 22 nt, Homo sapiens
auuuggguuuuacaucaggcua

SEQ ID NO: 12768 - RNA, 21 nt, Homo sapiens
uaaagcuuagcuauaguggcu

SEQ ID NO: 12769 - RNA, 22 nt, Homo sapiens
aucacugugauuucuacugugc

SEQ ID NO: 12770 - RNA, 22 nt, Homo sapiens
cccaguuuugcuucucaugagg

SEQ ID NO: 12771 - RNA, 22 nt, Homo sapiens
auggccgggugcgguggcucac

SEQ ID NO: 12772 - RNA, 22 nt, Homo sapiens
aauugcacuacugcacucccac

SEQ ID NO: 12773 - RNA, 22 nt, Homo sapiens
aaagucuguuacagcuauuucu

SEQ ID NO: 12774 - RNA, 22 nt, Homo sapiens
gugagauaucuagacuagggaa

SEQ ID NO: 12775 - RNA, 22 nt, Homo sapiens
gcauggccuuuaaaugucacag

SEQ ID NO: 12776 - RNA, 21 nt, Homo sapiens
uacaaugcacaggagagccuc

SEQ ID NO: 12777 - RNA, 22 nt, Homo sapiens
cugcaguaaccacuguaggugu

SEQ ID NO: 12778 - RNA, 22 nt, Homo sapiens
uugaaagacagaggggcaaguu

SEQ ID NO: 12779 - RNA, 22 nt, Homo sapiens
uauugauuaauugugauuaggc

SEQ ID NO: 12780 - RNA, 22 nt, Homo sapiens
augaccaaugggcagagcuaga

SEQ ID NO: 12781 - RNA, 22 nt, Homo sapiens
aauaaagcagcuuuuugggacu

SEQ ID NO: 12782 - RNA, 19 nt, Homo sapiens
uccaccgcgugcaccucua

SEQ ID NO: 12783 - RNA, 22 nt, Homo sapiens
aacagugcuguuauaaauguac

SEQ ID NO: 12784 - RNA, 17 nt, Homo sapiens
cccuaguagcugggacu

SEQ ID NO: 12785 - RNA, 22 nt, Homo sapiens
auaaaugcuuagaucuguauau

SEQ ID NO: 12786 - RNA, 21 nt, Homo sapiens
auugcacaauauacccaugua

SEQ ID NO: 12787 - RNA, 22 nt, Homo sapiens
uaagugcuugacuuugauguuu

SEQ ID NO: 12788 - RNA, 22 nt, Homo sapiens
uaagugaauuucacuacugagu

SEQ ID NO: 12789 - RNA, 22 nt, Homo sapiens
aaagugcugagacagacuggga

SEQ ID NO: 12790 - RNA, 22 nt, Homo sapiens
uuuuaguggacaaagguauuua

SEQ ID NO: 12791 - RNA, 20 nt, Homo sapiens
guccauuugcugccauugcu

SEQ ID NO: 12792 - RNA, 22 nt, Homo sapiens
auagcagugugaggacagacua

SEQ ID NO: 12793 - RNA, 22 nt, Homo sapiens
aacacuaucugccuuacaggga

SEQ ID NO: 12794 - RNA, 22 nt, Homo sapiens
cauugcacucuaucccgguggg

SEQ ID NO: 12795 - RNA, 22 nt, Homo sapiens
cauugcacugcagcccgggcaa

SEQ ID NO: 12796 - RNA, 22 nt, Homo sapiens
uuaaaagcuaucuccaagguca

SEQ ID NO: 12797 - RNA, 22 nt, Homo sapiens
auuauugcucccaauuuuucac

SEQ ID NO: 12798 - RNA, 19 nt, Homo sapiens
cauugcacuccacccuggg

SEQ ID NO: 12799 - RNA, 22 nt, Homo sapiens
augaguaugagaauacauuaag

SEQ ID NO: 12800 - RNA, 22 nt, Homo sapiens
uagcagcauaaauggacuaaga

SEQ ID NO: 12801 - RNA, 22 nt, Homo sapiens
ugagauaauuuacuuguugagg

SEQ ID NO: 12802 - RNA, 22 nt, Homo sapiens
uugaaggaggugcucacucucg

SEQ ID NO: 12803 - RNA, 22 nt, Homo sapiens
ucuggcuugugaacugucuucu

SEQ ID NO: 12804 - RNA, 22 nt, Homo sapiens
gagauacuugguuucuguuucu

SEQ ID NO: 12805 - RNA, 22 nt, Homo sapiens
cauacagcuaguaaguguaaga

SEQ ID NO: 12806 - RNA, 22 nt, Homo sapiens
uucuggccuccauuuuucuccu

SEQ ID NO: 12807 - RNA, 19 nt, Homo sapiens
uacccagaagcagcauugu

SEQ ID NO: 12808 - RNA, 22 nt, Homo sapiens
acagaacugggcuugcuuuugg

SEQ ID NO: 12809 - RNA, 22 nt, Homo sapiens
uugaaagaugaacuggauugga

SEQ ID NO: 12810 - RNA, 22 nt, Homo sapiens
guaaucucagcuacuugggagg

SEQ ID NO: 12811 - RNA, 22 nt, Homo sapiens
uaugugcaaauuaauugcuaga

SEQ ID NO: 12812 - RNA, 22 nt, Homo sapiens
aacagugcauuccuguccauau

SEQ ID NO: 12813 - RNA, 22 nt, Homo sapiens
aagugcuucuuuccucgagaag

SEQ ID NO: 12814 - RNA, 22 nt, Homo sapiens
aagugcaaauucccaggcucug

SEQ ID NO: 12815 - RNA, 22 nt, Homo sapiens
uucauaguucuuuuagucauua

SEQ ID NO: 12816 - RNA, 22 nt, Homo sapiens
acccugugaauauuuaaacuuc

SEQ ID NO: 12817 - RNA, 22 nt, Homo sapiens
gacacugucuucugcucuuaaa

SEQ ID NO: 12818 - RNA, 22 nt, Homo sapiens
caagugaauaguugcucucaga

SEQ ID NO: 12819 - RNA, 22 nt, Homo sapiens
uuacuguauagaaucaucuuga

SEQ ID NO: 12820 - RNA, 19 nt, Homo sapiens
ugacaugaaacccaagauc

SEQ ID NO: 12821 - RNA, 22 nt, Homo sapiens
uucauggaacaaguggguucaa

SEQ ID NO: 12822 - RNA, 22 nt, Homo sapiens
uggucuucuggccuccagaacc

SEQ ID NO: 12823 - RNA, 22 nt, Homo sapiens
ugacauuacagucacuugcugu

SEQ ID NO: 12824 - RNA, 22 nt, Homo sapiens
ucaaagugagcuccuucucacu

SEQ ID NO: 12825 - RNA, 22 nt, Homo sapiens
uaagugaauguuggcuacugaa

SEQ ID NO: 12826 - RNA, 22 nt, Homo sapiens
aucaugucuucccagugauucu

SEQ ID NO: 12827 - RNA, 22 nt, Homo sapiens
uaucacaggucaggaaucuugc

SEQ ID NO: 12828 - RNA, 22 nt, Homo sapiens
gcaaagaaugcagauuugccuc

SEQ ID NO: 12829 - RNA, 22 nt, Homo sapiens
ugagacacugaauccggccuga

SEQ ID NO: 12830 - RNA, 22 nt, Homo sapiens
uugagcaauccuccugccaugu

SEQ ID NO: 12831 - RNA, 22 nt, Homo sapiens
ucggcucagugcaagcucugcc

SEQ ID NO: 12832 - RNA, 22 nt, Homo sapiens
guaaaguaaagcacaucaaggu

SEQ ID NO: 12833 - RNA, 22 nt, Homo sapiens
uugacuucagagcugauucaag

SEQ ID NO: 12834 - RNA, 22 nt, Homo sapiens
uaugucuucuuuagagaaaugu

SEQ ID NO: 12835 - RNA, 22 nt, Homo sapiens
augggaaaaucagaaggccugg

SEQ ID NO: 12836 - RNA, 22 nt, Homo sapiens
uagcagaauauaccucuuacuu

SEQ ID NO: 12837 - RNA, 21 nt, Homo sapiens
gacauggcgauacuccgucuc

SEQ ID NO: 12838 - RNA, 22 nt, Homo sapiens
cuagcagacaugggcugaacca

SEQ ID NO: 12839 - RNA, 22 nt, Homo sapiens
uagcaguauggagcgaggccca

SEQ ID NO: 12840 - RNA, 22 nt, Homo sapiens
uugaaagucauuucuucuaagu

SEQ ID NO: 12841 - RNA, 22 nt, Homo sapiens
cuggaguaugaaccauguauca

SEQ ID NO: 12842 - RNA, 22 nt, Homo sapiens
uggcaagagauaugugucuaua

SEQ ID NO: 12843 - RNA, 22 nt, Homo sapiens
uuaaucuguucucuguauucua

SEQ ID NO: 12844 - RNA, 22 nt, Homo sapiens
ugcauccauucuagacucaucu

SEQ ID NO: 12845 - RNA, 20 nt, Homo sapiens
ugugauuauuuaguugcaug

SEQ ID NO: 12846 - RNA, 20 nt, Homo sapiens
uaagugcuuuauauugauua

SEQ ID NO: 12847 - RNA, 18 nt, Homo sapiens
uaaauugcuucaccugag

SEQ ID NO: 12848 - RNA, 22 nt, Homo sapiens
uggaaugugaauaacuuccuuc

SEQ ID NO: 12849 - RNA, 17 nt, Homo sapiens
ucuaauaauaugcauuu

SEQ ID NO: 12850 - RNA, 22 nt, Homo sapiens
uaaagcuuggauuuaggcuaau

SEQ ID NO: 12851 - RNA, 22 nt, Homo sapiens
gugugauuguuaauuuuaggug

SEQ ID NO: 12852 - RNA, 18 nt, Homo sapiens
cuugucaaaucuuuccuc

SEQ ID NO: 12853 - RNA, 22 nt, Homo sapiens
uggaaugucagcuacaagaggg

SEQ ID NO: 12854 - RNA, 20 nt, Homo sapiens
auguaauguaugauauguac

SEQ ID NO: 12855 - RNA, 22 nt, Homo sapiens
uugucuccuagacgaccaggcg

SEQ ID NO: 12856 - RNA, 22 nt, Homo sapiens
cacauugcaggaaaguucauua

SEQ ID NO: 12857 - RNA, 20 nt, Homo sapiens
cuugccuagcccuuugccuc

SEQ ID NO: 12858 - RNA, 18 nt, Homo sapiens
cuuaacauugggaugaua

SEQ ID NO: 12859 - RNA, 17 nt, Homo sapiens
uuuuggauuagaaaucc

SEQ ID NO: 12860 - RNA, 22 nt, Homo sapiens
uaaucacagagguuuggccuca

SEQ ID NO: 12861 - RNA, 22 nt, Homo sapiens
gugucccagugugcauacaggu

SEQ ID NO: 12862 - RNA, 22 nt, Homo sapiens
acugcacuccaccuugggcaac

SEQ ID NO: 12863 - RNA, 18 nt, Homo sapiens
ggaaaacuuuucuaagua

SEQ ID NO: 12864 - RNA, 22 nt, Homo sapiens
cauugcacuccagcucugggcg

SEQ ID NO: 12865 - RNA, 22 nt, Homo sapiens
ccuguguuaugguuucuaaugu

SEQ ID NO: 12866 - RNA, 22 nt, Homo sapiens
uagaaagcaugaccuucagaua

SEQ ID NO: 12867 - RNA, 22 nt, Homo sapiens
ugaaacauacacucugaugggg

SEQ ID NO: 12868 - RNA, 22 nt, Homo sapiens
auugcaugucauguuuagugua

SEQ ID NO: 12869 - RNA, 22 nt, Homo sapiens
cauugcacuccagccugaguga

SEQ ID NO: 12870 - RNA, 23 nt, Homo sapiens
ugagaugucugauugcgaggguc

SEQ ID NO: 12871 - RNA, 22 nt, Homo sapiens
guggaauggaaugauuguguau

SEQ ID NO: 12872 - RNA, 20 nt, Homo sapiens
aucacuggagaaggaaaccu

SEQ ID NO: 12873 - RNA, 22 nt, Homo sapiens
guaaucucagcuacucaggagg

SEQ ID NO: 12874 - RNA, 22 nt, Homo sapiens
gacauguaaggcucucucuguu

SEQ ID NO: 12875 - RNA, 22 nt, Homo sapiens
aauacugugauaucgagcgauu

SEQ ID NO: 12876 - RNA, 22 nt, Homo sapiens
ucacuaaagaaaauggcaugga

SEQ ID NO: 12877 - RNA, 22 nt, Homo sapiens
uaguuauggaguaauuuuaagc

SEQ ID NO: 12878 - RNA, 22 nt, Homo sapiens
aaguggaauguuuguggcacaa

SEQ ID NO: 12879 - RNA, 18 nt, Homo sapiens
agagcacugaguuuuaga

SEQ ID NO: 12880 - RNA, 22 nt, Homo sapiens
auaagauaguggaagugggauu

SEQ ID NO: 12881 - RNA, 22 nt, Homo sapiens
uuccaguuauuauaccucuuaa

SEQ ID NO: 12882 - RNA, 22 nt, Homo sapiens
aauggcaagagccacagaggcg

SEQ ID NO: 12883 - RNA, 22 nt, Homo sapiens
guaugauacuguaacagugggu

SEQ ID NO: 12884 - RNA, 22 nt, Homo sapiens
guucaaguuuucucuugugggu

SEQ ID NO: 12885 - RNA, 22 nt, Homo sapiens
uuccaguugugagcuauccggg

SEQ ID NO: 12886 - RNA, 22 nt, Homo sapiens
uuagucaaguguacugugaaug

SEQ ID NO: 12887 - RNA, 20 nt, Homo sapiens
uccugagauucccaguucuc

SEQ ID NO: 12888 - RNA, 22 nt, Homo sapiens
uuuaucuguuuaaaacuguuca

SEQ ID NO: 12889 - RNA, 22 nt, Homo sapiens
agaaacauucucuugccuccuu

SEQ ID NO: 12890 - RNA, 22 nt, Homo sapiens
uugugcauaucagagguuugcu

SEQ ID NO: 12891 - RNA, 22 nt, Homo sapiens
uggucaccuucuugcucugucu

SEQ ID NO: 12892 - RNA, 21 nt, Homo sapiens
aggauaguagauuaaauauuu

SEQ ID NO: 12893 - RNA, 22 nt, Homo sapiens
cauugcacuccagccuuggcaa

SEQ ID NO: 12894 - RNA, 22 nt, Homo sapiens
auagcagugugaaaauguacua

SEQ ID NO: 12895 - RNA, 22 nt, Homo sapiens
ucucaaguggucgcaguuagau

SEQ ID NO: 12896 - RNA, 22 nt, Homo sapiens
uuccaguguguucauccucaga

SEQ ID NO: 12897 - RNA, 22 nt, Homo sapiens
gugaaaagaugagcaccauaca

SEQ ID NO: 12898 - RNA, 22 nt, Homo sapiens
gcuggguucagagugggcugcg

SEQ ID NO: 12899 - RNA, 22 nt, Homo sapiens
gugucaugagggggacaggaag

SEQ ID NO: 12900 - RNA, 22 nt, Homo sapiens
auaugcuuauuagcaagaaaua

SEQ ID NO: 12901 - RNA, 23 nt, Homo sapiens
cuuuguccccacccaaaucucau

SEQ ID NO: 12902 - RNA, 22 nt, Homo sapiens
ugaagugaagacucacagaagg

SEQ ID NO: 12903 - RNA, 22 nt, Homo sapiens
uucaacagugauggccuuugua

SEQ ID NO: 12904 - RNA, 22 nt, Homo sapiens
uugccuaggcuggagugcagua

SEQ ID NO: 12905 - RNA, 22 nt, Homo sapiens
uaacagcucuacagcugcucuu

SEQ ID NO: 12906 - RNA, 22 nt, Homo sapiens
aagggaaugugguagcugguuu

SEQ ID NO: 12907 - RNA, 22 nt, Homo sapiens
ucccauguagcuaggauuacag

SEQ ID NO: 12908 - RNA, 22 nt, Homo sapiens
ugacaugaugagcaauaauggc

SEQ ID NO: 12909 - RNA, 22 nt, Homo sapiens
guucaagugauagcugggauua

SEQ ID NO: 12910 - RNA, 22 nt, Homo sapiens
uucaguccauuuccuuggucac

SEQ ID NO: 12911 - RNA, 22 nt, Homo sapiens
auugcagcuugcagggugugua

SEQ ID NO: 12912 - RNA, 22 nt, Homo sapiens
ugaaauuauucuuaccaaggug

SEQ ID NO: 12913 - RNA, 23 nt, Homo sapiens
uggcaagaauucuuaccgugugg

SEQ ID NO: 12914 - RNA, 22 nt, Homo sapiens
auuguaauuuuagagaaagugg

SEQ ID NO: 12915 - RNA, 22 nt, Homo sapiens
gauuuuccaguggcccugauca

SEQ ID NO: 12916 - RNA, 22 nt, Homo sapiens
ggaucauaugauagcucaauuu

SEQ ID NO: 12917 - RNA, 22 nt, Homo sapiens
guggaaaaguaguugcgguuuu

SEQ ID NO: 12918 - RNA, 22 nt, Homo sapiens
gugagguacgugucaagaacca

SEQ ID NO: 12919 - RNA, 22 nt, Homo sapiens
uugcauagaccgaugucuugga

SEQ ID NO: 12920 - RNA, 22 nt, Homo sapiens
uuggaagacaaugcugauucuc

SEQ ID NO: 12921 - RNA, 18 nt, Homo sapiens
uuucaagucuuaggugac

SEQ ID NO: 12922 - RNA, 22 nt, Homo sapiens
auucacuuuuauagacaggucu

SEQ ID NO: 12923 - RNA, 22 nt, Homo sapiens
augauaaguuauuagaagaaga

SEQ ID NO: 12924 - RNA, 18 nt, Homo sapiens
uagaauauaggucauucu

SEQ ID NO: 12925 - RNA, 22 nt, Homo sapiens
ugagauaggaucuugcucuguu

SEQ ID NO: 12926 - RNA, 22 nt, Homo sapiens
ucauggcacugaugagaguuuc

SEQ ID NO: 12927 - RNA, 22 nt, Homo sapiens
acccugucauccacauggugcu

SEQ ID NO: 12928 - RNA, 22 nt, Homo sapiens
uagacacugcauauuuuuuuaa

SEQ ID NO: 12929 - RNA, 22 nt, Homo sapiens
uuuugcacuguuuuaucugaca

SEQ ID NO: 12930 - RNA, 22 nt, Homo sapiens
guaauaacuguggaaaaagguu

SEQ ID NO: 12931 - RNA, 22 nt, Homo sapiens
aauugcauugaauuuguagcuu

SEQ ID NO: 12932 - RNA, 22 nt, Homo sapiens
uguauuuguuguuaaauggaga

SEQ ID NO: 12933 - RNA, 22 nt, Homo sapiens
auuaucacaguuuugcauaugg

SEQ ID NO: 12934 - RNA, 22 nt, Homo sapiens
uaucacuuugauaguuuaaaug

SEQ ID NO: 12935 - RNA, 22 nt, Homo sapiens
gucacauugaugcccauggugg

SEQ ID NO: 12936 - RNA, 22 nt, Homo sapiens
uugugcaugaugcauacauggu

SEQ ID NO: 12937 - RNA, 22 nt, Homo sapiens
aaguaaauauccgguaguccca

SEQ ID NO: 12938 - RNA, 22 nt, Homo sapiens
aacacggcccgcagagcaagcu

SEQ ID NO: 12939 - RNA, 22 nt, Homo sapiens
ugugucuccugaaaauucacau

SEQ ID NO: 12940 - RNA, 22 nt, Homo sapiens
aauacagcacacagaugggucu

SEQ ID NO: 12941 - RNA, 22 nt, Homo sapiens
ugugaacacagaggcuauggca

SEQ ID NO: 12942 - RNA, 22 nt, Homo sapiens
ugacagagaagcauugaguuca

SEQ ID NO: 12943 - RNA, 22 nt, Homo sapiens
gcaccaugguagaauaauggua

SEQ ID NO: 12944 - RNA, 22 nt, Homo sapiens
ggcacaaugucagcucacugca

SEQ ID NO: 12945 - RNA, 22 nt, Homo sapiens
guuuuuggggucacuauuaccg

SEQ ID NO: 12946 - RNA, 22 nt, Homo sapiens
gucacuggcugucuuguaugau

SEQ ID NO: 12947 - RNA, 22 nt, Homo sapiens
uuaggcuuuauugaaaacaaua

SEQ ID NO: 12948 - RNA, 22 nt, Homo sapiens
ucaugucuuguuguauuuauuu

SEQ ID NO: 12949 - RNA, 22 nt, Homo sapiens
uagagguauuaacaguagaaga

SEQ ID NO: 12950 - RNA, 22 nt, Homo sapiens
cugauacugagaccuuggguua

SEQ ID NO: 12951 - RNA, 22 nt, Homo sapiens
cucucaagaugcugggauuaca

SEQ ID NO: 12952 - RNA, 22 nt, Homo sapiens
aguggaaucuguuauacuaacu

SEQ ID NO: 12953 - RNA, 22 nt, Homo sapiens
agcuggauguauguuaagugaa

SEQ ID NO: 12954 - RNA, 22 nt, Homo sapiens
uugugaauggugccgcgauaaa

SEQ ID NO: 12955 - RNA, 22 nt, Homo sapiens
ggcagcaugggugccuuuguga

SEQ ID NO: 12956 - RNA, 19 nt, Homo sapiens
ugcaaauucuaaaaacuga

SEQ ID NO: 12957 - RNA, 22 nt, Homo sapiens
ugcagagaaacauuuuguauuu

SEQ ID NO: 12958 - RNA, 22 nt, Homo sapiens
augagauucuuagagaagucug

SEQ ID NO: 12959 - RNA, 22 nt, Homo sapiens
aaaugcauaucaagauugcccu

SEQ ID NO: 12960 - RNA, 22 nt, Homo sapiens
uuagggaguaaucuaaaaaugg

SEQ ID NO: 12961 - RNA, 22 nt, Homo sapiens
uagagguauguauaguauucuu

SEQ ID NO: 12962 - RNA, 22 nt, Homo sapiens
uguagucauuccuuuuugcuuu

SEQ ID NO: 12963 - RNA, 22 nt, Homo sapiens
uuaacagucacuuagcucauuu

SEQ ID NO: 12964 - RNA, 22 nt, Homo sapiens
uacucuuuagcuccuuaaggaa

SEQ ID NO: 12965 - RNA, 22 nt, Homo sapiens
acccgcccagguguggccggga

SEQ ID NO: 12966 - RNA, 22 nt, Homo sapiens
gugaaagauuaaaccagugugu

SEQ ID NO: 12967 - RNA, 22 nt, Homo sapiens
acuggacuuaaugaugaauugu

SEQ ID NO: 12968 - RNA, 22 nt, Homo sapiens
aaagugcuguagacugggcgca

SEQ ID NO: 12969 - RNA, 22 nt, Homo sapiens
gucuggcacagggaaaguacaa

SEQ ID NO: 12970 - RNA, 22 nt, Homo sapiens
uugcacauuuuuucuggcagaa

SEQ ID NO: 12971 - RNA, 22 nt, Homo sapiens
acaccuguggucccaguaacuu

SEQ ID NO: 12972 - RNA, 22 nt, Homo sapiens
uaucaugucuguguguaccuag

SEQ ID NO: 12973 - RNA, 22 nt, Homo sapiens
gucaggcaccgauacaguuuuu

SEQ ID NO: 12974 - RNA, 21 nt, Homo sapiens
gagguaccucauguaagugga

SEQ ID NO: 12975 - RNA, 22 nt, Homo sapiens
uacaagcacaggcagcaggcug

SEQ ID NO: 12976 - RNA, 22 nt, Homo sapiens
gucacugucuacuguaauagcc

SEQ ID NO: 12977 - RNA, 20 nt, Homo sapiens
uggugguuuuaugugguuua

SEQ ID NO: 12978 - RNA, 22 nt, Homo sapiens
agccuguguugaauuauagaaa

SEQ ID NO: 12979 - RNA, 22 nt, Homo sapiens
ucugagaugagacuuugaauuu

SEQ ID NO: 12980 - RNA, 22 nt, Homo sapiens
acugcacuccaguuugggcagc

SEQ ID NO: 12981 - RNA, 22 nt, Homo sapiens
aagggaauguuguggcugguug

SEQ ID NO: 12982 - RNA, 22 nt, Homo sapiens
uguacuucaagauuaugguuua

SEQ ID NO: 12983 - RNA, 22 nt, Homo sapiens
gcuggaauuaacauagaugugc

SEQ ID NO: 12984 - RNA, 22 nt, Homo sapiens
gagauauuuagaaauguguucu

SEQ ID NO: 12985 - RNA, 22 nt, Homo sapiens
auagugcagugaugaaccuagg

SEQ ID NO: 12986 - RNA, 22 nt, Homo sapiens
uagcaguauaugagagcuauug

SEQ ID NO: 12987 - RNA, 22 nt, Homo sapiens
aacaccauucucuguaacaaga

SEQ ID NO: 12988 - RNA, 19 nt, Homo sapiens
ugccauguagcacaugguc

SEQ ID NO: 12989 - RNA, 22 nt, Homo sapiens
cacccuugcagggacagcuuug

SEQ ID NO: 12990 - RNA, 22 nt, Homo sapiens
auugcuauuauuugaccauugu

SEQ ID NO: 12991 - RNA, 22 nt, Homo sapiens
gagacggagucuugcucuguug

SEQ ID NO: 12992 - RNA, 22 nt, Homo sapiens
gagacggagucucgcucugucg

SEQ ID NO: 12993 - RNA, 21 nt, Homo sapiens
uuacaauggcuccuugaaggu

SEQ ID NO: 12994 - RNA, 20 nt, Homo sapiens
uaagugcuugaugaaugaac

SEQ ID NO: 12995 - RNA, 22 nt, Homo sapiens
agaacacugaguucagggucag

SEQ ID NO: 12996 - RNA, 22 nt, Homo sapiens
aaguacuguuuaaauugcagaa

SEQ ID NO: 12997 - RNA, 22 nt, Homo sapiens
auaugucuuaguuaccuugggc

SEQ ID NO: 12998 - RNA, 22 nt, Homo sapiens
ucacuguugaugggcaugcagg

SEQ ID NO: 12999 - RNA, 22 nt, Homo sapiens
gaaucacaguuauuagagcagc

SEQ ID NO: 13000 - RNA, 23 nt, Homo sapiens
aaauuugccuauuauuccuaugg

SEQ ID NO: 13001 - RNA, 19 nt, Homo sapiens
ccauggcaaugaucugaug

SEQ ID NO: 13002 - RNA, 16 nt, Homo sapiens
uguauugcuaaaaaga

SEQ ID NO: 13003 - RNA, 22 nt, Homo sapiens
uaucacagcauugucuauaaua

SEQ ID NO: 13004 - RNA, 22 nt, Homo sapiens
agaguacaggcaaguuagucau

SEQ ID NO: 13005 - RNA, 22 nt, Homo sapiens
cauugcacugcauucugggcaa

SEQ ID NO: 13006 - RNA, 22 nt, Homo sapiens
ugucaguuucuugagauggaac

SEQ ID NO: 13007 - RNA, 22 nt, Homo sapiens
ugugaagaaagucauugguagc

SEQ ID NO: 13008 - RNA, 22 nt, Homo sapiens
ucaguaaaugcuguucucuuuu

SEQ ID NO: 13009 - RNA, 21 nt, Homo sapiens
agcagcuuugguugaagcaga

SEQ ID NO: 13010 - RNA, 22 nt, Homo sapiens
acugaguguugauuuagauuaa

SEQ ID NO: 13011 - RNA, 22 nt, Homo sapiens
uuauucauuaauugcuaagguu

SEQ ID NO: 13012 - RNA, 22 nt, Homo sapiens
uggcaagauuguuccgguuugg

SEQ ID NO: 13013 - RNA, 22 nt, Homo sapiens
auauguauuuuaacguguaagg

SEQ ID NO: 13014 - RNA, 22 nt, Homo sapiens
uaaagugaggauggcaguaggu

SEQ ID NO: 13015 - RNA, 22 nt, Homo sapiens
cuaugucuuucauauuuugggg

SEQ ID NO: 13016 - RNA, 22 nt, Homo sapiens
augacauguauuuccaggauuu

SEQ ID NO: 13017 - RNA, 22 nt, Homo sapiens
auaaagacacuuggcaugauuu

SEQ ID NO: 13018 - RNA, 22 nt, Homo sapiens
cugauugucaucaauauuauua

SEQ ID NO: 13019 - RNA, 22 nt, Homo sapiens
aaaugcagucuuuguucugggc

SEQ ID NO: 13020 - RNA, 22 nt, Homo sapiens
cagucacagugacaggaugugg

SEQ ID NO: 13021 - RNA, 22 nt, Homo sapiens
uuauuagguuagugcaaaaguu

SEQ ID NO: 13022 - RNA, 22 nt, Homo sapiens
auaugucuguuuagucuguaau

SEQ ID NO: 13023 - RNA, 22 nt, Homo sapiens
uagaucauauacuugccaugac

SEQ ID NO: 13024 - RNA, 22 nt, Homo sapiens
guagugcaguuugagaaucagu

SEQ ID NO: 13025 - RNA, 22 nt, Homo sapiens
cauugcacuccagccugcugac

SEQ ID NO: 13026 - RNA, 22 nt, Homo sapiens
ugagaugugugcauucaacuca

SEQ ID NO: 13027 - RNA, 22 nt, Homo sapiens
uugcacauugcaccuuuuguau

SEQ ID NO: 13028 - RNA, 22 nt, Homo sapiens
uuucugaggccucaccagaagc

SEQ ID NO: 13029 - RNA, 22 nt, Homo sapiens
uaugacauaguccuuaacccuc

SEQ ID NO: 13030 - RNA, 22 nt, Homo sapiens
guucuggagauaaagccaaggu

SEQ ID NO: 13031 - RNA, 22 nt, Homo sapiens
augagauaaaccaucucuuaag

SEQ ID NO: 13032 - RNA, 19 nt, Homo sapiens
cuauugcacauagcugaag

SEQ ID NO: 13033 - RNA, 22 nt, Homo sapiens
gcugagaucucuugccugaacu

SEQ ID NO: 13034 - RNA, 22 nt, Homo sapiens
uugugaauggugcugcaguaaa

SEQ ID NO: 13035 - RNA, 22 nt, Homo sapiens
guggaagauaguguguuaaugu

SEQ ID NO: 13036 - RNA, 22 nt, Homo sapiens
ucugccuuuucaugugggaugg

SEQ ID NO: 13037 - RNA, 22 nt, Homo sapiens
uucuauggucacagaugcuuga

SEQ ID NO: 13038 - RNA, 19 nt, Homo sapiens
uauguaguuuucucaauau

SEQ ID NO: 13039 - RNA, 21 nt, Homo sapiens
ugugaacauguuggguggcau

SEQ ID NO: 13040 - RNA, 18 nt, Homo sapiens
auugcacaccagccuggg

SEQ ID NO: 13041 - RNA, 22 nt, Homo sapiens
ucauggcauuguuaaggguuuu

SEQ ID NO: 13042 - RNA, 22 nt, Homo sapiens
uuacaguugugagccaccaugc

SEQ ID NO: 13043 - RNA, 22 nt, Homo sapiens
cauugcacuccagucugggcaa

SEQ ID NO: 13044 - RNA, 22 nt, Homo sapiens
ucuggcuuauuucacuuagcau

SEQ ID NO: 13045 - RNA, 22 nt, Homo sapiens
uuugggaaugaguuuaucauuu

SEQ ID NO: 13046 - RNA, 22 nt, Homo sapiens
gucacuguuuccuauuauauuu

SEQ ID NO: 13047 - RNA, 22 nt, Homo sapiens
auagcagugugaaaauugacug

SEQ ID NO: 13048 - RNA, 22 nt, Homo sapiens
aagagguaggaaauggucauuu

SEQ ID NO: 13049 - RNA, 22 nt, Homo sapiens
aagcaggugucugugucuguaa

SEQ ID NO: 13050 - RNA, 22 nt, Homo sapiens
uuugucccuuugcaguggcaca

SEQ ID NO: 13051 - RNA, 22 nt, Homo sapiens
caaaggauucauuuccaggagu

SEQ ID NO: 13052 - RNA, 21 nt, Homo sapiens
ucacugagcaucaugguuuca

SEQ ID NO: 13053 - RNA, 22 nt, Homo sapiens
aucuuguguugaauggugcaga

SEQ ID NO: 13054 - RNA, 22 nt, Homo sapiens
uaggucaguuuuggcuuggcuu

SEQ ID NO: 13055 - RNA, 22 nt, Homo sapiens
aaucacaguguucuugugaggg

SEQ ID NO: 13056 - RNA, 22 nt, Homo sapiens
aaggugcuguaagcauccaugu

SEQ ID NO: 13057 - RNA, 22 nt, Homo sapiens
ucaacaggucaauugcauagaa

SEQ ID NO: 13058 - RNA, 22 nt, Homo sapiens
cauugcacuccagccugaccaa

SEQ ID NO: 13059 - RNA, 18 nt, Homo sapiens
uugaauaguguccaaucu

SEQ ID NO: 13060 - RNA, 22 nt, Homo sapiens
gagacugagucuugcucugucg

SEQ ID NO: 13061 - RNA, 22 nt, Homo sapiens
uacagucauaaugccuagugac

SEQ ID NO: 13062 - RNA, 22 nt, Homo sapiens
uugagcccuggagguggaggcu

SEQ ID NO: 13063 - RNA, 22 nt, Homo sapiens
uagcaguaaagaaugugauguu

SEQ ID NO: 13064 - RNA, 22 nt, Homo sapiens
uucauaguaacaguaacuaugg

SEQ ID NO: 13065 - RNA, 22 nt, Homo sapiens
accugagauuacaggugcuggc

SEQ ID NO: 13066 - RNA, 22 nt, Homo sapiens
uaagugaauuugacagguaaug

SEQ ID NO: 13067 - RNA, 17 nt, Homo sapiens
aaggugcuucgaccucc

SEQ ID NO: 13068 - RNA, 22 nt, Homo sapiens
ucugugaaugaacacuugaaaa

SEQ ID NO: 13069 - RNA, 22 nt, Homo sapiens
auguaauguuaaauugcuaauu

SEQ ID NO: 13070 - RNA, 22 nt, Homo sapiens
uggcaagaccccaucucuacaa

SEQ ID NO: 13071 - RNA, 22 nt, Homo sapiens
ucauucauucauccagcuugag

SEQ ID NO: 13072 - RNA, 22 nt, Homo sapiens
uugaguuugaguauucuaaagc

SEQ ID NO: 13073 - RNA, 22 nt, Homo sapiens
ucuccauuguccagaugaggaa

SEQ ID NO: 13074 - RNA, 22 nt, Homo sapiens
guacaguaguaaaagugaauga

SEQ ID NO: 13075 - RNA, 23 nt, Homo sapiens
gagaccagcuucagaaagcacga

SEQ ID NO: 13076 - RNA, 22 nt, Homo sapiens
guaaucucagcuacucgggaga

SEQ ID NO: 13077 - RNA, 23 nt, Homo sapiens
uauugcacuaugguaacccuuuu

SEQ ID NO: 13078 - RNA, 22 nt, Homo sapiens
ucauugcaaucucugccucccg

SEQ ID NO: 13079 - RNA, 22 nt, Homo sapiens
aagagguagaagcuugccuucu

SEQ ID NO: 13080 - RNA, 22 nt, Homo sapiens
acaagcacaaauuuaauccugu

SEQ ID NO: 13081 - RNA, 22 nt, Homo sapiens
uuucugagaccaaaacuuguaa

SEQ ID NO: 13082 - RNA, 22 nt, Homo sapiens
aauuaguugucgugagaguggu

SEQ ID NO: 13083 - RNA, 22 nt, Homo sapiens
ccauggcaauggucagucuauu

SEQ ID NO: 13084 - RNA, 22 nt, Homo sapiens
agcagguguccacaauguuugc

SEQ ID NO: 13085 - RNA, 22 nt, Homo sapiens
gcagucacagggagauggugac

SEQ ID NO: 13086 - RNA, 22 nt, Homo sapiens
cauugcacuccagccucggcaa

SEQ ID NO: 13087 - RNA, 22 nt, Homo sapiens
uauugcacuccagccuuggcaa

SEQ ID NO: 13088 - RNA, 22 nt, Homo sapiens
cauugcacuccacuccugaaca

SEQ ID NO: 13089 - RNA, 22 nt, Homo sapiens
uucacagucacccuucuccaug

SEQ ID NO: 13090 - RNA, 22 nt, Homo sapiens
uaaaagucaucacaacuggagu

SEQ ID NO: 13091 - RNA, 21 nt, Homo sapiens
uuggggaauggagagguuuuc

SEQ ID NO: 13092 - RNA, 22 nt, Homo sapiens
uuaugucuuugagcaaugcugu

SEQ ID NO: 13093 - RNA, 22 nt, Homo sapiens
ugaaguaauguuuuauucuauu

SEQ ID NO: 13094 - RNA, 20 nt, Homo sapiens
cuuggcuuucuugguguuaa

SEQ ID NO: 13095 - RNA, 22 nt, Homo sapiens
aucacuguuuugaugcucggac

SEQ ID NO: 13096 - RNA, 22 nt, Homo sapiens
agacacugaaauguauugaaga

SEQ ID NO: 13097 - RNA, 22 nt, Homo sapiens
uugauaguuuuaaaauuaaucu

SEQ ID NO: 13098 - RNA, 22 nt, Homo sapiens
ugagauuaucuugaucuugaaa

SEQ ID NO: 13099 - RNA, 22 nt, Homo sapiens
guaugucuugucuauggcugcu

SEQ ID NO: 13100 - RNA, 22 nt, Homo sapiens
acuuuuugaugaggucguuugu

SEQ ID NO: 13101 - RNA, 22 nt, Homo sapiens
acccaguagccagauguagcug

SEQ ID NO: 13102 - RNA, 22 nt, Homo sapiens
uuacaugucuugguaagguuag

SEQ ID NO: 13103 - RNA, 22 nt, Homo sapiens
auggaagacuccucuuugggua

SEQ ID NO: 13104 - RNA, 22 nt, Homo sapiens
ucaggcaugcagcaaugcagug

SEQ ID NO: 13105 - RNA, 22 nt, Homo sapiens
uugugaauggaguagcaggauc

SEQ ID NO: 13106 - RNA, 22 nt, Homo sapiens
aagugcuuaggauagugugugg

SEQ ID NO: 13107 - RNA, 22 nt, Homo sapiens
ugagacgaagucuugcucuguu

SEQ ID NO: 13108 - RNA, 22 nt, Homo sapiens
uaauucacauaaagcacuuaga

SEQ ID NO: 13109 - RNA, 22 nt, Homo sapiens
aaagugcugagaguucuaacuu

SEQ ID NO: 13110 - RNA, 22 nt, Homo sapiens
ugaacagcacguuuauucagaa

SEQ ID NO: 13111 - RNA, 22 nt, Homo sapiens
uucauaguuuauacugauauuu

SEQ ID NO: 13112 - RNA, 22 nt, Homo sapiens
gugcacaugguagguauugagu

SEQ ID NO: 13113 - RNA, 22 nt, Homo sapiens
ucuacagccaguucaggaagaa

SEQ ID NO: 13114 - RNA, 22 nt, Homo sapiens
uugugaucauugucaaauagug

SEQ ID NO: 13115 - RNA, 22 nt, Homo sapiens
uuuuggcucugucuguaucuuu

SEQ ID NO: 13116 - RNA, 22 nt, Homo sapiens
ucaguguuuggaaucucaauuu

SEQ ID NO: 13117 - RNA, 22 nt, Homo sapiens
acauaguagacacugaaaauau

SEQ ID NO: 13118 - RNA, 22 nt, Homo sapiens
uggagugcaauggcaccaucuu

SEQ ID NO: 13119 - RNA, 22 nt, Homo sapiens
cauugcacuccagccuugguga

SEQ ID NO: 13120 - RNA, 22 nt, Homo sapiens
ugagauagggucucacucuguc

SEQ ID NO: 13121 - RNA, 22 nt, Homo sapiens
ucacuguguauguauaugcagg

SEQ ID NO: 13122 - RNA, 22 nt, Homo sapiens
ugcuaugucagccaggcugguc

SEQ ID NO: 13123 - RNA, 22 nt, Homo sapiens
ugagacacuucccagaucccuu

SEQ ID NO: 13124 - RNA, 22 nt, Homo sapiens
uugaggaaugugauuucaaaua

SEQ ID NO: 13125 - RNA, 22 nt, Homo sapiens
ucagcagugugaaaacaaacua

SEQ ID NO: 13126 - RNA, 20 nt, Homo sapiens
auugcagcaugauuuauaau

SEQ ID NO: 13127 - RNA, 21 nt, Homo sapiens
uccugagagaggaguaacucu

SEQ ID NO: 13128 - RNA, 22 nt, Homo sapiens
caugcauuggucuauuauguga

SEQ ID NO: 13129 - RNA, 22 nt, Homo sapiens
auaucacucccaauaucgcagg

SEQ ID NO: 13130 - RNA, 22 nt, Homo sapiens
uuaccuuuuuaagacagguuag

SEQ ID NO: 13131 - RNA, 22 nt, Homo sapiens
agaauguauauucuguaguugu

SEQ ID NO: 13132 - RNA, 22 nt, Homo sapiens
auggcuauuccauaggcagagc

SEQ ID NO: 13133 - RNA, 22 nt, Homo sapiens
auuggcagaaaucuuuauagua

SEQ ID NO: 13134 - RNA, 22 nt, Homo sapiens
uaggcagccagcuguggauuga

SEQ ID NO: 13135 - RNA, 22 nt, Homo sapiens
aagugcuucagaagacaauauu

SEQ ID NO: 13136 - RNA, 22 nt, Homo sapiens
uuuguauguuggagauuggaga

SEQ ID NO: 13137 - RNA, 22 nt, Homo sapiens
ugagaugugaucaccugaaggg

SEQ ID NO: 13138 - RNA, 18 nt, Homo sapiens
guaaauguaucuauugcc

SEQ ID NO: 13139 - RNA, 22 nt, Homo sapiens
auaacucuguuuuuuucaugca

SEQ ID NO: 13140 - RNA, 22 nt, Homo sapiens
guggaaaacauaugcuuguuga

SEQ ID NO: 13141 - RNA, 22 nt, Homo sapiens
uacaugcaugggcaugugugca

SEQ ID NO: 13142 - RNA, 22 nt, Homo sapiens
ucuuuuggguauggagccauca

SEQ ID NO: 13143 - RNA, 22 nt, Homo sapiens
uauggcaaugcauaggaaggaa

SEQ ID NO: 13144 - RNA, 22 nt, Homo sapiens
caggugcauuggcugacaccug

SEQ ID NO: 13145 - RNA, 22 nt, Homo sapiens
uugaaguagaaagacgaaauuu

SEQ ID NO: 13146 - RNA, 22 nt, Homo sapiens
aagugcuuuguacagggguuga

SEQ ID NO: 13147 - RNA, 19 nt, Homo sapiens
uacauaguauuuaguggca

SEQ ID NO: 13148 - RNA, 22 nt, Homo sapiens
ugagaugcuccucuugcaaagc

SEQ ID NO: 13149 - RNA, 22 nt, Homo sapiens
ucagaguagcugucugaggugc

SEQ ID NO: 13150 - RNA, 22 nt, Homo sapiens
auacuguuuuacaucauugccu

SEQ ID NO: 13151 - RNA, 22 nt, Homo sapiens
aagagguaauaacaaagcuucu

SEQ ID NO: 13152 - RNA, 22 nt, Homo sapiens
guacaguauaguaauaggauuu

SEQ ID NO: 13153 - RNA, 22 nt, Homo sapiens
cauugcacuccagccugcacga

SEQ ID NO: 13154 - RNA, 23 nt, Homo sapiens
uucaccguguuggccaggcuggu

SEQ ID NO: 13155 - RNA, 22 nt, Homo sapiens
uugagguaauaaacagccauuc

SEQ ID NO: 13156 - RNA, 23 nt, Homo sapiens
ucgcagcauucaauaccaggcag

SEQ ID NO: 13157 - RNA, 22 nt, Homo sapiens
ucagacacugcccuccaccugu

SEQ ID NO: 13158 - RNA, 20 nt, Homo sapiens
uucuauggugaugaguccug

SEQ ID NO: 13159 - RNA, 22 nt, Homo sapiens
cauugcaacuucugccucccag

SEQ ID NO: 13160 - RNA, 22 nt, Homo sapiens
uuguaaucaacacaucauuggg

SEQ ID NO: 13161 - RNA, 22 nt, Homo sapiens
auagcagugugaaaacagacug

SEQ ID NO: 13162 - RNA, 22 nt, Homo sapiens
uugaaagcuaucagagauucca

SEQ ID NO: 13163 - RNA, 22 nt, Homo sapiens
gagacugagucuugcucuguca

SEQ ID NO: 13164 - RNA, 22 nt, Homo sapiens
aauacuggcacugaagaccaug

SEQ ID NO: 13165 - RNA, 23 nt, Homo sapiens
uucaucagggauauuggccugaa

SEQ ID NO: 13166 - RNA, 22 nt, Homo sapiens
uuaugcagcaaagugcuugaaa

SEQ ID NO: 13167 - RNA, 22 nt, Homo sapiens
agaugguauuauagguuucugu

SEQ ID NO: 13168 - RNA, 22 nt, Homo sapiens
gucacuguggagaagaaagugg

SEQ ID NO: 13169 - RNA, 22 nt, Homo sapiens
ccugagacgaauggagugaaca

SEQ ID NO: 13170 - RNA, 22 nt, Homo sapiens
agugcaauaaggauguagaacu

SEQ ID NO: 13171 - RNA, 22 nt, Homo sapiens
aucccagaaacucggguuucuc

SEQ ID NO: 13172 - RNA, 22 nt, Homo sapiens
uuggaaaaauccaccuugaucu

SEQ ID NO: 13173 - RNA, 22 nt, Homo sapiens
ugauugcacaccugcacucaag

SEQ ID NO: 13174 - RNA, 20 nt, Homo sapiens
uucaucaggauauuggucua

SEQ ID NO: 13175 - RNA, 22 nt, Homo sapiens
aucuggguccguucugcuucuc

SEQ ID NO: 13176 - RNA, 22 nt, Homo sapiens
gaaagauuuccugagcuagaaa

SEQ ID NO: 13177 - RNA, 22 nt, Homo sapiens
augcagugugcaacagauuaag

SEQ ID NO: 13178 - RNA, 22 nt, Homo sapiens
uugaauagaagguuuuuuguuc

SEQ ID NO: 13179 - RNA, 22 nt, Homo sapiens
uucuaaguaauuuugcaugccu

SEQ ID NO: 13180 - RNA, 22 nt, Homo sapiens
gcagaauugguuucuucuaagg

SEQ ID NO: 13181 - RNA, 19 nt, Homo sapiens
cuaaguccccuugauuaga

SEQ ID NO: 13182 - RNA, 22 nt, Homo sapiens
uuaaucaggccguuuccuaaga

SEQ ID NO: 13183 - RNA, 22 nt, Homo sapiens
uauggcacuaguacuggaaagc

SEQ ID NO: 13184 - RNA, 22 nt, Homo sapiens
uucaucaguuauauuggccuga

SEQ ID NO: 13185 - RNA, 22 nt, Homo sapiens
ugaaucauuucuugucuucagu

SEQ ID NO: 13186 - RNA, 22 nt, Homo sapiens
uugucccauggggucuuccuuu

SEQ ID NO: 13187 - RNA, 18 nt, Homo sapiens
uucuuguguugauauuuu

SEQ ID NO: 13188 - RNA, 19 nt, Homo sapiens
ugacacuguuggugggagg

SEQ ID NO: 13189 - RNA, 22 nt, Homo sapiens
uugaaagcuaucucaaaucgcu

SEQ ID NO: 13190 - RNA, 22 nt, Homo sapiens
ggagaauguaauugguauuuug

SEQ ID NO: 13191 - RNA, 22 nt, Homo sapiens
ugguauguaugauuaacaugga

SEQ ID NO: 13192 - RNA, 22 nt, Homo sapiens
ucucauggagucaggagcagaa

SEQ ID NO: 13193 - RNA, 22 nt, Homo sapiens
aggaucauugacuauuauaagg

SEQ ID NO: 13194 - RNA, 22 nt, Homo sapiens
cacuuugguucaccugaguuuc

SEQ ID NO: 13195 - RNA, 23 nt, Homo sapiens
ggaaacauccagucuuucaccau

SEQ ID NO: 13196 - RNA, 22 nt, Homo sapiens
cuguaauguaaugagacuacau

SEQ ID NO: 13197 - RNA, 22 nt, Homo sapiens
ugugaauguaagaaaauccaac

SEQ ID NO: 13198 - RNA, 21 nt, Homo sapiens
uggaauuaauggagagguguu

SEQ ID NO: 13199 - RNA, 22 nt, Homo sapiens
uaaacugucuugcaguuacaug

SEQ ID NO: 13200 - RNA, 22 nt, Homo sapiens
aggacacugauguaugcugugg

SEQ ID NO: 13201 - RNA, 22 nt, Homo sapiens
ucauacaguaguccucacuugu

SEQ ID NO: 13202 - RNA, 22 nt, Homo sapiens
uggagucuugaugauuuucaaa

SEQ ID NO: 13203 - RNA, 18 nt, Homo sapiens
ccauucaacagauuuguc

SEQ ID NO: 13204 - RNA, 22 nt, Homo sapiens
aucccuugacguggagucucug

SEQ ID NO: 13205 - RNA, 18 nt, Homo sapiens
ugacuguccagguggacc

SEQ ID NO: 13206 - RNA, 22 nt, Homo sapiens
cuuugguguauuuucagagacc

SEQ ID NO: 13207 - RNA, 22 nt, Homo sapiens
uaaguagaggaaucauuuugug

SEQ ID NO: 13208 - RNA, 22 nt, Homo sapiens
uagagguaggucuucgagucuc

SEQ ID NO: 13209 - RNA, 22 nt, Homo sapiens
cagcagguuuuuaucaguuaag

SEQ ID NO: 13210 - RNA, 22 nt, Homo sapiens
aucacuguaaguuuacacuuug

SEQ ID NO: 13211 - RNA, 22 nt, Homo sapiens
guggacaugaauuuuggaggca

SEQ ID NO: 13212 - RNA, 22 nt, Homo sapiens
gugccacugcaccuggccuaag

SEQ ID NO: 13213 - RNA, 22 nt, Homo sapiens
aauaaagcauggcuacuccaua

SEQ ID NO: 13214 - RNA, 19 nt, Homo sapiens
uguugcacauaucaauaug

SEQ ID NO: 13215 - RNA, 22 nt, Homo sapiens
uucaagaauuaaaguggcuuuu

SEQ ID NO: 13216 - RNA, 22 nt, Homo sapiens
cccugagagcagggucuuucuc

SEQ ID NO: 13217 - RNA, 22 nt, Homo sapiens
aauugcaccaucuagaucaaga

SEQ ID NO: 13218 - RNA, 22 nt, Homo sapiens
auucccuuagcugccucagccu

SEQ ID NO: 13219 - RNA, 22 nt, Homo sapiens
aaagugcugagauuguaggcau

SEQ ID NO: 13220 - RNA, 21 nt, Homo sapiens
uaacagcuccacuccauucuc

SEQ ID NO: 13221 - RNA, 22 nt, Homo sapiens
ucuaauguaaccugcaaauauu

SEQ ID NO: 13222 - RNA, 21 nt, Homo sapiens
gaccacagcagggaaugucag

SEQ ID NO: 13223 - RNA, 22 nt, Homo sapiens
uauugcucaugcauuuaauuuc

SEQ ID NO: 13224 - RNA, 22 nt, Homo sapiens
aaaggcuucggaucagaaggua

SEQ ID NO: 13225 - RNA, 22 nt, Homo sapiens
cuccuguagccccaucaucuuu

SEQ ID NO: 13226 - RNA, 22 nt, Homo sapiens
uugaaauguuuagaaguuugga

SEQ ID NO: 13227 - RNA, 22 nt, Homo sapiens
ucacugagaaugauguuucuga

SEQ ID NO: 13228 - RNA, 22 nt, Homo sapiens
augagguaguagaaagucaggu

SEQ ID NO: 13229 - RNA, 22 nt, Homo sapiens
ugucacaguuuguacuuuauag

SEQ ID NO: 13230 - RNA, 22 nt, Homo sapiens
uuugcuauagugaauagugcug

SEQ ID NO: 13231 - RNA, 22 nt, Homo sapiens
uagcaguagacagacuuuggcu

SEQ ID NO: 13232 - RNA, 22 nt, Homo sapiens
agucacagguucuugggauuag

SEQ ID NO: 13233 - RNA, 22 nt, Homo sapiens
uugaauagaaguguugaaagug

SEQ ID NO: 13234 - RNA, 22 nt, Homo sapiens
uggcaaaucagaggcauggaca

SEQ ID NO: 13235 - RNA, 22 nt, Homo sapiens
ggucacauuggacuaucaaguu

SEQ ID NO: 13236 - RNA, 22 nt, Homo sapiens
ucaucagaguuuacaagcucag

SEQ ID NO: 13237 - RNA, 22 nt, Homo sapiens
uuacuguagugucauaucguau

SEQ ID NO: 13238 - RNA, 20 nt, Homo sapiens
gugagguagaggguuaccug

SEQ ID NO: 13239 - RNA, 21 nt, Homo sapiens
ugugaccucugucucugaguc

SEQ ID NO: 13240 - RNA, 22 nt, Homo sapiens
uuugaauggaaguuuugugaaa

SEQ ID NO: 13241 - RNA, 22 nt, Homo sapiens
cucaaguaauccucccgccuug

SEQ ID NO: 13242 - RNA, 22 nt, Homo sapiens
acugcacuccagccucggcaau

SEQ ID NO: 13243 - RNA, 22 nt, Homo sapiens
uauugcacgccagccugagcaa

SEQ ID NO: 13244 - RNA, 22 nt, Homo sapiens
uucaucaguugagcugguugcu

SEQ ID NO: 13245 - RNA, 22 nt, Homo sapiens
uugagccaaggauugucuuucc

SEQ ID NO: 13246 - RNA, 22 nt, Homo sapiens
uaggaaguuucuugauuacuua

SEQ ID NO: 13247 - RNA, 22 nt, Homo sapiens
ucaagcaauucugcugccucag

SEQ ID NO: 13248 - RNA, 22 nt, Homo sapiens
ugucaugaacucacauucuggg

SEQ ID NO: 13249 - RNA, 22 nt, Homo sapiens
cuuuuggcuuagaauugucuug

SEQ ID NO: 13250 - RNA, 20 nt, Homo sapiens
auucaaguaugccuugagaa

SEQ ID NO: 13251 - RNA, 22 nt, Homo sapiens
auugcacaucugcacuacagcc

SEQ ID NO: 13252 - RNA, 22 nt, Homo sapiens
aguaacaggauccaaagaaugu

SEQ ID NO: 13253 - RNA, 22 nt, Homo sapiens
uaugucaugggguuuuugagau

SEQ ID NO: 13254 - RNA, 22 nt, Homo sapiens
ucaucagugcuugcaaauuauu

SEQ ID NO: 13255 - RNA, 22 nt, Homo sapiens
ugugcucaucucagucaacugu

SEQ ID NO: 13256 - RNA, 22 nt, Homo sapiens
guauggaagucaguuuguuggc

SEQ ID NO: 13257 - RNA, 22 nt, Homo sapiens
uugugaaaucuaggcagagguu

SEQ ID NO: 13258 - RNA, 22 nt, Homo sapiens
ugaugguuuuaaaaagaggagu

SEQ ID NO: 13259 - RNA, 22 nt, Homo sapiens
uacaaagugggaaacgaagguu

SEQ ID NO: 13260 - RNA, 22 nt, Homo sapiens
ugagacggagucuugcucuguc

SEQ ID NO: 13261 - RNA, 22 nt, Homo sapiens
auugcaaagcguagacucuaaa

SEQ ID NO: 13262 - RNA, 22 nt, Homo sapiens
uaugucuauuauguagcaggaa

SEQ ID NO: 13263 - RNA, 20 nt, Homo sapiens
uaagugcauaggauauuucu

SEQ ID NO: 13264 - RNA, 22 nt, Homo sapiens
guugcucaggccggagugcagu

SEQ ID NO: 13265 - RNA, 22 nt, Homo sapiens
auacaagcaguccaacuccaua

SEQ ID NO: 13266 - RNA, 21 nt, Homo sapiens
ugaaaugcaugugcacauuaa

SEQ ID NO: 13267 - RNA, 22 nt, Homo sapiens
auaugcauguacccacacaggc

SEQ ID NO: 13268 - RNA, 22 nt, Homo sapiens
auaucugcauugccauuuaugu

SEQ ID NO: 13269 - RNA, 22 nt, Homo sapiens
cauugcacacauuuaccuaugu

SEQ ID NO: 13270 - RNA, 23 nt, Homo sapiens
ggaguguauuggcacgaucucag

SEQ ID NO: 13271 - RNA, 22 nt, Homo sapiens
uagcaguauacguacugggucc

SEQ ID NO: 13272 - RNA, 22 nt, Homo sapiens
aagugcuuuacacaugcaugau

SEQ ID NO: 13273 - RNA, 22 nt, Homo sapiens
ucuucaugcuugaaauaauagc

SEQ ID NO: 13274 - RNA, 18 nt, Homo sapiens
uaagugcuuuaaacacau

SEQ ID NO: 13275 - RNA, 20 nt, Homo sapiens
aagacacuguccccacugga

SEQ ID NO: 13276 - RNA, 22 nt, Homo sapiens
guaaauaccaguuucuggaaca

SEQ ID NO: 13277 - RNA, 22 nt, Homo sapiens
gauggcacuuaagagcaagagc

SEQ ID NO: 13278 - RNA, 22 nt, Homo sapiens
ugugccacuccagcucuagcuu

SEQ ID NO: 13279 - RNA, 22 nt, Homo sapiens
uucuggccccucccaaucucau

SEQ ID NO: 13280 - RNA, 22 nt, Homo sapiens
gcugcacuuuaaggcauccccu

SEQ ID NO: 13281 - RNA, 22 nt, Homo sapiens
uugaugauguuucugccuugcc

SEQ ID NO: 13282 - RNA, 22 nt, Homo sapiens
uagagguagagugacuucccca

SEQ ID NO: 13283 - RNA, 22 nt, Homo sapiens
cacugcacuccagucccgucuc

SEQ ID NO: 13284 - RNA, 22 nt, Homo sapiens
uugagauuuuccucaaauauuu

SEQ ID NO: 13285 - RNA, 22 nt, Homo sapiens
cugccacugacaccucaaggac

SEQ ID NO: 13286 - RNA, 22 nt, Homo sapiens
gugacugcauccauccaggcuu

SEQ ID NO: 13287 - RNA, 22 nt, Homo sapiens
uuacugcucuuuugucaugagu

SEQ ID NO: 13288 - RNA, 22 nt, Homo sapiens
uuugguaguuuguugggaccca

SEQ ID NO: 13289 - RNA, 22 nt, Homo sapiens
cauugcacuccagccuaggcaa

SEQ ID NO: 13290 - RNA, 22 nt, Homo sapiens
ugugaacauuuuguauauauua

SEQ ID NO: 13291 - RNA, 22 nt, Homo sapiens
aucaaaguaucucaauauggua

SEQ ID NO: 13292 - RNA, 22 nt, Homo sapiens
uugagacggagucuugcucuuu

SEQ ID NO: 13293 - RNA, 22 nt, Homo sapiens
aaaugcuuucuuggaccauuug

SEQ ID NO: 13294 - RNA, 19 nt, Homo sapiens
cauggcuuauaauuuuaau

SEQ ID NO: 13295 - RNA, 18 nt, Homo sapiens
ccuuaguuauagagaguc

SEQ ID NO: 13296 - RNA, 22 nt, Homo sapiens
uuguaaacaucuguacauugcu

SEQ ID NO: 13297 - RNA, 22 nt, Homo sapiens
aacugguauuucccaugaauuu

SEQ ID NO: 13298 - RNA, 22 nt, Homo sapiens
gaggugaaggucucaauaaaua

SEQ ID NO: 13299 - RNA, 22 nt, Homo sapiens
guaaucucagcuacucgggagg

SEQ ID NO: 13300 - RNA, 22 nt, Homo sapiens
cuggauauguugcaacauuucc

SEQ ID NO: 13301 - RNA, 23 nt, Homo sapiens
aagagguaugacuaugaagugga

SEQ ID NO: 13302 - RNA, 18 nt, Homo sapiens
uuugguccuuuauaaaca

SEQ ID NO: 13303 - RNA, 22 nt, Homo sapiens
aucgcgccauuguacuccagcc

SEQ ID NO: 13304 - RNA, 22 nt, Homo sapiens
cucccagagccaguuauaggcu

SEQ ID NO: 13305 - RNA, 22 nt, Homo sapiens
ugaaauuguuugcaaggauagg

SEQ ID NO: 13306 - RNA, 22 nt, Homo sapiens
uugagacggaguuuugcucuug

SEQ ID NO: 13307 - RNA, 22 nt, Homo sapiens
aguggaauuaagaaacugaauu

SEQ ID NO: 13308 - RNA, 22 nt, Homo sapiens
uaucacuguuguuuguuuaagg

SEQ ID NO: 13309 - RNA, 22 nt, Homo sapiens
uugcacauguugaaccagcaaa

SEQ ID NO: 13310 - RNA, 22 nt, Homo sapiens
uuauugcacuccagccugggua

SEQ ID NO: 13311 - RNA, 19 nt, Homo sapiens
gacuccagaguugugugcu

SEQ ID NO: 13312 - RNA, 22 nt, Homo sapiens
ccaggguuccacgccuggcugu

SEQ ID NO: 13313 - RNA, 22 nt, Homo sapiens
uugccuaggcuggagugcagug

SEQ ID NO: 13314 - RNA, 22 nt, Homo sapiens
gaaaacugcuucucuggguuuc

SEQ ID NO: 13315 - RNA, 22 nt, Homo sapiens
uagcaguaagaaacugacauug

SEQ ID NO: 13316 - RNA, 22 nt, Homo sapiens
agaauguaaacagaauagagga

SEQ ID NO: 13317 - RNA, 22 nt, Homo sapiens
cccuguguuuagcugaagguuu

SEQ ID NO: 13318 - RNA, 22 nt, Homo sapiens
ucucuggauaucuacuuauguu

SEQ ID NO: 13319 - RNA, 22 nt, Homo sapiens
gugcaaugagaaggggcucugg

SEQ ID NO: 13320 - RNA, 22 nt, Homo sapiens
acugcacuccagccuccugggu

SEQ ID NO: 13321 - RNA, 18 nt, Homo sapiens
uguugguguucacucacu

SEQ ID NO: 13322 - RNA, 22 nt, Homo sapiens
cuucaaaguuggcuaggagaca

SEQ ID NO: 13323 - RNA, 22 nt, Homo sapiens
cugucucagccucuccaguagc

SEQ ID NO: 13324 - RNA, 22 nt, Homo sapiens
ucacuuugacggccaacuucua

SEQ ID NO: 13325 - RNA, 22 nt, Homo sapiens
auagcagugugagaaugaacua

SEQ ID NO: 13326 - RNA, 22 nt, Homo sapiens
ucugagaucaugucugugcugu

SEQ ID NO: 13327 - RNA, 22 nt, Homo sapiens
cuccauuuggaacagauguccu

SEQ ID NO: 13328 - RNA, 22 nt, Homo sapiens
guauggguuuuguuucuucugg

SEQ ID NO: 13329 - RNA, 22 nt, Homo sapiens
caaaagugguucuuauccuuuu

SEQ ID NO: 13330 - RNA, 22 nt, Homo sapiens
uuucagagucaucugcccaagu

SEQ ID NO: 13331 - RNA, 22 nt, Homo sapiens
ucaggcuuuucccagagugaug

SEQ ID NO: 13332 - RNA, 22 nt, Homo sapiens
ugugcauaugucuuuauaguag

SEQ ID NO: 13333 - RNA, 22 nt, Homo sapiens
auguggaaagcagcaugauaug

SEQ ID NO: 13334 - RNA, 22 nt, Homo sapiens
agcaguguggccuuagacccgg

SEQ ID NO: 13335 - RNA, 18 nt, Homo sapiens
ugugacauugagcauguc

SEQ ID NO: 13336 - RNA, 22 nt, Homo sapiens
cauugcacuccagcccuggcaa

SEQ ID NO: 13337 - RNA, 22 nt, Homo sapiens
gucaucaggacgggucaucugc

SEQ ID NO: 13338 - RNA, 22 nt, Homo sapiens
ugagaaugcagaaucucgugca

SEQ ID NO: 13339 - RNA, 22 nt, Homo sapiens
auggaagaaaguuggguucuug

SEQ ID NO: 13340 - RNA, 21 nt, Homo sapiens
uaaaacuguaacuuuguccug

SEQ ID NO: 13341 - RNA, 22 nt, Homo sapiens
ugugccacugcacuccugccug

SEQ ID NO: 13342 - RNA, 22 nt, Homo sapiens
caucagagugagauauaagauc

SEQ ID NO: 13343 - RNA, 22 nt, Homo sapiens
gcaggcaugacauuucacucuu

SEQ ID NO: 13344 - RNA, 22 nt, Homo sapiens
agcaguacauaaaaagcauccu

SEQ ID NO: 13345 - RNA, 22 nt, Homo sapiens
ucgcgccauucuccugccucag

SEQ ID NO: 13346 - RNA, 22 nt, Homo sapiens
acacuggaguuaaaggugauuu

SEQ ID NO: 13347 - RNA, 22 nt, Homo sapiens
aguccauuugaugaugauucca

SEQ ID NO: 13348 - RNA, 22 nt, Homo sapiens
uaucagcagagucauacuucaa

SEQ ID NO: 13349 - RNA, 22 nt, Homo sapiens
ugaguucuuuguagauucugug

SEQ ID NO: 13350 - RNA, 22 nt, Homo sapiens
uugcacauugauuuuguaucuu

SEQ ID NO: 13351 - RNA, 22 nt, Homo sapiens
cagugcuuuaucaaguccucca

SEQ ID NO: 13352 - RNA, 22 nt, Homo sapiens
uuuuggcuagaaauauaccucc

SEQ ID NO: 13353 - RNA, 17 nt, Homo sapiens
augugaauguucaaaua

SEQ ID NO: 13354 - RNA, 22 nt, Homo sapiens
ugagauuaaucuuuaaguaaga

SEQ ID NO: 13355 - RNA, 22 nt, Homo sapiens
uggcaaaaaucacaaguaccuu

SEQ ID NO: 13356 - RNA, 22 nt, Homo sapiens
aaguagcuggaugcaguggcac

SEQ ID NO: 13357 - RNA, 22 nt, Homo sapiens
aagggagcugcauaaucuugug

SEQ ID NO: 13358 - RNA, 22 nt, Homo sapiens
aagagguagucugucccuuagc

SEQ ID NO: 13359 - RNA, 22 nt, Homo sapiens
ugagacauauuauacugcuuuu

SEQ ID NO: 13360 - RNA, 22 nt, Homo sapiens
ucagguccuuacugugcucccu

SEQ ID NO: 13361 - RNA, 22 nt, Homo sapiens
auggcacagaguagaugcucaa

SEQ ID NO: 13362 - RNA, 22 nt, Homo sapiens
cauugcacucuagucuggguga

SEQ ID NO: 13363 - RNA, 22 nt, Homo sapiens
uauuaguuuucuguggauuaca

SEQ ID NO: 13364 - RNA, 22 nt, Homo sapiens
auuacauagucaaggugucuca

SEQ ID NO: 13365 - RNA, 22 nt, Homo sapiens
gugagauacuagagauauagug

SEQ ID NO: 13366 - RNA, 22 nt, Homo sapiens
uuugugaaugucauaagcucca

SEQ ID NO: 13367 - RNA, 22 nt, Homo sapiens
cauugcacuccauccuuggcaa

SEQ ID NO: 13368 - RNA, 22 nt, Homo sapiens
cuugcacucagaagauucaguu

SEQ ID NO: 13369 - RNA, 22 nt, Homo sapiens
ucacacugaauuugaagcaaug

SEQ ID NO: 13370 - RNA, 22 nt, Homo sapiens
uuggcagcuguggaaucugggc

SEQ ID NO: 13371 - RNA, 22 nt, Homo sapiens
uggacauguacauauguguaug

SEQ ID NO: 13372 - RNA, 22 nt, Homo sapiens
uuacagauggauggcagcuggc

SEQ ID NO: 13373 - RNA, 22 nt, Homo sapiens
uuggaagacauucugucugcua

SEQ ID NO: 13374 - RNA, 22 nt, Homo sapiens
ugacaugauuguauauuuagaa

SEQ ID NO: 13375 - RNA, 22 nt, Homo sapiens
ugagaugcauauucuggcuccu

SEQ ID NO: 13376 - RNA, 22 nt, Homo sapiens
cuguaugugagaaauaauaagu

SEQ ID NO: 13377 - RNA, 23 nt, Homo sapiens
ugagauuacccagaaagaguaua

SEQ ID NO: 13378 - RNA, 22 nt, Homo sapiens
gugcacaucuguguuccagcua

SEQ ID NO: 13379 - RNA, 22 nt, Homo sapiens
aguauugcuaauaagagauuug

SEQ ID NO: 13380 - RNA, 22 nt, Homo sapiens
cugacuuuagaacccaaaaagu

SEQ ID NO: 13381 - RNA, 22 nt, Homo sapiens
agagugcuauagauuagauuuc

SEQ ID NO: 13382 - RNA, 22 nt, Homo sapiens
ugugauaguuggcuaaagcagu

SEQ ID NO: 13383 - RNA, 22 nt, Homo sapiens
acauggcacugcgggcuucuug

SEQ ID NO: 13384 - RNA, 22 nt, Homo sapiens
uacagccacauaauguaugauu

SEQ ID NO: 13385 - RNA, 22 nt, Homo sapiens
ggcaagaucuuggcucacugaa

SEQ ID NO: 13386 - RNA, 22 nt, Homo sapiens
ucagaguagagcgacuucuccu

SEQ ID NO: 13387 - RNA, 22 nt, Homo sapiens
acauucagcuguuguuucaaug

SEQ ID NO: 13388 - RNA, 22 nt, Homo sapiens
cauugcacuccagcuugggcaa

SEQ ID NO: 13389 - RNA, 22 nt, Homo sapiens
agucacagccuuuuacuuuaga

SEQ ID NO: 13390 - RNA, 22 nt, Homo sapiens
ugaaagcuacaggaaaguauuu

SEQ ID NO: 13391 - RNA, 22 nt, Homo sapiens
uaauccuagcacuuuggaagac

SEQ ID NO: 13392 - RNA, 22 nt, Homo sapiens
cagagguaagcaagucagcauu

SEQ ID NO: 13393 - RNA, 22 nt, Homo sapiens
cuggaauguuccuaaagauuca

SEQ ID NO: 13394 - RNA, 22 nt, Homo sapiens
ugucacagagauuuugguaugu

SEQ ID NO: 13395 - RNA, 20 nt, Homo sapiens
aguauucacuuuuuucaugg

SEQ ID NO: 13396 - RNA, 22 nt, Homo sapiens
auucagaggggcagcugucuug

SEQ ID NO: 13397 - RNA, 22 nt, Homo sapiens
gaugugaaaucauaguuucuag

SEQ ID NO: 13398 - RNA, 22 nt, Homo sapiens
acagucacaauuuguaccuuuu

SEQ ID NO: 13399 - RNA, 22 nt, Homo sapiens
gaugaggcuagagacaugugua

SEQ ID NO: 13400 - RNA, 22 nt, Homo sapiens
ugcauauucgaguuauuuuggg

SEQ ID NO: 13401 - RNA, 22 nt, Homo sapiens
cucacaugcucaccugguguuc

SEQ ID NO: 13402 - RNA, 22 nt, Homo sapiens
uccaguuuuguuaacauauggu

SEQ ID NO: 13403 - RNA, 22 nt, Homo sapiens
gaacccuggaggcggagguugc

SEQ ID NO: 13404 - RNA, 22 nt, Homo sapiens
aguagcaauggcucugagcuau

SEQ ID NO: 13405 - RNA, 19 nt, Homo sapiens
uaugcuauuuauuagaagu

SEQ ID NO: 13406 - RNA, 18 nt, Homo sapiens
acugcacuccaccuuggg

SEQ ID NO: 13407 - RNA, 22 nt, Homo sapiens
uugcacauugauuuuguauccu

SEQ ID NO: 13408 - RNA, 22 nt, Homo sapiens
uuaaauacagcaugguguuucu

SEQ ID NO: 13409 - RNA, 20 nt, Homo sapiens
ggaauagucuacacucugac

SEQ ID NO: 13410 - RNA, 22 nt, Homo sapiens
gguggugguauuucagaaaaug

SEQ ID NO: 13411 - RNA, 22 nt, Homo sapiens
guuggcaaguggcugagcuggg

SEQ ID NO: 13412 - RNA, 18 nt, Homo sapiens
ucacagguaaaguugaca

SEQ ID NO: 13413 - RNA, 22 nt, Homo sapiens
auaugcauacauguaugcagga

SEQ ID NO: 13414 - RNA, 22 nt, Homo sapiens
auacuguacugaaguacccauu

SEQ ID NO: 13415 - RNA, 22 nt, Homo sapiens
auagcagugugaaaacagacua

SEQ ID NO: 13416 - RNA, 22 nt, Homo sapiens
uuggcagcauuccagccaagca

SEQ ID NO: 13417 - RNA, 22 nt, Homo sapiens
ugugccacugcacuucagccug

SEQ ID NO: 13418 - RNA, 22 nt, Homo sapiens
uguaacacacacuguuuacucc

SEQ ID NO: 13419 - RNA, 22 nt, Homo sapiens
ugaaaucauguaguuauugcaa

SEQ ID NO: 13420 - RNA, 22 nt, Homo sapiens
uucuccugguggacccuaaacg

SEQ ID NO: 13421 - RNA, 22 nt, Homo sapiens
uggaauguaacuugaaacuuuu

SEQ ID NO: 13422 - RNA, 22 nt, Homo sapiens
uaguauguuuauagcauugagu

SEQ ID NO: 13423 - RNA, 22 nt, Homo sapiens
agagugcaaagguuggggcugg

SEQ ID NO: 13424 - RNA, 22 nt, Homo sapiens
uuuuuggaggagguuagaucau

SEQ ID NO: 13425 - RNA, 22 nt, Homo sapiens
guggaagaccagacuuuccaac

SEQ ID NO: 13426 - RNA, 22 nt, Homo sapiens
uuauuagagauauuugguuagg

SEQ ID NO: 13427 - RNA, 22 nt, Homo sapiens
aaauugcauugagcugcuuauu

SEQ ID NO: 13428 - RNA, 22 nt, Homo sapiens
agcagagcaguggauuuuguga

SEQ ID NO: 13429 - RNA, 22 nt, Homo sapiens
caagagaccugagugucauucu

SEQ ID NO: 13430 - RNA, 22 nt, Homo sapiens
cuugcacuugaaauuccaguuu

SEQ ID NO: 13431 - RNA, 22 nt, Homo sapiens
cuuucucagugagacccgagau

SEQ ID NO: 13432 - RNA, 23 nt, Homo sapiens
uggguucauucuugaagucagug

SEQ ID NO: 13433 - RNA, 22 nt, Homo sapiens
guucaagugauucuacugccuc

SEQ ID NO: 13434 - RNA, 22 nt, Homo sapiens
acugcacuccacccuuggcagc

SEQ ID NO: 13435 - RNA, 22 nt, Homo sapiens
caauggcacgaucucgucucac

SEQ ID NO: 13436 - RNA, 22 nt, Homo sapiens
augugaacaucauagaaugcac

SEQ ID NO: 13437 - RNA, 22 nt, Homo sapiens
uucaguauugcaccuggagucc

SEQ ID NO: 13438 - RNA, 22 nt, Homo sapiens
aaagugauguccaggcuuucag

SEQ ID NO: 13439 - RNA, 22 nt, Homo sapiens
ccugagaucauacuguuaguaa

SEQ ID NO: 13440 - RNA, 22 nt, Homo sapiens
uaacaggcaaggucacaccuug

SEQ ID NO: 13441 - RNA, 22 nt, Homo sapiens
uuccaugugggcuugucaagua

SEQ ID NO: 13442 - RNA, 22 nt, Homo sapiens
cucauugcaaucucugccuccc

SEQ ID NO: 13443 - RNA, 18 nt, Homo sapiens
uuuggcuguucaugacuc

SEQ ID NO: 13444 - RNA, 23 nt, Homo sapiens
ucaguacuccacuuucaauagug

SEQ ID NO: 13445 - RNA, 22 nt, Homo sapiens
uggaagccuagauucuuuucuu

SEQ ID NO: 13446 - RNA, 20 nt, Homo sapiens
uccaguuuuggagacauucu

SEQ ID NO: 13447 - RNA, 18 nt, Homo sapiens
ucacaaccacagugcugu

SEQ ID NO: 13448 - RNA, 17 nt, Homo sapiens
aaucagauuucugagga

SEQ ID NO: 13449 - RNA, 22 nt, Homo sapiens
agguagcauagcgggaauauca

SEQ ID NO: 13450 - RNA, 22 nt, Homo sapiens
cauugcacuccaucuugggcaa

SEQ ID NO: 13451 - RNA, 18 nt, Homo sapiens
ugcauacuaucugauuuu

SEQ ID NO: 13452 - RNA, 22 nt, Homo sapiens
uuuuccagugggacucccauua

SEQ ID NO: 13453 - RNA, 23 nt, Homo sapiens
aucacuguuaacaauuucuuccu

SEQ ID NO: 13454 - RNA, 22 nt, Homo sapiens
guggaaaauuauugcuguuuuu

SEQ ID NO: 13455 - RNA, 22 nt, Homo sapiens
auacacgguaggcacauauuua

SEQ ID NO: 13456 - RNA, 22 nt, Homo sapiens
guaaucucagcuacuugggagu

SEQ ID NO: 13457 - RNA, 22 nt, Homo sapiens
ggguucaaaucuuggcucuuac

SEQ ID NO: 13458 - RNA, 22 nt, Homo sapiens
ugagauuauauuucuuaacaga

SEQ ID NO: 13459 - RNA, 22 nt, Homo sapiens
cuaugagucugcagaucuauua

SEQ ID NO: 13460 - RNA, 22 nt, Homo sapiens
gugugcucaucacaugcaauag

SEQ ID NO: 13461 - RNA, 22 nt, Homo sapiens
ggcuuggaggaaugugagggcu

SEQ ID NO: 13462 - RNA, 22 nt, Homo sapiens
aagcuacauuuuauuuauguca

SEQ ID NO: 13463 - RNA, 22 nt, Homo sapiens
ugcaaauguuaggugucauuau

SEQ ID NO: 13464 - RNA, 22 nt, Homo sapiens
agccauacaacguaugcaugua

SEQ ID NO: 13465 - RNA, 22 nt, Homo sapiens
auuuggguaaugagugcaaggg

SEQ ID NO: 13466 - RNA, 22 nt, Homo sapiens
cuggaagaaaaucacgccaucu

SEQ ID NO: 13467 - RNA, 22 nt, Homo sapiens
uuggaagagaagggagauaaac

SEQ ID NO: 13468 - RNA, 22 nt, Homo sapiens
acugcacuucagccuuggcuac

SEQ ID NO: 13469 - RNA, 20 nt, Homo sapiens
uaucacaguucaggaacucu

SEQ ID NO: 13470 - RNA, 22 nt, Homo sapiens
ucauugcauguuaauuaaacag

SEQ ID NO: 13471 - RNA, 21 nt, Homo sapiens
aagcacauugaguguguguga

SEQ ID NO: 13472 - RNA, 22 nt, Homo sapiens
uggcaaaugaaagaaagccagu

SEQ ID NO: 13473 - RNA, 22 nt, Homo sapiens
caugucuuuuaaacauucaacu

SEQ ID NO: 13474 - RNA, 22 nt, Homo sapiens
uucugaguggcuuucaacacug

SEQ ID NO: 13475 - RNA, 22 nt, Homo sapiens
uuggcaacauagugagaccccc

SEQ ID NO: 13476 - RNA, 22 nt, Homo sapiens
uaugcagacauuguuccaacca

SEQ ID NO: 13477 - RNA, 22 nt, Homo sapiens
aaucacauugaaucugcuaccu

SEQ ID NO: 13478 - RNA, 22 nt, Homo sapiens
gcagcaucaaaucacacaagau

SEQ ID NO: 13479 - RNA, 22 nt, Homo sapiens
gaguuagguugucaaugucuua

SEQ ID NO: 13480 - RNA, 22 nt, Homo sapiens
gaauuguacugcaaucagggga

SEQ ID NO: 13481 - RNA, 17 nt, Homo sapiens
uuucagaguggaagugu

SEQ ID NO: 13482 - RNA, 22 nt, Homo sapiens
ugcgccauugcauuccagccug

SEQ ID NO: 13483 - RNA, 22 nt, Homo sapiens
aaagugcugggauuaggccagg

SEQ ID NO: 13484 - RNA, 22 nt, Homo sapiens
agcucuuguuaguauuagcagu

SEQ ID NO: 13485 - RNA, 22 nt, Homo sapiens
ugggagacuacauuuuuaacaa

SEQ ID NO: 13486 - RNA, 23 nt, Homo sapiens
ugagauuauaaucuuuuacuucu

SEQ ID NO: 13487 - RNA, 22 nt, Homo sapiens
guguccucgaguacacaucagg

SEQ ID NO: 13488 - RNA, 22 nt, Homo sapiens
aaagugcugggaucacacugaa

SEQ ID NO: 13489 - RNA, 22 nt, Homo sapiens
uaugucuuuugcuugcaaauag

SEQ ID NO: 13490 - RNA, 22 nt, Homo sapiens
auggaagaauugucggggaugu

SEQ ID NO: 13491 - RNA, 22 nt, Homo sapiens
uuuauggagagauauuuauggu

SEQ ID NO: 13492 - RNA, 22 nt, Homo sapiens
cugagauggagucucgcauugu

SEQ ID NO: 13493 - RNA, 19 nt, Homo sapiens
ucauagucuaagaugagaa

SEQ ID NO: 13494 - RNA, 22 nt, Homo sapiens
gccugagaggauaugauccccu

SEQ ID NO: 13495 - RNA, 18 nt, Homo sapiens
ucacggggagcagcagcc

SEQ ID NO: 13496 - RNA, 22 nt, Homo sapiens
gugcacauauggugcauaagug

SEQ ID NO: 13497 - RNA, 22 nt, Homo sapiens
uuagugaaugcaccacuucuga

SEQ ID NO: 13498 - RNA, 22 nt, Homo sapiens
uacaaagcuuucugcaaaucau

SEQ ID NO: 13499 - RNA, 22 nt, Homo sapiens
cuucaugucuucaauggggggg

SEQ ID NO: 13500 - RNA, 22 nt, Homo sapiens
uagagguagguguaugaacuag

SEQ ID NO: 13501 - RNA, 22 nt, Homo sapiens
aaaagucuguagugaaagguga

SEQ ID NO: 13502 - RNA, 22 nt, Homo sapiens
augaaaagcauaaacgcugaag

SEQ ID NO: 13503 - RNA, 22 nt, Homo sapiens
caaagucuauucuacccuuacc

SEQ ID NO: 13504 - RNA, 22 nt, Homo sapiens
ucacugaggucugagcuuuaug

SEQ ID NO: 13505 - RNA, 22 nt, Homo sapiens
ugaauguaagaugucugcuggu

SEQ ID NO: 13506 - RNA, 22 nt, Homo sapiens
ugcaugaugcugagauuuggga

SEQ ID NO: 13507 - RNA, 22 nt, Homo sapiens
cauugcacuccaucccgggaaa

SEQ ID NO: 13508 - RNA, 22 nt, Homo sapiens
ucacugcgaccucugccucccg

SEQ ID NO: 13509 - RNA, 22 nt, Homo sapiens
cauugcacuccagccuagccaa

SEQ ID NO: 13510 - RNA, 22 nt, Homo sapiens
uuccuggagaguuuucccaaag

SEQ ID NO: 13511 - RNA, 22 nt, Homo sapiens
uucauguaauauuucacagcuu

SEQ ID NO: 13512 - RNA, 22 nt, Homo sapiens
gagagugcuuggcaucugcuga

SEQ ID NO: 13513 - RNA, 22 nt, Homo sapiens
auccaucagacggcaggcguug

SEQ ID NO: 13514 - RNA, 22 nt, Homo sapiens
cccagagacagaaugauaaacu

SEQ ID NO: 13515 - RNA, 23 nt, Homo sapiens
aauugcacauuccuugcuggcag

SEQ ID NO: 13516 - RNA, 22 nt, Homo sapiens
uaagguccuuaaauguguaacc

SEQ ID NO: 13517 - RNA, 22 nt, Homo sapiens
uugcacauggcaggugcucaau

SEQ ID NO: 13518 - RNA, 21 nt, Homo sapiens
aauacucuagguuaagagagc

SEQ ID NO: 13519 - RNA, 22 nt, Homo sapiens
cauugcacuccagccugccugg

SEQ ID NO: 13520 - RNA, 22 nt, Homo sapiens
ggagaugauuaugaaucacuua

SEQ ID NO: 13521 - RNA, 22 nt, Homo sapiens
caggugcuuacuuaauagccau

SEQ ID NO: 13522 - RNA, 22 nt, Homo sapiens
cugguuuguaaaguuccugaga

SEQ ID NO: 13523 - RNA, 22 nt, Homo sapiens
uugcaaagaccucuucacuucc

SEQ ID NO: 13524 - RNA, 22 nt, Homo sapiens
aagagaugaagguccugacugu

SEQ ID NO: 13525 - RNA, 21 nt, Homo sapiens
auuguauguaaaccaaaugag

SEQ ID NO: 13526 - RNA, 22 nt, Homo sapiens
uugugaaugaugucgcaauaaa

SEQ ID NO: 13527 - RNA, 22 nt, Homo sapiens
ugaugacauugucacagucuga

SEQ ID NO: 13528 - RNA, 22 nt, Homo sapiens
cccugagaugcuguuaaucugu

SEQ ID NO: 13529 - RNA, 23 nt, Homo sapiens
aggcauuguacaguaauggaaaa

SEQ ID NO: 13530 - RNA, 22 nt, Homo sapiens
uucauagucuaugcaaguaaga

SEQ ID NO: 13531 - RNA, 16 nt, Homo sapiens
uuauugcauucuucuc

SEQ ID NO: 13532 - RNA, 22 nt, Homo sapiens
uaucacagaggguauccuagag

SEQ ID NO: 13533 - RNA, 22 nt, Homo sapiens
accaguuuuuuauacaucuucu

SEQ ID NO: 13534 - RNA, 22 nt, Homo sapiens
auuacaugucuauccaugaaca

SEQ ID NO: 13535 - RNA, 22 nt, Homo sapiens
acaccaugucuguuucugguuu

SEQ ID NO: 13536 - RNA, 22 nt, Homo sapiens
aaucacacuugauguugagcaa

SEQ ID NO: 13537 - RNA, 22 nt, Homo sapiens
uccugagacucacaggcucccc

SEQ ID NO: 13538 - RNA, 22 nt, Homo sapiens
ggaaucugaaccaugggaaugg

SEQ ID NO: 13539 - RNA, 18 nt, Homo sapiens
uccaguuuucccagcauc

SEQ ID NO: 13540 - RNA, 22 nt, Homo sapiens
uucauguaauuccauaagguaa

SEQ ID NO: 13541 - RNA, 22 nt, Homo sapiens
gugaggcacugcugcuuuccag

SEQ ID NO: 13542 - RNA, 22 nt, Homo sapiens
aauugcacuggaaguaacugag

SEQ ID NO: 13543 - RNA, 21 nt, Homo sapiens
ugagaugugaccagggcauca

SEQ ID NO: 13544 - RNA, 22 nt, Homo sapiens
uccugagaauagaguugcaugu

SEQ ID NO: 13545 - RNA, 22 nt, Homo sapiens
uacuguacugcaguucugcaaa

SEQ ID NO: 13546 - RNA, 22 nt, Homo sapiens
uagcaguaucccaccaucuggu

SEQ ID NO: 13547 - RNA, 22 nt, Homo sapiens
cauugcacuccaccuuggguaa

SEQ ID NO: 13548 - RNA, 22 nt, Homo sapiens
gcacauauguaaauagcugccu

SEQ ID NO: 13549 - RNA, 22 nt, Homo sapiens
ugagauggagucuugucgccua

SEQ ID NO: 13550 - RNA, 22 nt, Homo sapiens
cugugcuugagagaugacacag

SEQ ID NO: 13551 - RNA, 22 nt, Homo sapiens
gcaguggugugugccagccuag

SEQ ID NO: 13552 - RNA, 19 nt, Homo sapiens
uuucaauguaaggauggag

SEQ ID NO: 13553 - RNA, 19 nt, Homo sapiens
uggcacauguauacauaug

SEQ ID NO: 13554 - RNA, 20 nt, Homo sapiens
guucacaggcuuccuuucag

SEQ ID NO: 13555 - RNA, 22 nt, Homo sapiens
uggucaccugaauuaugcaugu

SEQ ID NO: 13556 - RNA, 20 nt, Homo sapiens
uauucacucuccagucuugc

SEQ ID NO: 13557 - RNA, 22 nt, Homo sapiens
acugagacugagaauguuucuu

SEQ ID NO: 13558 - RNA, 22 nt, Homo sapiens
uaaaugcucuuuaaaagugcuu

SEQ ID NO: 13559 - RNA, 22 nt, Homo sapiens
uaggugaaugcuggaagaaaug

SEQ ID NO: 13560 - RNA, 22 nt, Homo sapiens
ugugccacugcacucccgccug

SEQ ID NO: 13561 - RNA, 21 nt, Homo sapiens
uaucacaguagaauaggaucu

SEQ ID NO: 13562 - RNA, 22 nt, Homo sapiens
uugcacauggcuggggaggccu

SEQ ID NO: 13563 - RNA, 22 nt, Homo sapiens
ccuucuuuuguaaggcugaaua

SEQ ID NO: 13564 - RNA, 17 nt, Homo sapiens
uucucaguucugaucuc

SEQ ID NO: 13565 - RNA, 22 nt, Homo sapiens
uuaucauagugcaguuuucuga

SEQ ID NO: 13566 - RNA, 22 nt, Homo sapiens
uugauauguuguuagauucagu

SEQ ID NO: 13567 - RNA, 22 nt, Homo sapiens
gagcaucaguggccucaucuca

SEQ ID NO: 13568 - RNA, 22 nt, Homo sapiens
auaaaugccuguuguuuuaagc

SEQ ID NO: 13569 - RNA, 22 nt, Homo sapiens
guguauauccuauuaguucugu

SEQ ID NO: 13570 - RNA, 18 nt, Homo sapiens
acauucagcuugaagaua

SEQ ID NO: 13571 - RNA, 22 nt, Homo sapiens
aagugcuuacagggaacaugau

SEQ ID NO: 13572 - RNA, 20 nt, Homo sapiens
augaagugaaguuagggaac

SEQ ID NO: 13573 - RNA, 22 nt, Homo sapiens
uugaaagucuaggcuuacagua

SEQ ID NO: 13574 - RNA, 22 nt, Homo sapiens
gucagugugauaucugcagggg

SEQ ID NO: 13575 - RNA, 20 nt, Homo sapiens
ucaaggcacgaauaaaaguu

SEQ ID NO: 13576 - RNA, 22 nt, Homo sapiens
uagagguauaccaaaaaggcau

SEQ ID NO: 13577 - RNA, 22 nt, Homo sapiens
augucaaagaggaaaacuggau

SEQ ID NO: 13578 - RNA, 22 nt, Homo sapiens
uugaaccauucuuuugauagag

SEQ ID NO: 13579 - RNA, 22 nt, Homo sapiens
uaucacaggucaggaaccuugu

SEQ ID NO: 13580 - RNA, 22 nt, Homo sapiens
gucuggcuuaucucacuuacca

SEQ ID NO: 13581 - RNA, 22 nt, Homo sapiens
accucagcccggggaaguugag

SEQ ID NO: 13582 - RNA, 22 nt, Homo sapiens
ucaucuggcgaaugugaagagu

SEQ ID NO: 13583 - RNA, 22 nt, Homo sapiens
auuuguccugccuuuuccuccu

SEQ ID NO: 13584 - RNA, 22 nt, Homo sapiens
augcacauggcuaacuuuuuuc

SEQ ID NO: 13585 - RNA, 22 nt, Homo sapiens
aagaguuaguaaaauuuccucu

SEQ ID NO: 13586 - RNA, 22 nt, Homo sapiens
auggcuuuuuaaaucauguugu

SEQ ID NO: 13587 - RNA, 22 nt, Homo sapiens
aaagugcugggauuggcugggc

SEQ ID NO: 13588 - RNA, 22 nt, Homo sapiens
agugccaaaucgagggcucuga

SEQ ID NO: 13589 - RNA, 22 nt, Homo sapiens
auaugucuauuauuagggcagg

SEQ ID NO: 13590 - RNA, 22 nt, Homo sapiens
uucucuguggauugggugagag

SEQ ID NO: 13591 - RNA, 22 nt, Homo sapiens
uaaagcuuagauccaugguggc

SEQ ID NO: 13592 - RNA, 22 nt, Homo sapiens
uguagcagccauaaacacagug

SEQ ID NO: 13593 - RNA, 22 nt, Homo sapiens
cauugcacugcuucuugggugu

SEQ ID NO: 13594 - RNA, 22 nt, Homo sapiens
auacuguauaggauuguagccu

SEQ ID NO: 13595 - RNA, 22 nt, Homo sapiens
agagugaagcuuuuuauauucu

SEQ ID NO: 13596 - RNA, 22 nt, Homo sapiens
auugcacaaagagggaaacuga

SEQ ID NO: 13597 - RNA, 22 nt, Homo sapiens
caagugcucuaggauccugagu

SEQ ID NO: 13598 - RNA, 22 nt, Homo sapiens
caacauccaccuccuggguuca

SEQ ID NO: 13599 - RNA, 22 nt, Homo sapiens
uccuucaguccaguggguuuug

SEQ ID NO: 13600 - RNA, 22 nt, Homo sapiens
cugaaagagcauguaacacagu

SEQ ID NO: 13601 - RNA, 22 nt, Homo sapiens
uugugaaugaugccgcaauaaa

SEQ ID NO: 13602 - RNA, 22 nt, Homo sapiens
uugugaauggugccgcaguaaa

SEQ ID NO: 13603 - RNA, 18 nt, Homo sapiens
uugcaaauucuucccugu

SEQ ID NO: 13604 - RNA, 22 nt, Homo sapiens
uuguaaagaucauaugcuguuc

SEQ ID NO: 13605 - RNA, 22 nt, Homo sapiens
uaucagagcugucagccuaccu

SEQ ID NO: 13606 - RNA, 22 nt, Homo sapiens
uuguacuuuuaguagagacggg

SEQ ID NO: 13607 - RNA, 22 nt, Homo sapiens
caauacuguguugaauaagagu

SEQ ID NO: 13608 - RNA, 22 nt, Homo sapiens
aaagugcugagucuaggcgggg

SEQ ID NO: 13609 - RNA, 22 nt, Homo sapiens
aauugcacuaagcauaguccag

SEQ ID NO: 13610 - RNA, 20 nt, Homo sapiens
uuccagcacauuagggaagc

SEQ ID NO: 13611 - RNA, 22 nt, Homo sapiens
uaucaagaugacaaacuuugcu

SEQ ID NO: 13612 - RNA, 21 nt, Homo sapiens
ugcauauuggaacuuucucuc

SEQ ID NO: 13613 - RNA, 22 nt, Homo sapiens
auuccauuuguuaucacacccg

SEQ ID NO: 13614 - RNA, 22 nt, Homo sapiens
ucuggagugugaaguggauaug

SEQ ID NO: 13615 - RNA, 22 nt, Homo sapiens
uaagugcuguguuguuaccuaa

SEQ ID NO: 13616 - RNA, 22 nt, Homo sapiens
aucucuugccagucagaauggu

SEQ ID NO: 13617 - RNA, 22 nt, Homo sapiens
auaagugagugauucaguguua

SEQ ID NO: 13618 - RNA, 22 nt, Homo sapiens
uucucaguuccuacuuugguga

SEQ ID NO: 13619 - RNA, 22 nt, Homo sapiens
ggagcugugauuugaguccaga

SEQ ID NO: 13620 - RNA, 22 nt, Homo sapiens
augauguaggccauggguuucu

SEQ ID NO: 13621 - RNA, 22 nt, Homo sapiens
uagcagguguuccacaaauauu

SEQ ID NO: 13622 - RNA, 22 nt, Homo sapiens
uuuaaagcaugacgagaagaag

SEQ ID NO: 13623 - RNA, 22 nt, Homo sapiens
uagacacuagauaugugacuga

SEQ ID NO: 13624 - RNA, 22 nt, Homo sapiens
uucaugucuuggcuguuagagu

SEQ ID NO: 13625 - RNA, 22 nt, Homo sapiens
ucacaguucagcauggcugagg

SEQ ID NO: 13626 - RNA, 22 nt, Homo sapiens
uauuguacauguuauagauuuu

SEQ ID NO: 13627 - RNA, 22 nt, Homo sapiens
gugcaaauuccagcucaacucc

SEQ ID NO: 13628 - RNA, 22 nt, Homo sapiens
cagugcuuguuauuguucuauu

SEQ ID NO: 13629 - RNA, 22 nt, Homo sapiens
uucuggaaaucagcagagggug

SEQ ID NO: 13630 - RNA, 22 nt, Homo sapiens
uguauguuguaagacuuagacc

SEQ ID NO: 13631 - RNA, 22 nt, Homo sapiens
ugccuaguagaaggugaacaug

SEQ ID NO: 13632 - RNA, 17 nt, Homo sapiens
gugagguauccucaaaa

SEQ ID NO: 13633 - RNA, 22 nt, Homo sapiens
uucauagucacauucgaugucu

SEQ ID NO: 13634 - RNA, 18 nt, Homo sapiens
ucagucacugccuggcuu

SEQ ID NO: 13635 - RNA, 22 nt, Homo sapiens
auuacacuuucuauucaaugag

SEQ ID NO: 13636 - RNA, 18 nt, Homo sapiens
auauugcauuggauggau

SEQ ID NO: 13637 - RNA, 22 nt, Homo sapiens
agcauuaguugugaagccuuua

SEQ ID NO: 13638 - RNA, 22 nt, Homo sapiens
gucaugucugcacauaguaaaa

SEQ ID NO: 13639 - RNA, 21 nt, Homo sapiens
cauaaugcuacuuauuuuaug

SEQ ID NO: 13640 - RNA, 22 nt, Homo sapiens
uuauuagguugguggaaaagua

SEQ ID NO: 13641 - RNA, 22 nt, Homo sapiens
uauugcacuuuuccauaggagu

SEQ ID NO: 13642 - RNA, 20 nt, Homo sapiens
aagugcuuccuuuuagaggg

SEQ ID NO: 13643 - RNA, 22 nt, Homo sapiens
uuuuuggauaaugguacaugua

SEQ ID NO: 13644 - RNA, 22 nt, Homo sapiens
uaugaaagcuacuucucacaau

SEQ ID NO: 13645 - RNA, 22 nt, Homo sapiens
uggcaccauccaggugucucua

SEQ ID NO: 13646 - RNA, 22 nt, Homo sapiens
ucuuuggucuacuuucauaugu

SEQ ID NO: 13647 - RNA, 22 nt, Homo sapiens
cuugcacuccacuguucuccug

SEQ ID NO: 13648 - RNA, 22 nt, Homo sapiens
gagguaucauuauguugcccag

SEQ ID NO: 13649 - RNA, 22 nt, Homo sapiens
gauggcacuaagccauguagga

SEQ ID NO: 13650 - RNA, 22 nt, Homo sapiens
ggaaauguuuagcauccacuuu

SEQ ID NO: 13651 - RNA, 22 nt, Homo sapiens
aagugcuuccuuucagaggguu

SEQ ID NO: 13652 - RNA, 21 nt, Homo sapiens
caugucacugcacucuagccu

SEQ ID NO: 13653 - RNA, 22 nt, Homo sapiens
cucacugucaacauguauuugg

SEQ ID NO: 13654 - RNA, 22 nt, Homo sapiens
aaauugcuuuugaagacuuagu

SEQ ID NO: 13655 - RNA, 22 nt, Homo sapiens
acuucauucucuggaucagaau

SEQ ID NO: 13656 - RNA, 21 nt, Homo sapiens
ugcuauguuguccaggcuggc

SEQ ID NO: 13657 - RNA, 22 nt, Homo sapiens
uugugaauggugccacaauaaa

SEQ ID NO: 13658 - RNA, 22 nt, Homo sapiens
guaaucucagcuucuugggagg

SEQ ID NO: 13659 - RNA, 22 nt, Homo sapiens
auccuuuagacuguccaguuga

SEQ ID NO: 13660 - RNA, 22 nt, Homo sapiens
uugugaaaaaccucucguggaa

SEQ ID NO: 13661 - RNA, 22 nt, Homo sapiens
uugaaagaaaggagacugaguu

SEQ ID NO: 13662 - RNA, 22 nt, Homo sapiens
cauugcacucugcauuccaguc

SEQ ID NO: 13663 - RNA, 22 nt, Homo sapiens
ugagauuguaucugcaaugugu

SEQ ID NO: 13664 - RNA, 20 nt, Homo sapiens
auuguccuugauuacacaga

SEQ ID NO: 13665 - RNA, 20 nt, Homo sapiens
ugacaagugagaauuauggg

SEQ ID NO: 13666 - RNA, 22 nt, Homo sapiens
auagcagugugaaaauggacua

SEQ ID NO: 13667 - RNA, 22 nt, Homo sapiens
auguagugugauuuucacuaga

SEQ ID NO: 13668 - RNA, 22 nt, Homo sapiens
agucaagaaucucagcaucuuu

SEQ ID NO: 13669 - RNA, 22 nt, Homo sapiens
uugcauaagugcauucugugau

SEQ ID NO: 13670 - RNA, 22 nt, Homo sapiens
acugcacuucagccuugggaaa

SEQ ID NO: 13671 - RNA, 22 nt, Homo sapiens
aaaguggugggauuccaggcau

SEQ ID NO: 13672 - RNA, 22 nt, Homo sapiens
uggaauguagcguugacacgag

SEQ ID NO: 13673 - RNA, 22 nt, Homo sapiens
accuggcacuuagcaaaucuga

SEQ ID NO: 13674 - RNA, 22 nt, Homo sapiens
caagugcuuucuuggggauuua

SEQ ID NO: 13675 - RNA, 22 nt, Homo sapiens
auacaagugccauguuggugug

SEQ ID NO: 13676 - RNA, 22 nt, Homo sapiens
cagcuaaauuguuaaauccaag

SEQ ID NO: 13677 - RNA, 22 nt, Homo sapiens
augacugucagggcagucauug

SEQ ID NO: 13678 - RNA, 22 nt, Homo sapiens
aauuacauggcaauugggaaau

SEQ ID NO: 13679 - RNA, 20 nt, Homo sapiens
uauugcacuccagucugggc

SEQ ID NO: 13680 - RNA, 22 nt, Homo sapiens
cuuucugaggagaauagagaac

SEQ ID NO: 13681 - RNA, 23 nt, Homo sapiens
ggcaagaucucagcucacugcaa

SEQ ID NO: 13682 - RNA, 22 nt, Homo sapiens
guacaugcaugcaugggugugc

SEQ ID NO: 13683 - RNA, 22 nt, Homo sapiens
uaacauuguugauuauacuaag

SEQ ID NO: 13684 - RNA, 22 nt, Homo sapiens
ugucaguuuuaacuagggaaua

SEQ ID NO: 13685 - RNA, 22 nt, Homo sapiens
ucuagccuaugaagcuugucca

SEQ ID NO: 13686 - RNA, 22 nt, Homo sapiens
uucacuguagccucagccucuu

SEQ ID NO: 13687 - RNA, 22 nt, Homo sapiens
aggugaaugcucacauucuaau

SEQ ID NO: 13688 - RNA, 22 nt, Homo sapiens
uaucacagugcuggaguauucc

SEQ ID NO: 13689 - RNA, 19 nt, Homo sapiens
uuuugcucuuuauaccuau

SEQ ID NO: 13690 - RNA, 22 nt, Homo sapiens
ugaggaacuagcuacccuaaua

SEQ ID NO: 13691 - RNA, 22 nt, Homo sapiens
uugucacccuacauaacaggga

SEQ ID NO: 13692 - RNA, 22 nt, Homo sapiens
augugcaacugcuggaacaguc

SEQ ID NO: 13693 - RNA, 22 nt, Homo sapiens
uggaguguguugcagaugaagg

SEQ ID NO: 13694 - RNA, 22 nt, Homo sapiens
auugucccucuuaaucccagca

SEQ ID NO: 13695 - RNA, 22 nt, Homo sapiens
ugagaucacgccacugcacucc

SEQ ID NO: 13696 - RNA, 22 nt, Homo sapiens
caugacacuggcauguuucuuu

SEQ ID NO: 13697 - RNA, 22 nt, Homo sapiens
ugagauguggcuagagagguug

SEQ ID NO: 13698 - RNA, 22 nt, Homo sapiens
uuauacucgucugaaugauucu

SEQ ID NO: 13699 - RNA, 22 nt, Homo sapiens
ucaugugaggauaacaauagug

SEQ ID NO: 13700 - RNA, 19 nt, Homo sapiens
ggucacagggguuacaagg

SEQ ID NO: 13701 - RNA, 22 nt, Homo sapiens
ugccuaguggaaggagagcaaa

SEQ ID NO: 13702 - RNA, 22 nt, Homo sapiens
auuaagugcuugccagugcugg

SEQ ID NO: 13703 - RNA, 23 nt, Homo sapiens
ggaguguaaugacucgaucucgg

SEQ ID NO: 13704 - RNA, 23 nt, Homo sapiens
aggaauggaaaaccaaguaucau

SEQ ID NO: 13705 - RNA, 22 nt, Homo sapiens
caugucuuuuauucugugugau

SEQ ID NO: 13706 - RNA, 22 nt, Homo sapiens
gugggcucguucguguuagaca

SEQ ID NO: 13707 - RNA, 22 nt, Homo sapiens
cacaaaguagauuagucuucca

SEQ ID NO: 13708 - RNA, 22 nt, Homo sapiens
uuuugcaccauccuaauaguau

SEQ ID NO: 13709 - RNA, 22 nt, Homo sapiens
cauugcacuccagccuggcaac

SEQ ID NO: 13710 - RNA, 22 nt, Homo sapiens
uaacauagucauauacuugcuu

SEQ ID NO: 13711 - RNA, 22 nt, Homo sapiens
agaacuguccauucagcaugaa

SEQ ID NO: 13712 - RNA, 22 nt, Homo sapiens
ugacucaguuucucagguagua

SEQ ID NO: 13713 - RNA, 20 nt, Homo sapiens
uuccuuaggcauuggaagaa

SEQ ID NO: 13714 - RNA, 22 nt, Homo sapiens
aucaccuggaggugaucacuug

SEQ ID NO: 13715 - RNA, 22 nt, Homo sapiens
acaguaaugggccccuuuuccu

SEQ ID NO: 13716 - RNA, 22 nt, Homo sapiens
aagugcucuugaaacugccuua

SEQ ID NO: 13717 - RNA, 22 nt, Homo sapiens
ucagcagugugaaaauggacua

SEQ ID NO: 13718 - RNA, 22 nt, Homo sapiens
ugucauguuucuacugaccaaa

SEQ ID NO: 13719 - RNA, 22 nt, Homo sapiens
gagaaugaugauuuccaauuuc

SEQ ID NO: 13720 - RNA, 22 nt, Homo sapiens
aagucaaggagagaagcuucag

SEQ ID NO: 13721 - RNA, 22 nt, Homo sapiens
gaagugcuuuuggacuaacagu

SEQ ID NO: 13722 - RNA, 22 nt, Homo sapiens
ggcagcauugccuuugcaguga

SEQ ID NO: 13723 - RNA, 22 nt, Homo sapiens
caaaagugauugcgguuuuugc

SEQ ID NO: 13724 - RNA, 19 nt, Homo sapiens
ucgcgccauucuccugccu

SEQ ID NO: 13725 - RNA, 22 nt, Homo sapiens
gagacggagucucgcucuguca

SEQ ID NO: 13726 - RNA, 23 nt, Homo sapiens
uaagucacacagauuaauuuauu

SEQ ID NO: 13727 - RNA, 22 nt, Homo sapiens
ucagacacugagcaaacgacua

SEQ ID NO: 13728 - RNA, 18 nt, Homo sapiens
cuggaugucgaguguguu

SEQ ID NO: 13729 - RNA, 22 nt, Homo sapiens
uauugcacaugaggagacauug

SEQ ID NO: 13730 - RNA, 22 nt, Homo sapiens
cuggcaagaggauaaaguccua

SEQ ID NO: 13731 - RNA, 22 nt, Homo sapiens
cccugaagauacagaguuuggg

SEQ ID NO: 13732 - RNA, 22 nt, Homo sapiens
uauuccuuuugcauuuccacau

SEQ ID NO: 13733 - RNA, 22 nt, Homo sapiens
agcagagcauauucauucgggg

SEQ ID NO: 13734 - RNA, 22 nt, Homo sapiens
gccuagagaaguaaauauuauc

SEQ ID NO: 13735 - RNA, 22 nt, Homo sapiens
aagugcuuuuuagauaugguuu

SEQ ID NO: 13736 - RNA, 22 nt, Homo sapiens
uugcaucagcaggcauaauugg

SEQ ID NO: 13737 - RNA, 22 nt, Homo sapiens
uacauacuucacagacuuuaaa

SEQ ID NO: 13738 - RNA, 22 nt, Homo sapiens
uaagugaauauggacaguuagc

SEQ ID NO: 13739 - RNA, 22 nt, Homo sapiens
accugagacuaggcauuuuaua

SEQ ID NO: 13740 - RNA, 22 nt, Homo sapiens
cauugcacuccagcccagguga

SEQ ID NO: 13741 - RNA, 22 nt, Homo sapiens
uaagugaaggaaguguguuuac

SEQ ID NO: 13742 - RNA, 22 nt, Homo sapiens
auugcacaccagucugggcaaa

SEQ ID NO: 13743 - RNA, 22 nt, Homo sapiens
acauguaauugauuuuguguua

SEQ ID NO: 13744 - RNA, 22 nt, Homo sapiens
augugaaugugaucggauaguc

SEQ ID NO: 13745 - RNA, 22 nt, Homo sapiens
acugcacuccagccuuggccac

SEQ ID NO: 13746 - RNA, 22 nt, Homo sapiens
cuggugauugguuucauucagu

SEQ ID NO: 13747 - RNA, 22 nt, Homo sapiens
aagggaauguuguggcugguuu

SEQ ID NO: 13748 - RNA, 22 nt, Homo sapiens
uaugucuggaguuacugagcug

SEQ ID NO: 13749 - RNA, 22 nt, Homo sapiens
aacagucaauugcugaugaccu

SEQ ID NO: 13750 - RNA, 22 nt, Homo sapiens
uuggcuuggagaguugaaaugu

SEQ ID NO: 13751 - RNA, 20 nt, Homo sapiens
cauugcacuccagccugcug

SEQ ID NO: 13752 - RNA, 22 nt, Homo sapiens
ucuugcacaaauuauuuuaacu

SEQ ID NO: 13753 - RNA, 21 nt, Homo sapiens
ccauggcaaugguaaacugac

SEQ ID NO: 13754 - RNA, 22 nt, Homo sapiens
ucacugugguuuugaugugcau

SEQ ID NO: 13755 - RNA, 22 nt, Homo sapiens
ugaugucuugcaggcacgagau

SEQ ID NO: 13756 - RNA, 22 nt, Homo sapiens
acugcacuccagccuuggcggc

SEQ ID NO: 13757 - RNA, 20 nt, Homo sapiens
uaagugcuugagacuucuga

SEQ ID NO: 13758 - RNA, 22 nt, Homo sapiens
uuucauggaggauuugcuucuu

SEQ ID NO: 13759 - RNA, 22 nt, Homo sapiens
guaaucucaccuacuugggagg

SEQ ID NO: 13760 - RNA, 22 nt, Homo sapiens
aagagguagcagucacaaaaga

SEQ ID NO: 13761 - RNA, 22 nt, Homo sapiens
cauugcacuccagccuggccaa

SEQ ID NO: 13762 - RNA, 22 nt, Homo sapiens
ccuuggcaauggcuggggcuga

SEQ ID NO: 13763 - RNA, 22 nt, Homo sapiens
acugcacuccggccuggcaaca

SEQ ID NO: 13764 - RNA, 23 nt, Homo sapiens
augacacuccugugcgcacccug

SEQ ID NO: 13765 - RNA, 19 nt, Homo sapiens
auacacguguauacauaca

SEQ ID NO: 13766 - RNA, 22 nt, Homo sapiens
uucacuguuaagcaguuaaacu

SEQ ID NO: 13767 - RNA, 16 nt, Homo sapiens
cauugcacucuagccu

SEQ ID NO: 13768 - RNA, 22 nt, Homo sapiens
gagaacugagauaagugauauu

SEQ ID NO: 13769 - RNA, 22 nt, Homo sapiens
auacaguugccauuucuugugc

SEQ ID NO: 13770 - RNA, 22 nt, Homo sapiens
cucagcuacuugggaagcugag

SEQ ID NO: 13771 - RNA, 22 nt, Homo sapiens
cucauugcaaucuccaccuccc

SEQ ID NO: 13772 - RNA, 22 nt, Homo sapiens
uaugcuuauaaacauuugucag

SEQ ID NO: 13773 - RNA, 22 nt, Homo sapiens
cauugcacuuagacaacuuuug

SEQ ID NO: 13774 - RNA, 22 nt, Homo sapiens
gugcacauuguuuaugucuguu

SEQ ID NO: 13775 - RNA, 21 nt, Homo sapiens
guucaagugauccuccugucu

SEQ ID NO: 13776 - RNA, 22 nt, Homo sapiens
uuuccagguggccaacauuuua

SEQ ID NO: 13777 - RNA, 22 nt, Homo sapiens
gcagagaaacaggucuaaggag

SEQ ID NO: 13778 - RNA, 20 nt, Homo sapiens
cuggaugucgaggcagaggu

SEQ ID NO: 13779 - RNA, 22 nt, Homo sapiens
ugucacccuuuauccauuuccu

SEQ ID NO: 13780 - RNA, 21 nt, Homo sapiens
caauggcacaaucucugcuca

SEQ ID NO: 13781 - RNA, 22 nt, Homo sapiens
gugaaagacauauaugguuuga

SEQ ID NO: 13782 - RNA, 22 nt, Homo sapiens
agauggguuuucacauguuggc

SEQ ID NO: 13783 - RNA, 22 nt, Homo sapiens
aauggcaaauguuuucuguuga

SEQ ID NO: 13784 - RNA, 22 nt, Homo sapiens
cuucaaguguggccaccugacc

SEQ ID NO: 13785 - RNA, 22 nt, Homo sapiens
cccugagaaaacuuuguccuua

SEQ ID NO: 13786 - RNA, 22 nt, Homo sapiens
ugugccacugcacucuggccug

SEQ ID NO: 13787 - RNA, 22 nt, Homo sapiens
uaagucacuccagguuaaagug

SEQ ID NO: 13788 - RNA, 22 nt, Homo sapiens
uguguaauaccuuugacuauau

SEQ ID NO: 13789 - RNA, 22 nt, Homo sapiens
uugugaauggugccgcaauaaa

SEQ ID NO: 13790 - RNA, 23 nt, Homo sapiens
auaagccuuuucuuucugcccca

SEQ ID NO: 13791 - RNA, 22 nt, Homo sapiens
cagagaaugucuuuuuuaacca

SEQ ID NO: 13792 - RNA, 22 nt, Homo sapiens
gagaacauuaauaguuaauuuu

SEQ ID NO: 13793 - RNA, 22 nt, Homo sapiens
ucacaugggugcaauauaauca

SEQ ID NO: 13794 - RNA, 22 nt, Homo sapiens
uagucacacacucaacuuuuca

SEQ ID NO: 13795 - RNA, 22 nt, Homo sapiens
uuauuagguuaaccuauagcua

SEQ ID NO: 13796 - RNA, 22 nt, Homo sapiens
aucaaaguuucccagaaguugu

SEQ ID NO: 13797 - RNA, 22 nt, Homo sapiens
acugcacuccagccuuggcaac

SEQ ID NO: 13798 - RNA, 22 nt, Homo sapiens
ccaguguucuggaaggcugagu

SEQ ID NO: 13799 - RNA, 22 nt, Homo sapiens
augucuggcagaagacuucuca

SEQ ID NO: 13800 - RNA, 22 nt, Homo sapiens
uugcaaugugaugugauuugga

SEQ ID NO: 13801 - RNA, 22 nt, Homo sapiens
aaagugcuuccuuuuugagggu

SEQ ID NO: 13802 - RNA, 22 nt, Homo sapiens
ucacugugugucucuguaucug

SEQ ID NO: 13803 - RNA, 22 nt, Homo sapiens
guaaucucagcuacuugggagc

SEQ ID NO: 13804 - RNA, 22 nt, Homo sapiens
uucaaaguguugguuuugggcu

SEQ ID NO: 13805 - RNA, 22 nt, Homo sapiens
acuccauuucauuuuagcucuu

SEQ ID NO: 13806 - RNA, 16 nt, Homo sapiens
aucacuugcuucuuuu

SEQ ID NO: 13807 - RNA, 22 nt, Homo sapiens
ucuugggugaguuugugaauaa

SEQ ID NO: 13808 - RNA, 22 nt, Homo sapiens
caucacaugcuuauuuuccuca

SEQ ID NO: 13809 - RNA, 22 nt, Homo sapiens
guggaagaaaucagguuauuug

SEQ ID NO: 13810 - RNA, 22 nt, Homo sapiens
cugaaagagcauuugaaugggu

SEQ ID NO: 13811 - RNA, 21 nt, Homo sapiens
uaucagagacauugagaggca

SEQ ID NO: 13812 - RNA, 22 nt, Homo sapiens
aaagugcuuacuaaguugccaa

SEQ ID NO: 13813 - RNA, 22 nt, Homo sapiens
ugaaaguuauauugugaaauuc

SEQ ID NO: 13814 - RNA, 22 nt, Homo sapiens
uuggagugugcucauaacugcu

SEQ ID NO: 13815 - RNA, 22 nt, Homo sapiens
uuguaacaugcuuucacuucag

SEQ ID NO: 13816 - RNA, 22 nt, Homo sapiens
gagagguaguuuuuuggucguc

SEQ ID NO: 13817 - RNA, 22 nt, Homo sapiens
uguaauuuaaaugauccuugga

SEQ ID NO: 13818 - RNA, 22 nt, Homo sapiens
ucucaaccucccaaguagcugg

SEQ ID NO: 13819 - RNA, 22 nt, Homo sapiens
ugagaucacuaagagguaaugg

SEQ ID NO: 13820 - RNA, 22 nt, Homo sapiens
uuucaagugcugucuuagcugu

SEQ ID NO: 13821 - RNA, 22 nt, Homo sapiens
uauugcacuccucaugcauuug

SEQ ID NO: 13822 - RNA, 22 nt, Homo sapiens
uaucaacaggguggccagugua

SEQ ID NO: 13823 - RNA, 22 nt, Homo sapiens
augagacauuaaaguguguuug

SEQ ID NO: 13824 - RNA, 22 nt, Homo sapiens
auuccuuaggcccuuugguuag

SEQ ID NO: 13825 - RNA, 22 nt, Homo sapiens
cucaguuuugccuuguuuaagg

SEQ ID NO: 13826 - RNA, 22 nt, Homo sapiens
ugugaacaaaauuuguugcaua

SEQ ID NO: 13827 - RNA, 22 nt, Homo sapiens
uccugagacugaggagcuuugg

SEQ ID NO: 13828 - RNA, 22 nt, Homo sapiens
uaaguaaaugaaagguugauuu

SEQ ID NO: 13829 - RNA, 22 nt, Homo sapiens
uuaaguuaggcuucagcagucu

SEQ ID NO: 13830 - RNA, 18 nt, Homo sapiens
ucuggcuucuuuguucca

SEQ ID NO: 13831 - RNA, 22 nt, Homo sapiens
uggauaguaauaaacauauagg

SEQ ID NO: 13832 - RNA, 22 nt, Homo sapiens
uauuacauccauaggcucugcu

SEQ ID NO: 13833 - RNA, 22 nt, Homo sapiens
cucaaguacaugggauuacagg

SEQ ID NO: 13834 - RNA, 22 nt, Homo sapiens
uauacagcaaguuacugugcug

SEQ ID NO: 13835 - RNA, 22 nt, Homo sapiens
cauugcacuccagcuugggcga

SEQ ID NO: 13836 - RNA, 22 nt, Homo sapiens
uggaaguauagauaauugaaag

SEQ ID NO: 13837 - RNA, 22 nt, Homo sapiens
uauuccacaauaugauuuuuaa

SEQ ID NO: 13838 - RNA, 22 nt, Homo sapiens
ugagaucaugccacugcacuuc

SEQ ID NO: 13839 - RNA, 22 nt, Homo sapiens
gcagcacauggcagaacauauu

SEQ ID NO: 13840 - RNA, 22 nt, Homo sapiens
uuggccauaugacuugcuuugg

SEQ ID NO: 13841 - RNA, 22 nt, Homo sapiens
auauuggccuaaaauucucuuu

SEQ ID NO: 13842 - RNA, 21 nt, Homo sapiens
ucaguuacugagagagaagug

SEQ ID NO: 13843 - RNA, 22 nt, Homo sapiens
ggaucacuugagaccaggaguu

SEQ ID NO: 13844 - RNA, 22 nt, Homo sapiens
acugagaucuuuaaauaaauaa

SEQ ID NO: 13845 - RNA, 22 nt, Homo sapiens
acccagaguuccuugucuuuca

SEQ ID NO: 13846 - RNA, 22 nt, Homo sapiens
cuggccagagacauucauuaaa

SEQ ID NO: 13847 - RNA, 22 nt, Homo sapiens
uugaaagacaucaccuacugcu

SEQ ID NO: 13848 - RNA, 22 nt, Homo sapiens
augauagucuugagaagcauuu

SEQ ID NO: 13849 - RNA, 22 nt, Homo sapiens
uccugagagcagacccucuaua

SEQ ID NO: 13850 - RNA, 22 nt, Homo sapiens
ucacuagggagaaacugaggcu

SEQ ID NO: 13851 - RNA, 22 nt, Homo sapiens
uucacagagagaacucaaacca

SEQ ID NO: 13852 - RNA, 22 nt, Homo sapiens
aggcaugauuguauuuugcucu

SEQ ID NO: 13853 - RNA, 22 nt, Homo sapiens
gaaucacugugguaucccaugc

SEQ ID NO: 13854 - RNA, 22 nt, Homo sapiens
ccugagacuugagggggcuucu

SEQ ID NO: 13855 - RNA, 22 nt, Homo sapiens
caagugcuacagagaaaucuuu

SEQ ID NO: 13856 - RNA, 22 nt, Homo sapiens
agcuggucuacguguguaugag

SEQ ID NO: 13857 - RNA, 22 nt, Homo sapiens
ucagacacuguggccuuuggac

SEQ ID NO: 13858 - RNA, 22 nt, Homo sapiens
auucaaagugcauguucccacu

SEQ ID NO: 13859 - RNA, 23 nt, Homo sapiens
ucucauuccuugaaaauaaugac

SEQ ID NO: 13860 - RNA, 22 nt, Homo sapiens
auugcagcccacccugggugau

SEQ ID NO: 13861 - RNA, 22 nt, Homo sapiens
ugagaaugaugauuuccaguuu

SEQ ID NO: 13862 - RNA, 22 nt, Homo sapiens
ucauagucuaagguucuuuugc

SEQ ID NO: 13863 - RNA, 22 nt, Homo sapiens
aaagugcuaggauuaccugggg

SEQ ID NO: 13864 - RNA, 22 nt, Homo sapiens
auagcagaacagugucucacug

SEQ ID NO: 13865 - RNA, 22 nt, Homo sapiens
auguauacaugcaggucacagg

SEQ ID NO: 13866 - RNA, 22 nt, Homo sapiens
cuuuuggcuuaagauugucuug

SEQ ID NO: 13867 - RNA, 22 nt, Homo sapiens
uuguguacuacaguaugccaca

SEQ ID NO: 13868 - RNA, 22 nt, Homo sapiens
augacauugaugcucuggcugg

SEQ ID NO: 13869 - RNA, 22 nt, Homo sapiens
gugccacugcacuccggccugg

SEQ ID NO: 13870 - RNA, 22 nt, Homo sapiens
ugcgccauugcacuccagccug

SEQ ID NO: 13871 - RNA, 20 nt, Homo sapiens
ucacugugaacuucuugagg

SEQ ID NO: 13872 - RNA, 22 nt, Homo sapiens
uucucaauggcaacuuguugcu

SEQ ID NO: 13873 - RNA, 22 nt, Homo sapiens
uuaauuguccaaguucaucucu

SEQ ID NO: 13874 - RNA, 22 nt, Homo sapiens
uccaguuuggaggcuugaugug

SEQ ID NO: 13875 - RNA, 22 nt, Homo sapiens
ugucauucaggaaauucuaagu

SEQ ID NO: 13876 - RNA, 22 nt, Homo sapiens
uuuguccccgcccagaucucau

SEQ ID NO: 13877 - RNA, 22 nt, Homo sapiens
uugccuaggcuggaguucagug

SEQ ID NO: 13878 - RNA, 22 nt, Homo sapiens
aaagugcugggauuuuaggcau

SEQ ID NO: 13879 - RNA, 22 nt, Homo sapiens
gagauauucugguuuacuaaau

SEQ ID NO: 13880 - RNA, 22 nt, Homo sapiens
gagaacauuuaagccacucagg

SEQ ID NO: 13881 - RNA, 22 nt, Homo sapiens
cagccgggugagguggcuuguu

SEQ ID NO: 13882 - RNA, 22 nt, Homo sapiens
uuggcaaguccccaccucucuc

SEQ ID NO: 13883 - RNA, 22 nt, Homo sapiens
gugaaagacagcauuaauggcu

SEQ ID NO: 13884 - RNA, 22 nt, Homo sapiens
aguggcaaugugauguccugaa

SEQ ID NO: 13885 - RNA, 22 nt, Homo sapiens
aguacaauguugaguagaagug

SEQ ID NO: 13886 - RNA, 22 nt, Homo sapiens
agaucauaugcaguaaugaacu

SEQ ID NO: 13887 - RNA, 22 nt, Homo sapiens
ugaguuagguaauaauaaauau

SEQ ID NO: 13888 - RNA, 20 nt, Homo sapiens
guucauguaauuaguucagg

SEQ ID NO: 13889 - RNA, 22 nt, Homo sapiens
gugucucagcccagaccuauuu

SEQ ID NO: 13890 - RNA, 22 nt, Homo sapiens
ucaggcaccuuccucuuaucug

SEQ ID NO: 13891 - RNA, 22 nt, Homo sapiens
cauugcacucuagccucggcaa

SEQ ID NO: 13892 - RNA, 22 nt, Homo sapiens
cacagaauucauuggauuaccu

SEQ ID NO: 13893 - RNA, 22 nt, Homo sapiens
gagcacugauuuauuuuugucu

SEQ ID NO: 13894 - RNA, 22 nt, Homo sapiens
uauaagacgagcaaaaagcuug

SEQ ID NO: 13895 - RNA, 22 nt, Homo sapiens
cacugcgacguccgccucccgg

SEQ ID NO: 13896 - RNA, 22 nt, Homo sapiens
guggaaugauaucucauugugg

SEQ ID NO: 13897 - RNA, 17 nt, Homo sapiens
auaugucugcuggggga

SEQ ID NO: 13898 - RNA, 22 nt, Homo sapiens
augaaauugcuaucgcaguacu

SEQ ID NO: 13899 - RNA, 20 nt, Homo sapiens
auaugcagacacauacauac

SEQ ID NO: 13900 - RNA, 22 nt, Homo sapiens
ggccggguggccauggcugccc

SEQ ID NO: 13901 - RNA, 22 nt, Homo sapiens
aagacuguaauccaucuugagu

SEQ ID NO: 13902 - RNA, 22 nt, Homo sapiens
gggaucaacuuauacuaaaauu

SEQ ID NO: 13903 - RNA, 22 nt, Homo sapiens
uucacaguacucccuggaauua

SEQ ID NO: 13904 - RNA, 22 nt, Homo sapiens
agcgccacugcacuccagccug

SEQ ID NO: 13905 - RNA, 22 nt, Homo sapiens
ugagaugugaagaucacaugaa

SEQ ID NO: 13906 - RNA, 22 nt, Homo sapiens
acugcacucuagccuuggcaac

SEQ ID NO: 13907 - RNA, 22 nt, Homo sapiens
acaagacuucuuguauucuagu

SEQ ID NO: 13908 - RNA, 22 nt, Homo sapiens
auggaagaaacgauuuucugga

SEQ ID NO: 13909 - RNA, 22 nt, Homo sapiens
accaugcaguccaauaugcaca

SEQ ID NO: 13910 - RNA, 22 nt, Homo sapiens
agacacuguugaaaaggcccca

SEQ ID NO: 13911 - RNA, 22 nt, Homo sapiens
aaagugaauguaucccguaagu

SEQ ID NO: 13912 - RNA, 19 nt, Homo sapiens
acugcacuccuccuugggu

SEQ ID NO: 13913 - RNA, 22 nt, Homo sapiens
ucaagcaauucuccugccucag

SEQ ID NO: 13914 - RNA, 22 nt, Homo sapiens
uucaagcuauggugaucuuuuc

SEQ ID NO: 13915 - RNA, 22 nt, Homo sapiens
cagagguauugcaaaagccuag

SEQ ID NO: 13916 - RNA, 22 nt, Homo sapiens
ugcaaaugcugcuauuucucuu

SEQ ID NO: 13917 - RNA, 22 nt, Homo sapiens
guugcucaggcuggagugcagu

SEQ ID NO: 13918 - RNA, 22 nt, Homo sapiens
uuauucauuaacagggaccaaa

SEQ ID NO: 13919 - RNA, 22 nt, Homo sapiens
cauugcacuccagccugaggga

SEQ ID NO: 13920 - RNA, 22 nt, Homo sapiens
uuguaaaguucucucccgaaaa

SEQ ID NO: 13921 - RNA, 22 nt, Homo sapiens
uuugucccucucaccaacgggg

SEQ ID NO: 13922 - RNA, 21 nt, Homo sapiens
agcuaaauuggaaauuucugu

SEQ ID NO: 13923 - RNA, 22 nt, Homo sapiens
ucauucauuugcucacuccaca

SEQ ID NO: 13924 - RNA, 22 nt, Homo sapiens
aaaugccucccauucuacugac

SEQ ID NO: 13925 - RNA, 22 nt, Homo sapiens
auccacaugcaguuggaaacag

SEQ ID NO: 13926 - RNA, 22 nt, Homo sapiens
uugugaaugaugucgcaguaaa

SEQ ID NO: 13927 - RNA, 22 nt, Homo sapiens
auugucacccgggcaguaagca

SEQ ID NO: 13928 - RNA, 22 nt, Homo sapiens
ucugucuugugguuugagugcc

SEQ ID NO: 13929 - RNA, 22 nt, Homo sapiens
gugucuccugccuucaugcagc

SEQ ID NO: 13930 - RNA, 17 nt, Homo sapiens
ugcaauuuaagcuagau

SEQ ID NO: 13931 - RNA, 22 nt, Homo sapiens
ucucuguuugucuguuacuggu

SEQ ID NO: 13932 - RNA, 19 nt, Homo sapiens
uggaaugaaauguuagggg

SEQ ID NO: 13933 - RNA, 22 nt, Homo sapiens
uacgccuguaauaucagcauuu

SEQ ID NO: 13934 - RNA, 22 nt, Homo sapiens
ucagugucugugauggagaggu

SEQ ID NO: 13935 - RNA, 22 nt, Homo sapiens
uacagucacauuccugaccaua

SEQ ID NO: 13936 - RNA, 22 nt, Homo sapiens
ggcacuguggcucaagccugua

SEQ ID NO: 13937 - RNA, 22 nt, Homo sapiens
ucacugaaaccacugccuccug

SEQ ID NO: 13938 - RNA, 22 nt, Homo sapiens
uaagcagugcaagaauggaaua

SEQ ID NO: 13939 - RNA, 22 nt, Homo sapiens
gugcaaaucucugaguaucuuu

SEQ ID NO: 13940 - RNA, 22 nt, Homo sapiens
aaucacuuugcuacaaggcagu

SEQ ID NO: 13941 - RNA, 20 nt, Homo sapiens
uggucaccuucaggagguuc

SEQ ID NO: 13942 - RNA, 22 nt, Homo sapiens
uagcaguauugaaagaugaggg

SEQ ID NO: 13943 - RNA, 22 nt, Homo sapiens
auugcacacagaaucaggguaa

SEQ ID NO: 13944 - RNA, 21 nt, Homo sapiens
ucaucagucaaagacaauggu

SEQ ID NO: 13945 - RNA, 22 nt, Homo sapiens
cccugagaugugaauuucagag

SEQ ID NO: 13946 - RNA, 22 nt, Homo sapiens
gagauauuauuucccuuucaca

SEQ ID NO: 13947 - RNA, 22 nt, Homo sapiens
uugaagugaagaacaauaucac

SEQ ID NO: 13948 - RNA, 22 nt, Homo sapiens
ucaagcaauucuccucucagcc

SEQ ID NO: 13949 - RNA, 22 nt, Homo sapiens
uugugaauggugccucaguaaa

SEQ ID NO: 13950 - RNA, 22 nt, Homo sapiens
acuggcuuauuucacuuagcau

SEQ ID NO: 13951 - RNA, 22 nt, Homo sapiens
uuaugucuuuuguguucagcua

SEQ ID NO: 13952 - RNA, 22 nt, Homo sapiens
uugucaacaugaaacuguguuu

SEQ ID NO: 13953 - RNA, 22 nt, Homo sapiens
caaagucuucucauuaugucuu

SEQ ID NO: 13954 - RNA, 22 nt, Homo sapiens
aagggaauguuguagcugguuu

SEQ ID NO: 13955 - RNA, 22 nt, Homo sapiens
uuggaagauuacuuaguuuucu

SEQ ID NO: 13956 - RNA, 22 nt, Homo sapiens
guguaaaacaauuagaggauuu

SEQ ID NO: 13957 - RNA, 22 nt, Homo sapiens
uauacugucuuuguaugccuag

SEQ ID NO: 13958 - RNA, 22 nt, Homo sapiens
uggaauuaauuaaaauauacug

SEQ ID NO: 13959 - RNA, 22 nt, Homo sapiens
uucauggaauauugaccauuuu

SEQ ID NO: 13960 - RNA, 22 nt, Homo sapiens
gugccuuuucugagcaaugagc

SEQ ID NO: 13961 - RNA, 22 nt, Homo sapiens
uagcaguaccccaguauccugg

SEQ ID NO: 13962 - RNA, 22 nt, Homo sapiens
uuggccagugucuuuuuuuccu

SEQ ID NO: 13963 - RNA, 22 nt, Homo sapiens
uugucauuuucagaguguuacg

SEQ ID NO: 13964 - RNA, 20 nt, Homo sapiens
cauugcacuccagcuugggc

SEQ ID NO: 13965 - RNA, 22 nt, Homo sapiens
uugccuaggcuggauugcagug

SEQ ID NO: 13966 - RNA, 19 nt, Homo sapiens
auaaaugccuacaagggug

SEQ ID NO: 13967 - RNA, 22 nt, Homo sapiens
uuuuaguggaauauuuacaguu

SEQ ID NO: 13968 - RNA, 22 nt, Homo sapiens
guaugucuuuauagcagugugg

SEQ ID NO: 13969 - RNA, 22 nt, Homo sapiens
ucucagugaauguggaaaaagc

SEQ ID NO: 13970 - RNA, 22 nt, Homo sapiens
ucaucaggcucauucaagcuga

SEQ ID NO: 13971 - RNA, 22 nt, Homo sapiens
uuggucucaucaagagcagcuu

SEQ ID NO: 13972 - RNA, 22 nt, Homo sapiens
aagugacauugugcccauuuga

SEQ ID NO: 13973 - RNA, 20 nt, Homo sapiens
ucucauggagggaaagagca

SEQ ID NO: 13974 - RNA, 22 nt, Homo sapiens
caagugcuugaugaaugaucaa

SEQ ID NO: 13975 - RNA, 22 nt, Homo sapiens
cccagaguucuuaaauacugag

SEQ ID NO: 13976 - RNA, 22 nt, Homo sapiens
ugagaaugacugggcaugcugc

SEQ ID NO: 13977 - RNA, 22 nt, Homo sapiens
uugaggaaugucauuuguguuu

SEQ ID NO: 13978 - RNA, 22 nt, Homo sapiens
agucacagugaccuugucugac

SEQ ID NO: 13979 - RNA, 22 nt, Homo sapiens
ugugaagauggacuaauauagu

SEQ ID NO: 13980 - RNA, 22 nt, Homo sapiens
aauaauggcaccaaagcacaag

SEQ ID NO: 13981 - RNA, 22 nt, Homo sapiens
uucuauguuugaaaaugccaaa

SEQ ID NO: 13982 - RNA, 22 nt, Homo sapiens
uuggcagcacgcaguccagagg

SEQ ID NO: 13983 - RNA, 20 nt, Mycobacterium tuberculosis CDC1551
uuucugagcggcucaugacg

SEQ ID NO: 13984 - RNA, 22 nt, Mycobacterium tuberculosis CDC1551
uuuggccaugccgcgggcgacc

SEQ ID NO: 13985 - RNA, 22 nt, Mycobacterium tuberculosis CDC1551
uuugggugugagaacgguuggu

SEQ ID NO: 13986 - RNA, 22 nt, Mycobacterium tuberculosis CDC1551
uugagggugugggccacgucgg

SEQ ID NO: 13987 - RNA, 22 nt, Mycobacterium tuberculosis CDC1551
uugcgcaggggcaugucagcgu

SEQ ID NO: 13988 - RNA, 22 nt, Mycobacterium tuberculosis CDC1551
uugauauuaccgauggaauguc

SEQ ID NO: 13989 - RNA, 22 nt, Mycobacterium tuberculosis CDC1551
uugaugaugcggauccggauuc

SEQ ID NO: 13990 - RNA, 22 nt, Mycobacterium tuberculosis CDC1551
uugggccaccucggcggccagc

SEQ ID NO: 13991 - RNA, 22 nt, Mycobacterium tuberculosis CDC1551
uuggcaggcggucaagccacaa

SEQ ID NO: 13992 - RNA, 22 nt, Mycobacterium tuberculosis CDC1551
uucaggcuacgguagcggugcg

SEQ ID NO: 13993 - RNA, 22 nt, Mycobacterium tuberculosis CDC1551
uucaucaaggacgcgugcaccc

SEQ ID NO: 13994 - RNA, 21 nt, Mycobacterium tuberculosis CDC1551
uuccggcccggguccagcgac

SEQ ID NO: 13995 - RNA, 22 nt, Mycobacterium tuberculosis CDC1551
uucuucagcauggcgaugacgg

SEQ ID NO: 13996 - RNA, 22 nt, Mycobacterium tuberculosis CDC1551
ugguggccggugccgacaccuc

SEQ ID NO: 13997 - RNA, 20 nt, Mycobacterium tuberculosis CDC1551
ugggcuaauggcaaccacgg

SEQ ID NO: 13998 - RNA, 22 nt, Mycobacterium tuberculosis CDC1551
uggucggcgaguucgccgugca

SEQ ID NO: 13999 - RNA, 20 nt, Mycobacterium tuberculosis CDC1551
uggucaccggguucgacacc

SEQ ID NO: 14000 - RNA, 22 nt, Mycobacterium tuberculosis CDC1551
uggggcaugagcguguccaggc

SEQ ID NO: 14001 - RNA, 22 nt, Mycobacterium tuberculosis CDC1551
ugucgcgcaagcucuccggcac

SEQ ID NO: 14002 - RNA, 22 nt, Mycobacterium tuberculosis CDC1551
ugucauucgggucgguuacguc

SEQ ID NO: 14003 - RNA, 18 nt, Mycobacterium tuberculosis CDC1551
ugugaccacagggcuggc

SEQ ID NO: 14004 - RNA, 22 nt, Mycobacterium tuberculosis CDC1551
ugugauggagugaucggcagcc

SEQ ID NO: 14005 - RNA, 22 nt, Mycobacterium tuberculosis CDC1551
uggcgcugucgaucaccgacuu

SEQ ID NO: 14006 - RNA, 22 nt, Mycobacterium tuberculosis CDC1551
uggcucagauugccggugccgc

SEQ ID NO: 14007 - RNA, 22 nt, Mycobacterium tuberculosis CDC1551
uggcucagcgggucaacgaggc

SEQ ID NO: 14008 - RNA, 22 nt, Mycobacterium tuberculosis CDC1551
ugggcugcugcgccgcaucggc

SEQ ID NO: 14009 - RNA, 22 nt, Mycobacterium tuberculosis CDC1551
uggccagcacgguguucaaguu

SEQ ID NO: 14010 - RNA, 22 nt, Mycobacterium tuberculosis CDC1551
uggcgcgcggaucgacgacagg

SEQ ID NO: 14011 - RNA, 18 nt, Mycobacterium tuberculosis CDC1551
ugcgccacaacggcggga

SEQ ID NO: 14012 - RNA, 22 nt, Mycobacterium tuberculosis CDC1551
ugcgccagcgccucccgcagga

SEQ ID NO: 14013 - RNA, 22 nt, Mycobacterium tuberculosis CDC1551
ugcugcgccuccugcggaccgu

SEQ ID NO: 14014 - RNA, 23 nt, Mycobacterium tuberculosis CDC1551
uggaauggaucucggcgauaaug

SEQ ID NO: 14015 - RNA, 22 nt, Mycobacterium tuberculosis CDC1551
uggacaccauuccguugggaug

SEQ ID NO: 14016 - RNA, 22 nt, Mycobacterium tuberculosis CDC1551
ugcacuccgacccgccgacguu

SEQ ID NO: 14017 - RNA, 18 nt, Mycobacterium tuberculosis CDC1551
ucgugggcgcgccgccaa

SEQ ID NO: 14018 - RNA, 21 nt, Mycobacterium tuberculosis CDC1551
ugacccacugggccgagucgg

SEQ ID NO: 14019 - RNA, 22 nt, Mycobacterium tuberculosis CDC1551
cgccaaaccgaacggcgagcug

SEQ ID NO: 14020 - RNA, 18 nt, Mycobacterium tuberculosis CDC1551
cgccacucgcagugggac

SEQ ID NO: 14021 - RNA, 22 nt, Mycobacterium tuberculosis CDC1551
cgcugcaccgcggccuggcccu

SEQ ID NO: 14022 - RNA, 22 nt, Mycobacterium tuberculosis CDC1551
ccgcccggcugcgcgagcuggg

SEQ ID NO: 14023 - RNA, 22 nt, Mycobacterium tuberculosis CDC1551
cgaccugcgacagccguuaacg

SEQ ID NO: 14024 - RNA, 22 nt, Mycobacterium tuberculosis CDC1551
ccuggcgcgcagcacggccugc

SEQ ID NO: 14025 - RNA, 22 nt, Mycobacterium tuberculosis CDC1551
ccugugccaagcgcugaccgcu

SEQ ID NO: 14026 - RNA, 22 nt, Mycobacterium tuberculosis CDC1551
cgaaacugcggaccgcgcaacc

SEQ ID NO: 14027 - RNA, 22 nt, Mycobacterium tuberculosis CDC1551
ccguugacccagaccggcucgu

SEQ ID NO: 14028 - RNA, 21 nt, Mycobacterium tuberculosis CDC1551
cugcugauggcggcgauaucg

SEQ ID NO: 14029 - RNA, 22 nt, Mycobacterium tuberculosis CDC1551
cucuugggucaaccaggugacu

SEQ ID NO: 14030 - RNA, 22 nt, Mycobacterium tuberculosis CDC1551
cucccgccgugugucgcgggcu

SEQ ID NO: 14031 - RNA, 18 nt, Mycobacterium tuberculosis CDC1551
cuccuuggacuacggcug

SEQ ID NO: 14032 - RNA, 22 nt, Mycobacterium tuberculosis CDC1551
cggccaagggugcggacgccga

SEQ ID NO: 14033 - RNA, 22 nt, Mycobacterium tuberculosis CDC1551
cgguggugaccgccgcgacguc

SEQ ID NO: 14034 - RNA, 22 nt, Mycobacterium tuberculosis CDC1551
cguggaauuucuucgccauggg

SEQ ID NO: 14035 - RNA, 22 nt, Mycobacterium tuberculosis CDC1551
cguggcaaaugugaucccgugc

SEQ ID NO: 14036 - RNA, 22 nt, Mycobacterium tuberculosis CDC1551
cguaagccucgucagcuauccg

SEQ ID NO: 14037 - RNA, 22 nt, Mycobacterium tuberculosis CDC1551
cgucaccugcacggugguugcc

SEQ ID NO: 14038 - RNA, 22 nt, Mycobacterium tuberculosis CDC1551
cagcgccaauacaucacggcag

SEQ ID NO: 14039 - RNA, 22 nt, Mycobacterium tuberculosis CDC1551
cagccgccaaaccgcugaggaa

SEQ ID NO: 14040 - RNA, 22 nt, Mycobacterium tuberculosis CDC1551
cauggucacuggcugugacuga

SEQ ID NO: 14041 - RNA, 23 nt, Mycobacterium tuberculosis CDC1551
cauguugaccgcgcccaggaugg

SEQ ID NO: 14042 - RNA, 22 nt, Mycobacterium tuberculosis CDC1551
cauuggcaccggaaaucgccgg

SEQ ID NO: 14043 - RNA, 22 nt, Mycobacterium tuberculosis CDC1551
caugacgguacguuugccucgu

SEQ ID NO: 14044 - RNA, 22 nt, Mycobacterium tuberculosis CDC1551
caugagcgccgaacagcgcuga

SEQ ID NO: 14045 - RNA, 22 nt, Mycobacterium tuberculosis CDC1551
ccgcccggggcauggccaagcu

SEQ ID NO: 14046 - RNA, 22 nt, Mycobacterium tuberculosis CDC1551
ccaaugggauguugccgagcau

SEQ ID NO: 14047 - RNA, 22 nt, Mycobacterium tuberculosis CDC1551
ccaugccgaugacgcuguuggc

SEQ ID NO: 14048 - RNA, 22 nt, Mycobacterium tuberculosis CDC1551
ccaugggccggguucuugacca

SEQ ID NO: 14049 - RNA, 22 nt, Mycobacterium tuberculosis CDC1551
augguguacgccgcagcgcggg

SEQ ID NO: 14050 - RNA, 23 nt, Mycobacterium tuberculosis CDC1551
augacgggauucugcuucgcaaa

SEQ ID NO: 14051 - RNA, 22 nt, Mycobacterium tuberculosis CDC1551
aucuggccguccggcgucccga

SEQ ID NO: 14052 - RNA, 22 nt, Mycobacterium tuberculosis CDC1551
aucacgccucucgguggugggg

SEQ ID NO: 14053 - RNA, 22 nt, Mycobacterium tuberculosis CDC1551
aguggucaugaauggcgaaugg

SEQ ID NO: 14054 - RNA, 22 nt, Mycobacterium tuberculosis CDC1551
agagauaucguagugaucgggc

SEQ ID NO: 14055 - RNA, 22 nt, Mycobacterium tuberculosis CDC1551
agcacugcuuucugagcucgag

SEQ ID NO: 14056 - RNA, 22 nt, Mycobacterium tuberculosis CDC1551
agcaagagcagcggccccuggg

SEQ ID NO: 14057 - RNA, 22 nt, Mycobacterium tuberculosis CDC1551
accaauucaccaaggacgaggu

SEQ ID NO: 14058 - RNA, 22 nt, Mycobacterium tuberculosis CDC1551
acugucccgagcgcaccaggaa

SEQ ID NO: 14059 - RNA, 22 nt, Mycobacterium tuberculosis CDC1551
acuggccagcgcgcgccacaug

SEQ ID NO: 14060 - RNA, 22 nt, Mycobacterium tuberculosis CDC1551
acugagcagcggcguuuucagg

SEQ ID NO: 14061 - RNA, 22 nt, Mycobacterium tuberculosis CDC1551
acgagcguaacggcacugcgaa

SEQ ID NO: 14062 - RNA, 22 nt, Mycobacterium tuberculosis CDC1551
acgaggucgcgaugaugacggu

SEQ ID NO: 14063 - RNA, 22 nt, Mycobacterium tuberculosis CDC1551
accucgcugaugauccaugaca

SEQ ID NO: 14064 - RNA, 22 nt, Mycobacterium tuberculosis CDC1551
accucgcugcgggaugggucgc

SEQ ID NO: 14065 - RNA, 22 nt, Mycobacterium tuberculosis CDC1551
accggccuggugcucaauagcc

SEQ ID NO: 14066 - RNA, 22 nt, Mycobacterium tuberculosis CDC1551
agaucucuggugcgcagauccc

SEQ ID NO: 14067 - RNA, 22 nt, Mycobacterium tuberculosis CDC1551
agccagcccgaugcugagcaau

SEQ ID NO: 14068 - RNA, 22 nt, Mycobacterium tuberculosis CDC1551
agccaggccgucgcgaccaugc

SEQ ID NO: 14069 - RNA, 22 nt, Mycobacterium tuberculosis CDC1551
agcuggucgacacuggccgaaa

SEQ ID NO: 14070 - RNA, 22 nt, Mycobacterium tuberculosis CDC1551
agcuguccgacaaaguauccga

SEQ ID NO: 14071 - RNA, 22 nt, Mycobacterium tuberculosis CDC1551
aggaaucaccgugagcagccca

SEQ ID NO: 14072 - RNA, 22 nt, Mycobacterium tuberculosis CDC1551
aggaucacacuggccugcucaa

SEQ ID NO: 14073 - RNA, 22 nt, Mycobacterium tuberculosis CDC1551
agcugggcgccgacgcuuugca

SEQ ID NO: 14074 - RNA, 22 nt, Mycobacterium tuberculosis CDC1551
agcccaccggugcuguaggcga

SEQ ID NO: 14075 - RNA, 22 nt, Mycobacterium tuberculosis CDC1551
aacugcaucgccaccacuuccu

SEQ ID NO: 14076 - RNA, 22 nt, Mycobacterium tuberculosis CDC1551
aaguaguaaugugcgagcugag

SEQ ID NO: 14077 - RNA, 22 nt, Mycobacterium tuberculosis CDC1551
aacacuaugcagcauuugggau

SEQ ID NO: 14078 - RNA, 22 nt, Mycobacterium tuberculosis CDC1551
acagcaugucgucggcagguuc

SEQ ID NO: 14079 - RNA, 22 nt, Mycobacterium tuberculosis CDC1551
accgcgccgccaaugcagcguc

SEQ ID NO: 14080 - RNA, 22 nt, Mycobacterium tuberculosis CDC1551
acccagcaggcugguggugccg

SEQ ID NO: 14081 - RNA, 22 nt, Mycobacterium tuberculosis CDC1551
aacagguggcggccggaccgcu

SEQ ID NO: 14082 - RNA, 22 nt, Mycobacterium tuberculosis CDC1551
ggccaugucgguccuuccagca

SEQ ID NO: 14083 - RNA, 22 nt, Mycobacterium tuberculosis CDC1551
ggcccggcaccggucaucguca

SEQ ID NO: 14084 - RNA, 22 nt, Mycobacterium tuberculosis CDC1551
ggccgcgcucgacuagccgggu

SEQ ID NO: 14085 - RNA, 22 nt, Mycobacterium tuberculosis CDC1551
ggcgagcuugcggugcaguaug

SEQ ID NO: 14086 - RNA, 22 nt, Mycobacterium tuberculosis CDC1551
ggcucaggucgauacccgaggg

SEQ ID NO: 14087 - RNA, 20 nt, Mycobacterium tuberculosis CDC1551
ggcucgagggcuggccggug

SEQ ID NO: 14088 - RNA, 22 nt, Mycobacterium tuberculosis CDC1551
ggcaccaagucaccggcaucca

SEQ ID NO: 14089 - RNA, 22 nt, Mycobacterium tuberculosis CDC1551
ggcagagcgcggccucggcguc

SEQ ID NO: 14090 - RNA, 22 nt, Mycobacterium tuberculosis CDC1551
gcuggcuuucgcgcugggccuu

SEQ ID NO: 14091 - RNA, 22 nt, Mycobacterium tuberculosis CDC1551
gcuggguuaccugguggcggcc

SEQ ID NO: 14092 - RNA, 22 nt, Mycobacterium tuberculosis CDC1551
gcggccaaccggcccgccuacu

SEQ ID NO: 14093 - RNA, 21 nt, Mycobacterium tuberculosis CDC1551
gcgagcucgucauggucuuuc

SEQ ID NO: 14094 - RNA, 22 nt, Mycobacterium tuberculosis CDC1551
gcucgcgcagguccacccgagc

SEQ ID NO: 14095 - RNA, 22 nt, Mycobacterium tuberculosis CDC1551
gccgccaccgcuaccacccgug

SEQ ID NO: 14096 - RNA, 22 nt, Mycobacterium tuberculosis CDC1551
gccguugaucgucucggcuagu

SEQ ID NO: 14097 - RNA, 22 nt, Mycobacterium tuberculosis CDC1551
gccuugucgagaucgucgccgu

SEQ ID NO: 14098 - RNA, 19 nt, Mycobacterium tuberculosis CDC1551
ucauggccgaugcggucgc

SEQ ID NO: 14099 - RNA, 22 nt, Mycobacterium tuberculosis CDC1551
uccugcaggcgaucgcccuggc

SEQ ID NO: 14100 - RNA, 18 nt, Mycobacterium tuberculosis CDC1551
uccugggccauggcccgg

SEQ ID NO: 14101 - RNA, 22 nt, Mycobacterium tuberculosis CDC1551
uccugggcgaccgcgacgaagu

SEQ ID NO: 14102 - RNA, 22 nt, Mycobacterium tuberculosis CDC1551
uccgggccggcuuugccgccgu

SEQ ID NO: 14103 - RNA, 23 nt, Mycobacterium tuberculosis CDC1551
ucgcugucccgaggucacgcuuu

SEQ ID NO: 14104 - RNA, 22 nt, Mycobacterium tuberculosis CDC1551
ucgaggccgggguugcgcugca

SEQ ID NO: 14105 - RNA, 22 nt, Mycobacterium tuberculosis CDC1551
ucggugacggacugcacagcga

SEQ ID NO: 14106 - RNA, 18 nt, Mycobacterium tuberculosis CDC1551
ucaggugaucccgccgac

SEQ ID NO: 14107 - RNA, 22 nt, Mycobacterium tuberculosis CDC1551
ucagcuguguccgcacaaccgg

SEQ ID NO: 14108 - RNA, 22 nt, Mycobacterium tuberculosis CDC1551
ucaccgccgcgguuggugcgca

SEQ ID NO: 14109 - RNA, 22 nt, Mycobacterium tuberculosis CDC1551
ucaccgccacggucaccggacu

SEQ ID NO: 14110 - RNA, 19 nt, Mycobacterium tuberculosis CDC1551
ucaccgccgaugccaccgc

SEQ ID NO: 14111 - RNA, 22 nt, Mycobacterium tuberculosis CDC1551
ucagccgccgggcuugccugcg

SEQ ID NO: 14112 - RNA, 22 nt, Mycobacterium tuberculosis CDC1551
ucagccucaacucggcgugccg

SEQ ID NO: 14113 - RNA, 22 nt, Mycobacterium tuberculosis CDC1551
uaagugaaugccgugccguccg

SEQ ID NO: 14114 - RNA, 22 nt, Mycobacterium tuberculosis CDC1551
uaaccgcuacaaaugaaguugg

SEQ ID NO: 14115 - RNA, 22 nt, Mycobacterium tuberculosis CDC1551
guggcagccagcgccuccggga

SEQ ID NO: 14116 - RNA, 22 nt, Mycobacterium tuberculosis CDC1551
gucgaggugaccagcggugagg

SEQ ID NO: 14117 - RNA, 22 nt, Mycobacterium tuberculosis CDC1551
guuacaggucaccacguagcgg

SEQ ID NO: 14118 - RNA, 19 nt, Mycobacterium tuberculosis CDC1551
guuggcagcggucgcggag

SEQ ID NO: 14119 - RNA, 22 nt, Mycobacterium tuberculosis CDC1551
guggugggaaccgcuccagggc

SEQ ID NO: 14120 - RNA, 22 nt, Mycobacterium tuberculosis CDC1551
gugguggugaguuugagaucgg

SEQ ID NO: 14121 - RNA, 22 nt, Mycobacterium tuberculosis CDC1551
guagugcacaccgacaacagcg

SEQ ID NO: 14122 - RNA, 22 nt, Mycobacterium tuberculosis CDC1551
gggaguacgcgggccaggugcg

SEQ ID NO: 14123 - RNA, 22 nt, Mycobacterium tuberculosis CDC1551
gggcugcccaaucagcgcugcg

SEQ ID NO: 14124 - RNA, 22 nt, Mycobacterium tuberculosis CDC1551
ggcuggcucggcgacuggacua

SEQ ID NO: 14125 - RNA, 22 nt, Mycobacterium tuberculosis CDC1551
ggucagcaugaauaccgggucg

SEQ ID NO: 14126 - RNA, 22 nt, Mycobacterium tuberculosis CDC1551
ggucuccuugccuauccagcug

SEQ ID NO: 14127 - RNA, 22 nt, Mycobacterium tuberculosis CDC1551
cgcucgagauugcagcgggccc

SEQ ID NO: 14128 - RNA, 22 nt, Mycobacterium tuberculosis CDC1551
cgcugggcgaugaagcgcuggg

SEQ ID NO: 14129 - RNA, 22 nt, Mycobacterium tuberculosis CDC1551
cgccugggccagugccgacuuc

SEQ ID NO: 14130 - RNA, 22 nt, Mycobacterium tuberculosis CDC1551
cgcagagcuuuucacgacgcug

SEQ ID NO: 14131 - RNA, 23 nt, Mycobacterium tuberculosis CDC1551
ccuugggcagaugccagcugaag

SEQ ID NO: 14132 - RNA, 22 nt, Mycobacterium tuberculosis CDC1551
caugcaucggaagaaccggcau

SEQ ID NO: 14133 - RNA, 22 nt, Mycobacterium tuberculosis CDC1551
ccagcacucggucgaugaucuu

SEQ ID NO: 14134 - RNA, 22 nt, Mycobacterium tuberculosis CDC1551
ccaccgccacggccagcaccgc

SEQ ID NO: 14135 - RNA, 22 nt, Mycobacterium tuberculosis CDC1551
cagggcgccaagcucaccugau

SEQ ID NO: 14136 - RNA, 22 nt, Mycobacterium tuberculosis CDC1551
caucacaucgaggucaccacgc

SEQ ID NO: 14137 - RNA, 22 nt, Mycobacterium tuberculosis CDC1551
caucuguuggcgcucucggccu

SEQ ID NO: 14138 - RNA, 22 nt, Mycobacterium tuberculosis CDC1551
ccaggcguagaagguucuccgg

SEQ ID NO: 14139 - RNA, 22 nt, Mycobacterium tuberculosis CDC1551
ccaugagggcgauaugcacgau

SEQ ID NO: 14140 - RNA, 22 nt, Mycobacterium tuberculosis CDC1551
cccacugccgccgguuggccac

SEQ ID NO: 14141 - RNA, 22 nt, Mycobacterium tuberculosis CDC1551
cccagcaccgaccagugccggc

SEQ ID NO: 14142 - RNA, 22 nt, Mycobacterium tuberculosis CDC1551
ccagcggguuugucacguagcc

SEQ ID NO: 14143 - RNA, 22 nt, Mycobacterium tuberculosis CDC1551
ccagcucaucgccguagcugag

SEQ ID NO: 14144 - RNA, 22 nt, Mycobacterium tuberculosis CDC1551
gaggccagcucggccagcugga

SEQ ID NO: 14145 - RNA, 22 nt, Mycobacterium tuberculosis CDC1551
gagguuuggcggggcgugaccu

SEQ ID NO: 14146 - RNA, 22 nt, Mycobacterium tuberculosis CDC1551
gaguaccugcaggugccgucgc

SEQ ID NO: 14147 - RNA, 20 nt, Mycobacterium tuberculosis CDC1551
gaugaugaucguguaugcga

SEQ ID NO: 14148 - RNA, 20 nt, Mycobacterium tuberculosis CDC1551
gcaaacucguucuggguuag

SEQ ID NO: 14149 - RNA, 22 nt, Mycobacterium tuberculosis CDC1551
gacuccagccguucacguucga

SEQ ID NO: 14150 - RNA, 22 nt, Mycobacterium tuberculosis CDC1551
gagaacugaccgugguuacgca

SEQ ID NO: 14151 - RNA, 22 nt, Mycobacterium tuberculosis CDC1551
gacgaggucuggggucagcuga

SEQ ID NO: 14152 - RNA, 22 nt, Mycobacterium tuberculosis CDC1551
gccagcagcucggcgauaucgg

SEQ ID NO: 14153 - RNA, 21 nt, Mycobacterium tuberculosis CDC1551
gccagcagcgucuuggcauuc

SEQ ID NO: 14154 - RNA, 22 nt, Mycobacterium tuberculosis CDC1551
gcccgcacguggccgccgguga

SEQ ID NO: 14155 - RNA, 23 nt, Mycobacterium tuberculosis CDC1551
gccagcucggcagcggcggcucc

SEQ ID NO: 14156 - RNA, 19 nt, Mycobacterium tuberculosis CDC1551
gccauagcggagugccggg

SEQ ID NO: 14157 - RNA, 21 nt, Mycobacterium tuberculosis CDC1551
gccauauaccagaucgcuggg

SEQ ID NO: 14158 - RNA, 22 nt, Mycobacterium tuberculosis CDC1551
cugguccagcucguacaccacg

SEQ ID NO: 14159 - RNA, 22 nt, Mycobacterium tuberculosis CDC1551
cugguguuccagcugcuguggu

SEQ ID NO: 14160 - RNA, 22 nt, Mycobacterium tuberculosis CDC1551
cugaauucgucggguaucuggu

SEQ ID NO: 14161 - RNA, 22 nt, Mycobacterium tuberculosis CDC1551
gaccagcucggccuucucgaga

SEQ ID NO: 14162 - RNA, 22 nt, Mycobacterium tuberculosis CDC1551
cggcugcagugcgacgacgaga

SEQ ID NO: 14163 - RNA, 22 nt, Mycobacterium tuberculosis CDC1551
cgggacagcuuggucuuucgcg

SEQ ID NO: 14164 - RNA, 22 nt, Mycobacterium tuberculosis CDC1551
cggucaccaucaccggcaccag

SEQ ID NO: 14165 - RNA, 22 nt, Mycobacterium tuberculosis CDC1551
cgugauccacagccacccggug

SEQ ID NO: 14166 - RNA, 22 nt, Mycobacterium tuberculosis CDC1551
cgguuucucggccgaacuuggc

SEQ ID NO: 14167 - RNA, 22 nt, Mycobacterium tuberculosis CDC1551
cgucccugaggcuacgccccag

SEQ ID NO: 14168 - RNA, 22 nt, Mycobacterium tuberculosis CDC1551
ucucggccgucgcgagcuccuc

SEQ ID NO: 14169 - RNA, 22 nt, Mycobacterium tuberculosis CDC1551
ucggagaccucgccggaccucg

SEQ ID NO: 14170 - RNA, 22 nt, Mycobacterium tuberculosis CDC1551
ucggcucaucgcugcuugcauu

SEQ ID NO: 14171 - RNA, 22 nt, Mycobacterium tuberculosis CDC1551
ucagcgucgaugaccaugucga

SEQ ID NO: 14172 - RNA, 22 nt, Mycobacterium tuberculosis CDC1551
ucgccagcaccaccugguuggg

SEQ ID NO: 14173 - RNA, 22 nt, Mycobacterium tuberculosis CDC1551
ucgaagcccuugauguccuuca

SEQ ID NO: 14174 - RNA, 22 nt, Mycobacterium tuberculosis CDC1551
uagugauucgcaucucugcacc

SEQ ID NO: 14175 - RNA, 22 nt, Mycobacterium tuberculosis CDC1551
uaagugaaagccugacgugguc

SEQ ID NO: 14176 - RNA, 22 nt, Mycobacterium tuberculosis CDC1551
ucccgcagggcacgccuagacg

SEQ ID NO: 14177 - RNA, 22 nt, Mycobacterium tuberculosis CDC1551
ucacugugacgccgggcugggu

SEQ ID NO: 14178 - RNA, 22 nt, Mycobacterium tuberculosis CDC1551
ucaccugcccggcaccuggagc

SEQ ID NO: 14179 - RNA, 22 nt, Mycobacterium tuberculosis CDC1551
uggaaaaacggcggccccgacc

SEQ ID NO: 14180 - RNA, 22 nt, Mycobacterium tuberculosis CDC1551
uggcugcggccgaucaccgaug

SEQ ID NO: 14181 - RNA, 22 nt, Mycobacterium tuberculosis CDC1551
uggcugcggugccacgaacgau

SEQ ID NO: 14182 - RNA, 22 nt, Mycobacterium tuberculosis CDC1551
uggcgagcagacgcaaaagccc

SEQ ID NO: 14183 - RNA, 17 nt, Mycobacterium tuberculosis CDC1551
uggcguggcugcaugag

SEQ ID NO: 14184 - RNA, 22 nt, Mycobacterium tuberculosis CDC1551
ugggcggucaucgcgccgaucg

SEQ ID NO: 14185 - RNA, 22 nt, Mycobacterium tuberculosis CDC1551
ugggcagcggucaaggggccca

SEQ ID NO: 14186 - RNA, 22 nt, Mycobacterium tuberculosis CDC1551
uggucggcggucauacccgcgg

SEQ ID NO: 14187 - RNA, 23 nt, Mycobacterium tuberculosis CDC1551
ugguggacgcagagucaacggau

SEQ ID NO: 14188 - RNA, 22 nt, Mycobacterium tuberculosis CDC1551
ugguggcuagcaaggucuuccc

SEQ ID NO: 14189 - RNA, 22 nt, Mycobacterium tuberculosis CDC1551
ugacauauaucaaagagauguu

SEQ ID NO: 14190 - RNA, 22 nt, Mycobacterium tuberculosis CDC1551
ucuuucccuccagaucggugcg

SEQ ID NO: 14191 - RNA, 22 nt, Mycobacterium tuberculosis CDC1551
ugcgcgccuugauccggcuguc

SEQ ID NO: 14192 - RNA, 22 nt, Mycobacterium tuberculosis CDC1551
ugcuccacugcugccaagucgg

SEQ ID NO: 14193 - RNA, 22 nt, Mycobacterium tuberculosis CDC1551
ugcccggcaugggcagccugcu

SEQ ID NO: 14194 - RNA, 22 nt, Mycobacterium tuberculosis CDC1551
ugcccggcgaacaggaauugcu

SEQ ID NO: 14195 - RNA, 22 nt, Mycobacterium tuberculosis CDC1551
caggaugacgccgcagcgcucg

SEQ ID NO: 14196 - RNA, 22 nt, Mycobacterium tuberculosis CDC1551
auuggcuguggugaagagcaau

SEQ ID NO: 14197 - RNA, 22 nt, Mycobacterium tuberculosis CDC1551
caagaccagguacguggaccau

SEQ ID NO: 14198 - RNA, 22 nt, Mycobacterium tuberculosis CDC1551
cacgccugcgcgacauggacgc

SEQ ID NO: 14199 - RNA, 20 nt, Mycobacterium tuberculosis CDC1551
cacugacuagugaagaaccu

SEQ ID NO: 14200 - RNA, 22 nt, Mycobacterium tuberculosis CDC1551
augcaguuggcggucgacugcg

SEQ ID NO: 14201 - RNA, 22 nt, Mycobacterium tuberculosis CDC1551
augguuuuggccagcuuugucg

SEQ ID NO: 14202 - RNA, 19 nt, Mycobacterium tuberculosis CDC1551
augguggccgggaucgugc

SEQ ID NO: 14203 - RNA, 22 nt, Mycobacterium tuberculosis CDC1551
augguggccacggcgugggcgu

SEQ ID NO: 14204 - RNA, 22 nt, Mycobacterium tuberculosis CDC1551
aucgcuugccgaugccgucggu

SEQ ID NO: 14205 - RNA, 22 nt, Mycobacterium tuberculosis CDC1551
uugggccaccaguccugguuuc

SEQ ID NO: 14206 - RNA, 22 nt, Mycobacterium tuberculosis CDC1551
aguuucucagcgagcaggugcu

SEQ ID NO: 14207 - RNA, 22 nt, Mycobacterium tuberculosis CDC1551
auccaugagcagcucgccgccg

SEQ ID NO: 14208 - RNA, 22 nt, Mycobacterium tuberculosis CDC1551
aucauucuggggaugaacgguc

SEQ ID NO: 14209 - RNA, 22 nt, Mycobacterium tuberculosis CDC1551
aucaggcugcgcacccgcucgg

SEQ ID NO: 14210 - RNA, 22 nt, Mycobacterium tuberculosis CDC1551
aucaucaggcgcgacauaucga

SEQ ID NO: 14211 - RNA, 22 nt, Mycobacterium tuberculosis CDC1551
ugguuaggcgggacggggagug

SEQ ID NO: 14212 - RNA, 22 nt, Mycobacterium tuberculosis CDC1551
ugguggcuguuguugcgccggc

SEQ ID NO: 14213 - RNA, 22 nt, Mycobacterium tuberculosis CDC1551
ugguuucccgugaggugaucgc

SEQ ID NO: 14214 - RNA, 23 nt, Mycobacterium tuberculosis CDC1551
ugguggucgacaugucggccagc

SEQ ID NO: 14215 - RNA, 22 nt, Mycobacterium tuberculosis CDC1551
ugugguuucccuacccgggcag

SEQ ID NO: 14216 - RNA, 22 nt, Mycobacterium tuberculosis CDC1551
uugaccuugcgcccggccagca

SEQ ID NO: 14217 - RNA, 22 nt, Mycobacterium tuberculosis CDC1551
uugacgucagcgccgcccgguc

SEQ ID NO: 14218 - RNA, 22 nt, Mycobacterium tuberculosis CDC1551
uuucauucagacgagaggcgug

SEQ ID NO: 14219 - RNA, 22 nt, Mycobacterium tuberculosis CDC1551
uugccauucaccguuggugacc

SEQ ID NO: 14220 - RNA, 22 nt, Mycobacterium tuberculosis CDC1551
uuggccgcugcgacaagccggc

SEQ ID NO: 14221 - RNA, 22 nt, Mycobacterium tuberculosis CDC1551
uugcgcagcgaucgcaugacug

SEQ ID NO: 14222 - RNA, 22 nt, Mycobacterium tuberculosis CDC1551
uuggcagcgugaaguguucggg

SEQ ID NO: 14223 - RNA, 22 nt, Mycobacterium tuberculosis CDC1551
uugguguccgccgacgccaagu

SEQ ID NO: 14224 - RNA, 22 nt, Mycobacterium tuberculosis CDC1551
uugucaccgcuuccauggcguu

SEQ ID NO: 14225 - RNA, 22 nt, Mycobacterium tuberculosis CDC1551
gcgauagcuuaucgaggauuuc

SEQ ID NO: 14226 - RNA, 22 nt, Mycobacterium tuberculosis CDC1551
ggaaagugacggucugaugcga

SEQ ID NO: 14227 - RNA, 22 nt, Mycobacterium tuberculosis CDC1551
ggagcuccuucaucuccgcugc

SEQ ID NO: 14228 - RNA, 22 nt, Mycobacterium tuberculosis CDC1551
ggccaaggugcgucgcgccccg

SEQ ID NO: 14229 - RNA, 22 nt, Mycobacterium tuberculosis CDC1551
ggccagggccgacggcacaucc

SEQ ID NO: 14230 - RNA, 22 nt, Mycobacterium tuberculosis CDC1551
ggcucacgauguagucgauccg

SEQ ID NO: 14231 - RNA, 22 nt, Mycobacterium tuberculosis CDC1551
ggcugcgcaccugcgccgacga

SEQ ID NO: 14232 - RNA, 22 nt, Mycobacterium tuberculosis CDC1551
ggccgaaacaccgcgcgaaggg

SEQ ID NO: 14233 - RNA, 22 nt, Mycobacterium tuberculosis CDC1551
ggccgggucucgcuuggcggcg

SEQ ID NO: 14234 - RNA, 22 nt, Mycobacterium tuberculosis CDC1551
ggcguggccguuucaccgcguu

SEQ ID NO: 14235 - RNA, 21 nt, Mycobacterium tuberculosis CDC1551
gggcugguuccaacgacagug

SEQ ID NO: 14236 - RNA, 22 nt, Mycobacterium tuberculosis CDC1551
ggggagacgauugccgccccgc

SEQ ID NO: 14237 - RNA, 22 nt, Mycobacterium tuberculosis CDC1551
gggcucaggauguggcugcgau

SEQ ID NO: 14238 - RNA, 22 nt, Mycobacterium tuberculosis CDC1551
ggucagcacgcaugugcggugg

SEQ ID NO: 14239 - RNA, 22 nt, Mycobacterium tuberculosis CDC1551
ggguaucaggcagccggcgcug

SEQ ID NO: 14240 - RNA, 22 nt, Mycobacterium tuberculosis CDC1551
gggugguggucgccaacgccga

SEQ ID NO: 14241 - RNA, 22 nt, Mycobacterium tuberculosis CDC1551
gggugguguugauugcggcggu

SEQ ID NO: 14242 - RNA, 22 nt, Mycobacterium tuberculosis CDC1551
gguggugccgguacgccaaugc

SEQ ID NO: 14243 - RNA, 22 nt, Mycobacterium tuberculosis CDC1551
ggugguggccaccgcagugggu

SEQ ID NO: 14244 - RNA, 22 nt, Mycobacterium tuberculosis CDC1551
ggugcuuuugcgucugcucggc

SEQ ID NO: 14245 - RNA, 22 nt, Mycobacterium tuberculosis CDC1551
gguugcgcuuggugaacucguc

SEQ ID NO: 14246 - RNA, 22 nt, Mycobacterium tuberculosis CDC1551
ggugguggugccgucgucgcgc

SEQ ID NO: 14247 - RNA, 22 nt, Mycobacterium tuberculosis CDC1551
ggugcugcacgccuucgccagc

SEQ ID NO: 14248 - RNA, 22 nt, Mycobacterium tuberculosis CDC1551
gugaagcccgguggguguggcc

SEQ ID NO: 14249 - RNA, 22 nt, Mycobacterium tuberculosis CDC1551
gugaccugcgcggcagggucau

SEQ ID NO: 14250 - RNA, 22 nt, Mycobacterium tuberculosis CDC1551
gucuggccgacgccaucagcga

SEQ ID NO: 14251 - RNA, 22 nt, Mycobacterium tuberculosis CDC1551
guccaggccgucgaacugcagg

SEQ ID NO: 14252 - RNA, 22 nt, Mycobacterium tuberculosis CDC1551
guuuggcgcgcccacagcccgg

SEQ ID NO: 14253 - RNA, 22 nt, Mycobacterium tuberculosis CDC1551
guuugguugccuaccgcguggg

SEQ ID NO: 14254 - RNA, 22 nt, Mycobacterium tuberculosis CDC1551
gugguggugagcaccaacggug

SEQ ID NO: 14255 - RNA, 22 nt, Mycobacterium tuberculosis CDC1551
guuucgggcgauuuugcgucug

SEQ ID NO: 14256 - RNA, 22 nt, Mycobacterium tuberculosis CDC1551
gccguugaggcggcuggcuggu

SEQ ID NO: 14257 - RNA, 22 nt, Mycobacterium tuberculosis CDC1551
gccgaagccgaccggcccagcg

SEQ ID NO: 14258 - RNA, 22 nt, Mycobacterium tuberculosis CDC1551
gccgcaccgacuaccaccgacu

SEQ ID NO: 14259 - RNA, 22 nt, Mycobacterium tuberculosis CDC1551
gccuugaccgccuugauggcgg

SEQ ID NO: 14260 - RNA, 22 nt, Mycobacterium tuberculosis CDC1551
gccuugccauaugcggccgacg

SEQ ID NO: 14261 - RNA, 22 nt, Mycobacterium tuberculosis CDC1551
gcgcuuuucguguucgucugcu

SEQ ID NO: 14262 - RNA, 22 nt, Mycobacterium tuberculosis CDC1551
gcggccaacgaggcagcggcgg

SEQ ID NO: 14263 - RNA, 22 nt, Mycobacterium tuberculosis CDC1551
gcguggucggaugcaggccagc

SEQ ID NO: 14264 - RNA, 22 nt, Mycobacterium tuberculosis CDC1551
gcugagacaugacgugccucac

SEQ ID NO: 14265 - RNA, 22 nt, Mycobacterium tuberculosis CDC1551
gcugcaaacccuagaguacuua

SEQ ID NO: 14266 - RNA, 22 nt, Mycobacterium tuberculosis CDC1551
gccacgccucgacgcacggccu

SEQ ID NO: 14267 - RNA, 22 nt, Mycobacterium tuberculosis CDC1551
gcaccgccggccugucccacga

SEQ ID NO: 14268 - RNA, 22 nt, Mycobacterium tuberculosis CDC1551
gcagcagguucaccacguaugc

SEQ ID NO: 14269 - RNA, 22 nt, Mycobacterium tuberculosis CDC1551
gccagcacaggcgcgauugcgu

SEQ ID NO: 14270 - RNA, 22 nt, Mycobacterium tuberculosis CDC1551
gccaggcuggugucggcggugg

SEQ ID NO: 14271 - RNA, 22 nt, Mycobacterium tuberculosis CDC1551
gaguagccggaguggcccuugc

SEQ ID NO: 14272 - RNA, 21 nt, Mycobacterium tuberculosis CDC1551
gcacacuggaagccagcacgc

SEQ ID NO: 14273 - RNA, 22 nt, Mycobacterium tuberculosis CDC1551
gcaccccagagcacugauacgc

SEQ ID NO: 14274 - RNA, 22 nt, Mycobacterium tuberculosis CDC1551
gaugagcgagcgacagcgugcg

SEQ ID NO: 14275 - RNA, 22 nt, Mycobacterium tuberculosis CDC1551
gagguguccgacgaaccugguu

SEQ ID NO: 14276 - RNA, 20 nt, Homo sapiens
uggcucuuugcugcuaaagu

SEQ ID NO: 14277 - RNA, 22 nt, Homo sapiens
aaaugcacaaagauuuugcacu

SEQ ID NO: 14278 - RNA, 23 nt, Homo sapiens
uccccgggagcaccagcuuguug

SEQ ID NO: 14279 - RNA, 22 nt, Homo sapiens
gugcacaacaugcaguuuuguu

SEQ ID NO: 14280 - RNA, 22 nt, Homo sapiens
auaagugagugauucaguguua

SEQ ID NO: 14281 - RNA, 22 nt, Homo sapiens
gugcacaaaucuuaaauguaca

SEQ ID NO: 14282 - RNA, 23 nt, Homo sapiens
uggaaguauggaggaggcagaau

SEQ ID NO: 14283 - RNA, 22 nt, Homo sapiens
uggcagcugcuucaugggaugc

SEQ ID NO: 14284 - RNA, 22 nt, Homo sapiens
ugugguuuuaguaaaacuaugu

SEQ ID NO: 14285 - RNA, 22 nt, Homo sapiens
ugaggauaguguugaaggcagg

SEQ ID NO: 14286 - RNA, 20 nt, Homo sapiens
uauucacucuccagucuugc

SEQ ID NO: 14287 - RNA, 22 nt, Homo sapiens
uugauagacacauauccaugug

SEQ ID NO: 14288 - RNA, 22 nt, Homo sapiens
gagcuggacuucuuaccuuuuc

SEQ ID NO: 14289 - RNA, 22 nt, Homo sapiens
guuaagaaguguaacuuaaguu

SEQ ID NO: 14290 - RNA, 22 nt, Homo sapiens
aggaaguaauaaguuugguucu

SEQ ID NO: 14291 - RNA, 22 nt, Homo sapiens
ggacuagggacauggggagcug

SEQ ID NO: 14292 - RNA, 22 nt, Homo sapiens
ggcagcucaggccccgcgcuga

SEQ ID NO: 14293 - RNA, 22 nt, Homo sapiens
uucagggacuuuagacaagaga

SEQ ID NO: 14294 - RNA, 22 nt, Homo sapiens
uggaagugaacaaccaaggcag

SEQ ID NO: 14295 - RNA, 22 nt, Homo sapiens
uguaaugaucaaaucagaguaa

SEQ ID NO: 14296 - RNA, 22 nt, Homo sapiens
gacuagaaauuauuuagugagc

SEQ ID NO: 14297 - RNA, 22 nt, Homo sapiens
gcuaggagaucugcugcucucu

SEQ ID NO: 14298 - RNA, 22 nt, Homo sapiens
augacuagaggagggauggcca

SEQ ID NO: 14299 - RNA, 20 nt, Homo sapiens
agacuagggagcagaaagcc

SEQ ID NO: 14300 - RNA, 22 nt, Homo sapiens
uacuagaaccuuauucagagug

SEQ ID NO: 14301 - RNA, 22 nt, Homo sapiens
ugacuagggcucuaaacagcuc

SEQ ID NO: 14302 - RNA, 23 nt, Homo sapiens
ggauggaaaguuuugagggccac

SEQ ID NO: 14303 - RNA, 22 nt, Homo sapiens
gagguauagaacaccuuucaag

SEQ ID NO: 14304 - RNA, 22 nt, Homo sapiens
augugcacaugcuuacauguga

SEQ ID NO: 14305 - RNA, 22 nt, Homo sapiens
ugacuagggacauucuuccacg

SEQ ID NO: 14306 - RNA, 22 nt, Homo sapiens
agcgccacugcacuccagccug

SEQ ID NO: 14307 - RNA, 22 nt, Homo sapiens
cuuuggcauuagccuguauaga

SEQ ID NO: 14308 - RNA, 22 nt, Homo sapiens
gcgguagcauagacugcaggac

SEQ ID NO: 14309 - RNA, 18 nt, Homo sapiens
ucacuagacacugaaucu

SEQ ID NO: 14310 - RNA, 22 nt, Homo sapiens
guccuggagaagcguggaccgg

SEQ ID NO: 14311 - RNA, 22 nt, Homo sapiens
uagccucacaaagugcuuaaga

SEQ ID NO: 14312 - RNA, 22 nt, Homo sapiens
ugggcggagacgugcagccgcc

SEQ ID NO: 14313 - RNA, 22 nt, Homo sapiens
aaauugcacaaguggugauuug

SEQ ID NO: 14314 - RNA, 22 nt, Homo sapiens
uaugcacacacguguuuaugug

SEQ ID NO: 14315 - RNA, 22 nt, Homo sapiens
cuuuaugagguuggauggaucu

SEQ ID NO: 14316 - RNA, 22 nt, Homo sapiens
ugaauagacacuaaagacugua

SEQ ID NO: 14317 - RNA, 22 nt, Homo sapiens
uuuaaugcgucucugaguuuug

SEQ ID NO: 14318 - RNA, 22 nt, Homo sapiens
augaggcaggaaaggcguaucu

SEQ ID NO: 14319 - RNA, 22 nt, Homo sapiens
ugacuaggaggcuggaggauga

SEQ ID NO: 14320 - RNA, 22 nt, Homo sapiens
gaacuguuucuggugaaagagu

SEQ ID NO: 14321 - RNA, 23 nt, Homo sapiens
aggaaguaacuaucuuuucuguc

SEQ ID NO: 14322 - RNA, 22 nt, Homo sapiens
aucagaaucucuagaggacugu

SEQ ID NO: 14323 - RNA, 22 nt, Homo sapiens
aagcuggagugcaguggugcga

SEQ ID NO: 14324 - RNA, 22 nt, Homo sapiens
augcacuuggcaggaugauucc

SEQ ID NO: 14325 - RNA, 22 nt, Homo sapiens
ucgcugcgaccuccaccucccg

SEQ ID NO: 14326 - RNA, 22 nt, Homo sapiens
augacuauugcacuuuccuggu

SEQ ID NO: 14327 - RNA, 22 nt, Homo sapiens
augcacauggcuaacuuuuuuc

SEQ ID NO: 14328 - RNA, 22 nt, Homo sapiens
ugacuaggggcccuggcuucuu

SEQ ID NO: 14329 - RNA, 22 nt, Homo sapiens
aauacugaaaguauuuucaaau

SEQ ID NO: 14330 - RNA, 22 nt, Homo sapiens
acuauacuguaacuguauucag

SEQ ID NO: 14331 - RNA, 21 nt, Homo sapiens
ugacuagggauaugugccacu

SEQ ID NO: 14332 - RNA, 22 nt, Homo sapiens
ccuucuuuuguaaggcugaaua

SEQ ID NO: 14333 - RNA, 22 nt, Homo sapiens
uuuccagguggccaacauuuua

SEQ ID NO: 14334 - RNA, 22 nt, Homo sapiens
augcagaucacauuuuucuguc

SEQ ID NO: 14335 - RNA, 22 nt, Homo sapiens
gaagcauugauccacaggcgug

SEQ ID NO: 14336 - RNA, 22 nt, Homo sapiens
cuuuggccauagcuaaaugauu

SEQ ID NO: 14337 - RNA, 22 nt, Homo sapiens
auaugcauacauguaugcagga

SEQ ID NO: 14338 - RNA, 19 nt, Homo sapiens
uuucaauguaaggauggag

SEQ ID NO: 14339 - RNA, 22 nt, Homo sapiens
aauacugagaugugagguacua

SEQ ID NO: 14340 - RNA, 22 nt, Homo sapiens
uggagacugaucccucuuuccu

SEQ ID NO: 14341 - RNA, 22 nt, Homo sapiens
auaugcacuauacacacguaua

SEQ ID NO: 14342 - RNA, 22 nt, Homo sapiens
ugagguuauuuguucaagaagu

SEQ ID NO: 14343 - RNA, 22 nt, Homo sapiens
aucagaaucucuagugggacca

SEQ ID NO: 14344 - RNA, 22 nt, Homo sapiens
aagcuggauuuaguguggagca

SEQ ID NO: 14345 - RNA, 22 nt, Homo sapiens
cuagaacuagaacugcuggggu

SEQ ID NO: 14346 - RNA, 19 nt, Homo sapiens
ugcauugucugggaaaugg

SEQ ID NO: 14347 - RNA, 22 nt, Homo sapiens
gacuaggagagcagcugcccau

SEQ ID NO: 14348 - RNA, 22 nt, Homo sapiens
guggaagugucuggggccaggg

SEQ ID NO: 14349 - RNA, 22 nt, Homo sapiens
uagcuggaauuacuugcaccug

SEQ ID NO: 14350 - RNA, 22 nt, Homo sapiens
ugacuauaggauaacaugcauu

SEQ ID NO: 14351 - RNA, 22 nt, Homo sapiens
uuggucucaucaagagcagcuu

SEQ ID NO: 14352 - RNA, 22 nt, Homo sapiens
accucagcccggggaaguugag

SEQ ID NO: 14353 - RNA, 22 nt, Homo sapiens
acccuggauucguggccuugaa

SEQ ID NO: 14354 - RNA, 22 nt, Homo sapiens
uggaaguagauagauuguguca

SEQ ID NO: 14355 - RNA, 22 nt, Homo sapiens
aaacugaucugaaggccaggcu

SEQ ID NO: 14356 - RNA, 22 nt, Homo sapiens
aucauacuguuuugauuacugu

SEQ ID NO: 14357 - RNA, 22 nt, Homo sapiens
gcgugguguuagaaugagaagu

SEQ ID NO: 14358 - RNA, 22 nt, Homo sapiens
cuguaauguaaugagacuacau

SEQ ID NO: 14359 - RNA, 22 nt, Homo sapiens
aagcuggauuucgcauccuguu

SEQ ID NO: 14360 - RNA, 19 nt, Homo sapiens
ggcaauacuuucuuguugg

SEQ ID NO: 14361 - RNA, 22 nt, Homo sapiens
uuccacaaugguugaacuagcu

SEQ ID NO: 14362 - RNA, 21 nt, Homo sapiens
augugcacuaugucauuuaau

SEQ ID NO: 14363 - RNA, 22 nt, Homo sapiens
uggaaguaaccaugaauggaau

SEQ ID NO: 14364 - RNA, 22 nt, Homo sapiens
cacuuugguucaccugaguuuc

SEQ ID NO: 14365 - RNA, 17 nt, Homo sapiens
ugauaagugugagguga

SEQ ID NO: 14366 - RNA, 22 nt, Homo sapiens
uacauacuucacagacuuuaaa

SEQ ID NO: 14367 - RNA, 22 nt, Homo sapiens
aucugcacaucuguguuuuugu

SEQ ID NO: 14368 - RNA, 19 nt, Homo sapiens
acagcugguuuugguuucu

SEQ ID NO: 14369 - RNA, 22 nt, Homo sapiens
guggcgagaucauagcucauug

SEQ ID NO: 14370 - RNA, 22 nt, Homo sapiens
uucacacugggccuacucugug

SEQ ID NO: 14371 - RNA, 18 nt, Homo sapiens
ucccucagaauuauagaa

SEQ ID NO: 14372 - RNA, 22 nt, Homo sapiens
aaugcacauauauuuccuuauu

SEQ ID NO: 14373 - RNA, 22 nt, Homo sapiens
uauggauuuuuuugacaagagc

SEQ ID NO: 14374 - RNA, 20 nt, Homo sapiens
aucagagacuaggauugcca

SEQ ID NO: 14375 - RNA, 17 nt, Homo sapiens
guuuggguacuggguaa

SEQ ID NO: 14376 - RNA, 22 nt, Homo sapiens
uuuggcuuuuguaauaacugcc

SEQ ID NO: 14377 - RNA, 22 nt, Homo sapiens
auugcacaucugcacuacagcc

SEQ ID NO: 14378 - RNA, 22 nt, Homo sapiens
gaaugauacuguuaacgaaaga

SEQ ID NO: 14379 - RNA, 22 nt, Homo sapiens
agagaacugauuggaugugggc

SEQ ID NO: 14380 - RNA, 22 nt, Homo sapiens
uuccacaaugguugaacuaguu

SEQ ID NO: 14381 - RNA, 22 nt, Homo sapiens
agugacaugggaucaaaucuga

SEQ ID NO: 14382 - RNA, 22 nt, Homo sapiens
auugauaguuuaauaggaauug

SEQ ID NO: 14383 - RNA, 22 nt, Homo sapiens
gaggaguagggcacaaagccuu

SEQ ID NO: 14384 - RNA, 22 nt, Homo sapiens
gugcacaaucgugcauuccuug

SEQ ID NO: 14385 - RNA, 22 nt, Homo sapiens
uggaaguaaucaugagguagca

SEQ ID NO: 14386 - RNA, 22 nt, Homo sapiens
uuaauguaucuaucacaucaca

SEQ ID NO: 14387 - RNA, 22 nt, Homo sapiens
ucacucagaccuggugauaugc

SEQ ID NO: 14388 - RNA, 22 nt, Homo sapiens
uaugcacaugcaugcuugaaua

SEQ ID NO: 14389 - RNA, 22 nt, Homo sapiens
gugauagaucugggauucagaa

SEQ ID NO: 14390 - RNA, 22 nt, Homo sapiens
ucacugaggucugagcuuuaug

SEQ ID NO: 14391 - RNA, 22 nt, Homo sapiens
acacuuucuggagcugcacaua

SEQ ID NO: 14392 - RNA, 22 nt, Homo sapiens
gacuaggagauauguuuucuuc

SEQ ID NO: 14393 - RNA, 20 nt, Homo sapiens
uggaacuuaauugauggaca

SEQ ID NO: 14394 - RNA, 22 nt, Homo sapiens
aucacuagaucauagguaaaca

SEQ ID NO: 14395 - RNA, 22 nt, Homo sapiens
uugguccucccaugcucaagag

SEQ ID NO: 14396 - RNA, 22 nt, Homo sapiens
uggaagugucugugcccagcuc

SEQ ID NO: 14397 - RNA, 22 nt, Homo sapiens
gagcuagguuuugaauccagac

SEQ ID NO: 14398 - RNA, 22 nt, Homo sapiens
auaaagccaugagcuugagaug

SEQ ID NO: 14399 - RNA, 22 nt, Homo sapiens
uagcuggaguuuuuguuauagg

SEQ ID NO: 14400 - RNA, 23 nt, Homo sapiens
ucacuagaguccuggaguuugag

SEQ ID NO: 14401 - RNA, 22 nt, Homo sapiens
auacaguugccauuucuugugc

SEQ ID NO: 14402 - RNA, 22 nt, Homo sapiens
uuagaacuagaggaguuugagu

SEQ ID NO: 14403 - RNA, 22 nt, Homo sapiens
gugaacagaaccugggaucgaa

SEQ ID NO: 14404 - RNA, 22 nt, Homo sapiens
aagcuggagugcaguggugcaa

SEQ ID NO: 14405 - RNA, 22 nt, Homo sapiens
uaaguauuaugugcugcauuuu

SEQ ID NO: 14406 - RNA, 22 nt, Homo sapiens
ucacuagaucaagggagagaaa

SEQ ID NO: 14407 - RNA, 22 nt, Homo sapiens
uccccgagcccaggcugugacu

SEQ ID NO: 14408 - RNA, 22 nt, Homo sapiens
cugggaugugacuguugccccc

SEQ ID NO: 14409 - RNA, 22 nt, Homo sapiens
auggaggccuacagaauuuugg

SEQ ID NO: 14410 - RNA, 22 nt, Homo sapiens
ucacacgugaacucaucacaga

SEQ ID NO: 14411 - RNA, 22 nt, Homo sapiens
cucacuaguaaggcuguuuagu

SEQ ID NO: 14412 - RNA, 22 nt, Homo sapiens
ucacaggguguuauuagaauua

SEQ ID NO: 14413 - RNA, 22 nt, Homo sapiens
uugugguuuuuaaaacuaggug

SEQ ID NO: 14414 - RNA, 22 nt, Homo sapiens
ugugguuuuuuucuccaauagg

SEQ ID NO: 14415 - RNA, 22 nt, Homo sapiens
gcuaggagauccacugcucucu

SEQ ID NO: 14416 - RNA, 22 nt, Homo sapiens
cauggcccugggcugggcgaac

SEQ ID NO: 14417 - RNA, 22 nt, Homo sapiens
acuagguaguaaucugcagaga

SEQ ID NO: 14418 - RNA, 22 nt, Homo sapiens
ggccggguggccauggcugccc

SEQ ID NO: 14419 - RNA, 23 nt, Homo sapiens
ucgguccccuuggcugcccucgg

SEQ ID NO: 14420 - RNA, 22 nt, Homo sapiens
uugauagaucagggauuugauu

SEQ ID NO: 14421 - RNA, 22 nt, Homo sapiens
uugauagacaucugaguuguug

SEQ ID NO: 14422 - RNA, 22 nt, Homo sapiens
acugaucaauguuaaggcuuau

SEQ ID NO: 14423 - RNA, 22 nt, Homo sapiens
aggcagcuguuauauacugagu

SEQ ID NO: 14424 - RNA, 22 nt, Homo sapiens
uuggauuuuaacaaacuaggug

SEQ ID NO: 14425 - RNA, 23 nt, Homo sapiens
ugugcacauuuacauauauacac

SEQ ID NO: 14426 - RNA, 19 nt, Homo sapiens
uccccgggucuagugcagc

SEQ ID NO: 14427 - RNA, 21 nt, Homo sapiens
ugcagccauucagcccuaugc

SEQ ID NO: 14428 - RNA, 22 nt, Homo sapiens
uugacaaggagccauugcaucu

SEQ ID NO: 14429 - RNA, 22 nt, Homo sapiens
cagccgggugagguggcuuguu

SEQ ID NO: 14430 - RNA, 17 nt, Homo sapiens
ucuaauaauaugcauuu

SEQ ID NO: 14431 - RNA, 20 nt, Homo sapiens
uggaaguaagaauauaggug

SEQ ID NO: 14432 - RNA, 22 nt, Homo sapiens
ucagaacugauacuagaacuuu

SEQ ID NO: 14433 - RNA, 22 nt, Homo sapiens
caaugcauuauucucccacuuc

SEQ ID NO: 14434 - RNA, 20 nt, Homo sapiens
cugcacauccacucuacuuc

SEQ ID NO: 14435 - RNA, 22 nt, Homo sapiens
ggacuaggagcuaggaagaucu

SEQ ID NO: 14436 - RNA, 17 nt, Homo sapiens
uuuaaugcuaggacucu

SEQ ID NO: 14437 - RNA, 22 nt, Homo sapiens
ugauauauugaaugaugaaaca

SEQ ID NO: 14438 - RNA, 22 nt, Homo sapiens
ggcagcuguguccuucguaagg

SEQ ID NO: 14439 - RNA, 22 nt, Homo sapiens
uugggacuggaaggaguaaggg

SEQ ID NO: 14440 - RNA, 22 nt, Homo sapiens
uggcucuuucuagacuuaauua

SEQ ID NO: 14441 - RNA, 22 nt, Homo sapiens
cacugcaguaaauugcgucggu

SEQ ID NO: 14442 - RNA, 22 nt, Homo sapiens
cuggaggccugaacauaaaugg

SEQ ID NO: 14443 - RNA, 22 nt, Homo sapiens
auacuguuuuacaucauugccu

SEQ ID NO: 14444 - RNA, 22 nt, Homo sapiens
uggaaguauagauaauugaaag

SEQ ID NO: 14445 - RNA, 22 nt, Homo sapiens
gaagcgaggugauuagcagaca

SEQ ID NO: 14446 - RNA, 22 nt, Homo sapiens
uggcuccguuguacaggcugga

SEQ ID NO: 14447 - RNA, 22 nt, Homo sapiens
gggaagugugcagaguucucuu

SEQ ID NO: 14448 - RNA, 22 nt, Homo sapiens
augagucacuuauuauuggggu

SEQ ID NO: 14449 - RNA, 22 nt, Homo sapiens
augacauugaaaagcaagugga

SEQ ID NO: 14450 - RNA, 22 nt, Homo sapiens
cucacuaggaaguaaaguuugu

SEQ ID NO: 14451 - RNA, 22 nt, Homo sapiens
uuccacaauggcugaacuaguu

SEQ ID NO: 14452 - RNA, 22 nt, Homo sapiens
ugacuaggaaauuagaacuuuu

SEQ ID NO: 14453 - RNA, 23 nt, Homo sapiens
ucaugaggccauucaaauccauu

SEQ ID NO: 14454 - RNA, 22 nt, Homo sapiens
gccccgggugaugcagccguca

SEQ ID NO: 14455 - RNA, 22 nt, Homo sapiens
uuaaaugcuagaauuuucuuug

SEQ ID NO: 14456 - RNA, 22 nt, Homo sapiens
uuccacaaugguugaacuaauu

SEQ ID NO: 14457 - RNA, 22 nt, Homo sapiens
uggagugauaugguuauauggg

SEQ ID NO: 14458 - RNA, 22 nt, Homo sapiens
uuugguguauaaaaaugcuagu

SEQ ID NO: 14459 - RNA, 22 nt, Pseudomonas aeruginosa PA01
ugaagauggccgagccggcgac

SEQ ID NO: 14460 - RNA, 22 nt, Pseudomonas aeruginosa PA01
ucggucucgaccagcaacuggc

SEQ ID NO: 14461 - RNA, 22 nt, Pseudomonas aeruginosa PA01
ucuccggcggccagcgccagcg

SEQ ID NO: 14462 - RNA, 22 nt, Pseudomonas aeruginosa PA01
ucucgucguccaugcucgcgcc

SEQ ID NO: 14463 - RNA, 22 nt, Pseudomonas aeruginosa PA01
ugaggaagcgcacgcaggcguc

SEQ ID NO: 14464 - RNA, 19 nt, Pseudomonas aeruginosa PA01
ugauauaggcgguacgggc

SEQ ID NO: 14465 - RNA, 19 nt, Pseudomonas aeruginosa PA01
ugagcagccccaggacgau

SEQ ID NO: 14466 - RNA, 22 nt, Pseudomonas aeruginosa PA01
ugagcgccaggaccugcuccgg

SEQ ID NO: 14467 - RNA, 22 nt, Pseudomonas aeruginosa PA01
ugagcguggccagccgcgccuc

SEQ ID NO: 14468 - RNA, 22 nt, Pseudomonas aeruginosa PA01
ugagcugcggacgcucgaagac

SEQ ID NO: 14469 - RNA, 22 nt, Pseudomonas aeruginosa PA01
ugcccggcgaccucgcggcugc

SEQ ID NO: 14470 - RNA, 22 nt, Pseudomonas aeruginosa PA01
ugccgaggaacagccaggcgug

SEQ ID NO: 14471 - RNA, 19 nt, Pseudomonas aeruginosa PA01
ugccggccgagcuguucga

SEQ ID NO: 14472 - RNA, 22 nt, Pseudomonas aeruginosa PA01
ugccggccugacugucugccgg

SEQ ID NO: 14473 - RNA, 22 nt, Pseudomonas aeruginosa PA01
ugccggccugcucuggcgccug

SEQ ID NO: 14474 - RNA, 22 nt, Pseudomonas aeruginosa PA01
ugccggcgcaguucgggcgcaa

SEQ ID NO: 14475 - RNA, 22 nt, Pseudomonas aeruginosa PA01
ugccggcgcccuggugaucugc

SEQ ID NO: 14476 - RNA, 22 nt, Pseudomonas aeruginosa PA01
ugccggcgcggcgguugaggcc

SEQ ID NO: 14477 - RNA, 22 nt, Pseudomonas aeruginosa PA01
ugccguccuaccuggagagcga

SEQ ID NO: 14478 - RNA, 22 nt, Pseudomonas aeruginosa PA01
uggaagcgcuggacgccuucuu

SEQ ID NO: 14479 - RNA, 22 nt, Pseudomonas aeruginosa PA01
uggaaaucgccacgguggacua

SEQ ID NO: 14480 - RNA, 22 nt, Pseudomonas aeruginosa PA01
ugcuucuuggcgcgcuugccgc

SEQ ID NO: 14481 - RNA, 19 nt, Pseudomonas aeruginosa PA01
ugcuugcagccaacugagc

SEQ ID NO: 14482 - RNA, 22 nt, Pseudomonas aeruginosa PA01
ugcuggaagaugcgcugguugg

SEQ ID NO: 14483 - RNA, 22 nt, Pseudomonas aeruginosa PA01
ugcuccgggaaauccggcaggu

SEQ ID NO: 14484 - RNA, 22 nt, Pseudomonas aeruginosa PA01
ugcgcggcguuuccucgccgaa

SEQ ID NO: 14485 - RNA, 22 nt, Pseudomonas aeruginosa PA01
ugcgcugggcguggucggcgac

SEQ ID NO: 14486 - RNA, 20 nt, Pseudomonas aeruginosa PA01
ugcggcggguaagcaggguc

SEQ ID NO: 14487 - RNA, 22 nt, Pseudomonas aeruginosa PA01
ugcgguggaaccauggcggacg

SEQ ID NO: 14488 - RNA, 22 nt, Pseudomonas aeruginosa PA01
ugcgguggcgauaccggugaug

SEQ ID NO: 14489 - RNA, 22 nt, Pseudomonas aeruginosa PA01
ugcgccggcccuggcuagacug

SEQ ID NO: 14490 - RNA, 22 nt, Pseudomonas aeruginosa PA01
ugcgccgggguuuccggcgugc

SEQ ID NO: 14491 - RNA, 22 nt, Pseudomonas aeruginosa PA01
ugcgcgaacuggugcugggcuc

SEQ ID NO: 14492 - RNA, 22 nt, Pseudomonas aeruginosa PA01
ugcccggcucgcgguucagccu

SEQ ID NO: 14493 - RNA, 18 nt, Pseudomonas aeruginosa PA01
uggcgcgcugcuggugga

SEQ ID NO: 14494 - RNA, 22 nt, Pseudomonas aeruginosa PA01
uggcgagcagggcaccgccgac

SEQ ID NO: 14495 - RNA, 22 nt, Pseudomonas aeruginosa PA01
uggcgagcuugaacagguggcg

SEQ ID NO: 14496 - RNA, 22 nt, Pseudomonas aeruginosa PA01
uggcgaggaucucgcggaucuu

SEQ ID NO: 14497 - RNA, 22 nt, Pseudomonas aeruginosa PA01
uggcgcgccugcugccggucga

SEQ ID NO: 14498 - RNA, 22 nt, Pseudomonas aeruginosa PA01
uggcgcgccuggaccgucggcg

SEQ ID NO: 14499 - RNA, 22 nt, Pseudomonas aeruginosa PA01
uggcgcgccuggcugauggcac

SEQ ID NO: 14500 - RNA, 22 nt, Pseudomonas aeruginosa PA01
uggccgggcagaugcuggucuc

SEQ ID NO: 14501 - RNA, 22 nt, Pseudomonas aeruginosa PA01
ugggcggcaagccugcgcgaca

SEQ ID NO: 14502 - RNA, 20 nt, Pseudomonas aeruginosa PA01
uggcggcugaucuucggcug

SEQ ID NO: 14503 - RNA, 22 nt, Pseudomonas aeruginosa PA01
uguucaacgagcugcucgccga

SEQ ID NO: 14504 - RNA, 23 nt, Pseudomonas aeruginosa PA01
ugucuccagcgucuucgggcugu

SEQ ID NO: 14505 - RNA, 22 nt, Pseudomonas aeruginosa PA01
ugguccugaccuacuucgucau

SEQ ID NO: 14506 - RNA, 23 nt, Pseudomonas aeruginosa PA01
ugguccuggugaucgguuucgcc

SEQ ID NO: 14507 - RNA, 19 nt, Pseudomonas aeruginosa PA01
uggucgaggggcuggaggc

SEQ ID NO: 14508 - RNA, 21 nt, Pseudomonas aeruginosa PA01
uucuucagccugcgcgccgug

SEQ ID NO: 14509 - RNA, 22 nt, Pseudomonas aeruginosa PA01
uucgcggcgaauuuccccggca

SEQ ID NO: 14510 - RNA, 22 nt, Pseudomonas aeruginosa PA01
uuccacggucagcaccgccggc

SEQ ID NO: 14511 - RNA, 22 nt, Pseudomonas aeruginosa PA01
uuccaggcagggccguccuccg

SEQ ID NO: 14512 - RNA, 22 nt, Pseudomonas aeruginosa PA01
uucccgcuggcagauggcccug

SEQ ID NO: 14513 - RNA, 22 nt, Pseudomonas aeruginosa PA01
uucccggcaccggucuggcggu

SEQ ID NO: 14514 - RNA, 22 nt, Pseudomonas aeruginosa PA01
uucccgucgaugcggagcggau

SEQ ID NO: 14515 - RNA, 19 nt, Pseudomonas aeruginosa PA01
uuagaaauaggcauuaguc

SEQ ID NO: 14516 - RNA, 22 nt, Pseudomonas aeruginosa PA01
uugcaugaacggcgugccguuc

SEQ ID NO: 14517 - RNA, 22 nt, Pseudomonas aeruginosa PA01
uugagaauggucuccuuggccu

SEQ ID NO: 14518 - RNA, 22 nt, Pseudomonas aeruginosa PA01
uuuuucaagcggcuagaucagc

SEQ ID NO: 14519 - RNA, 22 nt, Pseudomonas aeruginosa PA01
uuucuucagcagcccgaggcug

SEQ ID NO: 14520 - RNA, 22 nt, Pseudomonas aeruginosa PA01
uuuccucgaugucgccgcccuu

SEQ ID NO: 14521 - RNA, 22 nt, Pseudomonas aeruginosa PA01
gagcagcuggaucgggcgccgc

SEQ ID NO: 14522 - RNA, 22 nt, Pseudomonas aeruginosa PA01
gaggguaagugucgcuaaaggu

SEQ ID NO: 14523 - RNA, 22 nt, Pseudomonas aeruginosa PA01
gaugccgacgaucagccggagc

SEQ ID NO: 14524 - RNA, 22 nt, Pseudomonas aeruginosa PA01
gaugccggcggcuuccagcaag

SEQ ID NO: 14525 - RNA, 22 nt, Pseudomonas aeruginosa PA01
gagccgggagcuggugcguggc

SEQ ID NO: 14526 - RNA, 22 nt, Pseudomonas aeruginosa PA01
gagcgagccgguuguucgaggc

SEQ ID NO: 14527 - RNA, 22 nt, Pseudomonas aeruginosa PA01
gagcgccgagcaggaaugcgau

SEQ ID NO: 14528 - RNA, 22 nt, Pseudomonas aeruginosa PA01
gagcgcgaaggccuggugguga

SEQ ID NO: 14529 - RNA, 22 nt, Pseudomonas aeruginosa PA01
gagcggcccucgauccgcuggu

SEQ ID NO: 14530 - RNA, 22 nt, Pseudomonas aeruginosa PA01
gagcggccggacuucggcgaga

SEQ ID NO: 14531 - RNA, 22 nt, Pseudomonas aeruginosa PA01
gagcggcgcaucgcgguggaga

SEQ ID NO: 14532 - RNA, 22 nt, Pseudomonas aeruginosa PA01
gagcucccaggcgucgccuggc

SEQ ID NO: 14533 - RNA, 22 nt, Pseudomonas aeruginosa PA01
gagcucgcucuggaugcgcguc

SEQ ID NO: 14534 - RNA, 22 nt, Pseudomonas aeruginosa PA01
gagcugcgcgaagcgcuggacg

SEQ ID NO: 14535 - RNA, 22 nt, Pseudomonas aeruginosa PA01
gagcuggaguugcggauuggca

SEQ ID NO: 14536 - RNA, 22 nt, Pseudomonas aeruginosa PA01
gaggaacgucaggacacgcagg

SEQ ID NO: 14537 - RNA, 22 nt, Pseudomonas aeruginosa PA01
gaggcgccggaaugggucgccg

SEQ ID NO: 14538 - RNA, 22 nt, Pseudomonas aeruginosa PA01
gaggcgcgcgggcugcucaacc

SEQ ID NO: 14539 - RNA, 22 nt, Pseudomonas aeruginosa PA01
gcacccucccgcugcucgaacu

SEQ ID NO: 14540 - RNA, 22 nt, Pseudomonas aeruginosa PA01
gaugcggaugcgcuugucgcgg

SEQ ID NO: 14541 - RNA, 22 nt, Pseudomonas aeruginosa PA01
gaugcguacgccgggcgagaug

SEQ ID NO: 14542 - RNA, 22 nt, Pseudomonas aeruginosa PA01
gaugcugaugaccgccgccggc

SEQ ID NO: 14543 - RNA, 22 nt, Pseudomonas aeruginosa PA01
gaugguccgggugcggucguug

SEQ ID NO: 14544 - RNA, 22 nt, Pseudomonas aeruginosa PA01
gaagagcgccaacgucgagggc

SEQ ID NO: 14545 - RNA, 22 nt, Pseudomonas aeruginosa PA01
gaagaugcccuucaucuucaag

SEQ ID NO: 14546 - RNA, 22 nt, Pseudomonas aeruginosa PA01
gacccgccgacgccguucagca

SEQ ID NO: 14547 - RNA, 22 nt, Pseudomonas aeruginosa PA01
gacccggacaucauccuggucg

SEQ ID NO: 14548 - RNA, 23 nt, Pseudomonas aeruginosa PA01
gacccggcggccuuccgcaucgc

SEQ ID NO: 14549 - RNA, 22 nt, Pseudomonas aeruginosa PA01
gaccgcccagaugaggggaaga

SEQ ID NO: 14550 - RNA, 22 nt, Pseudomonas aeruginosa PA01
gaccagccugcacgagggcauu

SEQ ID NO: 14551 - RNA, 22 nt, Pseudomonas aeruginosa PA01
gaccaggcguacguauagcagg

SEQ ID NO: 14552 - RNA, 22 nt, Pseudomonas aeruginosa PA01
gagcagguagucgccgcgcccg

SEQ ID NO: 14553 - RNA, 22 nt, Pseudomonas aeruginosa PA01
gagcauccggcacaggcgcagg

SEQ ID NO: 14554 - RNA, 22 nt, Pseudomonas aeruginosa PA01
gagcauggcgcgcgagcugggg

SEQ ID NO: 14555 - RNA, 22 nt, Pseudomonas aeruginosa PA01
gacgcgcgccuggcgcaguggg

SEQ ID NO: 14556 - RNA, 22 nt, Pseudomonas aeruginosa PA01
gacugcgggaucgccagccgca

SEQ ID NO: 14557 - RNA, 22 nt, Pseudomonas aeruginosa PA01
gcccauggcgaaagcgccgccg

SEQ ID NO: 14558 - RNA, 22 nt, Pseudomonas aeruginosa PA01
gccccgcgcagguugaucacgc

SEQ ID NO: 14559 - RNA, 22 nt, Pseudomonas aeruginosa PA01
gcccggcggcacgcugggccug

SEQ ID NO: 14560 - RNA, 18 nt, Pseudomonas aeruginosa PA01
gcccggcguaguccagca

SEQ ID NO: 14561 - RNA, 22 nt, Pseudomonas aeruginosa PA01
gcccggcucgaagagcgugcgc

SEQ ID NO: 14562 - RNA, 22 nt, Pseudomonas aeruginosa PA01
gcccggcuggcgcucggccugg

SEQ ID NO: 14563 - RNA, 22 nt, Pseudomonas aeruginosa PA01
gcccggcuguccaggcggccgg

SEQ ID NO: 14564 - RNA, 22 nt, Pseudomonas aeruginosa PA01
gcccucgccgacgaccugcgcc

SEQ ID NO: 14565 - RNA, 22 nt, Pseudomonas aeruginosa PA01
gcccuggagguuguccggcaag

SEQ ID NO: 14566 - RNA, 22 nt, Pseudomonas aeruginosa PA01
gcccuggugcagcgcaaggccg

SEQ ID NO: 14567 - RNA, 22 nt, Pseudomonas aeruginosa PA01
gccagcagcucggcgccggcca

SEQ ID NO: 14568 - RNA, 22 nt, Pseudomonas aeruginosa PA01
gccagcaguucgcgggcacggg

SEQ ID NO: 14569 - RNA, 22 nt, Pseudomonas aeruginosa PA01
gccagccagaucggcgccggcc

SEQ ID NO: 14570 - RNA, 22 nt, Pseudomonas aeruginosa PA01
gccagccgaccgacucgccgcu

SEQ ID NO: 14571 - RNA, 17 nt, Pseudomonas aeruginosa PA01
gccagccgaucugcggc

SEQ ID NO: 14572 - RNA, 22 nt, Pseudomonas aeruginosa PA01
gccagcgccgccugaaccaggc

SEQ ID NO: 14573 - RNA, 22 nt, Pseudomonas aeruginosa PA01
gcacuggaauggccggccgcgc

SEQ ID NO: 14574 - RNA, 22 nt, Pseudomonas aeruginosa PA01
gcagcccguuccagccgccggu

SEQ ID NO: 14575 - RNA, 22 nt, Pseudomonas aeruginosa PA01
gcagcgaguagccgauccccgg

SEQ ID NO: 14576 - RNA, 22 nt, Pseudomonas aeruginosa PA01
gcagcgccacccgcggaucgaa

SEQ ID NO: 14577 - RNA, 22 nt, Pseudomonas aeruginosa PA01
gcagcgcugcgcgagcagggug

SEQ ID NO: 14578 - RNA, 20 nt, Pseudomonas aeruginosa PA01
gcagcaaggccaggccgaug

SEQ ID NO: 14579 - RNA, 22 nt, Pseudomonas aeruginosa PA01
gcagcagcuugccguccggguu

SEQ ID NO: 14580 - RNA, 22 nt, Pseudomonas aeruginosa PA01
gcagcaggcgucggcgggccuc

SEQ ID NO: 14581 - RNA, 22 nt, Pseudomonas aeruginosa PA01
gcagggcgugcgcccggcgaau

SEQ ID NO: 14582 - RNA, 22 nt, Pseudomonas aeruginosa PA01
gcagcuggcgccgaucuccgcg

SEQ ID NO: 14583 - RNA, 22 nt, Pseudomonas aeruginosa PA01
gcaggaagccggcgagcgcuug

SEQ ID NO: 14584 - RNA, 22 nt, Pseudomonas aeruginosa PA01
gcaggccgaacaucaucaccgg

SEQ ID NO: 14585 - RNA, 22 nt, Pseudomonas aeruginosa PA01
gcaggccgaccaguucgcugau

SEQ ID NO: 14586 - RNA, 22 nt, Pseudomonas aeruginosa PA01
gcaggccgcccuggucgagcag

SEQ ID NO: 14587 - RNA, 22 nt, Pseudomonas aeruginosa PA01
gcaggcgcaguuggacgcccgc

SEQ ID NO: 14588 - RNA, 22 nt, Pseudomonas aeruginosa PA01
gcaggcugagcacgccggcggc

SEQ ID NO: 14589 - RNA, 22 nt, Pseudomonas aeruginosa PA01
gcaggcuggcgucuuccagggc

SEQ ID NO: 14590 - RNA, 22 nt, Pseudomonas aeruginosa PA01
gcugcagucggcaacuggcucu

SEQ ID NO: 14591 - RNA, 22 nt, Pseudomonas aeruginosa PA01
gcugaggcguuccgccggcccg

SEQ ID NO: 14592 - RNA, 22 nt, Pseudomonas aeruginosa PA01
gcucuugcggaucgccuucggc

SEQ ID NO: 14593 - RNA, 22 nt, Pseudomonas aeruginosa PA01
gcugccggcgaucgucgaggcg

SEQ ID NO: 14594 - RNA, 23 nt, Pseudomonas aeruginosa PA01
gcugccggcggcgucguugucgu

SEQ ID NO: 14595 - RNA, 22 nt, Pseudomonas aeruginosa PA01
gcugcgcaaguaccuggcgcgu

SEQ ID NO: 14596 - RNA, 21 nt, Pseudomonas aeruginosa PA01
gcugcgcaucuccgcggccgg

SEQ ID NO: 14597 - RNA, 22 nt, Pseudomonas aeruginosa PA01
gcugcgcgagcguggcugggac

SEQ ID NO: 14598 - RNA, 22 nt, Pseudomonas aeruginosa PA01
gcugcggccgcgguacaggcug

SEQ ID NO: 14599 - RNA, 22 nt, Pseudomonas aeruginosa PA01
gcuccgccuucuugucguugug

SEQ ID NO: 14600 - RNA, 22 nt, Pseudomonas aeruginosa PA01
gcuccgcucuuggcgccgccca

SEQ ID NO: 14601 - RNA, 22 nt, Pseudomonas aeruginosa PA01
gcuccggcaggugaucguaguc

SEQ ID NO: 14602 - RNA, 22 nt, Pseudomonas aeruginosa PA01
gcucgccuggcugcgcagcgag

SEQ ID NO: 14603 - RNA, 22 nt, Pseudomonas aeruginosa PA01
gcucgcgauugccguccagcca

SEQ ID NO: 14604 - RNA, 22 nt, Pseudomonas aeruginosa PA01
gcucgcgguacggagccggccc

SEQ ID NO: 14605 - RNA, 22 nt, Pseudomonas aeruginosa PA01
gcucgcugggguccagccagag

SEQ ID NO: 14606 - RNA, 22 nt, Pseudomonas aeruginosa PA01
gcucggcguggcguugccgggc

SEQ ID NO: 14607 - RNA, 22 nt, Pseudomonas aeruginosa PA01
gcggaagaacucgaugacgccc

SEQ ID NO: 14608 - RNA, 22 nt, Pseudomonas aeruginosa PA01
gcggaagcgcugcgggucgucc

SEQ ID NO: 14609 - RNA, 22 nt, Pseudomonas aeruginosa PA01
gcggacgccuggcccguccugg

SEQ ID NO: 14610 - RNA, 22 nt, Pseudomonas aeruginosa PA01
gcggagcgcuggucgcuguucc

SEQ ID NO: 14611 - RNA, 22 nt, Pseudomonas aeruginosa PA01
gcggcagcccgggcaacggcag

SEQ ID NO: 14612 - RNA, 22 nt, Pseudomonas aeruginosa PA01
gcgcccacuccaaccaccugca

SEQ ID NO: 14613 - RNA, 22 nt, Pseudomonas aeruginosa PA01
gcgccccggugccgccguggaa

SEQ ID NO: 14614 - RNA, 22 nt, Pseudomonas aeruginosa PA01
gcgccccuggaagagccgccgg

SEQ ID NO: 14615 - RNA, 22 nt, Pseudomonas aeruginosa PA01
gcgcccggugugccggcuggcg

SEQ ID NO: 14616 - RNA, 22 nt, Pseudomonas aeruginosa PA01
gcgccgagcaauucggcgagca

SEQ ID NO: 14617 - RNA, 22 nt, Pseudomonas aeruginosa PA01
gcgccgaggcaggcguggaccu

SEQ ID NO: 14618 - RNA, 22 nt, Pseudomonas aeruginosa PA01
gcgcggcgaacuucacccaugc

SEQ ID NO: 14619 - RNA, 22 nt, Pseudomonas aeruginosa PA01
gcgcggcgugucguacuccucc

SEQ ID NO: 14620 - RNA, 21 nt, Pseudomonas aeruginosa PA01
gcgcgggcgagggcguagguc

SEQ ID NO: 14621 - RNA, 19 nt, Pseudomonas aeruginosa PA01
gcgcggggugcggaugcug

SEQ ID NO: 14622 - RNA, 22 nt, Pseudomonas aeruginosa PA01
gcgcgucgcccugggugacgcg

SEQ ID NO: 14623 - RNA, 22 nt, Pseudomonas aeruginosa PA01
gcgcgugcauuggcuggccggc

SEQ ID NO: 14624 - RNA, 22 nt, Pseudomonas aeruginosa PA01
gcgcguggccgaacuggccgcc

SEQ ID NO: 14625 - RNA, 22 nt, Pseudomonas aeruginosa PA01
gcgcuggagguguuccgccgcg

SEQ ID NO: 14626 - RNA, 16 nt, Pseudomonas aeruginosa PA01
gcgcuggauacggcgg

SEQ ID NO: 14627 - RNA, 22 nt, Pseudomonas aeruginosa PA01
gcgcuggcugcgaucggcuggc

SEQ ID NO: 14628 - RNA, 18 nt, Pseudomonas aeruginosa PA01
gcggcgccgggccagcag

SEQ ID NO: 14629 - RNA, 22 nt, Pseudomonas aeruginosa PA01
gcggcgcgggucuggcugagca

SEQ ID NO: 14630 - RNA, 22 nt, Pseudomonas aeruginosa PA01
gcggcgcguccaggcgaucgag

SEQ ID NO: 14631 - RNA, 18 nt, Pseudomonas aeruginosa PA01
gcggcgcguuggcgaucg

SEQ ID NO: 14632 - RNA, 22 nt, Pseudomonas aeruginosa PA01
gcggcggcgaacugggcgaagc

SEQ ID NO: 14633 - RNA, 22 nt, Pseudomonas aeruginosa PA01
gcggcggcgucucgugggccug

SEQ ID NO: 14634 - RNA, 22 nt, Pseudomonas aeruginosa PA01
gcggcucgcugaaagccgagcc

SEQ ID NO: 14635 - RNA, 22 nt, Pseudomonas aeruginosa PA01
gcgggagccgcaggcgccccau

SEQ ID NO: 14636 - RNA, 22 nt, Pseudomonas aeruginosa PA01
gcgggaggaucgaauugcaggc

SEQ ID NO: 14637 - RNA, 22 nt, Pseudomonas aeruginosa PA01
gcgggccggcgaacaaugcgug

SEQ ID NO: 14638 - RNA, 22 nt, Pseudomonas aeruginosa PA01
gcgggcgcccugccgaggcugg

SEQ ID NO: 14639 - RNA, 22 nt, Pseudomonas aeruginosa PA01
gcgggcgcgggucgucguugcc

SEQ ID NO: 14640 - RNA, 22 nt, Pseudomonas aeruginosa PA01
gcgggcgggugcuggaacugac

SEQ ID NO: 14641 - RNA, 22 nt, Pseudomonas aeruginosa PA01
gcgguggcgauccagcccggcg

SEQ ID NO: 14642 - RNA, 22 nt, Pseudomonas aeruginosa PA01
gcguccgggguuuccugcuggc

SEQ ID NO: 14643 - RNA, 22 nt, Pseudomonas aeruginosa PA01
gcgucgcggacuaccugcaggg

SEQ ID NO: 14644 - RNA, 22 nt, Pseudomonas aeruginosa PA01
gcgucggccgcagaugaacucg

SEQ ID NO: 14645 - RNA, 19 nt, Pseudomonas aeruginosa PA01
gcgucggcuuccuugacga

SEQ ID NO: 14646 - RNA, 22 nt, Pseudomonas aeruginosa PA01
gccuuggucgccgcgaucaccc

SEQ ID NO: 14647 - RNA, 22 nt, Pseudomonas aeruginosa PA01
gcgaccagccuucgcgcuugcc

SEQ ID NO: 14648 - RNA, 22 nt, Pseudomonas aeruginosa PA01
gcgaccgguggucgggcgcugc

SEQ ID NO: 14649 - RNA, 22 nt, Pseudomonas aeruginosa PA01
gccuucuucauguccggaguuu

SEQ ID NO: 14650 - RNA, 22 nt, Pseudomonas aeruginosa PA01
gccugggcgaugcccgcgucga

SEQ ID NO: 14651 - RNA, 22 nt, Pseudomonas aeruginosa PA01
gccugggguagggagggcgaca

SEQ ID NO: 14652 - RNA, 22 nt, Pseudomonas aeruginosa PA01
gcgacgccgaggcgacgcaggg

SEQ ID NO: 14653 - RNA, 22 nt, Pseudomonas aeruginosa PA01
gcgacggagucaacgacguacc

SEQ ID NO: 14654 - RNA, 17 nt, Pseudomonas aeruginosa PA01
gcgagcagcuugccgcc

SEQ ID NO: 14655 - RNA, 23 nt, Pseudomonas aeruginosa PA01
gcgagcagcuugccgccacgguu

SEQ ID NO: 14656 - RNA, 22 nt, Pseudomonas aeruginosa PA01
gcgagccgaugcaacgggcgac

SEQ ID NO: 14657 - RNA, 22 nt, Pseudomonas aeruginosa PA01
gcgagccgcuggagaaggcggu

SEQ ID NO: 14658 - RNA, 22 nt, Pseudomonas aeruginosa PA01
gcgaggaauucgccuugcugcg

SEQ ID NO: 14659 - RNA, 22 nt, Pseudomonas aeruginosa PA01
gcgaggagccgcuggacugguc

SEQ ID NO: 14660 - RNA, 21 nt, Pseudomonas aeruginosa PA01
gcgaggccaccagcccgguga

SEQ ID NO: 14661 - RNA, 22 nt, Pseudomonas aeruginosa PA01
gcgaggccaucgagcaggccgc

SEQ ID NO: 14662 - RNA, 22 nt, Pseudomonas aeruginosa PA01
gcgcgacagugguagcggcgac

SEQ ID NO: 14663 - RNA, 22 nt, Pseudomonas aeruginosa PA01
gcgcgacgcggggauggacgug

SEQ ID NO: 14664 - RNA, 22 nt, Pseudomonas aeruginosa PA01
gcgcgacgcuguugcuggcggg

SEQ ID NO: 14665 - RNA, 22 nt, Pseudomonas aeruginosa PA01
gcgcgagcgccugggucggcag

SEQ ID NO: 14666 - RNA, 22 nt, Pseudomonas aeruginosa PA01
gcgcgaggaacuggccggcgag

SEQ ID NO: 14667 - RNA, 22 nt, Pseudomonas aeruginosa PA01
gcgcgaggugcuggcgccgagg

SEQ ID NO: 14668 - RNA, 17 nt, Pseudomonas aeruginosa PA01
gcgcgcacgacaggcgc

SEQ ID NO: 14669 - RNA, 22 nt, Pseudomonas aeruginosa PA01
gcgcgcagcgagacgguggugc

SEQ ID NO: 14670 - RNA, 20 nt, Pseudomonas aeruginosa PA01
gcgcgcaggccaccuucgac

SEQ ID NO: 14671 - RNA, 22 nt, Pseudomonas aeruginosa PA01
gcgcaagcucgacgagaacggc

SEQ ID NO: 14672 - RNA, 23 nt, Pseudomonas aeruginosa PA01
gcgcaggcccaugaacagcaugc

SEQ ID NO: 14673 - RNA, 22 nt, Pseudomonas aeruginosa PA01
gcgccacgguuaucgcccaguu

SEQ ID NO: 14674 - RNA, 22 nt, Pseudomonas aeruginosa PA01
gcgccagcgcaccgccaugggc

SEQ ID NO: 14675 - RNA, 22 nt, Pseudomonas aeruginosa PA01
gccgccgaccugggcugcggca

SEQ ID NO: 14676 - RNA, 22 nt, Pseudomonas aeruginosa PA01
gccgccgaggcugaugcgcugc

SEQ ID NO: 14677 - RNA, 17 nt, Pseudomonas aeruginosa PA01
gccgccgaggucggcga

SEQ ID NO: 14678 - RNA, 22 nt, Pseudomonas aeruginosa PA01
gccgccgagucccuggagcgug

SEQ ID NO: 14679 - RNA, 22 nt, Pseudomonas aeruginosa PA01
gccgccgccagaucgaucaucg

SEQ ID NO: 14680 - RNA, 22 nt, Pseudomonas aeruginosa PA01
gccgccuggaagccgccggcuu

SEQ ID NO: 14681 - RNA, 22 nt, Pseudomonas aeruginosa PA01
gccgcuggaacuggggucgcug

SEQ ID NO: 14682 - RNA, 22 nt, Pseudomonas aeruginosa PA01
gccggagaucaccgagccgucc

SEQ ID NO: 14683 - RNA, 22 nt, Pseudomonas aeruginosa PA01
gccggcagcacaccgggcaguc

SEQ ID NO: 14684 - RNA, 22 nt, Pseudomonas aeruginosa PA01
gccggcagguuggcgcgcaggu

SEQ ID NO: 14685 - RNA, 22 nt, Pseudomonas aeruginosa PA01
gccggcccugucgggcaggccg

SEQ ID NO: 14686 - RNA, 22 nt, Pseudomonas aeruginosa PA01
gccggccgagaaggucgcguag

SEQ ID NO: 14687 - RNA, 22 nt, Pseudomonas aeruginosa PA01
gccggccguugcaauggcugua

SEQ ID NO: 14688 - RNA, 22 nt, Pseudomonas aeruginosa PA01
gccggcgacggcucgcuccuga

SEQ ID NO: 14689 - RNA, 22 nt, Pseudomonas aeruginosa PA01
gccggcgagcaguuggcgaugu

SEQ ID NO: 14690 - RNA, 22 nt, Pseudomonas aeruginosa PA01
gccggcgaggaaaucgccggag

SEQ ID NO: 14691 - RNA, 22 nt, Pseudomonas aeruginosa PA01
gccggcucaucagcacccgcug

SEQ ID NO: 14692 - RNA, 22 nt, Pseudomonas aeruginosa PA01
gccgggagugaagaaggcgaug

SEQ ID NO: 14693 - RNA, 22 nt, Pseudomonas aeruginosa PA01
gccgggauggaggagcaucucg

SEQ ID NO: 14694 - RNA, 22 nt, Pseudomonas aeruginosa PA01
gccggugacccuggcgaucggc

SEQ ID NO: 14695 - RNA, 22 nt, Pseudomonas aeruginosa PA01
gccgucgauccucgccgcguuc

SEQ ID NO: 14696 - RNA, 22 nt, Pseudomonas aeruginosa PA01
gccgucggccauuaccagguga

SEQ ID NO: 14697 - RNA, 22 nt, Pseudomonas aeruginosa PA01
gccgucggcgaccacgauggcc

SEQ ID NO: 14698 - RNA, 22 nt, Pseudomonas aeruginosa PA01
gccguggaagcucgccacgccg

SEQ ID NO: 14699 - RNA, 20 nt, Pseudomonas aeruginosa PA01
gccgaccggcggcccaggcg

SEQ ID NO: 14700 - RNA, 22 nt, Pseudomonas aeruginosa PA01
gccgaggaauuuccccgcgaac

SEQ ID NO: 14701 - RNA, 22 nt, Pseudomonas aeruginosa PA01
gccgaggagaccuggcggguac

SEQ ID NO: 14702 - RNA, 22 nt, Pseudomonas aeruginosa PA01
gccgaggaguuccggcucugag

SEQ ID NO: 14703 - RNA, 22 nt, Pseudomonas aeruginosa PA01
gccugcagaaggucggcggcga

SEQ ID NO: 14704 - RNA, 22 nt, Pseudomonas aeruginosa PA01
gccugcgauuuccugcgcguuc

SEQ ID NO: 14705 - RNA, 22 nt, Pseudomonas aeruginosa PA01
gccugcgcaacuggccgcgcug

SEQ ID NO: 14706 - RNA, 22 nt, Pseudomonas aeruginosa PA01
gccuggagaauaucgucggcga

SEQ ID NO: 14707 - RNA, 22 nt, Pseudomonas aeruginosa PA01
gccuggagaucgagcagucccc

SEQ ID NO: 14708 - RNA, 22 nt, Pseudomonas aeruginosa PA01
gccuggagggucacgcugucgu

SEQ ID NO: 14709 - RNA, 22 nt, Pseudomonas aeruginosa PA01
gccuggagguccaggcgcuggc

SEQ ID NO: 14710 - RNA, 22 nt, Pseudomonas aeruginosa PA01
guggcgagaaucaggucgaucc

SEQ ID NO: 14711 - RNA, 22 nt, Pseudomonas aeruginosa PA01
gugggcgcgaccucggcugcgg

SEQ ID NO: 14712 - RNA, 22 nt, Pseudomonas aeruginosa PA01
gugggcggucaacgccagcacc

SEQ ID NO: 14713 - RNA, 22 nt, Pseudomonas aeruginosa PA01
guggaaguggucgaggccccgg

SEQ ID NO: 14714 - RNA, 22 nt, Pseudomonas aeruginosa PA01
guccaugaucgcgaacugcggc

SEQ ID NO: 14715 - RNA, 22 nt, Pseudomonas aeruginosa PA01
guccggccaggcgggcuugccg

SEQ ID NO: 14716 - RNA, 22 nt, Pseudomonas aeruginosa PA01
guccggcgaccagcggcgcgug

SEQ ID NO: 14717 - RNA, 22 nt, Pseudomonas aeruginosa PA01
guccugcgcgcugcgcaggguc

SEQ ID NO: 14718 - RNA, 22 nt, Pseudomonas aeruginosa PA01
guccagcgcagcaccagcucgc

SEQ ID NO: 14719 - RNA, 22 nt, Pseudomonas aeruginosa PA01
gucuuucccggauggauggaga

SEQ ID NO: 14720 - RNA, 22 nt, Pseudomonas aeruginosa PA01
gucggccugaccuggggcgaga

SEQ ID NO: 14721 - RNA, 22 nt, Pseudomonas aeruginosa PA01
gucggcgaaguccugcacgaac

SEQ ID NO: 14722 - RNA, 22 nt, Pseudomonas aeruginosa PA01
gucggcgaguuccgcggagauc

SEQ ID NO: 14723 - RNA, 22 nt, Pseudomonas aeruginosa PA01
gucggcgauggccagcagcgcg

SEQ ID NO: 14724 - RNA, 22 nt, Pseudomonas aeruginosa PA01
gucggcgccgaaguugaugcgg

SEQ ID NO: 14725 - RNA, 22 nt, Pseudomonas aeruginosa PA01
gugagcgccgaggagcagacca

SEQ ID NO: 14726 - RNA, 22 nt, Pseudomonas aeruginosa PA01
gugaggcgccggacagcgcccg

SEQ ID NO: 14727 - RNA, 22 nt, Pseudomonas aeruginosa PA01
gugccggcgggugcugcgcgag

SEQ ID NO: 14728 - RNA, 19 nt, Pseudomonas aeruginosa PA01
gguuccgucggccuugccg

SEQ ID NO: 14729 - RNA, 22 nt, Pseudomonas aeruginosa PA01
gguugcgguugugguugagcag

SEQ ID NO: 14730 - RNA, 22 nt, Pseudomonas aeruginosa PA01
gucaggccgaagaucgcgccgc

SEQ ID NO: 14731 - RNA, 22 nt, Pseudomonas aeruginosa PA01
ggugggcgaugcgcgaggucag

SEQ ID NO: 14732 - RNA, 22 nt, Pseudomonas aeruginosa PA01
ggugccagggcuacagcgagcc

SEQ ID NO: 14733 - RNA, 22 nt, Pseudomonas aeruginosa PA01
ggugcgcaccgucgagggcgag

SEQ ID NO: 14734 - RNA, 22 nt, Pseudomonas aeruginosa PA01
ggugcggaagaaggcgcgcgua

SEQ ID NO: 14735 - RNA, 22 nt, Pseudomonas aeruginosa PA01
gggucuguucgaccaacugcgg

SEQ ID NO: 14736 - RNA, 22 nt, Pseudomonas aeruginosa PA01
gguccugcaacugaaacgggug

SEQ ID NO: 14737 - RNA, 22 nt, Pseudomonas aeruginosa PA01
ggucggccaguuguccuucgag

SEQ ID NO: 14738 - RNA, 22 nt, Pseudomonas aeruginosa PA01
ggucgggaugcgcaggcggccg

SEQ ID NO: 14739 - RNA, 22 nt, Pseudomonas aeruginosa PA01
gggcuccgacuaucacucgaug

SEQ ID NO: 14740 - RNA, 22 nt, Pseudomonas aeruginosa PA01
gggccgggcgacgaacuggacg

SEQ ID NO: 14741 - RNA, 22 nt, Pseudomonas aeruginosa PA01
ggggcgccggaccugcaggagc

SEQ ID NO: 14742 - RNA, 22 nt, Pseudomonas aeruginosa PA01
ggggcgcgccuccaggcgacgg

SEQ ID NO: 14743 - RNA, 22 nt, Pseudomonas aeruginosa PA01
ggggcucgccgaucaccccggu

SEQ ID NO: 14744 - RNA, 22 nt, Pseudomonas aeruginosa PA01
ggccuggagcgcggccaggccu

SEQ ID NO: 14745 - RNA, 22 nt, Pseudomonas aeruginosa PA01
ggcgacgccggcggcacccagu

SEQ ID NO: 14746 - RNA, 19 nt, Pseudomonas aeruginosa PA01
ggcgagcagcagggcgcgg

SEQ ID NO: 14747 - RNA, 22 nt, Pseudomonas aeruginosa PA01
ggcgagcagcggcaggcugucg

SEQ ID NO: 14748 - RNA, 22 nt, Pseudomonas aeruginosa PA01
ggcgaggaagucgcagugcucg

SEQ ID NO: 14749 - RNA, 22 nt, Pseudomonas aeruginosa PA01
ggcgaggaggguuuccgcgugc

SEQ ID NO: 14750 - RNA, 22 nt, Pseudomonas aeruginosa PA01
ggcgaggccaauggcugaggcg

SEQ ID NO: 14751 - RNA, 22 nt, Pseudomonas aeruginosa PA01
ggcgagguagcgcagcacgccg

SEQ ID NO: 14752 - RNA, 22 nt, Pseudomonas aeruginosa PA01
ggccgccgagccaggccucgcg

SEQ ID NO: 14753 - RNA, 22 nt, Pseudomonas aeruginosa PA01
ggccgccgccgacuugucggug

SEQ ID NO: 14754 - RNA, 22 nt, Pseudomonas aeruginosa PA01
ggccgccgcguggcgucggagu

SEQ ID NO: 14755 - RNA, 22 nt, Pseudomonas aeruginosa PA01
ggccgcgccgggagagcggaca

SEQ ID NO: 14756 - RNA, 22 nt, Pseudomonas aeruginosa PA01
ggccggcaccgaugucaccgcg

SEQ ID NO: 14757 - RNA, 22 nt, Pseudomonas aeruginosa PA01
ggccggcgaacucgcggucggu

SEQ ID NO: 14758 - RNA, 22 nt, Pseudomonas aeruginosa PA01
ggccgggacgaagccggggaaa

SEQ ID NO: 14759 - RNA, 23 nt, Pseudomonas aeruginosa PA01
ggccgggaucgagcaacuggcgc

SEQ ID NO: 14760 - RNA, 18 nt, Pseudomonas aeruginosa PA01
ggcggcgcgagccaggcg

SEQ ID NO: 14761 - RNA, 22 nt, Pseudomonas aeruginosa PA01
ggcggcgcuccucgaaggggaa

SEQ ID NO: 14762 - RNA, 21 nt, Pseudomonas aeruginosa PA01
ggcggcugguagcucaaggga

SEQ ID NO: 14763 - RNA, 22 nt, Pseudomonas aeruginosa PA01
ggcgggcguuuccgcgcugacg

SEQ ID NO: 14764 - RNA, 22 nt, Pseudomonas aeruginosa PA01
ggcgggugacgccguugucgau

SEQ ID NO: 14765 - RNA, 22 nt, Pseudomonas aeruginosa PA01
ggcgggugcucggagcgcuugc

SEQ ID NO: 14766 - RNA, 22 nt, Pseudomonas aeruginosa PA01
ggcgggugcugcuggaggaccu

SEQ ID NO: 14767 - RNA, 22 nt, Pseudomonas aeruginosa PA01
ggcgucuuccucguccucggcg

SEQ ID NO: 14768 - RNA, 22 nt, Pseudomonas aeruginosa PA01
ggcgcccagcgucgccaggcuc

SEQ ID NO: 14769 - RNA, 22 nt, Pseudomonas aeruginosa PA01
ggcgcccggcgaacagcuugcg

SEQ ID NO: 14770 - RNA, 22 nt, Pseudomonas aeruginosa PA01
ggcgcgaguugcugcgcgucua

SEQ ID NO: 14771 - RNA, 22 nt, Pseudomonas aeruginosa PA01
ggcgcgcaccgcgugggacagg

SEQ ID NO: 14772 - RNA, 22 nt, Pseudomonas aeruginosa PA01
ggcgcgcaggcgcagaacaccu

SEQ ID NO: 14773 - RNA, 19 nt, Pseudomonas aeruginosa PA01
ggcgcgccaggucuggcug

SEQ ID NO: 14774 - RNA, 22 nt, Pseudomonas aeruginosa PA01
ggcgcggcucguggaucagcgc

SEQ ID NO: 14775 - RNA, 22 nt, Pseudomonas aeruginosa PA01
ggcgcugcuggccgugcagguc

SEQ ID NO: 14776 - RNA, 22 nt, Pseudomonas aeruginosa PA01
ggcgcugcuguuccaguacgcg

SEQ ID NO: 14777 - RNA, 22 nt, Pseudomonas aeruginosa PA01
ggcgcuggcgcaaccggccaac

SEQ ID NO: 14778 - RNA, 22 nt, Pseudomonas aeruginosa PA01
ggcgcuggcgcaacgcaccgaa

SEQ ID NO: 14779 - RNA, 22 nt, Pseudomonas aeruginosa PA01
ggcgcugggcuugaccccggcg

SEQ ID NO: 14780 - RNA, 22 nt, Pseudomonas aeruginosa PA01
ggcggccguucauguaccagau

SEQ ID NO: 14781 - RNA, 22 nt, Pseudomonas aeruginosa PA01
ggcugcgucgugacgcccgcgg

SEQ ID NO: 14782 - RNA, 22 nt, Pseudomonas aeruginosa PA01
ggcugcuggagcgccugggcca

SEQ ID NO: 14783 - RNA, 22 nt, Pseudomonas aeruginosa PA01
ggcugcugggccuggccguucu

SEQ ID NO: 14784 - RNA, 22 nt, Pseudomonas aeruginosa PA01
ggcugcuguccgguggccuugu

SEQ ID NO: 14785 - RNA, 22 nt, Pseudomonas aeruginosa PA01
ggcugccgccgauggccuugga

SEQ ID NO: 14786 - RNA, 22 nt, Pseudomonas aeruginosa PA01
ggcuucggcuccccagccggac

SEQ ID NO: 14787 - RNA, 22 nt, Pseudomonas aeruginosa PA01
ggcuccgccgccucagcggggc

SEQ ID NO: 14788 - RNA, 22 nt, Pseudomonas aeruginosa PA01
ggcuccgcgaacgcuuccccca

SEQ ID NO: 14789 - RNA, 22 nt, Pseudomonas aeruginosa PA01
ggcuccugguugccgggagcgg

SEQ ID NO: 14790 - RNA, 22 nt, Pseudomonas aeruginosa PA01
ggcucgcgagcgccagggcaac

SEQ ID NO: 14791 - RNA, 22 nt, Pseudomonas aeruginosa PA01
ggcucgcgcgcuggccacccug

SEQ ID NO: 14792 - RNA, 22 nt, Pseudomonas aeruginosa PA01
ggcucgcucaugucgucgccuu

SEQ ID NO: 14793 - RNA, 22 nt, Pseudomonas aeruginosa PA01
ggcuuucucguuaccgccggcu

SEQ ID NO: 14794 - RNA, 22 nt, Pseudomonas aeruginosa PA01
gggaagcgcgccugcugcuuga

SEQ ID NO: 14795 - RNA, 21 nt, Pseudomonas aeruginosa PA01
gggaagcucgaggcgucgggu

SEQ ID NO: 14796 - RNA, 22 nt, Pseudomonas aeruginosa PA01
gggcagcucgaggucuucgucg

SEQ ID NO: 14797 - RNA, 22 nt, Pseudomonas aeruginosa PA01
gggcagcuucagcaagcgcucg

SEQ ID NO: 14798 - RNA, 22 nt, Pseudomonas aeruginosa PA01
gggcgacggcgaucagcgucua

SEQ ID NO: 14799 - RNA, 22 nt, Pseudomonas aeruginosa PA01
gggcgagccacucgccgaggaa

SEQ ID NO: 14800 - RNA, 22 nt, Pseudomonas aeruginosa PA01
gggcgaggucgacaacggcguc

SEQ ID NO: 14801 - RNA, 21 nt, Pseudomonas aeruginosa PA01
gggcgcgucccgccuggcggc

SEQ ID NO: 14802 - RNA, 20 nt, Pseudomonas aeruginosa PA01
gggcgcuggcauaggcgccc

SEQ ID NO: 14803 - RNA, 22 nt, Pseudomonas aeruginosa PA01
ggccccucggcggccuggcugc

SEQ ID NO: 14804 - RNA, 22 nt, Pseudomonas aeruginosa PA01
ggcccgggugauccuccagcau

SEQ ID NO: 14805 - RNA, 22 nt, Pseudomonas aeruginosa PA01
ggcccgucgccgcgccugaggc

SEQ ID NO: 14806 - RNA, 22 nt, Pseudomonas aeruginosa PA01
ggcccuggaucucgcccugcca

SEQ ID NO: 14807 - RNA, 22 nt, Pseudomonas aeruginosa PA01
ggcaggaagcuuuccggcaguu

SEQ ID NO: 14808 - RNA, 22 nt, Pseudomonas aeruginosa PA01
ggcagcagguguggaaggccuc

SEQ ID NO: 14809 - RNA, 22 nt, Pseudomonas aeruginosa PA01
ggagggcgaguuccugguggau

SEQ ID NO: 14810 - RNA, 22 nt, Pseudomonas aeruginosa PA01
ggagggcgccagcgaggugccg

SEQ ID NO: 14811 - RNA, 22 nt, Pseudomonas aeruginosa PA01
ggagguccgucaugccgcucga

SEQ ID NO: 14812 - RNA, 22 nt, Pseudomonas aeruginosa PA01
ggagucgcccucgaccaggaac

SEQ ID NO: 14813 - RNA, 22 nt, Pseudomonas aeruginosa PA01
ggaaccauggucgagagccucg

SEQ ID NO: 14814 - RNA, 22 nt, Pseudomonas aeruginosa PA01
gcuuccggcgaagcuccagcga

SEQ ID NO: 14815 - RNA, 23 nt, Pseudomonas aeruginosa PA01
gcuucggccuggucgguuuccgc

SEQ ID NO: 14816 - RNA, 22 nt, Pseudomonas aeruginosa PA01
gcuucguccgcgugguggcgcg

SEQ ID NO: 14817 - RNA, 22 nt, Pseudomonas aeruginosa PA01
gcuuucccccgccgcgcucuuc

SEQ ID NO: 14818 - RNA, 22 nt, Pseudomonas aeruginosa PA01
ggaccgcgcgaggagacgccgg

SEQ ID NO: 14819 - RNA, 22 nt, Pseudomonas aeruginosa PA01
ggacgccgaggaccaggcgcgc

SEQ ID NO: 14820 - RNA, 22 nt, Pseudomonas aeruginosa PA01
ggagccguccucgccggccugg

SEQ ID NO: 14821 - RNA, 22 nt, Pseudomonas aeruginosa PA01
ggagccguugcagugguagcac

SEQ ID NO: 14822 - RNA, 22 nt, Pseudomonas aeruginosa PA01
ggagcgccugugggaucguccc

SEQ ID NO: 14823 - RNA, 22 nt, Pseudomonas aeruginosa PA01
ggagcgcgugaccggcuacggu

SEQ ID NO: 14824 - RNA, 22 nt, Pseudomonas aeruginosa PA01
ggagcgggccuuagcccaggug

SEQ ID NO: 14825 - RNA, 22 nt, Pseudomonas aeruginosa PA01
gcuggaaacccucggcgugguc

SEQ ID NO: 14826 - RNA, 22 nt, Pseudomonas aeruginosa PA01
gcuggaggcgcgcaucgcucga

SEQ ID NO: 14827 - RNA, 22 nt, Pseudomonas aeruginosa PA01
gcugguaguggucgagcaucau

SEQ ID NO: 14828 - RNA, 22 nt, Pseudomonas aeruginosa PA01
gcugcuggccaguucggagcgc

SEQ ID NO: 14829 - RNA, 22 nt, Pseudomonas aeruginosa PA01
gcugcuggcgguauucggccac

SEQ ID NO: 14830 - RNA, 22 nt, Pseudomonas aeruginosa PA01
gcugcuggugccgcgcgcccau

SEQ ID NO: 14831 - RNA, 22 nt, Pseudomonas aeruginosa PA01
gcuggccgaguuccgccgacag

SEQ ID NO: 14832 - RNA, 22 nt, Pseudomonas aeruginosa PA01
gcuggccgggucgcggcgccac

SEQ ID NO: 14833 - RNA, 22 nt, Pseudomonas aeruginosa PA01
uugcccgguugcagcggcacca

SEQ ID NO: 14834 - RNA, 22 nt, Pseudomonas aeruginosa PA01
uuucgcggacgaacuggcggau

SEQ ID NO: 14835 - RNA, 22 nt, Pseudomonas aeruginosa PA01
uuucuucaaccagggcgagguc

SEQ ID NO: 14836 - RNA, 23 nt, Pseudomonas aeruginosa PA01
agucgcgcgcccuggucggcccg

SEQ ID NO: 14837 - RNA, 22 nt, Pseudomonas aeruginosa PA01
uucuucagcuugaucacgucga

SEQ ID NO: 14838 - RNA, 22 nt, Pseudomonas aeruginosa PA01
uucgccggcggcccgccugucc

SEQ ID NO: 14839 - RNA, 22 nt, Pseudomonas aeruginosa PA01
uuccgggcaaaaauucagccga

SEQ ID NO: 14840 - RNA, 22 nt, Pseudomonas aeruginosa PA01
uuccucggcgccagcgccggca

SEQ ID NO: 14841 - RNA, 22 nt, Pseudomonas aeruginosa PA01
uuccaguuggcggcguugcagc

SEQ ID NO: 14842 - RNA, 22 nt, Pseudomonas aeruginosa PA01
uuccccggcgggcggcgcgacc

SEQ ID NO: 14843 - RNA, 22 nt, Pseudomonas aeruginosa PA01
uucccgccggaggugcgcgccc

SEQ ID NO: 14844 - RNA, 22 nt, Pseudomonas aeruginosa PA01
ugucggccuccugggaugccgc

SEQ ID NO: 14845 - RNA, 17 nt, Pseudomonas aeruginosa PA01
ugucccggcggcggggu

SEQ ID NO: 14846 - RNA, 22 nt, Pseudomonas aeruginosa PA01
aucccggccucgaugccgcgug

SEQ ID NO: 14847 - RNA, 22 nt, Pseudomonas aeruginosa PA01
aucacaccggaauacaucggcg

SEQ ID NO: 14848 - RNA, 22 nt, Pseudomonas aeruginosa PA01
aucagcgggaucagcaugccgc

SEQ ID NO: 14849 - RNA, 22 nt, Pseudomonas aeruginosa PA01
aucaggccgcaggcguggcccu

SEQ ID NO: 14850 - RNA, 22 nt, Pseudomonas aeruginosa PA01
auaggagaaguccgaggcgauu

SEQ ID NO: 14851 - RNA, 22 nt, Pseudomonas aeruginosa PA01
aucgagcgggcgccucggcgug

SEQ ID NO: 14852 - RNA, 22 nt, Pseudomonas aeruginosa PA01
aucuggagcaacaggucgcggg

SEQ ID NO: 14853 - RNA, 22 nt, Pseudomonas aeruginosa PA01
augccgaggaaaccgccgcacc

SEQ ID NO: 14854 - RNA, 22 nt, Pseudomonas aeruginosa PA01
augccggcgaugggcgacuucg

SEQ ID NO: 14855 - RNA, 22 nt, Pseudomonas aeruginosa PA01
augccggcgccaacggugccgu

SEQ ID NO: 14856 - RNA, 22 nt, Pseudomonas aeruginosa PA01
augccgucucagccagcgcagg

SEQ ID NO: 14857 - RNA, 19 nt, Pseudomonas aeruginosa PA01
augcggaugccguggcggc

SEQ ID NO: 14858 - RNA, 22 nt, Pseudomonas aeruginosa PA01
auggcgcguuguccucgccgcc

SEQ ID NO: 14859 - RNA, 22 nt, Pseudomonas aeruginosa PA01
cacgcgcuuccggcacuuccac

SEQ ID NO: 14860 - RNA, 22 nt, Pseudomonas aeruginosa PA01
caccagcaggcgcgaggcgauc

SEQ ID NO: 14861 - RNA, 22 nt, Pseudomonas aeruginosa PA01
caggaugcccagcagggucggc

SEQ ID NO: 14862 - RNA, 22 nt, Pseudomonas aeruginosa PA01
caggccaagcgccuggcgcagc

SEQ ID NO: 14863 - RNA, 22 nt, Pseudomonas aeruginosa PA01
caggccgaccaggaacgcggug

SEQ ID NO: 14864 - RNA, 22 nt, Pseudomonas aeruginosa PA01
caggccgaccgccucgcgcacu

SEQ ID NO: 14865 - RNA, 22 nt, Pseudomonas aeruginosa PA01
caggccgagaccgguguugccg

SEQ ID NO: 14866 - RNA, 22 nt, Pseudomonas aeruginosa PA01
caggccgcucagggucaacgga

SEQ ID NO: 14867 - RNA, 22 nt, Pseudomonas aeruginosa PA01
caggccggcgaggcguggccga

SEQ ID NO: 14868 - RNA, 19 nt, Pseudomonas aeruginosa PA01
cagcagcgggccgcaccug

SEQ ID NO: 14869 - RNA, 22 nt, Pseudomonas aeruginosa PA01
cagcagcucgccgagacggccg

SEQ ID NO: 14870 - RNA, 22 nt, Pseudomonas aeruginosa PA01
cagcuccagcagcccggcgccg

SEQ ID NO: 14871 - RNA, 22 nt, Pseudomonas aeruginosa PA01
cacuggagcagcgccuggaucg

SEQ ID NO: 14872 - RNA, 22 nt, Pseudomonas aeruginosa PA01
cagagccggucgaccgccuggc

SEQ ID NO: 14873 - RNA, 22 nt, Pseudomonas aeruginosa PA01
cagccagauggucggccucacg

SEQ ID NO: 14874 - RNA, 22 nt, Pseudomonas aeruginosa PA01
cagcccgcugaagaugccgcgc

SEQ ID NO: 14875 - RNA, 22 nt, Pseudomonas aeruginosa PA01
cagccggcgcaauggggaggac

SEQ ID NO: 14876 - RNA, 22 nt, Pseudomonas aeruginosa PA01
cagccugaaggacuggccggcg

SEQ ID NO: 14877 - RNA, 22 nt, Pseudomonas aeruginosa PA01
cagcgagcgggaguugcucgcc

SEQ ID NO: 14878 - RNA, 22 nt, Pseudomonas aeruginosa PA01
cagcgcagccaggacgaagagc

SEQ ID NO: 14879 - RNA, 22 nt, Pseudomonas aeruginosa PA01
cagcgccaccccgaggaucgcc

SEQ ID NO: 14880 - RNA, 22 nt, Pseudomonas aeruginosa PA01
cagcgccgccugggccgcgaca

SEQ ID NO: 14881 - RNA, 22 nt, Pseudomonas aeruginosa PA01
cagcgcgguacucgacggcagc

SEQ ID NO: 14882 - RNA, 22 nt, Pseudomonas aeruginosa PA01
cagcggcaacuggcggaggcgg

SEQ ID NO: 14883 - RNA, 22 nt, Pseudomonas aeruginosa PA01
cagcggugggccccacggcugc

SEQ ID NO: 14884 - RNA, 22 nt, Pseudomonas aeruginosa PA01
ugcccggcgacccgcgcggagg

SEQ ID NO: 14885 - RNA, 22 nt, Pseudomonas aeruginosa PA01
ugcgcagcugcgagcugaucug

SEQ ID NO: 14886 - RNA, 22 nt, Pseudomonas aeruginosa PA01
ugccgggaguagcgguucaccc

SEQ ID NO: 14887 - RNA, 22 nt, Pseudomonas aeruginosa PA01
ugccgccgccgaggcuucgcug

SEQ ID NO: 14888 - RNA, 22 nt, Pseudomonas aeruginosa PA01
ugccgccguccgccgagcuggu

SEQ ID NO: 14889 - RNA, 22 nt, Pseudomonas aeruginosa PA01
ugccggagcgcgccgagggcag

SEQ ID NO: 14890 - RNA, 22 nt, Pseudomonas aeruginosa PA01
ugccggagucuucgccugguug

SEQ ID NO: 14891 - RNA, 22 nt, Pseudomonas aeruginosa PA01
ugccggccacaugcucgggggu

SEQ ID NO: 14892 - RNA, 22 nt, Pseudomonas aeruginosa PA01
ugccggccauggccuccacguc

SEQ ID NO: 14893 - RNA, 21 nt, Pseudomonas aeruginosa PA01
ugccggccgccaggugcagga

SEQ ID NO: 14894 - RNA, 22 nt, Pseudomonas aeruginosa PA01
ugccggcgaggucggccaugac

SEQ ID NO: 14895 - RNA, 19 nt, Pseudomonas aeruginosa PA01
ugccggcgagucgaacaug

SEQ ID NO: 14896 - RNA, 22 nt, Pseudomonas aeruginosa PA01
ugccggcgccggagaggccgcu

SEQ ID NO: 14897 - RNA, 22 nt, Pseudomonas aeruginosa PA01
ugccggcggcagcggugccgug

SEQ ID NO: 14898 - RNA, 22 nt, Pseudomonas aeruginosa PA01
ugccggcggggcgcagcccuag

SEQ ID NO: 14899 - RNA, 18 nt, Pseudomonas aeruginosa PA01
ugcuccgggccuauucgc

SEQ ID NO: 14900 - RNA, 22 nt, Pseudomonas aeruginosa PA01
ugcugaagagcgucgagaucca

SEQ ID NO: 14901 - RNA, 22 nt, Pseudomonas aeruginosa PA01
ugcgccccugguucucgaugaa

SEQ ID NO: 14902 - RNA, 22 nt, Pseudomonas aeruginosa PA01
ugcgcgaggugcugccgcagug

SEQ ID NO: 14903 - RNA, 22 nt, Pseudomonas aeruginosa PA01
ugcgguggccccaccagagcug

SEQ ID NO: 14904 - RNA, 22 nt, Pseudomonas aeruginosa PA01
ugcgcgcguagccgguauuccu

SEQ ID NO: 14905 - RNA, 22 nt, Pseudomonas aeruginosa PA01
ugcgcggccgguagccgaaggu

SEQ ID NO: 14906 - RNA, 22 nt, Pseudomonas aeruginosa PA01
ugcgcugguggucgagcagcac

SEQ ID NO: 14907 - RNA, 21 nt, Pseudomonas aeruginosa PA01
ugcggacgauaugcgugcccc

SEQ ID NO: 14908 - RNA, 22 nt, Pseudomonas aeruginosa PA01
ugcggauggucaucgaccuggc

SEQ ID NO: 14909 - RNA, 22 nt, Pseudomonas aeruginosa PA01
ugcggcccggcucggugagggu

SEQ ID NO: 14910 - RNA, 22 nt, Pseudomonas aeruginosa PA01
ugcggcucuucagcccggagag

SEQ ID NO: 14911 - RNA, 22 nt, Pseudomonas aeruginosa PA01
ugaaguacugcagcaucuucuc

SEQ ID NO: 14912 - RNA, 22 nt, Pseudomonas aeruginosa PA01
ugagcgccugcucgcggcugau

SEQ ID NO: 14913 - RNA, 22 nt, Pseudomonas aeruginosa PA01
ugagcgccugcugcgcaccacc

SEQ ID NO: 14914 - RNA, 22 nt, Pseudomonas aeruginosa PA01
ugaugcggguuccgguagggga

SEQ ID NO: 14915 - RNA, 22 nt, Pseudomonas aeruginosa PA01
ugcagcggaucgagcaggccga

SEQ ID NO: 14916 - RNA, 22 nt, Pseudomonas aeruginosa PA01
ugguccucggugccggcgacau

SEQ ID NO: 14917 - RNA, 22 nt, Pseudomonas aeruginosa PA01
ugguccuggcggagcugcccaa

SEQ ID NO: 14918 - RNA, 22 nt, Pseudomonas aeruginosa PA01
ugguccuguucgcccugacccu

SEQ ID NO: 14919 - RNA, 18 nt, Pseudomonas aeruginosa PA01
ugggcgagcggucgucga

SEQ ID NO: 14920 - RNA, 22 nt, Pseudomonas aeruginosa PA01
ugggcgggcacugucaggguca

SEQ ID NO: 14921 - RNA, 23 nt, Pseudomonas aeruginosa PA01
ugcuggaagaagcggcgaugauc

SEQ ID NO: 14922 - RNA, 22 nt, Pseudomonas aeruginosa PA01
ugcuggagaaggacggcgagcg

SEQ ID NO: 14923 - RNA, 22 nt, Pseudomonas aeruginosa PA01
ugcuggagaaugucgcggcugc

SEQ ID NO: 14924 - RNA, 23 nt, Pseudomonas aeruginosa PA01
uggaagauccgcugcgcuuccuu

SEQ ID NO: 14925 - RNA, 23 nt, Pseudomonas aeruginosa PA01
uggaagcgcgguucgccgcuggc

SEQ ID NO: 14926 - RNA, 22 nt, Pseudomonas aeruginosa PA01
uggagcgcggcaacuggcgcgg

SEQ ID NO: 14927 - RNA, 22 nt, Pseudomonas aeruginosa PA01
uggagugcagaaaggcuucgac

SEQ ID NO: 14928 - RNA, 22 nt, Pseudomonas aeruginosa PA01
uggcagcucagggugcucauga

SEQ ID NO: 14929 - RNA, 22 nt, Pseudomonas aeruginosa PA01
uggccgggaucuccaggcugac

SEQ ID NO: 14930 - RNA, 22 nt, Pseudomonas aeruginosa PA01
uggcggagcgccaggcggcguu

SEQ ID NO: 14931 - RNA, 22 nt, Pseudomonas aeruginosa PA01
uggcgaccuucaagcgucggcu

SEQ ID NO: 14932 - RNA, 22 nt, Pseudomonas aeruginosa PA01
uggcgcgcucgaaguaacugaa

SEQ ID NO: 14933 - RNA, 22 nt, Pseudomonas aeruginosa PA01
uggcgcgggcguugagcucggc

SEQ ID NO: 14934 - RNA, 22 nt, Pseudomonas aeruginosa PA01
ucaccggccugggcggcgagug

SEQ ID NO: 14935 - RNA, 22 nt, Pseudomonas aeruginosa PA01
ucaccggcuacgaccugggcau

SEQ ID NO: 14936 - RNA, 22 nt, Pseudomonas aeruginosa PA01
ucaggccggcgcccagggaguc

SEQ ID NO: 14937 - RNA, 22 nt, Pseudomonas aeruginosa PA01
ucagcgccggaucgugcaguug

SEQ ID NO: 14938 - RNA, 22 nt, Pseudomonas aeruginosa PA01
ucccggacgaugucggcacuga

SEQ ID NO: 14939 - RNA, 22 nt, Pseudomonas aeruginosa PA01
ucccggcgcgguccaggcgcgg

SEQ ID NO: 14940 - RNA, 22 nt, Pseudomonas aeruginosa PA01
uccccggucgaugcggaagcuc

SEQ ID NO: 14941 - RNA, 22 nt, Pseudomonas aeruginosa PA01
ucccaggcggucagucgcgagc

SEQ ID NO: 14942 - RNA, 22 nt, Pseudomonas aeruginosa PA01
uccagguagcgcucgaggaagg

SEQ ID NO: 14943 - RNA, 22 nt, Pseudomonas aeruginosa PA01
uacaacuucggccaggaccuga

SEQ ID NO: 14944 - RNA, 22 nt, Pseudomonas aeruginosa PA01
uagcuccagccgaagccuucga

SEQ ID NO: 14945 - RNA, 22 nt, Pseudomonas aeruginosa PA01
uagcccugguucgugcccugca

SEQ ID NO: 14946 - RNA, 22 nt, Pseudomonas aeruginosa PA01
uagcgcgcauucggaucgcccg

SEQ ID NO: 14947 - RNA, 19 nt, Pseudomonas aeruginosa PA01
uauuuccagcgcuacaucc

SEQ ID NO: 14948 - RNA, 22 nt, Pseudomonas aeruginosa PA01
ucgacccggcuuuccgccucgg

SEQ ID NO: 14949 - RNA, 22 nt, Pseudomonas aeruginosa PA01
ucgagcgcuugcgcugaugcag

SEQ ID NO: 14950 - RNA, 22 nt, Pseudomonas aeruginosa PA01
ucgcgcaggucggcgcggguga

SEQ ID NO: 14951 - RNA, 22 nt, Pseudomonas aeruginosa PA01
ucgcgccgaagcgccgggaaug

SEQ ID NO: 14952 - RNA, 22 nt, Pseudomonas aeruginosa PA01
ucgcggcuucgccgugguggcc

SEQ ID NO: 14953 - RNA, 19 nt, Pseudomonas aeruginosa PA01
ucgcugcaacacgucaagc

SEQ ID NO: 14954 - RNA, 22 nt, Pseudomonas aeruginosa PA01
ucggccggcagcucguaggcau

SEQ ID NO: 14955 - RNA, 22 nt, Pseudomonas aeruginosa PA01
ucggccuccuucagcuuggcca

SEQ ID NO: 14956 - RNA, 18 nt, Pseudomonas aeruginosa PA01
ucggcgcgcacucggugg

SEQ ID NO: 14957 - RNA, 23 nt, Pseudomonas aeruginosa PA01
ucggcgcgggacuugagggucgc

SEQ ID NO: 14958 - RNA, 22 nt, Pseudomonas aeruginosa PA01
ucgcccugggcgcggcggaagc

SEQ ID NO: 14959 - RNA, 22 nt, Pseudomonas aeruginosa PA01
ucgccgccgcuacguccuacuu

SEQ ID NO: 14960 - RNA, 19 nt, Pseudomonas aeruginosa PA01
ucgccgccuucgccgcacc

SEQ ID NO: 14961 - RNA, 22 nt, Pseudomonas aeruginosa PA01
ucgccggcaaagucgagggcuu

SEQ ID NO: 14962 - RNA, 22 nt, Pseudomonas aeruginosa PA01
ucgccggcaucugggaggccua

SEQ ID NO: 14963 - RNA, 22 nt, Pseudomonas aeruginosa PA01
ucgccgggaaucggcgugcagc

SEQ ID NO: 14964 - RNA, 22 nt, Pseudomonas aeruginosa PA01
ucgccgggcgccgcugggagug

SEQ ID NO: 14965 - RNA, 22 nt, Pseudomonas aeruginosa PA01
uccugcggcgggccgucaugca

SEQ ID NO: 14966 - RNA, 22 nt, Pseudomonas aeruginosa PA01
uccugcucgaucacggccuggu

SEQ ID NO: 14967 - RNA, 22 nt, Pseudomonas aeruginosa PA01
uccgaucggccugcgccacgau

SEQ ID NO: 14968 - RNA, 22 nt, Pseudomonas aeruginosa PA01
uccgccgcguuccacuccagcg

SEQ ID NO: 14969 - RNA, 22 nt, Pseudomonas aeruginosa PA01
uccgccggcgacagcaguucgg

SEQ ID NO: 14970 - RNA, 22 nt, Pseudomonas aeruginosa PA01
uccggcgggcagccgcugugga

SEQ ID NO: 14971 - RNA, 22 nt, Pseudomonas aeruginosa PA01
ucggucgguugcgccggguagu

SEQ ID NO: 14972 - RNA, 22 nt, Pseudomonas aeruginosa PA01
ucggucucguaggcguagaagc

SEQ ID NO: 14973 - RNA, 22 nt, Pseudomonas aeruginosa PA01
ucgucggcccgcugcaacugcc

SEQ ID NO: 14974 - RNA, 22 nt, Pseudomonas aeruginosa PA01
ucgucggcgaaaugccggucgc

SEQ ID NO: 14975 - RNA, 22 nt, Pseudomonas aeruginosa PA01
ucgucggcgccaacgaccuggu

SEQ ID NO: 14976 - RNA, 22 nt, Pseudomonas aeruginosa PA01
ucucgucgcugcuggcaccgac

SEQ ID NO: 14977 - RNA, 23 nt, Pseudomonas aeruginosa PA01
ucugcaggaagccuggcagcagc

SEQ ID NO: 14978 - RNA, 20 nt, Pseudomonas aeruginosa PA01
ucuccggcgaagagcugcgc

SEQ ID NO: 14979 - RNA, 22 nt, Pseudomonas aeruginosa PA01
ucuccgucgagcggauccaggc

SEQ ID NO: 14980 - RNA, 23 nt, Pseudomonas aeruginosa PA01
ucuugcccuucuucucgacgguc

SEQ ID NO: 14981 - RNA, 22 nt, Pseudomonas aeruginosa PA01
ucuggcucgccaccggccgggu

SEQ ID NO: 14982 - RNA, 23 nt, Pseudomonas aeruginosa PA01
cguccggacgacgacccggcguu

SEQ ID NO: 14983 - RNA, 22 nt, Pseudomonas aeruginosa PA01
cgucgagcagaccaaccgggcg

SEQ ID NO: 14984 - RNA, 22 nt, Pseudomonas aeruginosa PA01
cgucgagccgggcgagggacuc

SEQ ID NO: 14985 - RNA, 22 nt, Pseudomonas aeruginosa PA01
cgucgagcgccgcuucgucagg

SEQ ID NO: 14986 - RNA, 22 nt, Pseudomonas aeruginosa PA01
cgucggccuguggaucgccgcc

SEQ ID NO: 14987 - RNA, 22 nt, Pseudomonas aeruginosa PA01
cgugcagcgggugccggaaacc

SEQ ID NO: 14988 - RNA, 20 nt, Pseudomonas aeruginosa PA01
cucaggccuggagccgagcg

SEQ ID NO: 14989 - RNA, 22 nt, Pseudomonas aeruginosa PA01
cucaggcuggcagcgacgcucc

SEQ ID NO: 14990 - RNA, 20 nt, Pseudomonas aeruginosa PA01
cuccccgggccauuuccugc

SEQ ID NO: 14991 - RNA, 22 nt, Pseudomonas aeruginosa PA01
cucccggcgaaggcgcgaucgu

SEQ ID NO: 14992 - RNA, 23 nt, Pseudomonas aeruginosa PA01
cucugcuucggcuucuggcccgg

SEQ ID NO: 14993 - RNA, 22 nt, Pseudomonas aeruginosa PA01
cucuucuucguugaucggcgag

SEQ ID NO: 14994 - RNA, 19 nt, Pseudomonas aeruginosa PA01
cucggcccgcuguggcucg

SEQ ID NO: 14995 - RNA, 22 nt, Pseudomonas aeruginosa PA01
cucggcccuggugauccucgcc

SEQ ID NO: 14996 - RNA, 22 nt, Pseudomonas aeruginosa PA01
cucggucagguagccgccuucc

SEQ ID NO: 14997 - RNA, 20 nt, Pseudomonas aeruginosa PA01
cucuacaucgccuucggcgc

SEQ ID NO: 14998 - RNA, 22 nt, Pseudomonas aeruginosa PA01
cuccuucuaucuuggucuacac

SEQ ID NO: 14999 - RNA, 22 nt, Pseudomonas aeruginosa PA01
cuccggccaaccgccacggauc

SEQ ID NO: 15000 - RNA, 22 nt, Pseudomonas aeruginosa PA01
cuccggcgugaucagggucucg

SEQ ID NO: 15001 - RNA, 22 nt, Pseudomonas aeruginosa PA01
cuccggcuucggcgagcagagc

SEQ ID NO: 15002 - RNA, 22 nt, Pseudomonas aeruginosa PA01
cuccugcggcaugggugcguuc

SEQ ID NO: 15003 - RNA, 22 nt, Pseudomonas aeruginosa PA01
cgggcgaggguaccgggagcua

SEQ ID NO: 15004 - RNA, 22 nt, Pseudomonas aeruginosa PA01
cgggcgccgggugcucccgguc

SEQ ID NO: 15005 - RNA, 22 nt, Pseudomonas aeruginosa PA01
cgggcgccguggaucagccgcg

SEQ ID NO: 15006 - RNA, 22 nt, Pseudomonas aeruginosa PA01
cggggagccucgucgacgaggc

SEQ ID NO: 15007 - RNA, 22 nt, Pseudomonas aeruginosa PA01
cggggcaagcuguccggaccgc

SEQ ID NO: 15008 - RNA, 22 nt, Pseudomonas aeruginosa PA01
cggguggucuucgagcguccgc

SEQ ID NO: 15009 - RNA, 22 nt, Pseudomonas aeruginosa PA01
cggucgcgcagggcagccggca

SEQ ID NO: 15010 - RNA, 22 nt, Pseudomonas aeruginosa PA01
cggucggcuggcuggcgcugcc

SEQ ID NO: 15011 - RNA, 22 nt, Pseudomonas aeruginosa PA01
cggucucuggugaucagcggcu

SEQ ID NO: 15012 - RNA, 22 nt, Pseudomonas aeruginosa PA01
cggugcaggcguuccgcgagcg

SEQ ID NO: 15013 - RNA, 22 nt, Pseudomonas aeruginosa PA01
cggugcgccugccguuccugau

SEQ ID NO: 15014 - RNA, 23 nt, Pseudomonas aeruginosa PA01
cggugggcgccggccauggccuc

SEQ ID NO: 15015 - RNA, 22 nt, Pseudomonas aeruginosa PA01
cggcugcugcgggucggccuug

SEQ ID NO: 15016 - RNA, 22 nt, Pseudomonas aeruginosa PA01
cggcuggaucucgcacuggcag

SEQ ID NO: 15017 - RNA, 22 nt, Pseudomonas aeruginosa PA01
cggcuguucgucgccggcggug

SEQ ID NO: 15018 - RNA, 22 nt, Pseudomonas aeruginosa PA01
cggcucccggcuggccgcugaa

SEQ ID NO: 15019 - RNA, 22 nt, Pseudomonas aeruginosa PA01
cggcucuggcuaagcucgaccu

SEQ ID NO: 15020 - RNA, 22 nt, Pseudomonas aeruginosa PA01
cggaggcguggguuucgcauuc

SEQ ID NO: 15021 - RNA, 22 nt, Pseudomonas aeruginosa PA01
cggaucuucuccaucgccgcuu

SEQ ID NO: 15022 - RNA, 22 nt, Pseudomonas aeruginosa PA01
cggcgaccacguugggguucuc

SEQ ID NO: 15023 - RNA, 22 nt, Pseudomonas aeruginosa PA01
cggcgacgaucaucuucggcuu

SEQ ID NO: 15024 - RNA, 22 nt, Pseudomonas aeruginosa PA01
cggcgagcaacgccaggugcag

SEQ ID NO: 15025 - RNA, 22 nt, Pseudomonas aeruginosa PA01
cggcgaggaucugcguggucgc

SEQ ID NO: 15026 - RNA, 22 nt, Pseudomonas aeruginosa PA01
cggcgcaggguauggcgguuca

SEQ ID NO: 15027 - RNA, 22 nt, Pseudomonas aeruginosa PA01
cggcgccaacgaggcggcgaug

SEQ ID NO: 15028 - RNA, 22 nt, Pseudomonas aeruginosa PA01
cggcgcgcuggugaucggcugg

SEQ ID NO: 15029 - RNA, 23 nt, Pseudomonas aeruginosa PA01
cggcgcuuccugcaccuggcgcc

SEQ ID NO: 15030 - RNA, 22 nt, Pseudomonas aeruginosa PA01
cggcgggcauagccgagcagcg

SEQ ID NO: 15031 - RNA, 22 nt, Pseudomonas aeruginosa PA01
cggcguacgcuggaggcgaugc

SEQ ID NO: 15032 - RNA, 22 nt, Pseudomonas aeruginosa PA01
gaccaggccgggcaacugcgcg

SEQ ID NO: 15033 - RNA, 22 nt, Pseudomonas aeruginosa PA01
gaccaggccggugaguccgccc

SEQ ID NO: 15034 - RNA, 22 nt, Pseudomonas aeruginosa PA01
gacagcgccuggcgcgcggauu

SEQ ID NO: 15035 - RNA, 22 nt, Pseudomonas aeruginosa PA01
gacagcggacgauaggcgagca

SEQ ID NO: 15036 - RNA, 23 nt, Pseudomonas aeruginosa PA01
gacagcuggaucgcgcccagcgc

SEQ ID NO: 15037 - RNA, 22 nt, Pseudomonas aeruginosa PA01
gaagcgagugucgccgccgacg

SEQ ID NO: 15038 - RNA, 22 nt, Pseudomonas aeruginosa PA01
gaagaugcugcccuccaccgcg

SEQ ID NO: 15039 - RNA, 22 nt, Pseudomonas aeruginosa PA01
gaagugggcugggccguugguc

SEQ ID NO: 15040 - RNA, 22 nt, Pseudomonas aeruginosa PA01
cugccccggcgcggcugagcau

SEQ ID NO: 15041 - RNA, 22 nt, Pseudomonas aeruginosa PA01
cugcaggccgaucucgcggauc

SEQ ID NO: 15042 - RNA, 22 nt, Pseudomonas aeruginosa PA01
cugcuuucgaagcgcucgcgcc

SEQ ID NO: 15043 - RNA, 22 nt, Pseudomonas aeruginosa PA01
cuggaaggcgagcaucuucaug

SEQ ID NO: 15044 - RNA, 22 nt, Pseudomonas aeruginosa PA01
cuggaagucggcguggugcaug

SEQ ID NO: 15045 - RNA, 22 nt, Pseudomonas aeruginosa PA01
cuggacgcccaugcggacgccc

SEQ ID NO: 15046 - RNA, 22 nt, Pseudomonas aeruginosa PA01
cugcccgggagcggugcgcucg

SEQ ID NO: 15047 - RNA, 22 nt, Pseudomonas aeruginosa PA01
cugccggccaggcggguguuca

SEQ ID NO: 15048 - RNA, 22 nt, Pseudomonas aeruginosa PA01
cugccggcgcaguccugcaugg

SEQ ID NO: 15049 - RNA, 22 nt, Pseudomonas aeruginosa PA01
cugccggcggauggcggguugc

SEQ ID NO: 15050 - RNA, 22 nt, Pseudomonas aeruginosa PA01
cugcgaggcgauccauccgggc

SEQ ID NO: 15051 - RNA, 22 nt, Pseudomonas aeruginosa PA01
cugcggcggaugggccggcuga

SEQ ID NO: 15052 - RNA, 22 nt, Pseudomonas aeruginosa PA01
cugggcgaucagcggccgcagg

SEQ ID NO: 15053 - RNA, 18 nt, Pseudomonas aeruginosa PA01
cuggccggaggcgaucga

SEQ ID NO: 15054 - RNA, 22 nt, Pseudomonas aeruginosa PA01
cuggcggccguagccgagguug

SEQ ID NO: 15055 - RNA, 22 nt, Pseudomonas aeruginosa PA01
cuggauuuuuugccggaaagcc

SEQ ID NO: 15056 - RNA, 21 nt, Pseudomonas aeruginosa PA01
gccauccguucucgcggcgcu

SEQ ID NO: 15057 - RNA, 22 nt, Pseudomonas aeruginosa PA01
gcccacggcgcugccacagaag

SEQ ID NO: 15058 - RNA, 22 nt, Pseudomonas aeruginosa PA01
gcccaggcccuggcgcgggcuc

SEQ ID NO: 15059 - RNA, 22 nt, Pseudomonas aeruginosa PA01
gcccagggacagcccgggcgua

SEQ ID NO: 15060 - RNA, 22 nt, Pseudomonas aeruginosa PA01
gccaggccugcuacccgcuggc

SEQ ID NO: 15061 - RNA, 22 nt, Pseudomonas aeruginosa PA01
gccaggccugcucguguuccgg

SEQ ID NO: 15062 - RNA, 22 nt, Pseudomonas aeruginosa PA01
gccaggggcugcgccgcucagg

SEQ ID NO: 15063 - RNA, 22 nt, Pseudomonas aeruginosa PA01
gccagccugcucgcuggcgagc

SEQ ID NO: 15064 - RNA, 22 nt, Pseudomonas aeruginosa PA01
gccagcgcguccgggucauggg

SEQ ID NO: 15065 - RNA, 22 nt, Pseudomonas aeruginosa PA01
gccaggccaccgcgcucaacca

SEQ ID NO: 15066 - RNA, 22 nt, Pseudomonas aeruginosa PA01
gccaggccuaugccgcguacca

SEQ ID NO: 15067 - RNA, 22 nt, Pseudomonas aeruginosa PA01
gccccgcgggaggacggcugcu

SEQ ID NO: 15068 - RNA, 22 nt, Pseudomonas aeruginosa PA01
gccccucgcggaucucggcgau

SEQ ID NO: 15069 - RNA, 20 nt, Pseudomonas aeruginosa PA01
gcccggccgcuguggcugcg

SEQ ID NO: 15070 - RNA, 22 nt, Pseudomonas aeruginosa PA01
gcccggcgaagucucgcggccg

SEQ ID NO: 15071 - RNA, 22 nt, Pseudomonas aeruginosa PA01
gcccggcuucccggcggaaagu

SEQ ID NO: 15072 - RNA, 22 nt, Pseudomonas aeruginosa PA01
gcccgucguagccggcggcgug

SEQ ID NO: 15073 - RNA, 21 nt, Pseudomonas aeruginosa PA01
gccgcacgcugcccuccaggc

SEQ ID NO: 15074 - RNA, 22 nt, Pseudomonas aeruginosa PA01
gccgagcgagaacguuccgccg

SEQ ID NO: 15075 - RNA, 21 nt, Pseudomonas aeruginosa PA01
gccgagcgauucggcgggagg

SEQ ID NO: 15076 - RNA, 22 nt, Pseudomonas aeruginosa PA01
gccgcacacgcccagcagcgau

SEQ ID NO: 15077 - RNA, 18 nt, Pseudomonas aeruginosa PA01
gccagcagcgguucggcc

SEQ ID NO: 15078 - RNA, 19 nt, Pseudomonas aeruginosa PA01
gcaguucagcgacaacccg

SEQ ID NO: 15079 - RNA, 22 nt, Pseudomonas aeruginosa PA01
gcaucgcgaccuuccgcgugga

SEQ ID NO: 15080 - RNA, 22 nt, Pseudomonas aeruginosa PA01
gccacuccucguuccaggcuga

SEQ ID NO: 15081 - RNA, 22 nt, Pseudomonas aeruginosa PA01
gcagcucgaccaggccgggcag

SEQ ID NO: 15082 - RNA, 22 nt, Pseudomonas aeruginosa PA01
gcagcuggaaguugucaacgaa

SEQ ID NO: 15083 - RNA, 22 nt, Pseudomonas aeruginosa PA01
gcagcgccaguugcuggacacc

SEQ ID NO: 15084 - RNA, 19 nt, Pseudomonas aeruginosa PA01
gcagcgucggcgugcccgg

SEQ ID NO: 15085 - RNA, 22 nt, Pseudomonas aeruginosa PA01
gcaggccggcgagguuggcggu

SEQ ID NO: 15086 - RNA, 22 nt, Pseudomonas aeruginosa PA01
gcaggcgauccuggagcggcgc

SEQ ID NO: 15087 - RNA, 22 nt, Pseudomonas aeruginosa PA01
gcaggcgcgccaggugcagcga

SEQ ID NO: 15088 - RNA, 22 nt, Pseudomonas aeruginosa PA01
gcaggcgcgccgggcccugcuc

SEQ ID NO: 15089 - RNA, 22 nt, Pseudomonas aeruginosa PA01
gcagucuucagcaugccgcguc

SEQ ID NO: 15090 - RNA, 22 nt, Pseudomonas aeruginosa PA01
gcagaugguugucggccugggc

SEQ ID NO: 15091 - RNA, 22 nt, Pseudomonas aeruginosa PA01
gcagcagggcgaggaucgcccg

SEQ ID NO: 15092 - RNA, 22 nt, Pseudomonas aeruginosa PA01
gacgcaggcaugcgggcgcugc

SEQ ID NO: 15093 - RNA, 22 nt, Pseudomonas aeruginosa PA01
gacgagcugauggucagccgca

SEQ ID NO: 15094 - RNA, 22 nt, Pseudomonas aeruginosa PA01
gacgaggacgaggaugucgagg

SEQ ID NO: 15095 - RNA, 22 nt, Pseudomonas aeruginosa PA01
gacccgccgcgaugcgcuggua

SEQ ID NO: 15096 - RNA, 22 nt, Pseudomonas aeruginosa PA01
gagagcgccaugccacugccca

SEQ ID NO: 15097 - RNA, 22 nt, Pseudomonas aeruginosa PA01
gagcuggaagcugcgcuggucg

SEQ ID NO: 15098 - RNA, 22 nt, Pseudomonas aeruginosa PA01
gagcuggaagugcucgcggugc

SEQ ID NO: 15099 - RNA, 22 nt, Pseudomonas aeruginosa PA01
gagcuggagaaccucggccugc

SEQ ID NO: 15100 - RNA, 22 nt, Pseudomonas aeruginosa PA01
gagcuggaugccgcgcagugcc

SEQ ID NO: 15101 - RNA, 22 nt, Pseudomonas aeruginosa PA01
gaggaaguggccagcgcgcugg

SEQ ID NO: 15102 - RNA, 22 nt, Pseudomonas aeruginosa PA01
gagcacuacacgaagcggcgcc

SEQ ID NO: 15103 - RNA, 21 nt, Pseudomonas aeruginosa PA01
gagcagcucgggcggcgcgac

SEQ ID NO: 15104 - RNA, 22 nt, Pseudomonas aeruginosa PA01
gagcaggccgcucuccucgccg

SEQ ID NO: 15105 - RNA, 22 nt, Pseudomonas aeruginosa PA01
gagcaggccguugccggacagu

SEQ ID NO: 15106 - RNA, 20 nt, Pseudomonas aeruginosa PA01
gagccggccgcggucgucgc

SEQ ID NO: 15107 - RNA, 22 nt, Pseudomonas aeruginosa PA01
gagcgccaggugauccucggca

SEQ ID NO: 15108 - RNA, 22 nt, Pseudomonas aeruginosa PA01
gagcgccaugcgccaggcggcc

SEQ ID NO: 15109 - RNA, 22 nt, Pseudomonas aeruginosa PA01
gagcgccugcaggcgccgcugg

SEQ ID NO: 15110 - RNA, 22 nt, Pseudomonas aeruginosa PA01
gagcgcgagguggagcgggucg

SEQ ID NO: 15111 - RNA, 22 nt, Pseudomonas aeruginosa PA01
gagcgcgccaccgccagcuuca

SEQ ID NO: 15112 - RNA, 22 nt, Pseudomonas aeruginosa PA01
gagcgcugcaagccggcgaguc

SEQ ID NO: 15113 - RNA, 19 nt, Pseudomonas aeruginosa PA01
gaugggcgaggcggaagcc

SEQ ID NO: 15114 - RNA, 22 nt, Pseudomonas aeruginosa PA01
gauggcggauguugccgacgcu

SEQ ID NO: 15115 - RNA, 22 nt, Pseudomonas aeruginosa PA01
gauggcggccagggccaguggc

SEQ ID NO: 15116 - RNA, 22 nt, Pseudomonas aeruginosa PA01
gaggugacacuucuccagcauu

SEQ ID NO: 15117 - RNA, 22 nt, Pseudomonas aeruginosa PA01
gaugcuggcgaaguagccgcug

SEQ ID NO: 15118 - RNA, 22 nt, Pseudomonas aeruginosa PA01
gaugcuggucgcgcggagucac

SEQ ID NO: 15119 - RNA, 22 nt, Pseudomonas aeruginosa PA01
gauggagcaggugcgcgauggc

SEQ ID NO: 15120 - RNA, 22 nt, Pseudomonas aeruginosa PA01
gaggccccgggccggcggaacg

SEQ ID NO: 15121 - RNA, 22 nt, Pseudomonas aeruginosa PA01
gaggcgccacucggcagccugc

SEQ ID NO: 15122 - RNA, 22 nt, Pseudomonas aeruginosa PA01
gaggcgcggaucgaguucauca

SEQ ID NO: 15123 - RNA, 22 nt, Pseudomonas aeruginosa PA01
gaggaugcgcugcggcuucucg

SEQ ID NO: 15124 - RNA, 22 nt, Pseudomonas aeruginosa PA01
gaggcaguucaccuggcgguug

SEQ ID NO: 15125 - RNA, 22 nt, Pseudomonas aeruginosa PA01
gagggccgggugaucagcgucg

SEQ ID NO: 15126 - RNA, 22 nt, Pseudomonas aeruginosa PA01
ccagccggcgaggcuccagcgg

SEQ ID NO: 15127 - RNA, 22 nt, Pseudomonas aeruginosa PA01
ccaggccgccagccguucggcc

SEQ ID NO: 15128 - RNA, 22 nt, Pseudomonas aeruginosa PA01
ccaggccgccgacguagcgauc

SEQ ID NO: 15129 - RNA, 22 nt, Pseudomonas aeruginosa PA01
ccaggccgucgacggcgcucug

SEQ ID NO: 15130 - RNA, 22 nt, Pseudomonas aeruginosa PA01
ccagccugcacggcggccagga

SEQ ID NO: 15131 - RNA, 22 nt, Pseudomonas aeruginosa PA01
ccagcgccagcaggcguugcag

SEQ ID NO: 15132 - RNA, 22 nt, Pseudomonas aeruginosa PA01
ccagcgccagucgcugcucgcc

SEQ ID NO: 15133 - RNA, 22 nt, Pseudomonas aeruginosa PA01
ccagcgccgacgggcucgacau

SEQ ID NO: 15134 - RNA, 22 nt, Pseudomonas aeruginosa PA01
ccagcgccuggaccuccaggcc

SEQ ID NO: 15135 - RNA, 22 nt, Pseudomonas aeruginosa PA01
ccagcgcggcggccaccaggcg

SEQ ID NO: 15136 - RNA, 22 nt, Pseudomonas aeruginosa PA01
ccagcggccgcaaccagggcga

SEQ ID NO: 15137 - RNA, 22 nt, Pseudomonas aeruginosa PA01
cccagcucgacaucccggcgcu

SEQ ID NO: 15138 - RNA, 22 nt, Pseudomonas aeruginosa PA01
cccagggcgccuucgacgaccc

SEQ ID NO: 15139 - RNA, 22 nt, Pseudomonas aeruginosa PA01
cccacgaggcggccgaggcggc

SEQ ID NO: 15140 - RNA, 21 nt, Pseudomonas aeruginosa PA01
cccacggcuaccugaucgacc

SEQ ID NO: 15141 - RNA, 22 nt, Pseudomonas aeruginosa PA01
ccaggcuccgcgcggugccgag

SEQ ID NO: 15142 - RNA, 22 nt, Pseudomonas aeruginosa PA01
ccaggcucgcggaugcgcgcag

SEQ ID NO: 15143 - RNA, 22 nt, Pseudomonas aeruginosa PA01
ccagggcaucgagacuuccggc

SEQ ID NO: 15144 - RNA, 22 nt, Pseudomonas aeruginosa PA01
ccagggccggcagcagccagag

SEQ ID NO: 15145 - RNA, 21 nt, Pseudomonas aeruginosa PA01
ccgagcaguuucucgaggcgc

SEQ ID NO: 15146 - RNA, 19 nt, Pseudomonas aeruginosa PA01
ccgagccgccgacgugguu

SEQ ID NO: 15147 - RNA, 21 nt, Pseudomonas aeruginosa PA01
ccgagcgcaaggggcgcgagc

SEQ ID NO: 15148 - RNA, 22 nt, Pseudomonas aeruginosa PA01
ccgagcgcgcccucgaacugau

SEQ ID NO: 15149 - RNA, 22 nt, Pseudomonas aeruginosa PA01
ccgagcgcuucgcccaugucgg

SEQ ID NO: 15150 - RNA, 22 nt, Pseudomonas aeruginosa PA01
cccgccugggugcccuggcuga

SEQ ID NO: 15151 - RNA, 22 nt, Pseudomonas aeruginosa PA01
cccgcgacuggaauccgcgaac

SEQ ID NO: 15152 - RNA, 22 nt, Pseudomonas aeruginosa PA01
cccgcgccacgaggaacgcgug

SEQ ID NO: 15153 - RNA, 21 nt, Pseudomonas aeruginosa PA01
cccggccgagagcgggcagga

SEQ ID NO: 15154 - RNA, 22 nt, Pseudomonas aeruginosa PA01
cccggccgccaccgucgagcag

SEQ ID NO: 15155 - RNA, 22 nt, Pseudomonas aeruginosa PA01
cccggccugccuggacgcgcug

SEQ ID NO: 15156 - RNA, 22 nt, Pseudomonas aeruginosa PA01
cccggcgcagaugcgcgucgau

SEQ ID NO: 15157 - RNA, 22 nt, Pseudomonas aeruginosa PA01
cccggcguugaucccgcgggcg

SEQ ID NO: 15158 - RNA, 22 nt, Pseudomonas aeruginosa PA01
cccggcucugcucggcgugggc

SEQ ID NO: 15159 - RNA, 20 nt, Pseudomonas aeruginosa PA01
ccggccgaagugcucgcggu

SEQ ID NO: 15160 - RNA, 22 nt, Pseudomonas aeruginosa PA01
ccggccgaggcgccggaccagg

SEQ ID NO: 15161 - RNA, 22 nt, Pseudomonas aeruginosa PA01
ccggccggguuuccuggguaug

SEQ ID NO: 15162 - RNA, 22 nt, Pseudomonas aeruginosa PA01
ccggccugcggcgcuuccacga

SEQ ID NO: 15163 - RNA, 22 nt, Pseudomonas aeruginosa PA01
ccggccuggcgccggcuucggc

SEQ ID NO: 15164 - RNA, 22 nt, Pseudomonas aeruginosa PA01
ccggccuuggccagcggcgcac

SEQ ID NO: 15165 - RNA, 23 nt, Pseudomonas aeruginosa PA01
ccggcgacacccucuacgugguc

SEQ ID NO: 15166 - RNA, 22 nt, Pseudomonas aeruginosa PA01
ccggcgacgugcugcgccuucu

SEQ ID NO: 15167 - RNA, 22 nt, Pseudomonas aeruginosa PA01
ccggcgauuuccucgccggcgu

SEQ ID NO: 15168 - RNA, 22 nt, Pseudomonas aeruginosa PA01
ccggcgcgccagaacucgaccg

SEQ ID NO: 15169 - RNA, 23 nt, Pseudomonas aeruginosa PA01
ccggcggcgaccuggcgguucug

SEQ ID NO: 15170 - RNA, 22 nt, Pseudomonas aeruginosa PA01
ccggcgucaauggccucgaggc

SEQ ID NO: 15171 - RNA, 20 nt, Pseudomonas aeruginosa PA01
ccggcgucgaaguucggcag

SEQ ID NO: 15172 - RNA, 22 nt, Pseudomonas aeruginosa PA01
ccggcuaccagguuccggcgcg

SEQ ID NO: 15173 - RNA, 22 nt, Pseudomonas aeruginosa PA01
ccggcuccgccgguugcggcau

SEQ ID NO: 15174 - RNA, 22 nt, Pseudomonas aeruginosa PA01
ccggcucggcgacgccgaggua

SEQ ID NO: 15175 - RNA, 22 nt, Pseudomonas aeruginosa PA01
ccggcuucggcgucuucucgcu

SEQ ID NO: 15176 - RNA, 22 nt, Pseudomonas aeruginosa PA01
ccgggcaguucggccucggcug

SEQ ID NO: 15177 - RNA, 22 nt, Pseudomonas aeruginosa PA01
ccgggcgcccggacgugcagcg

SEQ ID NO: 15178 - RNA, 22 nt, Pseudomonas aeruginosa PA01
caggggcaggcugucgcggaag

SEQ ID NO: 15179 - RNA, 22 nt, Pseudomonas aeruginosa PA01
caggcgcggaugcggcccagcg

SEQ ID NO: 15180 - RNA, 22 nt, Pseudomonas aeruginosa PA01
caggcuggcguugcccuugccg

SEQ ID NO: 15181 - RNA, 22 nt, Pseudomonas aeruginosa PA01
cagggccgccuuggccucgcgc

SEQ ID NO: 15182 - RNA, 22 nt, Pseudomonas aeruginosa PA01
cagggccggcauuuccccgagc

SEQ ID NO: 15183 - RNA, 22 nt, Pseudomonas aeruginosa PA01
cagcuggagcagaugaaagccu

SEQ ID NO: 15184 - RNA, 22 nt, Pseudomonas aeruginosa PA01
cagcucggcaggcuuuccggca

SEQ ID NO: 15185 - RNA, 22 nt, Pseudomonas aeruginosa PA01
ccagaacugcuuggagaucucg

SEQ ID NO: 15186 - RNA, 22 nt, Pseudomonas aeruginosa PA01
ccagcagcgaugcgcccagcag

SEQ ID NO: 15187 - RNA, 22 nt, Pseudomonas aeruginosa PA01
ccagcagggucuucagcaguuc

SEQ ID NO: 15188 - RNA, 22 nt, Pseudomonas aeruginosa PA01
caugcuugccgguuuguugcag

SEQ ID NO: 15189 - RNA, 22 nt, Pseudomonas aeruginosa PA01
cgaagcgccugggcugccgcca

SEQ ID NO: 15190 - RNA, 22 nt, Pseudomonas aeruginosa PA01
ccucuucuggcuggaggcgcgc

SEQ ID NO: 15191 - RNA, 22 nt, Pseudomonas aeruginosa PA01
ccguuggcggcgucggugguga

SEQ ID NO: 15192 - RNA, 22 nt, Pseudomonas aeruginosa PA01
ccugccggcggcgcuggucgaa

SEQ ID NO: 15193 - RNA, 23 nt, Pseudomonas aeruginosa PA01
ccugcgacuaccugcaacgccuc

SEQ ID NO: 15194 - RNA, 22 nt, Pseudomonas aeruginosa PA01
ccugcgccugucggccggcgcc

SEQ ID NO: 15195 - RNA, 22 nt, Pseudomonas aeruginosa PA01
ccuggaagugcuguuccuggac

SEQ ID NO: 15196 - RNA, 22 nt, Pseudomonas aeruginosa PA01
ccccggcugcggcagcggcgga

SEQ ID NO: 15197 - RNA, 22 nt, Pseudomonas aeruginosa PA01
ccgagggcaucgacugccaggg

SEQ ID NO: 15198 - RNA, 22 nt, Pseudomonas aeruginosa PA01
ccgcagaggucccucggcgcuu

SEQ ID NO: 15199 - RNA, 22 nt, Pseudomonas aeruginosa PA01
ccgcagccacagcggccgggca

SEQ ID NO: 15200 - RNA, 22 nt, Pseudomonas aeruginosa PA01
ccgcagccuggcgaucgaagcg

SEQ ID NO: 15201 - RNA, 22 nt, Pseudomonas aeruginosa PA01
ccgccacccugagcgcgcugau

SEQ ID NO: 15202 - RNA, 22 nt, Pseudomonas aeruginosa PA01
ccgccccgccuccugggaccag

SEQ ID NO: 15203 - RNA, 22 nt, Pseudomonas aeruginosa PA01
ccgccccgcucugcgccaacgg

SEQ ID NO: 15204 - RNA, 22 nt, Pseudomonas aeruginosa PA01
ccgccccggcugcucagcgugc

SEQ ID NO: 15205 - RNA, 22 nt, Pseudomonas aeruginosa PA01
ccgcccugguccugcugccguu

SEQ ID NO: 15206 - RNA, 22 nt, Pseudomonas aeruginosa PA01
ccgccucgacgaagccgcgcag

SEQ ID NO: 15207 - RNA, 22 nt, Pseudomonas aeruginosa PA01
ccgcgcagaucccccggcuggc

SEQ ID NO: 15208 - RNA, 21 nt, Pseudomonas aeruginosa PA01
ccgcgccuggaccgcgccggg

SEQ ID NO: 15209 - RNA, 22 nt, Pseudomonas aeruginosa PA01
ccgcggagcccggucgggcgcu

SEQ ID NO: 15210 - RNA, 23 nt, Pseudomonas aeruginosa PA01
ccgcggccugcaauucuuccagc

SEQ ID NO: 15211 - RNA, 22 nt, Pseudomonas aeruginosa PA01
ccggagccggcuugccguggac

SEQ ID NO: 15212 - RNA, 18 nt, Pseudomonas aeruginosa PA01
ccggagccugugucggcc

SEQ ID NO: 15213 - RNA, 22 nt, Pseudomonas aeruginosa PA01
ccggagcgggaggucagaccuu

SEQ ID NO: 15214 - RNA, 18 nt, Pseudomonas aeruginosa PA01
cgcagcagacgcaguugc

SEQ ID NO: 15215 - RNA, 22 nt, Pseudomonas aeruginosa PA01
cgcagcgccaggcgcugggcuu

SEQ ID NO: 15216 - RNA, 22 nt, Pseudomonas aeruginosa PA01
cgccaccacccgccgcugcauc

SEQ ID NO: 15217 - RNA, 21 nt, Pseudomonas aeruginosa PA01
cgccaccaguuguucgugacc

SEQ ID NO: 15218 - RNA, 22 nt, Pseudomonas aeruginosa PA01
cgccaccaugaucaagccuucc

SEQ ID NO: 15219 - RNA, 22 nt, Pseudomonas aeruginosa PA01
cgcccagcucggugccgauggc

SEQ ID NO: 15220 - RNA, 22 nt, Pseudomonas aeruginosa PA01
cgccccacuggcgccgcucgaa

SEQ ID NO: 15221 - RNA, 22 nt, Pseudomonas aeruginosa PA01
cgccagccgcgcucguagaacg

SEQ ID NO: 15222 - RNA, 22 nt, Pseudomonas aeruginosa PA01
cgccaccuggcuggugccgcgc

SEQ ID NO: 15223 - RNA, 22 nt, Pseudomonas aeruginosa PA01
cgacccggugauacacggcgaa

SEQ ID NO: 15224 - RNA, 17 nt, Pseudomonas aeruginosa PA01
cgacgcaggucgccauc

SEQ ID NO: 15225 - RNA, 22 nt, Pseudomonas aeruginosa PA01
cgacgccccggugcucuucccg

SEQ ID NO: 15226 - RNA, 22 nt, Pseudomonas aeruginosa PA01
cgagcagcaggcgcacaggaug

SEQ ID NO: 15227 - RNA, 22 nt, Pseudomonas aeruginosa PA01
cgagcgcaggaacagggucagg

SEQ ID NO: 15228 - RNA, 22 nt, Pseudomonas aeruginosa PA01
cgagcgcgagcagcgccuggaa

SEQ ID NO: 15229 - RNA, 22 nt, Pseudomonas aeruginosa PA01
cgaggccggcguggcgaaguag

SEQ ID NO: 15230 - RNA, 22 nt, Pseudomonas aeruginosa PA01
cgaggccgggccgaagcaggug

SEQ ID NO: 15231 - RNA, 22 nt, Pseudomonas aeruginosa PA01
cgaugcgggcgccacucucgau

SEQ ID NO: 15232 - RNA, 21 nt, Pseudomonas aeruginosa PA01
cgcaagcggcaucgccaucag

SEQ ID NO: 15233 - RNA, 22 nt, Pseudomonas aeruginosa PA01
cgagggccugauggcgacgcug

SEQ ID NO: 15234 - RNA, 22 nt, Pseudomonas aeruginosa PA01
cgagggccuggcgccggagguc

SEQ ID NO: 15235 - RNA, 22 nt, Pseudomonas aeruginosa PA01
cgaucagguugaggcggcccgg

SEQ ID NO: 15236 - RNA, 22 nt, Pseudomonas aeruginosa PA01
cgauccgggcuggcugcaggug

SEQ ID NO: 15237 - RNA, 22 nt, Pseudomonas aeruginosa PA01
cgccugggcgaacucgccccgc

SEQ ID NO: 15238 - RNA, 22 nt, Pseudomonas aeruginosa PA01
cgccugggcgcgguguaccagc

SEQ ID NO: 15239 - RNA, 22 nt, Pseudomonas aeruginosa PA01
cgccccagcucuucgcgcaggu

SEQ ID NO: 15240 - RNA, 22 nt, Pseudomonas aeruginosa PA01
cgcccuggcggggccgcgacuu

SEQ ID NO: 15241 - RNA, 22 nt, Pseudomonas aeruginosa PA01
cgccgaccgccuccaggcaacg

SEQ ID NO: 15242 - RNA, 22 nt, Pseudomonas aeruginosa PA01
cgccgagcugaagcuguaggau

SEQ ID NO: 15243 - RNA, 20 nt, Pseudomonas aeruginosa PA01
cgccgcagccgcuggacggc

SEQ ID NO: 15244 - RNA, 22 nt, Pseudomonas aeruginosa PA01
cgccgccgccaucgagcagaac

SEQ ID NO: 15245 - RNA, 17 nt, Pseudomonas aeruginosa PA01
cgccgccggcgcagaag

SEQ ID NO: 15246 - RNA, 17 nt, Pseudomonas aeruginosa PA01
cgccgccggggcggaag

SEQ ID NO: 15247 - RNA, 22 nt, Pseudomonas aeruginosa PA01
cgccggccaucagcgcuaccgc

SEQ ID NO: 15248 - RNA, 22 nt, Pseudomonas aeruginosa PA01
cgccggccgccgaggucgccaa

SEQ ID NO: 15249 - RNA, 22 nt, Pseudomonas aeruginosa PA01
cgccggccggcuggguauucgc

SEQ ID NO: 15250 - RNA, 22 nt, Pseudomonas aeruginosa PA01
cgccggcgccgaggcaggcacc

SEQ ID NO: 15251 - RNA, 22 nt, Pseudomonas aeruginosa PA01
cgccggcgcuguuguccaggcu

SEQ ID NO: 15252 - RNA, 23 nt, Pseudomonas aeruginosa PA01
cgcgcuccagcaggucggccaug

SEQ ID NO: 15253 - RNA, 22 nt, Pseudomonas aeruginosa PA01
cgcgcucgcgguaagguaugcc

SEQ ID NO: 15254 - RNA, 22 nt, Pseudomonas aeruginosa PA01
cgcgcucggaacccgguuuggc

SEQ ID NO: 15255 - RNA, 22 nt, Pseudomonas aeruginosa PA01
cgcggaugagcccgcgaucgau

SEQ ID NO: 15256 - RNA, 17 nt, Pseudomonas aeruginosa PA01
cgcggcagccaggcggc

SEQ ID NO: 15257 - RNA, 22 nt, Pseudomonas aeruginosa PA01
cgcggccgugcccuucgagcug

SEQ ID NO: 15258 - RNA, 23 nt, Pseudomonas aeruginosa PA01
cgcggcgaucgaggccgaggccc

SEQ ID NO: 15259 - RNA, 22 nt, Pseudomonas aeruginosa PA01
cgcgggcgucguccucggucau

SEQ ID NO: 15260 - RNA, 22 nt, Pseudomonas aeruginosa PA01
cgcggggcggagagccagccgg

SEQ ID NO: 15261 - RNA, 22 nt, Pseudomonas aeruginosa PA01
cgcgucggccggcaggcucucg

SEQ ID NO: 15262 - RNA, 22 nt, Pseudomonas aeruginosa PA01
cgcgagccacauccaguugcau

SEQ ID NO: 15263 - RNA, 22 nt, Pseudomonas aeruginosa PA01
cgcgagcgcggcugcuccaucc

SEQ ID NO: 15264 - RNA, 22 nt, Pseudomonas aeruginosa PA01
cgcgaggaaaccucgcuggccg

SEQ ID NO: 15265 - RNA, 22 nt, Pseudomonas aeruginosa PA01
cgcgcacguugauccgccggau

SEQ ID NO: 15266 - RNA, 22 nt, Pseudomonas aeruginosa PA01
cgcgcaggcgguacaggcggcu

SEQ ID NO: 15267 - RNA, 22 nt, Pseudomonas aeruginosa PA01
cgcgccacccguugcgagagag

SEQ ID NO: 15268 - RNA, 22 nt, Pseudomonas aeruginosa PA01
cgcgccagcagguggcggaugg

SEQ ID NO: 15269 - RNA, 19 nt, Pseudomonas aeruginosa PA01
cgcgccagcgccgccuggg

SEQ ID NO: 15270 - RNA, 22 nt, Pseudomonas aeruginosa PA01
cggaacagcgagccgacgccgg

SEQ ID NO: 15271 - RNA, 22 nt, Pseudomonas aeruginosa PA01
cggacgccagcgugcccggcua

SEQ ID NO: 15272 - RNA, 22 nt, Pseudomonas aeruginosa PA01
cgcugccgacccggaggauuuc

SEQ ID NO: 15273 - RNA, 22 nt, Pseudomonas aeruginosa PA01
cgcuggagagugccucccaggg

SEQ ID NO: 15274 - RNA, 22 nt, Pseudomonas aeruginosa PA01
cgcuggcgcaccagcuugccga

SEQ ID NO: 15275 - RNA, 22 nt, Pseudomonas aeruginosa PA01
cgcuccgggucgaucugcuggc

SEQ ID NO: 15276 - RNA, 19 nt, Pseudomonas aeruginosa PA01
cgcuccucugcccgguggc

SEQ ID NO: 15277 - RNA, 22 nt, Pseudomonas aeruginosa PA01
cgcugcagguauucggugccug

SEQ ID NO: 15278 - RNA, 22 nt, Pseudomonas aeruginosa PA01
cggagcgugccggcgagggucg

SEQ ID NO: 15279 - RNA, 22 nt, Pseudomonas aeruginosa PA01
cggagcugaacgccgagcgcuu

SEQ ID NO: 15280 - RNA, 22 nt, Pseudomonas aeruginosa PA01
cggcagcgccucgccacgcucc

SEQ ID NO: 15281 - RNA, 22 nt, Pseudomonas aeruginosa PA01
cggcagcggcgggccguugacc

SEQ ID NO: 15282 - RNA, 22 nt, Pseudomonas aeruginosa PA01
cggcccgccguaggccugcgcu

SEQ ID NO: 15283 - RNA, 22 nt, Pseudomonas aeruginosa PA01
cggcccggcauggaccccggcg

SEQ ID NO: 15284 - RNA, 22 nt, Pseudomonas aeruginosa PA01
cggccgcgccuuuggcauggcc

SEQ ID NO: 15285 - RNA, 22 nt, Pseudomonas aeruginosa PA01
cggccggacgcucgccgggcag

SEQ ID NO: 15286 - RNA, 20 nt, Pseudomonas aeruginosa PA01
cggccggcaggugaucgaac

SEQ ID NO: 15287 - RNA, 22 nt, Pseudomonas aeruginosa PA01
cggccagccaggcccgcaccag

SEQ ID NO: 15288 - RNA, 22 nt, Pseudomonas aeruginosa PA01
cggccaggccccggucgauggc

SEQ ID NO: 15289 - RNA, 22 nt, Pseudomonas aeruginosa PA01
cggccagggcaaugucgaagcc

SEQ ID NO: 15290 - RNA, 22 nt, Pseudomonas aeruginosa PA01
gggucagcagcagguguuccuu

SEQ ID NO: 15291 - RNA, 22 nt, Pseudomonas aeruginosa PA01
ggugccagauccaguaggcggc

SEQ ID NO: 15292 - RNA, 22 nt, Pseudomonas aeruginosa PA01
ggugccggcgccggcccuggcg

SEQ ID NO: 15293 - RNA, 22 nt, Pseudomonas aeruginosa PA01
ggugcgcaccgcccugcgcgag

SEQ ID NO: 15294 - RNA, 22 nt, Pseudomonas aeruginosa PA01
ggugcgcgcccuucugcgagua

SEQ ID NO: 15295 - RNA, 22 nt, Pseudomonas aeruginosa PA01
gguguaccggugaaggaacugu

SEQ ID NO: 15296 - RNA, 22 nt, Pseudomonas aeruginosa PA01
guacaucgucgucgcccugguc

SEQ ID NO: 15297 - RNA, 22 nt, Pseudomonas aeruginosa PA01
guacucgcgggcaagcuuggcg

SEQ ID NO: 15298 - RNA, 22 nt, Pseudomonas aeruginosa PA01
guagcccuggccgagguccggg

SEQ ID NO: 15299 - RNA, 21 nt, Pseudomonas aeruginosa PA01
guagccguggaccuggcagcc

SEQ ID NO: 15300 - RNA, 22 nt, Pseudomonas aeruginosa PA01
gguggcaggaugcgcagacugg

SEQ ID NO: 15301 - RNA, 22 nt, Pseudomonas aeruginosa PA01
ggugggauugcccugcaaggcu

SEQ ID NO: 15302 - RNA, 22 nt, Pseudomonas aeruginosa PA01
ggcuuccggcggccucccgcgg

SEQ ID NO: 15303 - RNA, 22 nt, Pseudomonas aeruginosa PA01
ggcuucgucgagggaggcgguc

SEQ ID NO: 15304 - RNA, 22 nt, Pseudomonas aeruginosa PA01
gggcagcggcguggagugguag

SEQ ID NO: 15305 - RNA, 22 nt, Pseudomonas aeruginosa PA01
gggcaggcucauggcagcucgg

SEQ ID NO: 15306 - RNA, 22 nt, Pseudomonas aeruginosa PA01
gggcgaccugaacugggccggc

SEQ ID NO: 15307 - RNA, 22 nt, Pseudomonas aeruginosa PA01
gggcgagcccugcugggcgaag

SEQ ID NO: 15308 - RNA, 22 nt, Pseudomonas aeruginosa PA01
gggcgaggaagccgccggcguc

SEQ ID NO: 15309 - RNA, 22 nt, Pseudomonas aeruginosa PA01
gggcgcggucgaggaucagcuc

SEQ ID NO: 15310 - RNA, 23 nt, Pseudomonas aeruginosa PA01
gggcaugcugguccccggcaccc

SEQ ID NO: 15311 - RNA, 22 nt, Pseudomonas aeruginosa PA01
gggccccuuccacggaccgcug

SEQ ID NO: 15312 - RNA, 22 nt, Pseudomonas aeruginosa PA01
gggccgcccggcgggaucuugc

SEQ ID NO: 15313 - RNA, 22 nt, Pseudomonas aeruginosa PA01
gggccgggcuucagcaucgacg

SEQ ID NO: 15314 - RNA, 22 nt, Pseudomonas aeruginosa PA01
gggcggcuugcaggaaggcuuc

SEQ ID NO: 15315 - RNA, 22 nt, Pseudomonas aeruginosa PA01
ggggcggcuuguugcgcccgcg

SEQ ID NO: 15316 - RNA, 22 nt, Pseudomonas aeruginosa PA01
gggggcaggucacuugccccgc

SEQ ID NO: 15317 - RNA, 22 nt, Pseudomonas aeruginosa PA01
ggggucaggucgcugagcaggg

SEQ ID NO: 15318 - RNA, 22 nt, Pseudomonas aeruginosa PA01
guggccggcgcgauggcgucca

SEQ ID NO: 15319 - RNA, 22 nt, Pseudomonas aeruginosa PA01
guggcgcggggcgagcugguuc

SEQ ID NO: 15320 - RNA, 22 nt, Pseudomonas aeruginosa PA01
guugcggaucgucguagccgag

SEQ ID NO: 15321 - RNA, 22 nt, Pseudomonas aeruginosa PA01
guugaugucguagcucaccagc

SEQ ID NO: 15322 - RNA, 22 nt, Pseudomonas aeruginosa PA01
gucgcgccaugacccuggaggc

SEQ ID NO: 15323 - RNA, 22 nt, Pseudomonas aeruginosa PA01
gucggccaggugcgcgguggcc

SEQ ID NO: 15324 - RNA, 22 nt, Pseudomonas aeruginosa PA01
gucggcccauuccggguggucu

SEQ ID NO: 15325 - RNA, 19 nt, Pseudomonas aeruginosa PA01
gucggccuggaaggccuga

SEQ ID NO: 15326 - RNA, 22 nt, Pseudomonas aeruginosa PA01
gucuuuccagguaugcgggcug

SEQ ID NO: 15327 - RNA, 22 nt, Pseudomonas aeruginosa PA01
gucgacccagggccgggcgcgc

SEQ ID NO: 15328 - RNA, 22 nt, Pseudomonas aeruginosa PA01
gucgacccguccgggcagcucg

SEQ ID NO: 15329 - RNA, 22 nt, Pseudomonas aeruginosa PA01
gucgacuacgcgcugauggagc

SEQ ID NO: 15330 - RNA, 22 nt, Pseudomonas aeruginosa PA01
guccagcgccaggccgaacucu

SEQ ID NO: 15331 - RNA, 22 nt, Pseudomonas aeruginosa PA01
guccagcgcgugcgccugccac

SEQ ID NO: 15332 - RNA, 22 nt, Pseudomonas aeruginosa PA01
guccggcgcgaggcccggcguu

SEQ ID NO: 15333 - RNA, 22 nt, Pseudomonas aeruginosa PA01
guccggcuuguacugguggugg

SEQ ID NO: 15334 - RNA, 22 nt, Pseudomonas aeruginosa PA01
guccgggagcgauggcguugac

SEQ ID NO: 15335 - RNA, 22 nt, Pseudomonas aeruginosa PA01
guccgggaucaccccgucgcug

SEQ ID NO: 15336 - RNA, 22 nt, Pseudomonas aeruginosa PA01
gucucuuccaucaccgagcgca

SEQ ID NO: 15337 - RNA, 22 nt, Pseudomonas aeruginosa PA01
gugccggccaaggacccgcgcg

SEQ ID NO: 15338 - RNA, 22 nt, Pseudomonas aeruginosa PA01
gugccggcgcggcguaccguuc

SEQ ID NO: 15339 - RNA, 22 nt, Pseudomonas aeruginosa PA01
gugccugccucggcgccggcgg

SEQ ID NO: 15340 - RNA, 18 nt, Pseudomonas aeruginosa PA01
gugcgcaggccaggcggg

SEQ ID NO: 15341 - RNA, 22 nt, Pseudomonas aeruginosa PA01
gugcgcaggccgagcgguccga

SEQ ID NO: 15342 - RNA, 22 nt, Pseudomonas aeruginosa PA01
gugcgcccagcgcgcggucaug

SEQ ID NO: 15343 - RNA, 22 nt, Pseudomonas aeruginosa PA01
uacccggccugccuugccgucg

SEQ ID NO: 15344 - RNA, 22 nt, Pseudomonas aeruginosa PA01
uacugaccacgucuuccaggcu

SEQ ID NO: 15345 - RNA, 22 nt, Pseudomonas aeruginosa PA01
uagcgggagaacucgcggccgc

SEQ ID NO: 15346 - RNA, 22 nt, Pseudomonas aeruginosa PA01
uauugacacugaacgagccgga

SEQ ID NO: 15347 - RNA, 22 nt, Pseudomonas aeruginosa PA01
ucaccggcggcuggaacgggcu

SEQ ID NO: 15348 - RNA, 22 nt, Pseudomonas aeruginosa PA01
ucaggcccauuucguugcggac

SEQ ID NO: 15349 - RNA, 22 nt, Pseudomonas aeruginosa PA01
ucaggccggcugccgccacucg

SEQ ID NO: 15350 - RNA, 22 nt, Pseudomonas aeruginosa PA01
ucagccuguucucgcggcgccc

SEQ ID NO: 15351 - RNA, 22 nt, Pseudomonas aeruginosa PA01
ucagcgcccacuucggcugcuc

SEQ ID NO: 15352 - RNA, 22 nt, Pseudomonas aeruginosa PA01
ucagcgccggcuggcagcggau

SEQ ID NO: 15353 - RNA, 20 nt, Pseudomonas aeruginosa PA01
ucaggccgucgaugccgggc

SEQ ID NO: 15354 - RNA, 22 nt, Pseudomonas aeruginosa PA01
ucaggcucggugguuccgcuga

SEQ ID NO: 15355 - RNA, 22 nt, Pseudomonas aeruginosa PA01
ucgucggccucguucucgauga

SEQ ID NO: 15356 - RNA, 22 nt, Pseudomonas aeruginosa PA01
ucgucggccuucaacgccgccg

SEQ ID NO: 15357 - RNA, 22 nt, Pseudomonas aeruginosa PA01
ucgucggcgaacuccgagcgca

SEQ ID NO: 15358 - RNA, 20 nt, Pseudomonas aeruginosa PA01
ucgucggcgcccuggugauc

SEQ ID NO: 15359 - RNA, 22 nt, Pseudomonas aeruginosa PA01
ucggcgccgcccacgccuggca

SEQ ID NO: 15360 - RNA, 22 nt, Pseudomonas aeruginosa PA01
ucggcgccuugcuggcgggcca

SEQ ID NO: 15361 - RNA, 22 nt, Pseudomonas aeruginosa PA01
ucggcgcgcugacccgcugggu

SEQ ID NO: 15362 - RNA, 22 nt, Pseudomonas aeruginosa PA01
ucggcgcgcugcuguucgucga

SEQ ID NO: 15363 - RNA, 22 nt, Pseudomonas aeruginosa PA01
uccuugagguugaucguccagu

SEQ ID NO: 15364 - RNA, 22 nt, Pseudomonas aeruginosa PA01
ucgccgccagcaggcggccgag

SEQ ID NO: 15365 - RNA, 22 nt, Pseudomonas aeruginosa PA01
ucgccggccugcugaccuuccu

SEQ ID NO: 15366 - RNA, 22 nt, Pseudomonas aeruginosa PA01
ucgccggcgcccuggcgccugg

SEQ ID NO: 15367 - RNA, 22 nt, Pseudomonas aeruginosa PA01
ucgccgggcuucaggcucaggg

SEQ ID NO: 15368 - RNA, 22 nt, Pseudomonas aeruginosa PA01
ucgccggguuggucagccaggc

SEQ ID NO: 15369 - RNA, 22 nt, Pseudomonas aeruginosa PA01
ucgcgcagcaacaggggccggu

SEQ ID NO: 15370 - RNA, 21 nt, Pseudomonas aeruginosa PA01
ucgcggaacuggcgggcgucc

SEQ ID NO: 15371 - RNA, 22 nt, Pseudomonas aeruginosa PA01
ucgcggagcagggcgcggcuga

SEQ ID NO: 15372 - RNA, 22 nt, Pseudomonas aeruginosa PA01
uccgggucgcggucggccugga

SEQ ID NO: 15373 - RNA, 22 nt, Pseudomonas aeruginosa PA01
uccgucgacggcccgcuggcgg

SEQ ID NO: 15374 - RNA, 22 nt, Pseudomonas aeruginosa PA01
uccggcucgacgccggcgaggu

SEQ ID NO: 15375 - RNA, 22 nt, Pseudomonas aeruginosa PA01
ucccgcgcucggugggccaggu

SEQ ID NO: 15376 - RNA, 22 nt, Pseudomonas aeruginosa PA01
uccucggcgaucacccggcgcu

SEQ ID NO: 15377 - RNA, 22 nt, Pseudomonas aeruginosa PA01
uccugcagaccgccaucgccga

SEQ ID NO: 15378 - RNA, 22 nt, Pseudomonas aeruginosa PA01
ucccugggcagccccuugaguu

SEQ ID NO: 15379 - RNA, 22 nt, Pseudomonas aeruginosa PA01
uccgaggacgggcagagguggu

SEQ ID NO: 15380 - RNA, 22 nt, Pseudomonas aeruginosa PA01
uccgccgggugcacagcgaggg

SEQ ID NO: 15381 - RNA, 22 nt, Pseudomonas aeruginosa PA01
uccaggcuggcggcgucgaucc

SEQ ID NO: 15382 - RNA, 22 nt, Pseudomonas aeruginosa PA01
uccaugacguacuugucgccca

SEQ ID NO: 15383 - RNA, 22 nt, Pseudomonas aeruginosa PA01
gccuuggugcacgaggcgcagg

SEQ ID NO: 15384 - RNA, 22 nt, Pseudomonas aeruginosa PA01
gccugucccgcgaacuggagaa

SEQ ID NO: 15385 - RNA, 22 nt, Pseudomonas aeruginosa PA01
gccuccccggacaccguggcaa

SEQ ID NO: 15386 - RNA, 22 nt, Pseudomonas aeruginosa PA01
gccugagcgagacucaggacac

SEQ ID NO: 15387 - RNA, 22 nt, Pseudomonas aeruginosa PA01
gccgccccggcuuccucauccg

SEQ ID NO: 15388 - RNA, 22 nt, Pseudomonas aeruginosa PA01
gccgccggauugaugaugauga

SEQ ID NO: 15389 - RNA, 22 nt, Pseudomonas aeruginosa PA01
gccgcgccccucggcuuccuug

SEQ ID NO: 15390 - RNA, 22 nt, Pseudomonas aeruginosa PA01
gccggacguaccagccggcggc

SEQ ID NO: 15391 - RNA, 22 nt, Pseudomonas aeruginosa PA01
gccggagacgauggcgacguuc

SEQ ID NO: 15392 - RNA, 22 nt, Pseudomonas aeruginosa PA01
gccggagcugccggccgaccug

SEQ ID NO: 15393 - RNA, 22 nt, Pseudomonas aeruginosa PA01
gccggcagccucaagcaggugg

SEQ ID NO: 15394 - RNA, 22 nt, Pseudomonas aeruginosa PA01
gccggccaguucaccggcgcgc

SEQ ID NO: 15395 - RNA, 22 nt, Pseudomonas aeruginosa PA01
gccggccccgcaauucggucug

SEQ ID NO: 15396 - RNA, 22 nt, Pseudomonas aeruginosa PA01
gccggccccggcgccauguuga

SEQ ID NO: 15397 - RNA, 22 nt, Pseudomonas aeruginosa PA01
gccggccgacgccuggauggcc

SEQ ID NO: 15398 - RNA, 22 nt, Pseudomonas aeruginosa PA01
gccggccgcccucgucgaguuc

SEQ ID NO: 15399 - RNA, 22 nt, Pseudomonas aeruginosa PA01
gccggccguagggaaucgaacg

SEQ ID NO: 15400 - RNA, 22 nt, Pseudomonas aeruginosa PA01
gccggccuggagcgccugggcg

SEQ ID NO: 15401 - RNA, 22 nt, Pseudomonas aeruginosa PA01
gccggcgaugguguagcggucc

SEQ ID NO: 15402 - RNA, 21 nt, Pseudomonas aeruginosa PA01
gccggcgccgcagagcuggcc

SEQ ID NO: 15403 - RNA, 22 nt, Pseudomonas aeruginosa PA01
gccggcgcggacuuccuggauc

SEQ ID NO: 15404 - RNA, 22 nt, Pseudomonas aeruginosa PA01
gccgggaggaagucauugcccg

SEQ ID NO: 15405 - RNA, 22 nt, Pseudomonas aeruginosa PA01
gccgggauuuccugcaacugcg

SEQ ID NO: 15406 - RNA, 22 nt, Pseudomonas aeruginosa PA01
gccgggcgauagccggggagau

SEQ ID NO: 15407 - RNA, 22 nt, Pseudomonas aeruginosa PA01
gccggggccgcuucggcuuccg

SEQ ID NO: 15408 - RNA, 22 nt, Pseudomonas aeruginosa PA01
gccggggccggcgaucuugcug

SEQ ID NO: 15409 - RNA, 22 nt, Pseudomonas aeruginosa PA01
gccggggcgcucgaccuggagg

SEQ ID NO: 15410 - RNA, 21 nt, Pseudomonas aeruginosa PA01
gccggggcguucuucuucgcu

SEQ ID NO: 15411 - RNA, 22 nt, Pseudomonas aeruginosa PA01
gccgggggugaggccgguccac

SEQ ID NO: 15412 - RNA, 22 nt, Pseudomonas aeruginosa PA01
gccggugagcuucgacgugucg

SEQ ID NO: 15413 - RNA, 22 nt, Pseudomonas aeruginosa PA01
gcgccggcaggcccugggccuc

SEQ ID NO: 15414 - RNA, 18 nt, Pseudomonas aeruginosa PA01
gcgccgggcugcccuggg

SEQ ID NO: 15415 - RNA, 22 nt, Pseudomonas aeruginosa PA01
gcgccggggaugaucggcgagc

SEQ ID NO: 15416 - RNA, 22 nt, Pseudomonas aeruginosa PA01
gcgccggguuucaucgucgcca

SEQ ID NO: 15417 - RNA, 20 nt, Pseudomonas aeruginosa PA01
gcgccuggugcagcggaucc

SEQ ID NO: 15418 - RNA, 22 nt, Pseudomonas aeruginosa PA01
gcgcgaaggacggccgcggguu

SEQ ID NO: 15419 - RNA, 22 nt, Pseudomonas aeruginosa PA01
gcgcgcaccuggaccgcaacaa

SEQ ID NO: 15420 - RNA, 22 nt, Pseudomonas aeruginosa PA01
gcgcgcaccuggcgccguuccu

SEQ ID NO: 15421 - RNA, 22 nt, Pseudomonas aeruginosa PA01
gcgcgcagcaguggcuggcguu

SEQ ID NO: 15422 - RNA, 22 nt, Pseudomonas aeruginosa PA01
gcgcgcaggagcccggcaccgg

SEQ ID NO: 15423 - RNA, 23 nt, Pseudomonas aeruginosa PA01
gcgcgcaggccaucggcaucguc

SEQ ID NO: 15424 - RNA, 22 nt, Pseudomonas aeruginosa PA01
gcgcgccagcaggcugccgggu

SEQ ID NO: 15425 - RNA, 22 nt, Pseudomonas aeruginosa PA01
gcgcgccgaaucccugggucgg

SEQ ID NO: 15426 - RNA, 22 nt, Pseudomonas aeruginosa PA01
gcgcgccgaccagucgcgagga

SEQ ID NO: 15427 - RNA, 22 nt, Pseudomonas aeruginosa PA01
gcgcgccggcaucaagagagua

SEQ ID NO: 15428 - RNA, 22 nt, Pseudomonas aeruginosa PA01
gcgcgccucuuccagcagccag

SEQ ID NO: 15429 - RNA, 22 nt, Pseudomonas aeruginosa PA01
gcgcgccuucaagagcgucggc

SEQ ID NO: 15430 - RNA, 22 nt, Pseudomonas aeruginosa PA01
gcgcgcgagaaagcggucggug

SEQ ID NO: 15431 - RNA, 22 nt, Pseudomonas aeruginosa PA01
gcgcgcggcuagaggaagaguc

SEQ ID NO: 15432 - RNA, 22 nt, Pseudomonas aeruginosa PA01
gcgcgcgguucucgauggagcc

SEQ ID NO: 15433 - RNA, 22 nt, Pseudomonas aeruginosa PA01
gcgcgcucggggugggcuuguu

SEQ ID NO: 15434 - RNA, 22 nt, Pseudomonas aeruginosa PA01
gcgcgcucuggggcaaggucug

SEQ ID NO: 15435 - RNA, 22 nt, Pseudomonas aeruginosa PA01
gcgcgcuggugcgacaagggcu

SEQ ID NO: 15436 - RNA, 16 nt, Pseudomonas aeruginosa PA01
gcgcggacgccgcgaa

SEQ ID NO: 15437 - RNA, 22 nt, Pseudomonas aeruginosa PA01
gcgcggcaccugccgggcagcc

SEQ ID NO: 15438 - RNA, 22 nt, Pseudomonas aeruginosa PA01
gcgcggccgaaggccagguucu

SEQ ID NO: 15439 - RNA, 22 nt, Pseudomonas aeruginosa PA01
gcgcggcgccucguccucgacc

SEQ ID NO: 15440 - RNA, 22 nt, Pseudomonas aeruginosa PA01
gcgcggcggaacagguggcgca

SEQ ID NO: 15441 - RNA, 23 nt, Pseudomonas aeruginosa PA01
gcgcgggagcugguggugcccug

SEQ ID NO: 15442 - RNA, 22 nt, Pseudomonas aeruginosa PA01
gcgcgguggucuucaggccggc

SEQ ID NO: 15443 - RNA, 21 nt, Pseudomonas aeruginosa PA01
gcgcggugucgccaucgcgac

SEQ ID NO: 15444 - RNA, 22 nt, Pseudomonas aeruginosa PA01
gcgcguccauggcggcgucgag

SEQ ID NO: 15445 - RNA, 22 nt, Pseudomonas aeruginosa PA01
gcgcgucgacguagcugcaggc

SEQ ID NO: 15446 - RNA, 22 nt, Pseudomonas aeruginosa PA01
gcgcuccagcacuucguccagc

SEQ ID NO: 15447 - RNA, 22 nt, Pseudomonas aeruginosa PA01
gcgcuggcgcaacggcucguca

SEQ ID NO: 15448 - RNA, 22 nt, Pseudomonas aeruginosa PA01
gcgcuggcguucgacgagcugg

SEQ ID NO: 15449 - RNA, 22 nt, Pseudomonas aeruginosa PA01
gcgcuucuacaagcgacgccgg

SEQ ID NO: 15450 - RNA, 22 nt, Pseudomonas aeruginosa PA01
gcggaauggcugucgccccaac

SEQ ID NO: 15451 - RNA, 22 nt, Pseudomonas aeruginosa PA01
gcggacgcucuucggugaagcg

SEQ ID NO: 15452 - RNA, 22 nt, Pseudomonas aeruginosa PA01
gcggauagcgcuggggcgcuau

SEQ ID NO: 15453 - RNA, 22 nt, Pseudomonas aeruginosa PA01
gcggcagcgagcgccaggagga

SEQ ID NO: 15454 - RNA, 22 nt, Pseudomonas aeruginosa PA01
gcucgcucaucaucacgaaauc

SEQ ID NO: 15455 - RNA, 17 nt, Pseudomonas aeruginosa PA01
gcucgcucggcggcagc

SEQ ID NO: 15456 - RNA, 22 nt, Pseudomonas aeruginosa PA01
gcucgggcaguugcgccgcugu

SEQ ID NO: 15457 - RNA, 22 nt, Pseudomonas aeruginosa PA01
gcucgguccuguugcuggccca

SEQ ID NO: 15458 - RNA, 18 nt, Pseudomonas aeruginosa PA01
gcucggucugugccgggu

SEQ ID NO: 15459 - RNA, 22 nt, Pseudomonas aeruginosa PA01
gcucgucggugaccggcgagac

SEQ ID NO: 15460 - RNA, 22 nt, Pseudomonas aeruginosa PA01
gcguggugcugaugaucggcgg

SEQ ID NO: 15461 - RNA, 22 nt, Pseudomonas aeruginosa PA01
gcugaagggcuccgcgcugucc

SEQ ID NO: 15462 - RNA, 22 nt, Pseudomonas aeruginosa PA01
gcgaggaacuggccggcggcgc

SEQ ID NO: 15463 - RNA, 22 nt, Pseudomonas aeruginosa PA01
gcgaggaaggcggccaggucag

SEQ ID NO: 15464 - RNA, 22 nt, Pseudomonas aeruginosa PA01
gcgagggcuucgccgaggcguu

SEQ ID NO: 15465 - RNA, 22 nt, Pseudomonas aeruginosa PA01
gcguccggaaaaggucucggcc

SEQ ID NO: 15466 - RNA, 22 nt, Pseudomonas aeruginosa PA01
gcgucggcugcaucgcacgacc

SEQ ID NO: 15467 - RNA, 21 nt, Pseudomonas aeruginosa PA01
gcgugcagcucgcccucagcc

SEQ ID NO: 15468 - RNA, 22 nt, Pseudomonas aeruginosa PA01
gcgugccggacuggguggugag

SEQ ID NO: 15469 - RNA, 22 nt, Pseudomonas aeruginosa PA01
gcgugccgucggucagcgguac

SEQ ID NO: 15470 - RNA, 22 nt, Pseudomonas aeruginosa PA01
gcgugccgucuuccagggugcc

SEQ ID NO: 15471 - RNA, 22 nt, Pseudomonas aeruginosa PA01
gcucaggcccaggccgagcgcg

SEQ ID NO: 15472 - RNA, 22 nt, Pseudomonas aeruginosa PA01
gcucaggcgaugccugcuugcu

SEQ ID NO: 15473 - RNA, 22 nt, Pseudomonas aeruginosa PA01
gcuccauuuauccaggggcaga

SEQ ID NO: 15474 - RNA, 22 nt, Pseudomonas aeruginosa PA01
gcucccguccacgcggcaacgg

SEQ ID NO: 15475 - RNA, 21 nt, Pseudomonas aeruginosa PA01
gcuccggcugaucgucggcau

SEQ ID NO: 15476 - RNA, 22 nt, Pseudomonas aeruginosa PA01
gcuccucuggaaccguucgaac

SEQ ID NO: 15477 - RNA, 22 nt, Pseudomonas aeruginosa PA01
gcuccugcgcgagcgccuggag

SEQ ID NO: 15478 - RNA, 22 nt, Pseudomonas aeruginosa PA01
gcucgccgacgucgccagcgac

SEQ ID NO: 15479 - RNA, 18 nt, Pseudomonas aeruginosa PA01
gcggccgguucgggaagu

SEQ ID NO: 15480 - RNA, 22 nt, Pseudomonas aeruginosa PA01
gcggcggccucugguauggcaa

SEQ ID NO: 15481 - RNA, 22 nt, Pseudomonas aeruginosa PA01
gcggcggccugccccuggcgag

SEQ ID NO: 15482 - RNA, 22 nt, Pseudomonas aeruginosa PA01
gcggcggguaagcgcaagcggu

SEQ ID NO: 15483 - RNA, 22 nt, Pseudomonas aeruginosa PA01
gcggcgugacccuguccggcga

SEQ ID NO: 15484 - RNA, 22 nt, Pseudomonas aeruginosa PA01
gcggcgugccagaggcagaguu

SEQ ID NO: 15485 - RNA, 22 nt, Pseudomonas aeruginosa PA01
gcggcugcgccuggaacggcuc

SEQ ID NO: 15486 - RNA, 22 nt, Pseudomonas aeruginosa PA01
gcggcugguugaucucgugggc

SEQ ID NO: 15487 - RNA, 22 nt, Pseudomonas aeruginosa PA01
gcgggaggcccuggauaccaug

SEQ ID NO: 15488 - RNA, 22 nt, Pseudomonas aeruginosa PA01
gcgggcagggccuugucagccc

SEQ ID NO: 15489 - RNA, 22 nt, Pseudomonas aeruginosa PA01
gcggggcaucgcuggcccagcg

SEQ ID NO: 15490 - RNA, 22 nt, Pseudomonas aeruginosa PA01
gcggucaccccgcccugcuccu

SEQ ID NO: 15491 - RNA, 22 nt, Pseudomonas aeruginosa PA01
gcggucaccggccagccggucu

SEQ ID NO: 15492 - RNA, 22 nt, Pseudomonas aeruginosa PA01
gcgguggccuacgaggccgaau

SEQ ID NO: 15493 - RNA, 22 nt, Pseudomonas aeruginosa PA01
gcgccagcgaacaacugggcga

SEQ ID NO: 15494 - RNA, 22 nt, Pseudomonas aeruginosa PA01
gcgccccucuugcccaucgagg

SEQ ID NO: 15495 - RNA, 22 nt, Pseudomonas aeruginosa PA01
gcgccccugguccagcggcagc

SEQ ID NO: 15496 - RNA, 22 nt, Pseudomonas aeruginosa PA01
gcgcccgcgacuacccgcugga

SEQ ID NO: 15497 - RNA, 22 nt, Pseudomonas aeruginosa PA01
gcgcccggccgagcgccaucug

SEQ ID NO: 15498 - RNA, 22 nt, Pseudomonas aeruginosa PA01
gcgccgccgccgggguguccag

SEQ ID NO: 15499 - RNA, 22 nt, Pseudomonas aeruginosa PA01
gcgccgcggaaagcagccuggc

SEQ ID NO: 15500 - RNA, 22 nt, Pseudomonas aeruginosa PA01
gcgaugcgcgccuccagcgucu

SEQ ID NO: 15501 - RNA, 22 nt, Pseudomonas aeruginosa PA01
gcgaugcggugaccucccugcg

SEQ ID NO: 15502 - RNA, 22 nt, Pseudomonas aeruginosa PA01
gcgcagccgggacucuggcugg

SEQ ID NO: 15503 - RNA, 22 nt, Pseudomonas aeruginosa PA01
gcgcagcgaauccaggggcgcc

SEQ ID NO: 15504 - RNA, 22 nt, Pseudomonas aeruginosa PA01
gcgcagcgaccugccgcaacug

SEQ ID NO: 15505 - RNA, 22 nt, Pseudomonas aeruginosa PA01
gcgcagcgcccuggaaggcucg

SEQ ID NO: 15506 - RNA, 22 nt, Pseudomonas aeruginosa PA01
gcgcaggccugccggaugaucg

SEQ ID NO: 15507 - RNA, 22 nt, Pseudomonas aeruginosa PA01
gcgcaucgaccugcguggccug

SEQ ID NO: 15508 - RNA, 22 nt, Pseudomonas aeruginosa PA01
gcgccaccucgcuguaugccuc

SEQ ID NO: 15509 - RNA, 22 nt, Pseudomonas aeruginosa PA01
gcgaacagcagaugcucgccau

SEQ ID NO: 15510 - RNA, 22 nt, Pseudomonas aeruginosa PA01
gcgaagcggccgucggccuuga

SEQ ID NO: 15511 - RNA, 22 nt, Pseudomonas aeruginosa PA01
gcgaccaguucggcugggccgg

SEQ ID NO: 15512 - RNA, 22 nt, Pseudomonas aeruginosa PA01
gcgaccgccgcuggcuggcguu

SEQ ID NO: 15513 - RNA, 22 nt, Pseudomonas aeruginosa PA01
gcgacgcccagggccgcuggcu

SEQ ID NO: 15514 - RNA, 22 nt, Pseudomonas aeruginosa PA01
gcgacggcaggcgcuccagcaa

SEQ ID NO: 15515 - RNA, 22 nt, Pseudomonas aeruginosa PA01
gcgagagggcgcggcgaaugau

SEQ ID NO: 15516 - RNA, 22 nt, Pseudomonas aeruginosa PA01
gcugguggugcagcccaggcaa

SEQ ID NO: 15517 - RNA, 22 nt, Pseudomonas aeruginosa PA01
gcuguucuucaagcacgccgaa

SEQ ID NO: 15518 - RNA, 21 nt, Pseudomonas aeruginosa PA01
ggaaaucagcucggugagguu

SEQ ID NO: 15519 - RNA, 22 nt, Pseudomonas aeruginosa PA01
ggaagcggaacagcgcgccaug

SEQ ID NO: 15520 - RNA, 20 nt, Pseudomonas aeruginosa PA01
ggaagugaacacgcggacgg

SEQ ID NO: 15521 - RNA, 22 nt, Pseudomonas aeruginosa PA01
ggaagugaaggucggcgaccug

SEQ ID NO: 15522 - RNA, 19 nt, Pseudomonas aeruginosa PA01
gcuucgucacccuggaggc

SEQ ID NO: 15523 - RNA, 22 nt, Pseudomonas aeruginosa PA01
gcuucuucgagcagggcaaggg

SEQ ID NO: 15524 - RNA, 22 nt, Pseudomonas aeruginosa PA01
gcuucuucgccacccuggugca

SEQ ID NO: 15525 - RNA, 22 nt, Pseudomonas aeruginosa PA01
gcuggaagcccaggcgugcgua

SEQ ID NO: 15526 - RNA, 22 nt, Pseudomonas aeruginosa PA01
gcugggggaagcguucgcggag

SEQ ID NO: 15527 - RNA, 22 nt, Pseudomonas aeruginosa PA01
gcuggccgauuucgccgagcgc

SEQ ID NO: 15528 - RNA, 22 nt, Pseudomonas aeruginosa PA01
gcuggccgcugccggacagcca

SEQ ID NO: 15529 - RNA, 22 nt, Pseudomonas aeruginosa PA01
gcuggccggcuccgcgcugguc

SEQ ID NO: 15530 - RNA, 22 nt, Pseudomonas aeruginosa PA01
gcuggcgcugaccgucugccug

SEQ ID NO: 15531 - RNA, 22 nt, Pseudomonas aeruginosa PA01
gcuggcggagaagugcggguug

SEQ ID NO: 15532 - RNA, 22 nt, Pseudomonas aeruginosa PA01
gcuggcgggcauccgcgugcgg

SEQ ID NO: 15533 - RNA, 22 nt, Pseudomonas aeruginosa PA01
gcugcggcuauugcggcucagc

SEQ ID NO: 15534 - RNA, 22 nt, Pseudomonas aeruginosa PA01
gcugcgcgccgaccagcggguc

SEQ ID NO: 15535 - RNA, 22 nt, Pseudomonas aeruginosa PA01
gcugcgcggcauuuucagggcg

SEQ ID NO: 15536 - RNA, 22 nt, Pseudomonas aeruginosa PA01
gcugcgcggccugggcgucguc

SEQ ID NO: 15537 - RNA, 22 nt, Pseudomonas aeruginosa PA01
gcugcggcaacgacaucgccca

SEQ ID NO: 15538 - RNA, 20 nt, Pseudomonas aeruginosa PA01
ggcagaugcgauccagcucc

SEQ ID NO: 15539 - RNA, 22 nt, Pseudomonas aeruginosa PA01
ggcagccgcgaggucgccgggc

SEQ ID NO: 15540 - RNA, 22 nt, Pseudomonas aeruginosa PA01
ggcagcuucgaccgcccguucg

SEQ ID NO: 15541 - RNA, 22 nt, Pseudomonas aeruginosa PA01
ggccagcaggaugcgcccggcg

SEQ ID NO: 15542 - RNA, 23 nt, Pseudomonas aeruginosa PA01
ggccacacaggugcccgccggga

SEQ ID NO: 15543 - RNA, 22 nt, Pseudomonas aeruginosa PA01
ggccagggcgaccgcgagcggg

SEQ ID NO: 15544 - RNA, 22 nt, Pseudomonas aeruginosa PA01
ggccagcucgcgcagggcaugg

SEQ ID NO: 15545 - RNA, 22 nt, Pseudomonas aeruginosa PA01
ggcaccagcaggcgcgaggcga

SEQ ID NO: 15546 - RNA, 22 nt, Pseudomonas aeruginosa PA01
ggacgcgcagugccggcaccgc

SEQ ID NO: 15547 - RNA, 22 nt, Pseudomonas aeruginosa PA01
ggagcacgcgguggcggcugug

SEQ ID NO: 15548 - RNA, 22 nt, Pseudomonas aeruginosa PA01
ggagcagccggagaucgcugcg

SEQ ID NO: 15549 - RNA, 22 nt, Pseudomonas aeruginosa PA01
ggaggaaggcggugcggaccuu

SEQ ID NO: 15550 - RNA, 22 nt, Pseudomonas aeruginosa PA01
ggaggcgccgcgcuggaagcug

SEQ ID NO: 15551 - RNA, 22 nt, Pseudomonas aeruginosa PA01
ggaucggaaaagugcuggcgag

SEQ ID NO: 15552 - RNA, 21 nt, Pseudomonas aeruginosa PA01
ggaugccggcauguucggcgg

SEQ ID NO: 15553 - RNA, 22 nt, Pseudomonas aeruginosa PA01
ggaugcgcaggucggcgugcuc

SEQ ID NO: 15554 - RNA, 23 nt, Pseudomonas aeruginosa PA01
ggaugcugucgacccgcucgcgc

SEQ ID NO: 15555 - RNA, 22 nt, Pseudomonas aeruginosa PA01
ggcucgcgcgggcugaccccgc

SEQ ID NO: 15556 - RNA, 22 nt, Pseudomonas aeruginosa PA01
ggcucgcggcagucucggcuag

SEQ ID NO: 15557 - RNA, 22 nt, Pseudomonas aeruginosa PA01
ggcucgcugccagcgccagggg

SEQ ID NO: 15558 - RNA, 22 nt, Pseudomonas aeruginosa PA01
ggcgagcuuggcggcgauggcg

SEQ ID NO: 15559 - RNA, 22 nt, Pseudomonas aeruginosa PA01
ggcgaggaacacgcagccgagc

SEQ ID NO: 15560 - RNA, 22 nt, Pseudomonas aeruginosa PA01
ggcgaggaggaucgccgcgauc

SEQ ID NO: 15561 - RNA, 22 nt, Pseudomonas aeruginosa PA01
ggcgagguugaccgacagcggg

SEQ ID NO: 15562 - RNA, 22 nt, Pseudomonas aeruginosa PA01
ggcgaugaagaucgucggcgua

SEQ ID NO: 15563 - RNA, 22 nt, Pseudomonas aeruginosa PA01
ggcgccaccgcagagugccgaa

SEQ ID NO: 15564 - RNA, 22 nt, Pseudomonas aeruginosa PA01
ggcugcgugccuggcggcaccc

SEQ ID NO: 15565 - RNA, 22 nt, Pseudomonas aeruginosa PA01
ggcuggaggcgccggguugccu

SEQ ID NO: 15566 - RNA, 22 nt, Pseudomonas aeruginosa PA01
ggcucuacggcccguuccugcg

SEQ ID NO: 15567 - RNA, 22 nt, Pseudomonas aeruginosa PA01
ggcucuucagcgucuggaugua

SEQ ID NO: 15568 - RNA, 22 nt, Pseudomonas aeruginosa PA01
ggcugagcgcccgcggcgugac

SEQ ID NO: 15569 - RNA, 22 nt, Pseudomonas aeruginosa PA01
ggcugccgaccugccccggacg

SEQ ID NO: 15570 - RNA, 19 nt, Pseudomonas aeruginosa PA01
ggcugccgguaacgggguc

SEQ ID NO: 15571 - RNA, 22 nt, Pseudomonas aeruginosa PA01
ggcgcgggucgagcguggccag

SEQ ID NO: 15572 - RNA, 22 nt, Pseudomonas aeruginosa PA01
ggcgcugguggucgauccgggc

SEQ ID NO: 15573 - RNA, 22 nt, Pseudomonas aeruginosa PA01
ggcggcaguuccggcggauggu

SEQ ID NO: 15574 - RNA, 23 nt, Pseudomonas aeruginosa PA01
ggcggccgcccuccucaugugcc

SEQ ID NO: 15575 - RNA, 18 nt, Pseudomonas aeruginosa PA01
ggcggccggcugaacgcc

SEQ ID NO: 15576 - RNA, 22 nt, Pseudomonas aeruginosa PA01
ggcggcgccguucggcaggcug

SEQ ID NO: 15577 - RNA, 22 nt, Pseudomonas aeruginosa PA01
ggcggcgcugcaggucggccug

SEQ ID NO: 15578 - RNA, 22 nt, Pseudomonas aeruginosa PA01
ggcgccacggugcuggagcacg

SEQ ID NO: 15579 - RNA, 22 nt, Pseudomonas aeruginosa PA01
ggcgccagggaguggcuccgcg

SEQ ID NO: 15580 - RNA, 22 nt, Pseudomonas aeruginosa PA01
ggcgccggcagguccaggcgcu

SEQ ID NO: 15581 - RNA, 22 nt, Pseudomonas aeruginosa PA01
ggcgcgcaggcugaagaaggcg

SEQ ID NO: 15582 - RNA, 22 nt, Pseudomonas aeruginosa PA01
ggcgcgcaucgcggaccugcuc

SEQ ID NO: 15583 - RNA, 22 nt, Pseudomonas aeruginosa PA01
ggcgcgccagcaggcuccagcc

SEQ ID NO: 15584 - RNA, 22 nt, Pseudomonas aeruginosa PA01
ggcgcgccaguucggccacgag

SEQ ID NO: 15585 - RNA, 22 nt, Pseudomonas aeruginosa PA01
ggccgcgcuggcggaggaggaa

SEQ ID NO: 15586 - RNA, 22 nt, Pseudomonas aeruginosa PA01
ggccgcucugcugcagggccug

SEQ ID NO: 15587 - RNA, 22 nt, Pseudomonas aeruginosa PA01
ggccggcgaaccuggcaacugg

SEQ ID NO: 15588 - RNA, 22 nt, Pseudomonas aeruginosa PA01
ggccggcgacgguggccgaggu

SEQ ID NO: 15589 - RNA, 22 nt, Pseudomonas aeruginosa PA01
ggccggcgccuguccgaccugc

SEQ ID NO: 15590 - RNA, 22 nt, Pseudomonas aeruginosa PA01
ggccggcgguguccuuggcgaa

SEQ ID NO: 15591 - RNA, 22 nt, Pseudomonas aeruginosa PA01
ggccgggaagucuucgucggcc

SEQ ID NO: 15592 - RNA, 22 nt, Pseudomonas aeruginosa PA01
ggccgggucgauacgcaggcug

SEQ ID NO: 15593 - RNA, 22 nt, Pseudomonas aeruginosa PA01
ggccggguugccgcugacgccg

SEQ ID NO: 15594 - RNA, 22 nt, Pseudomonas aeruginosa PA01
ggccgugggccggcgaagccug

SEQ ID NO: 15595 - RNA, 22 nt, Pseudomonas aeruginosa PA01
ggcccuggcgaugcgcuggcug

SEQ ID NO: 15596 - RNA, 22 nt, Pseudomonas aeruginosa PA01
ggccgagcacgucggcuucgag

SEQ ID NO: 15597 - RNA, 19 nt, Pseudomonas aeruginosa PA01
ggccgaggccgagaguuuc

SEQ ID NO: 15598 - RNA, 22 nt, Pseudomonas aeruginosa PA01
ggccgcaggccuggagugccug

SEQ ID NO: 15599 - RNA, 16 nt, Pseudomonas aeruginosa PA01
ggccgcagggccaggc

SEQ ID NO: 15600 - RNA, 22 nt, Pseudomonas aeruginosa PA01
ggcgagcgguucgcgggaaagg

SEQ ID NO: 15601 - RNA, 22 nt, Pseudomonas aeruginosa PA01
ggcgagcugccgcugccggucu

SEQ ID NO: 15602 - RNA, 17 nt, Pseudomonas aeruginosa PA01
ggcgaccaggucggcgu

SEQ ID NO: 15603 - RNA, 22 nt, Pseudomonas aeruginosa PA01
ggcgacccggacuucgccggcg

SEQ ID NO: 15604 - RNA, 22 nt, Pseudomonas aeruginosa PA01
ggccgccgaugcugaccucggc

SEQ ID NO: 15605 - RNA, 23 nt, Pseudomonas aeruginosa PA01
ggccgccggcgauacgcuccugg

SEQ ID NO: 15606 - RNA, 22 nt, Pseudomonas aeruginosa PA01
ggccgccguagccgcugaucag

SEQ ID NO: 15607 - RNA, 22 nt, Pseudomonas aeruginosa PA01
ggccgcgaagugacguaggcca

SEQ ID NO: 15608 - RNA, 22 nt, Pseudomonas aeruginosa PA01
ggccugggccuggaagacguag

SEQ ID NO: 15609 - RNA, 22 nt, Pseudomonas aeruginosa PA01
ggccugggcggccaggacuaca

SEQ ID NO: 15610 - RNA, 20 nt, Pseudomonas aeruginosa PA01
ggccuggggcgacgaugcgc

SEQ ID NO: 15611 - RNA, 22 nt, Pseudomonas aeruginosa PA01
aacgcgagguggugcggcucgg

SEQ ID NO: 15612 - RNA, 22 nt, Pseudomonas aeruginosa PA01
aacugagucucggcaaucauag

SEQ ID NO: 15613 - RNA, 22 nt, Pseudomonas aeruginosa PA01
aacuggaggacauccagguccu

SEQ ID NO: 15614 - RNA, 22 nt, Pseudomonas aeruginosa PA01
aauagcggcuuuucgaugcgca

SEQ ID NO: 15615 - RNA, 22 nt, Pseudomonas aeruginosa PA01
acccuggaauugcagggcuacc

SEQ ID NO: 15616 - RNA, 22 nt, Pseudomonas aeruginosa PA01
accgucggccuggccgcugcgc

SEQ ID NO: 15617 - RNA, 22 nt, Pseudomonas aeruginosa PA01
accacgagaccgaccagcaggc

SEQ ID NO: 15618 - RNA, 22 nt, Pseudomonas aeruginosa PA01
accagcgcgaacaggccgggau

SEQ ID NO: 15619 - RNA, 22 nt, Pseudomonas aeruginosa PA01
accaguccgccagggccgccgg

SEQ ID NO: 15620 - RNA, 22 nt, Pseudomonas aeruginosa PA01
acagccuggaaggcgcggaaga

SEQ ID NO: 15621 - RNA, 22 nt, Pseudomonas aeruginosa PA01
acagcgcguggagguucuccag

SEQ ID NO: 15622 - RNA, 22 nt, Pseudomonas aeruginosa PA01
aaggaugcgccagcggcaacca

SEQ ID NO: 15623 - RNA, 20 nt, Pseudomonas aeruginosa PA01
aaggcauggguuuuucgucg

SEQ ID NO: 15624 - RNA, 22 nt, Pseudomonas aeruginosa PA01
aaguggcguucggcgaacgcgg

SEQ ID NO: 15625 - RNA, 22 nt, Pseudomonas aeruginosa PA01
acaacugcguggacggcgugga

SEQ ID NO: 15626 - RNA, 22 nt, Pseudomonas aeruginosa PA01
aacggcagcgccuccggcagcu

SEQ ID NO: 15627 - RNA, 22 nt, Pseudomonas aeruginosa PA01
aagagugcgccguuggggugaa

SEQ ID NO: 15628 - RNA, 22 nt, Pseudomonas aeruginosa PA01
aagcgaucggcgcggcugaucg

SEQ ID NO: 15629 - RNA, 22 nt, Pseudomonas aeruginosa PA01
aaacugcaugagcggcucgacc

SEQ ID NO: 15630 - RNA, 22 nt, Pseudomonas aeruginosa PA01
agccggcggccucggcggccuc

SEQ ID NO: 15631 - RNA, 22 nt, Pseudomonas aeruginosa PA01
agcuccggcuugaucaggucgg

SEQ ID NO: 15632 - RNA, 19 nt, Pseudomonas aeruginosa PA01
agcucgcgguugccggcau

SEQ ID NO: 15633 - RNA, 18 nt, Pseudomonas aeruginosa PA01
agcugcgacggcuggugg

SEQ ID NO: 15634 - RNA, 22 nt, Pseudomonas aeruginosa PA01
agcugcgcgacgaggucggcca

SEQ ID NO: 15635 - RNA, 22 nt, Pseudomonas aeruginosa PA01
agcuggagcgugaguucgccgc

SEQ ID NO: 15636 - RNA, 23 nt, Pseudomonas aeruginosa PA01
agcuggauggccgccugcuguuc

SEQ ID NO: 15637 - RNA, 19 nt, Pseudomonas aeruginosa PA01
agcuggcgcagcagggugc

SEQ ID NO: 15638 - RNA, 22 nt, Pseudomonas aeruginosa PA01
aggaggaagcgcgccagcaguu

SEQ ID NO: 15639 - RNA, 22 nt, Pseudomonas aeruginosa PA01
aggauccgccagggugucgcgc

SEQ ID NO: 15640 - RNA, 22 nt, Pseudomonas aeruginosa PA01
aggaugaguuccagcgccuuca

SEQ ID NO: 15641 - RNA, 22 nt, Pseudomonas aeruginosa PA01
agggcgaggucagcguggacgc

SEQ ID NO: 15642 - RNA, 22 nt, Pseudomonas aeruginosa PA01
agggcgcguaacugguggucga

SEQ ID NO: 15643 - RNA, 22 nt, Pseudomonas aeruginosa PA01
aggcagcgaauccccagugaug

SEQ ID NO: 15644 - RNA, 22 nt, Pseudomonas aeruginosa PA01
aggcagugggcgaggaugucgg

SEQ ID NO: 15645 - RNA, 22 nt, Pseudomonas aeruginosa PA01
aggccagcggacgcgacgccuu

SEQ ID NO: 15646 - RNA, 22 nt, Pseudomonas aeruginosa PA01
aggccagcgggucgcgccacag

SEQ ID NO: 15647 - RNA, 22 nt, Pseudomonas aeruginosa PA01
aggccgaccugcagcgccgccg

SEQ ID NO: 15648 - RNA, 22 nt, Pseudomonas aeruginosa PA01
aggccggcuaccucgaaggcgg

SEQ ID NO: 15649 - RNA, 22 nt, Pseudomonas aeruginosa PA01
aggccggggugaccaagccggu

SEQ ID NO: 15650 - RNA, 22 nt, Pseudomonas aeruginosa PA01
aggcgccguugcgcgaggcuuu

SEQ ID NO: 15651 - RNA, 22 nt, Pseudomonas aeruginosa PA01
agcaggucagcggcaugccgcu

SEQ ID NO: 15652 - RNA, 22 nt, Pseudomonas aeruginosa PA01
agcaggcggcgguccagcucgc

SEQ ID NO: 15653 - RNA, 22 nt, Pseudomonas aeruginosa PA01
agcagcaggccgcccagggucg

SEQ ID NO: 15654 - RNA, 22 nt, Pseudomonas aeruginosa PA01
agcagcgccugaaggaagucga

SEQ ID NO: 15655 - RNA, 22 nt, Pseudomonas aeruginosa PA01
agcgaccgguguagcgccggcu

SEQ ID NO: 15656 - RNA, 22 nt, Pseudomonas aeruginosa PA01
agcgcagcgagcgcaaucuccu

SEQ ID NO: 15657 - RNA, 22 nt, Pseudomonas aeruginosa PA01
agcgcccgcgcaacugggaaag

SEQ ID NO: 15658 - RNA, 22 nt, Pseudomonas aeruginosa PA01
agcgccgcguccagcuccaggc

SEQ ID NO: 15659 - RNA, 22 nt, Pseudomonas aeruginosa PA01
agcgcgccaucaggcgguucga

SEQ ID NO: 15660 - RNA, 22 nt, Pseudomonas aeruginosa PA01
agcgcgcgcugaaugccgugga

SEQ ID NO: 15661 - RNA, 22 nt, Pseudomonas aeruginosa PA01
agcgcgcggaagcugucgucca

SEQ ID NO: 15662 - RNA, 22 nt, Pseudomonas aeruginosa PA01
agcgcggcaagauguucggcuu

SEQ ID NO: 15663 - RNA, 21 nt, Pseudomonas aeruginosa PA01
agcgcggcgccgaauaucggg

SEQ ID NO: 15664 - RNA, 22 nt, Pseudomonas aeruginosa PA01
agcggcgcgacaccgagcagug

SEQ ID NO: 15665 - RNA, 22 nt, Pseudomonas aeruginosa PA01
agcggcggccccggcaacagcg

SEQ ID NO: 15666 - RNA, 22 nt, Pseudomonas aeruginosa PA01
agcggcgggugcugcuggaccu

SEQ ID NO: 15667 - RNA, 22 nt, Pseudomonas aeruginosa PA01
agcggcgugcgcagcucguggg

SEQ ID NO: 15668 - RNA, 22 nt, Pseudomonas aeruginosa PA01
agcguggccuucuccucggaca

SEQ ID NO: 15669 - RNA, 22 nt, Pseudomonas aeruginosa PA01
aggccgaagcgcugcgccagca

SEQ ID NO: 15670 - RNA, 22 nt, Pseudomonas aeruginosa PA01
aggccgagcgcgaagccuuguc

SEQ ID NO: 15671 - RNA, 22 nt, Pseudomonas aeruginosa PA01
aggccgaguugcgccaggacga

SEQ ID NO: 15672 - RNA, 22 nt, Pseudomonas aeruginosa PA01
aggccgcacgccuggucgggcu

SEQ ID NO: 15673 - RNA, 22 nt, Pseudomonas aeruginosa PA01
aggccgcgcuuuccggcuccag

SEQ ID NO: 15674 - RNA, 22 nt, Pseudomonas aeruginosa PA01
aggccggcgccgaggccagugc

SEQ ID NO: 15675 - RNA, 22 nt, Pseudomonas aeruginosa PA01
aggccggcuuucagcgcggcca

SEQ ID NO: 15676 - RNA, 22 nt, Pseudomonas aeruginosa PA01
aggccggguagcgccucgcugg

SEQ ID NO: 15677 - RNA, 22 nt, Pseudomonas aeruginosa PA01
aggccggguugauggccaggau

SEQ ID NO: 15678 - RNA, 22 nt, Pseudomonas aeruginosa PA01
aggcgcaggcgcaacuggcaga

SEQ ID NO: 15679 - RNA, 22 nt, Pseudomonas aeruginosa PA01
aggcgccgcuugaugguuucgg

SEQ ID NO: 15680 - RNA, 22 nt, Pseudomonas aeruginosa PA01
aggcgccgcuugauguucugca

SEQ ID NO: 15681 - RNA, 22 nt, Pseudomonas aeruginosa PA01
aggcgcgccaggucggacaggu

SEQ ID NO: 15682 - RNA, 22 nt, Pseudomonas aeruginosa PA01
aggcggcgcaggccgagaccga

SEQ ID NO: 15683 - RNA, 22 nt, Pseudomonas aeruginosa PA01
aggcuacgaccgauuucagccg

SEQ ID NO: 15684 - RNA, 22 nt, Pseudomonas aeruginosa PA01
aggcucaggcaggccgccggca

SEQ ID NO: 15685 - RNA, 22 nt, Pseudomonas aeruginosa PA01
aggcuuccuucaacuugucgcc

SEQ ID NO: 15686 - RNA, 22 nt, Pseudomonas aeruginosa PA01
aggagcgcgcggugaucgcccu

SEQ ID NO: 15687 - RNA, 22 nt, Pseudomonas aeruginosa PA01
aggaggcgucggcgucgcccgc

SEQ ID NO: 15688 - RNA, 22 nt, Pseudomonas aeruginosa PA01
aggaacaguucgacgcccaggu

SEQ ID NO: 15689 - RNA, 22 nt, Pseudomonas aeruginosa PA01
agggcgaggccguucgccucgu

SEQ ID NO: 15690 - RNA, 22 nt, Pseudomonas aeruginosa PA01
agggcgcggucgccgucgaaca

SEQ ID NO: 15691 - RNA, 22 nt, Pseudomonas aeruginosa PA01
agggcgggaacugcgcgcgcag

SEQ ID NO: 15692 - RNA, 22 nt, Pseudomonas aeruginosa PA01
agagcgccgccagcgucacagu

SEQ ID NO: 15693 - RNA, 22 nt, Pseudomonas aeruginosa PA01
agccagcccugggcgucgcuca

SEQ ID NO: 15694 - RNA, 22 nt, Pseudomonas aeruginosa PA01
agccggaguugaccccgccguu

SEQ ID NO: 15695 - RNA, 22 nt, Pseudomonas aeruginosa PA01
agccggcgccaugcgucauggc

SEQ ID NO: 15696 - RNA, 22 nt, Pseudomonas aeruginosa PA01
agccguccagcuugagguaggc

SEQ ID NO: 15697 - RNA, 22 nt, Pseudomonas aeruginosa PA01
agccgugcuguccggagcggau

SEQ ID NO: 15698 - RNA, 22 nt, Pseudomonas aeruginosa PA01
agcugcgcgaaggcgauacgcu

SEQ ID NO: 15699 - RNA, 22 nt, Pseudomonas aeruginosa PA01
agcuggaagaucaccuguucga

SEQ ID NO: 15700 - RNA, 22 nt, Pseudomonas aeruginosa PA01
agcuggaaggccagcucgcggc

SEQ ID NO: 15701 - RNA, 20 nt, Pseudomonas aeruginosa PA01
agcgacccuugagcgccggc

SEQ ID NO: 15702 - RNA, 22 nt, Pseudomonas aeruginosa PA01
agcgaggcgucuggcacggcga

SEQ ID NO: 15703 - RNA, 22 nt, Pseudomonas aeruginosa PA01
agcgcagcaaugccaccgugca

SEQ ID NO: 15704 - RNA, 22 nt, Pseudomonas aeruginosa PA01
agcgcagcaggcaggccuggua

SEQ ID NO: 15705 - RNA, 22 nt, Pseudomonas aeruginosa PA01
agcgccacgguggcgccgguga

SEQ ID NO: 15706 - RNA, 22 nt, Pseudomonas aeruginosa PA01
agcgccucgcgcucggcaugac

SEQ ID NO: 15707 - RNA, 22 nt, Pseudomonas aeruginosa PA01
agcgcgaggccagccagcaacu

SEQ ID NO: 15708 - RNA, 22 nt, Pseudomonas aeruginosa PA01
agcgcgcacgcacacccagcuc

SEQ ID NO: 15709 - RNA, 22 nt, Pseudomonas aeruginosa PA01
agcgcgcccuggagcacaaggu

SEQ ID NO: 15710 - RNA, 22 nt, Pseudomonas aeruginosa PA01
agcgcgcggacuaccggguggc

SEQ ID NO: 15711 - RNA, 22 nt, Pseudomonas aeruginosa PA01
agcgcggccggcucgacgaggu

SEQ ID NO: 15712 - RNA, 22 nt, Pseudomonas aeruginosa PA01
agcgcggcggguauugcgacau

SEQ ID NO: 15713 - RNA, 22 nt, Pseudomonas aeruginosa PA01
agcgcgugguucagcagcacau

SEQ ID NO: 15714 - RNA, 22 nt, Pseudomonas aeruginosa PA01
agcggcagcaacgccagucccu

SEQ ID NO: 15715 - RNA, 22 nt, Pseudomonas aeruginosa PA01
agcggccggaugagccagggca

SEQ ID NO: 15716 - RNA, 22 nt, Pseudomonas aeruginosa PA01
agcggcgccagcaggugaugga

SEQ ID NO: 15717 - RNA, 22 nt, Pseudomonas aeruginosa PA01
agcggcgccuucaagcgucuca

SEQ ID NO: 15718 - RNA, 22 nt, Pseudomonas aeruginosa PA01
agcggcgcggugguuggcgugc

SEQ ID NO: 15719 - RNA, 22 nt, Pseudomonas aeruginosa PA01
agcggcggugccugaacuggag

SEQ ID NO: 15720 - RNA, 22 nt, Pseudomonas aeruginosa PA01
agcgggagaucgccaguugaug

SEQ ID NO: 15721 - RNA, 22 nt, Pseudomonas aeruginosa PA01
agcgggcguuugcggcgaccug

SEQ ID NO: 15722 - RNA, 22 nt, Pseudomonas aeruginosa PA01
agcguggcuggcggucaccggg

SEQ ID NO: 15723 - RNA, 22 nt, Pseudomonas aeruginosa PA01
agaucuggaacgacuuccuguu

SEQ ID NO: 15724 - RNA, 22 nt, Pseudomonas aeruginosa PA01
agcacgcgcucguagccgaugu

SEQ ID NO: 15725 - RNA, 22 nt, Pseudomonas aeruginosa PA01
agcaccagguaggacagcgccu

SEQ ID NO: 15726 - RNA, 22 nt, Pseudomonas aeruginosa PA01
agcaccccgccgaccagcauca

SEQ ID NO: 15727 - RNA, 22 nt, Pseudomonas aeruginosa PA01
agaggccgcgcucgccgagcau

SEQ ID NO: 15728 - RNA, 22 nt, Pseudomonas aeruginosa PA01
agaccaggccggacagguacca

SEQ ID NO: 15729 - RNA, 22 nt, Pseudomonas aeruginosa PA01
agacccagcuccggggucucug

SEQ ID NO: 15730 - RNA, 22 nt, Pseudomonas aeruginosa PA01
acugggaucggccagcuugcgg

SEQ ID NO: 15731 - RNA, 22 nt, Pseudomonas aeruginosa PA01
accccgggcacccugacggcuu

SEQ ID NO: 15732 - RNA, 22 nt, Pseudomonas aeruginosa PA01
acccggaccgaggucaaguaag

SEQ ID NO: 15733 - RNA, 22 nt, Pseudomonas aeruginosa PA01
accggcagaccaucggcggcua

SEQ ID NO: 15734 - RNA, 22 nt, Pseudomonas aeruginosa PA01
acuccggccgccgcacgccagg

SEQ ID NO: 15735 - RNA, 22 nt, Pseudomonas aeruginosa PA01
acgucggcggcaugcugcgcuc

SEQ ID NO: 15736 - RNA, 22 nt, Pseudomonas aeruginosa PA01
acgaugcgcuccgaguagccgc

SEQ ID NO: 15737 - RNA, 22 nt, Pseudomonas aeruginosa PA01
acgcagcgcaugcucguagccg

SEQ ID NO: 15738 - RNA, 22 nt, Pseudomonas aeruginosa PA01
acgccggccuggagggcgcucg

SEQ ID NO: 15739 - RNA, 22 nt, Pseudomonas aeruginosa PA01
acgcgcgcaaccgacggcaggg

SEQ ID NO: 15740 - RNA, 22 nt, Pseudomonas aeruginosa PA01
acggaagcgauccgugccuggu

SEQ ID NO: 15741 - RNA, 22 nt, Pseudomonas aeruginosa PA01
acggcucccaagcucagcgacg

SEQ ID NO: 15742 - RNA, 22 nt, Pseudomonas aeruginosa PA01
accugagcgucggcggcgcggu

SEQ ID NO: 15743 - RNA, 22 nt, Pseudomonas aeruginosa PA01
accuggagcuggaggccuugcc

SEQ ID NO: 15744 - RNA, 23 nt, Pseudomonas aeruginosa PA01
acgucggcugggagcguucgcgc

SEQ ID NO: 15745 - RNA, 22 nt, Pseudomonas aeruginosa PA01
acggaagcggaagaaccaggcc

SEQ ID NO: 15746 - RNA, 22 nt, Pseudomonas aeruginosa PA01
acggcagccugcggcugcuggu

SEQ ID NO: 15747 - RNA, 22 nt, Pseudomonas aeruginosa PA01
agcagcggguggccaugggccg

SEQ ID NO: 15748 - RNA, 22 nt, Pseudomonas aeruginosa PA01
agcaggccggcgauggcgucgc

SEQ ID NO: 15749 - RNA, 22 nt, Pseudomonas aeruginosa PA01
agcaggcgaucgagcaugccgc

SEQ ID NO: 15750 - RNA, 22 nt, Pseudomonas aeruginosa PA01
agcagguccuucgagcgacccg

SEQ ID NO: 15751 - RNA, 22 nt, Pseudomonas aeruginosa PA01
agcaggucguggccggccaggg

SEQ ID NO: 15752 - RNA, 22 nt, Pseudomonas aeruginosa PA01
accaggccgccgccuuccucgu

SEQ ID NO: 15753 - RNA, 22 nt, Pseudomonas aeruginosa PA01
accacgagcgcgagcugucgac

SEQ ID NO: 15754 - RNA, 23 nt, Pseudomonas aeruginosa PA01
accagcaggacagcuucgacuuc

SEQ ID NO: 15755 - RNA, 22 nt, Pseudomonas aeruginosa PA01
agagcgaggccaggcgccugga

SEQ ID NO: 15756 - RNA, 19 nt, Pseudomonas aeruginosa PA01
agagcgcggugaucgagcc

SEQ ID NO: 15757 - RNA, 22 nt, Pseudomonas aeruginosa PA01
agagcggccugcgcuucggcga

SEQ ID NO: 15758 - RNA, 22 nt, Pseudomonas aeruginosa PA01
agagcggcuugcuggucggcgc

SEQ ID NO: 15759 - RNA, 22 nt, Pseudomonas aeruginosa PA01
agucgcugaugaaguucaccgc

SEQ ID NO: 15760 - RNA, 22 nt, Pseudomonas aeruginosa PA01
agguugauguacaucauggcgu

SEQ ID NO: 15761 - RNA, 22 nt, Pseudomonas aeruginosa PA01
agguggagcguugcggcgccgg

SEQ ID NO: 15762 - RNA, 22 nt, Pseudomonas aeruginosa PA01
aucagcccggcgaucccgccug

SEQ ID NO: 15763 - RNA, 22 nt, Pseudomonas aeruginosa PA01
auccccggauugcucaggcggu

SEQ ID NO: 15764 - RNA, 22 nt, Pseudomonas aeruginosa PA01
auccgucgcgccgcuaccaucc

SEQ ID NO: 15765 - RNA, 22 nt, Pseudomonas aeruginosa PA01
aucggcccucugcggcaggcgg

SEQ ID NO: 15766 - RNA, 22 nt, Pseudomonas aeruginosa PA01
augccgaaggcgaucgaggcga

SEQ ID NO: 15767 - RNA, 22 nt, Pseudomonas aeruginosa PA01
augccggccaccggagccggcg

SEQ ID NO: 15768 - RNA, 22 nt, Pseudomonas aeruginosa PA01
augcgcccugcccgucugcugg

SEQ ID NO: 15769 - RNA, 22 nt, Pseudomonas aeruginosa PA01
augcggcagguggcgaagaccg

SEQ ID NO: 15770 - RNA, 20 nt, Pseudomonas aeruginosa PA01
augcugaauucgccgccggc

SEQ ID NO: 15771 - RNA, 18 nt, Pseudomonas aeruginosa PA01
cagaccagcgccagcggc

SEQ ID NO: 15772 - RNA, 22 nt, Pseudomonas aeruginosa PA01
cagagcggccuguucggcgggc

SEQ ID NO: 15773 - RNA, 22 nt, Pseudomonas aeruginosa PA01
caagcgccugcgcgccuuccug

SEQ ID NO: 15774 - RNA, 22 nt, Pseudomonas aeruginosa PA01
caccagcuggcggugauggccg

SEQ ID NO: 15775 - RNA, 22 nt, Pseudomonas aeruginosa PA01
caccgucgccuggcccagcggc

SEQ ID NO: 15776 - RNA, 22 nt, Pseudomonas aeruginosa PA01
ccaggccgcgcucuugccccac

SEQ ID NO: 15777 - RNA, 22 nt, Pseudomonas aeruginosa PA01
ccaggccggggcgaugaucgug

SEQ ID NO: 15778 - RNA, 22 nt, Pseudomonas aeruginosa PA01
ccaggccguccucgcggacgaa

SEQ ID NO: 15779 - RNA, 22 nt, Pseudomonas aeruginosa PA01
ccaggcgcagguugagcaggaa

SEQ ID NO: 15780 - RNA, 22 nt, Pseudomonas aeruginosa PA01
ccagggcacgcugggcgucggc

SEQ ID NO: 15781 - RNA, 22 nt, Pseudomonas aeruginosa PA01
ccagggccucgagacucugccg

SEQ ID NO: 15782 - RNA, 22 nt, Pseudomonas aeruginosa PA01
cccagcaguugcugcuggcggc

SEQ ID NO: 15783 - RNA, 22 nt, Pseudomonas aeruginosa PA01
ccagcaggaaccgcgcgcgguu

SEQ ID NO: 15784 - RNA, 22 nt, Pseudomonas aeruginosa PA01
ccagccagccuucgccgaggcu

SEQ ID NO: 15785 - RNA, 22 nt, Pseudomonas aeruginosa PA01
ccagccugaccagccuggccac

SEQ ID NO: 15786 - RNA, 22 nt, Pseudomonas aeruginosa PA01
ccagcgccuggccaucgugcgc

SEQ ID NO: 15787 - RNA, 20 nt, Pseudomonas aeruginosa PA01
ccagcgcguggucgcgcagc

SEQ ID NO: 15788 - RNA, 21 nt, Pseudomonas aeruginosa PA01
ccaggcagugaccacaagggc

SEQ ID NO: 15789 - RNA, 22 nt, Pseudomonas aeruginosa PA01
ccaggccaacgaagccaacgaa

SEQ ID NO: 15790 - RNA, 22 nt, Pseudomonas aeruginosa PA01
ccgcccuggccuauccgcugcu

SEQ ID NO: 15791 - RNA, 22 nt, Pseudomonas aeruginosa PA01
ccgccgccgaccaugaacaucg

SEQ ID NO: 15792 - RNA, 22 nt, Pseudomonas aeruginosa PA01
ccgccggcaucggccugcacac

SEQ ID NO: 15793 - RNA, 22 nt, Pseudomonas aeruginosa PA01
ccgccggguacguugcagcaac

SEQ ID NO: 15794 - RNA, 22 nt, Pseudomonas aeruginosa PA01
ccgccgggugguguccucagcg

SEQ ID NO: 15795 - RNA, 22 nt, Pseudomonas aeruginosa PA01
ccgccuggguagcuacguggcg

SEQ ID NO: 15796 - RNA, 22 nt, Pseudomonas aeruginosa PA01
ccgcggcauggugguggucuac

SEQ ID NO: 15797 - RNA, 22 nt, Pseudomonas aeruginosa PA01
ccgcggcuauggcgucgaggcg

SEQ ID NO: 15798 - RNA, 22 nt, Pseudomonas aeruginosa PA01
ccgagcaggaagccuugcagcg

SEQ ID NO: 15799 - RNA, 22 nt, Pseudomonas aeruginosa PA01
ccgagggcaagccgcgcuacac

SEQ ID NO: 15800 - RNA, 22 nt, Pseudomonas aeruginosa PA01
ccgcacagccguaucggccugc

SEQ ID NO: 15801 - RNA, 22 nt, Pseudomonas aeruginosa PA01
cccuggaagaccugccggagaa

SEQ ID NO: 15802 - RNA, 22 nt, Pseudomonas aeruginosa PA01
ccccagggccgcggagcgcagg

SEQ ID NO: 15803 - RNA, 22 nt, Pseudomonas aeruginosa PA01
cccgagcugcucgaacuccacg

SEQ ID NO: 15804 - RNA, 19 nt, Pseudomonas aeruginosa PA01
cccgccgcgccggccugga

SEQ ID NO: 15805 - RNA, 22 nt, Pseudomonas aeruginosa PA01
cccgccgcugguggucgacguc

SEQ ID NO: 15806 - RNA, 22 nt, Pseudomonas aeruginosa PA01
cccgcggcuggcugcgcuaccg

SEQ ID NO: 15807 - RNA, 22 nt, Pseudomonas aeruginosa PA01
cccgcuccguuggggccgagga

SEQ ID NO: 15808 - RNA, 22 nt, Pseudomonas aeruginosa PA01
cccggagcuggucaaccaggac

SEQ ID NO: 15809 - RNA, 22 nt, Pseudomonas aeruginosa PA01
cccggccggcgaugcaguggag

SEQ ID NO: 15810 - RNA, 22 nt, Pseudomonas aeruginosa PA01
cccggcgggcaccuguguggcc

SEQ ID NO: 15811 - RNA, 22 nt, Pseudomonas aeruginosa PA01
cccggcucguuggucacggcga

SEQ ID NO: 15812 - RNA, 22 nt, Pseudomonas aeruginosa PA01
cccggcuguucguugaucggcu

SEQ ID NO: 15813 - RNA, 22 nt, Pseudomonas aeruginosa PA01
cccggggacaugucguccagcc

SEQ ID NO: 15814 - RNA, 22 nt, Pseudomonas aeruginosa PA01
cauccggcggacagcccgcccc

SEQ ID NO: 15815 - RNA, 22 nt, Pseudomonas aeruginosa PA01
cagucucagugucugcggugcu

SEQ ID NO: 15816 - RNA, 22 nt, Pseudomonas aeruginosa PA01
cagggcgcuauucgcccuacgg

SEQ ID NO: 15817 - RNA, 22 nt, Pseudomonas aeruginosa PA01
ccaccggcaccggcgccgaggu

SEQ ID NO: 15818 - RNA, 22 nt, Pseudomonas aeruginosa PA01
ccaccuccuccccggugagcag

SEQ ID NO: 15819 - RNA, 22 nt, Pseudomonas aeruginosa PA01
ccacgaaggccaucugcauggu

SEQ ID NO: 15820 - RNA, 22 nt, Pseudomonas aeruginosa PA01
ccacgagccggagcuggccuuc

SEQ ID NO: 15821 - RNA, 22 nt, Pseudomonas aeruginosa PA01
cagccgcgccaggccaggcgcu

SEQ ID NO: 15822 - RNA, 22 nt, Pseudomonas aeruginosa PA01
cagccagcccggcggucuccgc

SEQ ID NO: 15823 - RNA, 22 nt, Pseudomonas aeruginosa PA01
cagcagccgaucgucgcgcucg

SEQ ID NO: 15824 - RNA, 22 nt, Pseudomonas aeruginosa PA01
cagcagccuggccggcaguuuu

SEQ ID NO: 15825 - RNA, 22 nt, Pseudomonas aeruginosa PA01
cagcagcgccucggcgccgaac

SEQ ID NO: 15826 - RNA, 22 nt, Pseudomonas aeruginosa PA01
cagcgccagcggaauccccgag

SEQ ID NO: 15827 - RNA, 22 nt, Pseudomonas aeruginosa PA01
cagcgccagcggccggcuccug

SEQ ID NO: 15828 - RNA, 22 nt, Pseudomonas aeruginosa PA01
cagcgcgccgauacccaugccg

SEQ ID NO: 15829 - RNA, 22 nt, Pseudomonas aeruginosa PA01
cagcgcgcgagugagcaugggc

SEQ ID NO: 15830 - RNA, 22 nt, Pseudomonas aeruginosa PA01
cagcgcguucuuggccugccag

SEQ ID NO: 15831 - RNA, 22 nt, Pseudomonas aeruginosa PA01
cagcgcuggugcgccgaggacu

SEQ ID NO: 15832 - RNA, 22 nt, Pseudomonas aeruginosa PA01
cagcggagagacuuuuucauua

SEQ ID NO: 15833 - RNA, 22 nt, Pseudomonas aeruginosa PA01
caggaugcgcuccagcucgccg

SEQ ID NO: 15834 - RNA, 22 nt, Pseudomonas aeruginosa PA01
cagcucggggaaaugccggccc

SEQ ID NO: 15835 - RNA, 22 nt, Pseudomonas aeruginosa PA01
cagcuggaaggcgcgcuugccg

SEQ ID NO: 15836 - RNA, 22 nt, Pseudomonas aeruginosa PA01
cagcuggaugcucgcgcucagc

SEQ ID NO: 15837 - RNA, 22 nt, Pseudomonas aeruginosa PA01
cagcgaccuggcgacgcgccug

SEQ ID NO: 15838 - RNA, 22 nt, Pseudomonas aeruginosa PA01
cagcgugccgucuucgaggcug

SEQ ID NO: 15839 - RNA, 22 nt, Pseudomonas aeruginosa PA01
caggcccagcugggucgcgguc

SEQ ID NO: 15840 - RNA, 22 nt, Pseudomonas aeruginosa PA01
caggccgaacucgcccugggcg

SEQ ID NO: 15841 - RNA, 22 nt, Pseudomonas aeruginosa PA01
caggccgagcgcgcccuggccg

SEQ ID NO: 15842 - RNA, 22 nt, Pseudomonas aeruginosa PA01
caggccgccggcgaccugccag

SEQ ID NO: 15843 - RNA, 23 nt, Pseudomonas aeruginosa PA01
caggccguugcuggcagcguggg

SEQ ID NO: 15844 - RNA, 22 nt, Pseudomonas aeruginosa PA01
caggccuguagcgccgaggcgg

SEQ ID NO: 15845 - RNA, 21 nt, Pseudomonas aeruginosa PA01
caggcgcgggcccauccaguu

SEQ ID NO: 15846 - RNA, 22 nt, Pseudomonas aeruginosa PA01
caggcgcguggcccagcaggag

SEQ ID NO: 15847 - RNA, 22 nt, Pseudomonas aeruginosa PA01
cguccggcaucagggcguaguc

SEQ ID NO: 15848 - RNA, 22 nt, Pseudomonas aeruginosa PA01
cgucggccaggaggugguacgc

SEQ ID NO: 15849 - RNA, 22 nt, Pseudomonas aeruginosa PA01
cgucggccaggcgcaugccgcc

SEQ ID NO: 15850 - RNA, 22 nt, Pseudomonas aeruginosa PA01
cgucggccucgcguugccagcg

SEQ ID NO: 15851 - RNA, 22 nt, Pseudomonas aeruginosa PA01
cgucgugcagcaucgcggccau

SEQ ID NO: 15852 - RNA, 22 nt, Pseudomonas aeruginosa PA01
cguacggcacagcgccuugucc

SEQ ID NO: 15853 - RNA, 22 nt, Pseudomonas aeruginosa PA01
cguagcgcauuuccugggccuu

SEQ ID NO: 15854 - RNA, 22 nt, Pseudomonas aeruginosa PA01
cguggcagaaggccgaggcgcg

SEQ ID NO: 15855 - RNA, 22 nt, Pseudomonas aeruginosa PA01
cguggcccuggugacccugguc

SEQ ID NO: 15856 - RNA, 22 nt, Pseudomonas aeruginosa PA01
cguggcgagcaggcggucggcg

SEQ ID NO: 15857 - RNA, 22 nt, Pseudomonas aeruginosa PA01
cguggcgaugcccgcauccagc

SEQ ID NO: 15858 - RNA, 22 nt, Pseudomonas aeruginosa PA01
cguggcgaugucggcguggccg

SEQ ID NO: 15859 - RNA, 20 nt, Pseudomonas aeruginosa PA01
cgugccgggcgguccgcgac

SEQ ID NO: 15860 - RNA, 22 nt, Pseudomonas aeruginosa PA01
cggggccacgugccagcaggag

SEQ ID NO: 15861 - RNA, 22 nt, Pseudomonas aeruginosa PA01
cgggccaggcacuacgugcucu

SEQ ID NO: 15862 - RNA, 22 nt, Pseudomonas aeruginosa PA01
cgggccaguuggaccaggaucg

SEQ ID NO: 15863 - RNA, 22 nt, Pseudomonas aeruginosa PA01
cggcuguuguuucccaaggcgg

SEQ ID NO: 15864 - RNA, 22 nt, Pseudomonas aeruginosa PA01
cggcuucgcgcagggccgccag

SEQ ID NO: 15865 - RNA, 22 nt, Pseudomonas aeruginosa PA01
cgguagcgguccgugcccagcc

SEQ ID NO: 15866 - RNA, 22 nt, Pseudomonas aeruginosa PA01
cgguccggcggaagcaggucgg

SEQ ID NO: 15867 - RNA, 20 nt, Pseudomonas aeruginosa PA01
cggucggcgaggcgccuggc

SEQ ID NO: 15868 - RNA, 22 nt, Pseudomonas aeruginosa PA01
cggugcgcaugaaggcgaggaa

SEQ ID NO: 15869 - RNA, 20 nt, Pseudomonas aeruginosa PA01
cggugggcugcaucuuuucc

SEQ ID NO: 15870 - RNA, 22 nt, Pseudomonas aeruginosa PA01
cggugggcuggaagguccggcu

SEQ ID NO: 15871 - RNA, 21 nt, Pseudomonas aeruginosa PA01
cggccgagcgcugguaccgcg

SEQ ID NO: 15872 - RNA, 22 nt, Pseudomonas aeruginosa PA01
cggccgaggaaauagcccuggc

SEQ ID NO: 15873 - RNA, 21 nt, Pseudomonas aeruginosa PA01
cggccgggagcgccuggaugc

SEQ ID NO: 15874 - RNA, 22 nt, Pseudomonas aeruginosa PA01
cggccuggccauggcgguggac

SEQ ID NO: 15875 - RNA, 22 nt, Pseudomonas aeruginosa PA01
cggccuggcugaacgacagcgu

SEQ ID NO: 15876 - RNA, 22 nt, Pseudomonas aeruginosa PA01
cggcgaacgggaaggugccgac

SEQ ID NO: 15877 - RNA, 23 nt, Pseudomonas aeruginosa PA01
cggcgaccagcgccgccaggcag

SEQ ID NO: 15878 - RNA, 22 nt, Pseudomonas aeruginosa PA01
cggcgaccugcgcgugcaguuc

SEQ ID NO: 15879 - RNA, 22 nt, Pseudomonas aeruginosa PA01
cggcgagccguccuugcgcaga

SEQ ID NO: 15880 - RNA, 22 nt, Pseudomonas aeruginosa PA01
cggcgagcugcuccgcguggcu

SEQ ID NO: 15881 - RNA, 22 nt, Pseudomonas aeruginosa PA01
cggcgaucugcucggcgagggc

SEQ ID NO: 15882 - RNA, 22 nt, Pseudomonas aeruginosa PA01
cggcgcaggaaagggaucugcg

SEQ ID NO: 15883 - RNA, 22 nt, Pseudomonas aeruginosa PA01
cggcgcaggaugggcguggacg

SEQ ID NO: 15884 - RNA, 22 nt, Pseudomonas aeruginosa PA01
cggcgccgacaucgcgcagguc

SEQ ID NO: 15885 - RNA, 22 nt, Pseudomonas aeruginosa PA01
cggcgcgccagaccaccugguc

SEQ ID NO: 15886 - RNA, 22 nt, Pseudomonas aeruginosa PA01
cggcgcgccgaaggcgauaugg

SEQ ID NO: 15887 - RNA, 20 nt, Pseudomonas aeruginosa PA01
cggcgcgcuggcuaccggcc

SEQ ID NO: 15888 - RNA, 22 nt, Pseudomonas aeruginosa PA01
cggcggcacaggcggccugcac

SEQ ID NO: 15889 - RNA, 22 nt, Pseudomonas aeruginosa PA01
cggcggcagguuuucucgacgc

SEQ ID NO: 15890 - RNA, 22 nt, Pseudomonas aeruginosa PA01
cggcggccuugccgcucugcuc

SEQ ID NO: 15891 - RNA, 22 nt, Pseudomonas aeruginosa PA01
cggcgggcugcuggugagccag

SEQ ID NO: 15892 - RNA, 22 nt, Pseudomonas aeruginosa PA01
cggcguccuggaucagcgccug

SEQ ID NO: 15893 - RNA, 22 nt, Pseudomonas aeruginosa PA01
cggcguccuggucccggugcuc

SEQ ID NO: 15894 - RNA, 22 nt, Pseudomonas aeruginosa PA01
cggcuacccuggaguccgggcc

SEQ ID NO: 15895 - RNA, 22 nt, Pseudomonas aeruginosa PA01
cggcuacgccuacgugcccggc

SEQ ID NO: 15896 - RNA, 22 nt, Pseudomonas aeruginosa PA01
cggcuccauggccagggcgcgg

SEQ ID NO: 15897 - RNA, 22 nt, Pseudomonas aeruginosa PA01
cggcucgucuuccgggcccugc

SEQ ID NO: 15898 - RNA, 22 nt, Pseudomonas aeruginosa PA01
cggcucguucaucgccaucugc

SEQ ID NO: 15899 - RNA, 22 nt, Pseudomonas aeruginosa PA01
cggcauccagcagggucuggua

SEQ ID NO: 15900 - RNA, 22 nt, Pseudomonas aeruginosa PA01
cggcauccuggcgguucugggu

SEQ ID NO: 15901 - RNA, 22 nt, Pseudomonas aeruginosa PA01
cgggagcaacgcuaugcccggc

SEQ ID NO: 15902 - RNA, 22 nt, Pseudomonas aeruginosa PA01
cgggagcggaccgccugcucgg

SEQ ID NO: 15903 - RNA, 22 nt, Pseudomonas aeruginosa PA01
cgggauggucgcucggcggcaa

SEQ ID NO: 15904 - RNA, 22 nt, Pseudomonas aeruginosa PA01
cgggcagcaccucgccagccgg

SEQ ID NO: 15905 - RNA, 22 nt, Pseudomonas aeruginosa PA01
cgggcagcgcauccgacagcgc

SEQ ID NO: 15906 - RNA, 20 nt, Pseudomonas aeruginosa PA01
cggaagugguggucgccggg

SEQ ID NO: 15907 - RNA, 22 nt, Pseudomonas aeruginosa PA01
cggacgcccgguguaggugcug

SEQ ID NO: 15908 - RNA, 22 nt, Pseudomonas aeruginosa PA01
cggacgcggauuggccgccucg

SEQ ID NO: 15909 - RNA, 22 nt, Pseudomonas aeruginosa PA01
cggagcgcccuugagcuugggu

SEQ ID NO: 15910 - RNA, 22 nt, Pseudomonas aeruginosa PA01
cggaggaagccaccggacucga

SEQ ID NO: 15911 - RNA, 22 nt, Pseudomonas aeruginosa PA01
cggcacagaggccgggcccuga

SEQ ID NO: 15912 - RNA, 22 nt, Pseudomonas aeruginosa PA01
cggcaccgcugaagccggcgac

SEQ ID NO: 15913 - RNA, 22 nt, Pseudomonas aeruginosa PA01
cggcagcagcgccggcgaggag

SEQ ID NO: 15914 - RNA, 22 nt, Pseudomonas aeruginosa PA01
cucgccggccggacugauggug

SEQ ID NO: 15915 - RNA, 22 nt, Pseudomonas aeruginosa PA01
cucgccggcgccaugcagcagc

SEQ ID NO: 15916 - RNA, 22 nt, Pseudomonas aeruginosa PA01
cucgccggucaccgacgagcgc

SEQ ID NO: 15917 - RNA, 22 nt, Pseudomonas aeruginosa PA01
cuccguggugguggucuugccc

SEQ ID NO: 15918 - RNA, 22 nt, Pseudomonas aeruginosa PA01
cuccggccuucugaaggcucuu

SEQ ID NO: 15919 - RNA, 22 nt, Pseudomonas aeruginosa PA01
cugaacuucgacgguaugauug

SEQ ID NO: 15920 - RNA, 22 nt, Pseudomonas aeruginosa PA01
cugccggcaacucggcgauccc

SEQ ID NO: 15921 - RNA, 22 nt, Pseudomonas aeruginosa PA01
cugccggcaccggccuugacca

SEQ ID NO: 15922 - RNA, 22 nt, Pseudomonas aeruginosa PA01
cugccggcccugguggcggcgg

SEQ ID NO: 15923 - RNA, 22 nt, Pseudomonas aeruginosa PA01
cugcuucaaggagcacuagacu

SEQ ID NO: 15924 - RNA, 22 nt, Pseudomonas aeruginosa PA01
cuggaagcgcuggugccgccau

SEQ ID NO: 15925 - RNA, 22 nt, Pseudomonas aeruginosa PA01
cugcgcgccaauggcgauccga

SEQ ID NO: 15926 - RNA, 22 nt, Pseudomonas aeruginosa PA01
cugcaucacccgcucguggucc

SEQ ID NO: 15927 - RNA, 22 nt, Pseudomonas aeruginosa PA01
cuuccauggugacgccggucug

SEQ ID NO: 15928 - RNA, 22 nt, Pseudomonas aeruginosa PA01
cuucggccuuggcguccuguag

SEQ ID NO: 15929 - RNA, 22 nt, Pseudomonas aeruginosa PA01
cuuguguuuuuacugucgaaau

SEQ ID NO: 15930 - RNA, 22 nt, Pseudomonas aeruginosa PA01
cugggcggcugugccgcggugg

SEQ ID NO: 15931 - RNA, 22 nt, Pseudomonas aeruginosa PA01
ccgggcgcuggucugcgcggug

SEQ ID NO: 15932 - RNA, 22 nt, Pseudomonas aeruginosa PA01
ccggucuccgccgggcgguggc

SEQ ID NO: 15933 - RNA, 22 nt, Pseudomonas aeruginosa PA01
ccgguucuccagcaccaggcgg

SEQ ID NO: 15934 - RNA, 22 nt, Pseudomonas aeruginosa PA01
ccguccugccucguccgcgcag

SEQ ID NO: 15935 - RNA, 19 nt, Pseudomonas aeruginosa PA01
ccgucgccggcguuggucg

SEQ ID NO: 15936 - RNA, 22 nt, Pseudomonas aeruginosa PA01
ccgugcggaagacgccuuccaa

SEQ ID NO: 15937 - RNA, 22 nt, Pseudomonas aeruginosa PA01
ccucgccgcgagcguggcacuc

SEQ ID NO: 15938 - RNA, 22 nt, Pseudomonas aeruginosa PA01
ccucuccggcgacgaggccaag

SEQ ID NO: 15939 - RNA, 22 nt, Pseudomonas aeruginosa PA01
ccugagcgucagcgacgacggu

SEQ ID NO: 15940 - RNA, 22 nt, Pseudomonas aeruginosa PA01
ccuggccggccacgaccugcuc

SEQ ID NO: 15941 - RNA, 22 nt, Pseudomonas aeruginosa PA01
ccugcgaccagagcugggccag

SEQ ID NO: 15942 - RNA, 23 nt, Pseudomonas aeruginosa PA01
ccugcuccgcgauugccugggcg

SEQ ID NO: 15943 - RNA, 22 nt, Pseudomonas aeruginosa PA01
ccgcuccgacaggggcaaggcg

SEQ ID NO: 15944 - RNA, 22 nt, Pseudomonas aeruginosa PA01
ccgcuggacggggccucguuga

SEQ ID NO: 15945 - RNA, 22 nt, Pseudomonas aeruginosa PA01
ccggaagcccugagccgcucug

SEQ ID NO: 15946 - RNA, 22 nt, Pseudomonas aeruginosa PA01
ccggagccgguucgcaccuauc

SEQ ID NO: 15947 - RNA, 22 nt, Pseudomonas aeruginosa PA01
ccggagccguccgguaccacgu

SEQ ID NO: 15948 - RNA, 22 nt, Pseudomonas aeruginosa PA01
ccggagcgcccgggccuucguc

SEQ ID NO: 15949 - RNA, 22 nt, Pseudomonas aeruginosa PA01
ccggagcggcgagcagggcgag

SEQ ID NO: 15950 - RNA, 22 nt, Pseudomonas aeruginosa PA01
ccggcagccacugcgccugcug

SEQ ID NO: 15951 - RNA, 19 nt, Pseudomonas aeruginosa PA01
ccggcaucuuauggggcgu

SEQ ID NO: 15952 - RNA, 22 nt, Pseudomonas aeruginosa PA01
ccggcccgccgggugcggccug

SEQ ID NO: 15953 - RNA, 22 nt, Pseudomonas aeruginosa PA01
ccggccugucuucugccggaca

SEQ ID NO: 15954 - RNA, 22 nt, Pseudomonas aeruginosa PA01
ccggccuuggcguccggcuugc

SEQ ID NO: 15955 - RNA, 22 nt, Pseudomonas aeruginosa PA01
ccggcgccgugaccccgguggc

SEQ ID NO: 15956 - RNA, 22 nt, Pseudomonas aeruginosa PA01
ccggcgcgaagaugucguguuc

SEQ ID NO: 15957 - RNA, 22 nt, Pseudomonas aeruginosa PA01
ccggcgcgcuccugcagacccg

SEQ ID NO: 15958 - RNA, 22 nt, Pseudomonas aeruginosa PA01
ccggcgcugcugaucgcuucgu

SEQ ID NO: 15959 - RNA, 22 nt, Pseudomonas aeruginosa PA01
ccggcggcaucaggcccugcac

SEQ ID NO: 15960 - RNA, 22 nt, Pseudomonas aeruginosa PA01
ccggcggccaguuggcgggcca

SEQ ID NO: 15961 - RNA, 22 nt, Pseudomonas aeruginosa PA01
ccggcggguggaagucuggguc

SEQ ID NO: 15962 - RNA, 22 nt, Pseudomonas aeruginosa PA01
ccggcuccaccgaacuggaccg

SEQ ID NO: 15963 - RNA, 23 nt, Pseudomonas aeruginosa PA01
ccggcucgucucagucgagcuug

SEQ ID NO: 15964 - RNA, 22 nt, Pseudomonas aeruginosa PA01
ccggcugguagccggccggcag

SEQ ID NO: 15965 - RNA, 22 nt, Pseudomonas aeruginosa PA01
ccggcuuccucgaacugcucgg

SEQ ID NO: 15966 - RNA, 22 nt, Pseudomonas aeruginosa PA01
cgaacagcagcagcggagcgac

SEQ ID NO: 15967 - RNA, 22 nt, Pseudomonas aeruginosa PA01
cgaaccagcgcaacggcgcguc

SEQ ID NO: 15968 - RNA, 18 nt, Pseudomonas aeruginosa PA01
cgaccaggcguggcugua

SEQ ID NO: 15969 - RNA, 22 nt, Pseudomonas aeruginosa PA01
cgaccagggcgcggccggcgaa

SEQ ID NO: 15970 - RNA, 22 nt, Pseudomonas aeruginosa PA01
cgaccaggucguccugcgccga

SEQ ID NO: 15971 - RNA, 22 nt, Pseudomonas aeruginosa PA01
cgacccgccaggcgcugggcga

SEQ ID NO: 15972 - RNA, 22 nt, Pseudomonas aeruginosa PA01
ccuuggucaucgggguggaucg

SEQ ID NO: 15973 - RNA, 22 nt, Pseudomonas aeruginosa PA01
ccuggggcgccugcugcuacag

SEQ ID NO: 15974 - RNA, 22 nt, Pseudomonas aeruginosa PA01
ccugggcaagcucggcaagggc

SEQ ID NO: 15975 - RNA, 22 nt, Pseudomonas aeruginosa PA01
cgaagcgcugguucagggaggc

SEQ ID NO: 15976 - RNA, 22 nt, Pseudomonas aeruginosa PA01
cgagcagcucagugccuuccac

SEQ ID NO: 15977 - RNA, 23 nt, Pseudomonas aeruginosa PA01
cgagcagcucgccgagcugucgc

SEQ ID NO: 15978 - RNA, 22 nt, Pseudomonas aeruginosa PA01
cgagcagguguugcaggcgggu

SEQ ID NO: 15979 - RNA, 22 nt, Pseudomonas aeruginosa PA01
cgagcuggcgcuccuggccgcu

SEQ ID NO: 15980 - RNA, 22 nt, Pseudomonas aeruginosa PA01
cgaggaacaugccgaugaucau

SEQ ID NO: 15981 - RNA, 22 nt, Pseudomonas aeruginosa PA01
cgaggaaguugaggauggcguu

SEQ ID NO: 15982 - RNA, 22 nt, Pseudomonas aeruginosa PA01
cgaggaggacgcucgcggucgc

SEQ ID NO: 15983 - RNA, 21 nt, Pseudomonas aeruginosa PA01
cgaucgcccaggcggcgggca

SEQ ID NO: 15984 - RNA, 22 nt, Pseudomonas aeruginosa PA01
cgaucgccuggcacgccacccg

SEQ ID NO: 15985 - RNA, 21 nt, Pseudomonas aeruginosa PA01
cgaucggcaggcugucgucgu

SEQ ID NO: 15986 - RNA, 21 nt, Pseudomonas aeruginosa PA01
cgaugcgguccucgucccagc

SEQ ID NO: 15987 - RNA, 22 nt, Pseudomonas aeruginosa PA01
cgcugcagaccgagcccggcca

SEQ ID NO: 15988 - RNA, 22 nt, Pseudomonas aeruginosa PA01
cgcugcagccacucggccaggu

SEQ ID NO: 15989 - RNA, 22 nt, Pseudomonas aeruginosa PA01
cgcugcagccgcagauggccuu

SEQ ID NO: 15990 - RNA, 22 nt, Pseudomonas aeruginosa PA01
cgcugcaggaucaguucguggu

SEQ ID NO: 15991 - RNA, 22 nt, Pseudomonas aeruginosa PA01
cgcugcgcgguguccucggcga

SEQ ID NO: 15992 - RNA, 22 nt, Pseudomonas aeruginosa PA01
cgcuggagacccuggauuucgc

SEQ ID NO: 15993 - RNA, 22 nt, Pseudomonas aeruginosa PA01
cgcuggaguuggccaacgccag

SEQ ID NO: 15994 - RNA, 22 nt, Pseudomonas aeruginosa PA01
cgcuggcgccgguggcggugga

SEQ ID NO: 15995 - RNA, 22 nt, Pseudomonas aeruginosa PA01
cgccagagcccgguggcgaucc

SEQ ID NO: 15996 - RNA, 17 nt, Pseudomonas aeruginosa PA01
cgccagcgccgacagcc

SEQ ID NO: 15997 - RNA, 22 nt, Pseudomonas aeruginosa PA01
cgccccagguccuggccgccga

SEQ ID NO: 15998 - RNA, 22 nt, Pseudomonas aeruginosa PA01
cgcccggcaugggcacucgcau

SEQ ID NO: 15999 - RNA, 22 nt, Pseudomonas aeruginosa PA01
cgccaccgauacgcagccgguu

SEQ ID NO: 16000 - RNA, 21 nt, Pseudomonas aeruginosa PA01
cgcagcugucgaggucggcga

SEQ ID NO: 16001 - RNA, 22 nt, Pseudomonas aeruginosa PA01
cgcagcaggcgguacucggcgc

SEQ ID NO: 16002 - RNA, 22 nt, Pseudomonas aeruginosa PA01
cgagcgcuuccugaggcgcgua

SEQ ID NO: 16003 - RNA, 22 nt, Pseudomonas aeruginosa PA01
cgagcggccagggccugcaccg

SEQ ID NO: 16004 - RNA, 22 nt, Pseudomonas aeruginosa PA01
cgcacagcuccgcgacugggaa

SEQ ID NO: 16005 - RNA, 22 nt, Pseudomonas aeruginosa PA01
cgcacagggccggauccuugcu

SEQ ID NO: 16006 - RNA, 22 nt, Pseudomonas aeruginosa PA01
cgcaccagggucgggccgcgcu

SEQ ID NO: 16007 - RNA, 22 nt, Pseudomonas aeruginosa PA01
cgcccuggucgccgucaucgcg

SEQ ID NO: 16008 - RNA, 22 nt, Pseudomonas aeruginosa PA01
cgccgaccagcaggccgacgac

SEQ ID NO: 16009 - RNA, 22 nt, Pseudomonas aeruginosa PA01
cgccgacccgcaugcccagcga

SEQ ID NO: 16010 - RNA, 22 nt, Pseudomonas aeruginosa PA01
cgccgaccuuccauggcgcgcu

SEQ ID NO: 16011 - RNA, 22 nt, Pseudomonas aeruginosa PA01
cgccgcccucuugcggcgaacc

SEQ ID NO: 16012 - RNA, 19 nt, Pseudomonas aeruginosa PA01
cgccgccgaauccuucgcc

SEQ ID NO: 16013 - RNA, 22 nt, Pseudomonas aeruginosa PA01
cgccgccgauacgcagccgguu

SEQ ID NO: 16014 - RNA, 22 nt, Pseudomonas aeruginosa PA01
cgccggccgucguccucgaagu

SEQ ID NO: 16015 - RNA, 19 nt, Pseudomonas aeruginosa PA01
cgccggcgccgggcugauc

SEQ ID NO: 16016 - RNA, 22 nt, Pseudomonas aeruginosa PA01
cgccggcgcucaagggucgcua

SEQ ID NO: 16017 - RNA, 17 nt, Pseudomonas aeruginosa PA01
cgccggcggcgugcagg

SEQ ID NO: 16018 - RNA, 22 nt, Pseudomonas aeruginosa PA01
cgccggcuuccaccugcucgac

SEQ ID NO: 16019 - RNA, 18 nt, Pseudomonas aeruginosa PA01
cgccucgccgcugcgguc

SEQ ID NO: 16020 - RNA, 22 nt, Pseudomonas aeruginosa PA01
cgcgaacauggacuggaaccgg

SEQ ID NO: 16021 - RNA, 22 nt, Pseudomonas aeruginosa PA01
cgcgcagcgccaaggauggccu

SEQ ID NO: 16022 - RNA, 22 nt, Pseudomonas aeruginosa PA01
cgcgcagggcccgcucgcuggg

SEQ ID NO: 16023 - RNA, 22 nt, Pseudomonas aeruginosa PA01
cgcgcaguuuacccggagaacc

SEQ ID NO: 16024 - RNA, 22 nt, Pseudomonas aeruginosa PA01
cgcgccggcaggaaaaagcccc

SEQ ID NO: 16025 - RNA, 22 nt, Pseudomonas aeruginosa PA01
cgcgccggugucagcgggccag

SEQ ID NO: 16026 - RNA, 22 nt, Pseudomonas aeruginosa PA01
cgcgcgccgggccuguucaggg

SEQ ID NO: 16027 - RNA, 22 nt, Pseudomonas aeruginosa PA01
cgcgcgcuggucgguccgggau

SEQ ID NO: 16028 - RNA, 22 nt, Pseudomonas aeruginosa PA01
cgcgcgguugcuggcggugcuc

SEQ ID NO: 16029 - RNA, 22 nt, Pseudomonas aeruginosa PA01
cgcgcuggaacgacgucuaccu

SEQ ID NO: 16030 - RNA, 22 nt, Pseudomonas aeruginosa PA01
cgcggacagcugcgacgagcgg

SEQ ID NO: 16031 - RNA, 22 nt, Pseudomonas aeruginosa PA01
cgcggagcaggccgaccagcgg

SEQ ID NO: 16032 - RNA, 22 nt, Pseudomonas aeruginosa PA01
cgcggagccacucccuggcgcc

SEQ ID NO: 16033 - RNA, 22 nt, Pseudomonas aeruginosa PA01
cgcggcaggaggacggcagcgu

SEQ ID NO: 16034 - RNA, 22 nt, Pseudomonas aeruginosa PA01
cgcggcccucaccggcuucggc

SEQ ID NO: 16035 - RNA, 22 nt, Pseudomonas aeruginosa PA01
cgcggccgauggccgggcuggu

SEQ ID NO: 16036 - RNA, 19 nt, Pseudomonas aeruginosa PA01
cgcggccgggauccucggc

SEQ ID NO: 16037 - RNA, 22 nt, Pseudomonas aeruginosa PA01
cgcggcgagggccagcaggugc

SEQ ID NO: 16038 - RNA, 22 nt, Pseudomonas aeruginosa PA01
cgcggcgcucggcaucgaccau

SEQ ID NO: 16039 - RNA, 22 nt, Pseudomonas aeruginosa PA01
cgcggcucggauugccggcgga

SEQ ID NO: 16040 - RNA, 22 nt, Pseudomonas aeruginosa PA01
cgcggucgccgggguccagcug

SEQ ID NO: 16041 - RNA, 22 nt, Pseudomonas aeruginosa PA01
cgcggugcagcugcucgguggc

SEQ ID NO: 16042 - RNA, 22 nt, Pseudomonas aeruginosa PA01
cgcguacaucggugucggcgcg

SEQ ID NO: 16043 - RNA, 22 nt, Pseudomonas aeruginosa PA01
cgcgucagcgccaggaguuguc

SEQ ID NO: 16044 - RNA, 22 nt, Homo sapiens
ugacuagggacauucuuccacg

SEQ ID NO: 16045 - RNA, 22 nt, Homo sapiens
cuguaauguaaugagacuacau

SEQ ID NO: 16046 - RNA, 22 nt, Homo sapiens
aggaauguuaguacuucuuagu

SEQ ID NO: 16047 - RNA, 22 nt, Homo sapiens
caaugcauuauucucccacuuc

SEQ ID NO: 16048 - RNA, 19 nt, Homo sapiens
uuucaauguaaggauggag

SEQ ID NO: 16049 - RNA, 23 nt, Homo sapiens
ugugcacauuuacauauauacac

SEQ ID NO: 16050 - RNA, 22 nt, Homo sapiens
aagcuggauuucgcauccuguu

SEQ ID NO: 16051 - RNA, 22 nt, Homo sapiens
acugaucaauguuaaggcuuau

SEQ ID NO: 16052 - RNA, 22 nt, Homo sapiens
gugaacagaaccugggaucgaa

SEQ ID NO: 16053 - RNA, 22 nt, Homo sapiens
cugggaugugacuguugccccc

SEQ ID NO: 16054 - RNA, 22 nt, Homo sapiens
uaaugugaauagugcuguaaug

SEQ ID NO: 16055 - RNA, 22 nt, Homo sapiens
uuccacaaugguugaacuaauu

SEQ ID NO: 16056 - RNA, 22 nt, Homo sapiens
cugaaucauugcauuaucaagg

SEQ ID NO: 16057 - RNA, 22 nt, Homo sapiens
gacuagaaauuauuuagugagc

SEQ ID NO: 16058 - RNA, 22 nt, Homo sapiens
ugagaguauaaauugaugcagc

SEQ ID NO: 16059 - RNA, 22 nt, Homo sapiens
uaaggaacucugauaucuggaa

SEQ ID NO: 16060 - RNA, 22 nt, Homo sapiens
guaaauaccaguuucuggaaca

SEQ ID NO: 16061 - RNA, 22 nt, Homo sapiens
gacagugugauacuuagucuca

SEQ ID NO: 16062 - RNA, 22 nt, Homo sapiens
ggccuguaaacuagagacccug

SEQ ID NO: 16063 - RNA, 22 nt, Homo sapiens
cagccgggugagguggcuuguu

SEQ ID NO: 16064 - RNA, 22 nt, Homo sapiens
ucacacgugaacucaucacaga

SEQ ID NO: 16065 - RNA, 22 nt, Homo sapiens
ucagaacugauacuagaacuuu

SEQ ID NO: 16066 - RNA, 22 nt, Homo sapiens
aauacugagaugugagguacua

SEQ ID NO: 16067 - RNA, 22 nt, Homo sapiens
aucagaaucucuagugggacca

SEQ ID NO: 16068 - RNA, 23 nt, Homo sapiens
ucaugaggccauucaaauccauu

SEQ ID NO: 16069 - RNA, 21 nt, Homo sapiens
ugcagccauucagcccuaugc

SEQ ID NO: 16070 - RNA, 22 nt, Homo sapiens
uuaaaugcuagaauuuucuuug

SEQ ID NO: 16071 - RNA, 22 nt, Homo sapiens
aucauacuguuuugauuacugu

SEQ ID NO: 16072 - RNA, 22 nt, Homo sapiens
cacugcaguaaauugcgucggu

SEQ ID NO: 16073 - RNA, 18 nt, Homo sapiens
gugagaaugacuguucug

SEQ ID NO: 16074 - RNA, 18 nt, Homo sapiens
ucacuagacacugaaucu

SEQ ID NO: 16075 - RNA, 22 nt, Homo sapiens
uuuggcuuuuguaauaacugcc

SEQ ID NO: 16076 - RNA, 22 nt, Homo sapiens
uaugcacacacguguuuaugug

SEQ ID NO: 16077 - RNA, 23 nt, Homo sapiens
ucgguccccuuggcugcccucgg

SEQ ID NO: 16078 - RNA, 22 nt, Homo sapiens
auaugcacuauacacacguaua

SEQ ID NO: 16079 - RNA, 23 nt, Homo sapiens
uuuguguccccacccaaaucuca

SEQ ID NO: 16080 - RNA, 22 nt, Homo sapiens
uaaguagugugcauguauguau

SEQ ID NO: 16081 - RNA, 22 nt, Homo sapiens
guccuggagaagcguggaccgg

SEQ ID NO: 16082 - RNA, 22 nt, Homo sapiens
uagccucacaaagugcuuaaga

SEQ ID NO: 16083 - RNA, 20 nt, Homo sapiens
aucagagacuaggauugcca

SEQ ID NO: 16084 - RNA, 22 nt, Homo sapiens
augacuagaggagggauggcca

SEQ ID NO: 16085 - RNA, 22 nt, Homo sapiens
aucauauccuagauauaacuuc

SEQ ID NO: 16086 - RNA, 22 nt, Homo sapiens
aaaguggacuaagugaauauga

SEQ ID NO: 16087 - RNA, 22 nt, Homo sapiens
auuccaguuugugagaagcugu

SEQ ID NO: 16088 - RNA, 22 nt, Homo sapiens
uagcuggaguuuuuguuauagg

SEQ ID NO: 16089 - RNA, 22 nt, Homo sapiens
auaaagccaugagcuugagaug

SEQ ID NO: 16090 - RNA, 22 nt, Homo sapiens
gagcuggacuucuuaccuuuuc

SEQ ID NO: 16091 - RNA, 22 nt, Homo sapiens
uggaagugucugugcccagcuc

SEQ ID NO: 16092 - RNA, 22 nt, Homo sapiens
augugcacaugcuuacauguga

SEQ ID NO: 16093 - RNA, 22 nt, Homo sapiens
agugacaugggaucaaaucuga

SEQ ID NO: 16094 - RNA, 22 nt, Homo sapiens
uuggucucaucaagagcagcuu

SEQ ID NO: 16095 - RNA, 22 nt, Homo sapiens
aggaaguaauaaguuugguucu

SEQ ID NO: 16096 - RNA, 22 nt, Homo sapiens
aaauugcacaaguggugauuug

SEQ ID NO: 16097 - RNA, 23 nt, Homo sapiens
agagugcaauggugccaucucgg

SEQ ID NO: 16098 - RNA, 20 nt, Homo sapiens
uggaaguaagaauauaggug

SEQ ID NO: 16099 - RNA, 22 nt, Homo sapiens
auaugcauacauguaugcagga

SEQ ID NO: 16100 - RNA, 17 nt, Homo sapiens
ucuaauaauaugcauuu

SEQ ID NO: 16101 - RNA, 22 nt, Homo sapiens
acuagguaguaaucugcagaga

SEQ ID NO: 16102 - RNA, 22 nt, Homo sapiens
gagcuagguuuugaauccagac

SEQ ID NO: 16103 - RNA, 22 nt, Homo sapiens
gcuaggagauccacugcucucu

SEQ ID NO: 16104 - RNA, 22 nt, Homo sapiens
uggaaaguccaagccaaccggg

SEQ ID NO: 16105 - RNA, 22 nt, Homo sapiens
ccuucuuuuguaaggcugaaua

SEQ ID NO: 16106 - RNA, 22 nt, Homo sapiens
auccugaagcuuuacugaauuc

SEQ ID NO: 16107 - RNA, 22 nt, Homo sapiens
uuccaugagaugcaucaaagcu

SEQ ID NO: 16108 - RNA, 22 nt, Homo sapiens
uugacaaggagccauugcaucu

SEQ ID NO: 16109 - RNA, 21 nt, Homo sapiens
ugacuagggauaugugccacu

SEQ ID NO: 16110 - RNA, 22 nt, Homo sapiens
ucacuagaucaagggagagaaa

SEQ ID NO: 16111 - RNA, 22 nt, Homo sapiens
ucacucagaccuggugauaugc

SEQ ID NO: 16112 - RNA, 22 nt, Homo sapiens
aagcuggagugcaguggugcga

SEQ ID NO: 16113 - RNA, 22 nt, Homo sapiens
ugacggaggcauuggaagcuug

SEQ ID NO: 16114 - RNA, 22 nt, Homo sapiens
guggaagugucuggggccaggg

SEQ ID NO: 16115 - RNA, 22 nt, Homo sapiens
auggaggccuacagaauuuugg

SEQ ID NO: 16116 - RNA, 19 nt, Homo sapiens
ugcauugucugggaaaugg

SEQ ID NO: 16117 - RNA, 22 nt, Homo sapiens
augacuauugcacuuuccuggu

SEQ ID NO: 16118 - RNA, 22 nt, Homo sapiens
uggcucuuucuagacuuaauua

SEQ ID NO: 16119 - RNA, 22 nt, Homo sapiens
ugaggauaguguugaaggcagg

SEQ ID NO: 16120 - RNA, 22 nt, Homo sapiens
aauacugaaaguauuuucaaau

SEQ ID NO: 16121 - RNA, 18 nt, Homo sapiens
gacagugugaagauuccu

SEQ ID NO: 16122 - RNA, 22 nt, Homo sapiens
uggagacugaucccucuuuccu

SEQ ID NO: 16123 - RNA, 22 nt, Homo sapiens
ccacauuaccuugcuugcucca

SEQ ID NO: 16124 - RNA, 22 nt, Homo sapiens
acuuuuugauggggagaacauu

SEQ ID NO: 16125 - RNA, 23 nt, Homo sapiens
aggaaguaacuaucuuuucuguc

SEQ ID NO: 16126 - RNA, 21 nt, Homo sapiens
augugcacuaugucauuuaau

SEQ ID NO: 16127 - RNA, 22 nt, Homo sapiens
ucauaucauuagaucuacugua

SEQ ID NO: 16128 - RNA, 22 nt, Homo sapiens
augugacuugugaaaaguucag

SEQ ID NO: 16129 - RNA, 22 nt, Homo sapiens
aggcagcuguuauauacugagu

SEQ ID NO: 16130 - RNA, 22 nt, Homo sapiens
gacaguguggcgauuccucaag

SEQ ID NO: 16131 - RNA, 19 nt, Homo sapiens
ugcagcaauguaaaagaca

SEQ ID NO: 16132 - RNA, 22 nt, Homo sapiens
ggacuaggagcuaggaagaucu

SEQ ID NO: 16133 - RNA, 22 nt, Homo sapiens
cacaguguucauagccaucagg

SEQ ID NO: 16134 - RNA, 22 nt, Homo sapiens
guuaagaaguguaacuuaaguu

SEQ ID NO: 16135 - RNA, 19 nt, Homo sapiens
uccccgggucuagugcagc

SEQ ID NO: 16136 - RNA, 20 nt, Homo sapiens
cagucaugaagaacugugag

SEQ ID NO: 16137 - RNA, 19 nt, Homo sapiens
acagcugguuuugguuucu

SEQ ID NO: 16138 - RNA, 22 nt, Homo sapiens
acuauacuguaacuguauucag

SEQ ID NO: 16139 - RNA, 22 nt, Homo sapiens
ucagggacuuacaaaccagaag

SEQ ID NO: 16140 - RNA, 22 nt, Homo sapiens
ugauauauugaaugaugaaaca

SEQ ID NO: 16141 - RNA, 18 nt, Homo sapiens
gacaguguggugauuccu

SEQ ID NO: 16142 - RNA, 22 nt, Homo sapiens
uggaaaguacuugaguuuguau

SEQ ID NO: 16143 - RNA, 22 nt, Homo sapiens
uuugguguauaaaaaugcuagu

SEQ ID NO: 16144 - RNA, 22 nt, Homo sapiens
ugaaaugaucaguuugguuacu

SEQ ID NO: 16145 - RNA, 22 nt, Homo sapiens
augagucacuuauuauuggggu

SEQ ID NO: 16146 - RNA, 22 nt, Homo sapiens
auuacccuuagacuccagagug

SEQ ID NO: 16147 - RNA, 22 nt, Homo sapiens
ugugguuuuuuucuccaauagg

SEQ ID NO: 16148 - RNA, 22 nt, Homo sapiens
gccuguagaagaguagaugacc

SEQ ID NO: 16149 - RNA, 22 nt, Homo sapiens
uauugaauuugagcugucucuu

SEQ ID NO: 16150 - RNA, 22 nt, Homo sapiens
acacuuucuggagcugcacaua

SEQ ID NO: 16151 - RNA, 22 nt, Homo sapiens
uggcuccguuguacaggcugga

SEQ ID NO: 16152 - RNA, 22 nt, Homo sapiens
ugggcggagacgugcagccgcc

SEQ ID NO: 16153 - RNA, 22 nt, Homo sapiens
ggccggguggccauggcugccc

SEQ ID NO: 16154 - RNA, 22 nt, Homo sapiens
uaaguaguauaagguuuuuuga

SEQ ID NO: 16155 - RNA, 22 nt, Homo sapiens
agcuuuuugggcagcuauugac

SEQ ID NO: 16156 - RNA, 22 nt, Homo sapiens
auuccagguggcgccauucaca

SEQ ID NO: 16157 - RNA, 22 nt, Homo sapiens
gggaagugugcagaguucucuu

SEQ ID NO: 16158 - RNA, 22 nt, Homo sapiens
ucaaauuccaagucuagguagg

SEQ ID NO: 16159 - RNA, 22 nt, Homo sapiens
ugagcagagaagugcccugcgc

SEQ ID NO: 16160 - RNA, 22 nt, Homo sapiens
auggacagaaaaaaauagaugu

SEQ ID NO: 16161 - RNA, 22 nt, Homo sapiens
uuggaaagagguguuuaugacu

SEQ ID NO: 16162 - RNA, 22 nt, Homo sapiens
uuuccagguggccaacauuuua

SEQ ID NO: 16163 - RNA, 22 nt, Homo sapiens
gaucacauuguuucauacauau

SEQ ID NO: 16164 - RNA, 22 nt, Homo sapiens
acaguguguguguucaccuaga

SEQ ID NO: 16165 - RNA, 21 nt, Homo sapiens
auggaaagacugccucuucaa

SEQ ID NO: 16166 - RNA, 22 nt, Homo sapiens
ugacauggagguggaggaagau

SEQ ID NO: 16167 - RNA, 22 nt, Homo sapiens
ugagguuauuuguucaagaagu

SEQ ID NO: 16168 - RNA, 22 nt, Homo sapiens
gaagcauugauccacaggcgug

SEQ ID NO: 16169 - RNA, 22 nt, Homo sapiens
ugugguuuuaguaaaacuaugu

SEQ ID NO: 16170 - RNA, 22 nt, Homo sapiens
ugagcagaaagcugcaaggucg

SEQ ID NO: 16171 - RNA, 22 nt, Homo sapiens
cuggaggccugaacauaaaugg

SEQ ID NO: 16172 - RNA, 22 nt, Homo sapiens
agagaacugauuggaugugggc

SEQ ID NO: 16173 - RNA, 22 nt, Homo sapiens
ugaaagacugaaagcuuuucuu

SEQ ID NO: 16174 - RNA, 22 nt, Homo sapiens
gaagcgaggugauuagcagaca

SEQ ID NO: 16175 - RNA, 22 nt, Homo sapiens
uugggacuggaaggaguaaggg

SEQ ID NO: 16176 - RNA, 22 nt, Homo sapiens
uggaaaguacugagguccaccu

SEQ ID NO: 16177 - RNA, 22 nt, Homo sapiens
ggcagcucaggccccgcgcuga

SEQ ID NO: 16178 - RNA, 22 nt, Homo sapiens
auacuguuuuacaucauugccu

SEQ ID NO: 16179 - RNA, 22 nt, Homo sapiens
cucacuaggaaguaaaguuugu

SEQ ID NO: 16180 - RNA, 22 nt, Homo sapiens
ggacuagggacauggggagcug

SEQ ID NO: 16181 - RNA, 22 nt, Homo sapiens
uuccacaauggcugaacuaguu

SEQ ID NO: 16182 - RNA, 22 nt, Homo sapiens
gugggaagcuggaacucccucc

SEQ ID NO: 16183 - RNA, 22 nt, Homo sapiens
auaaggaguaucauauuaaaac

SEQ ID NO: 16184 - RNA, 22 nt, Homo sapiens
gaaugauacuguuaacgaaaga

SEQ ID NO: 16185 - RNA, 22 nt, Homo sapiens
caggugcauuggcugacaccug

SEQ ID NO: 16186 - RNA, 22 nt, Homo sapiens
aguggauguuguggccugggag

SEQ ID NO: 16187 - RNA, 22 nt, Homo sapiens
uggcagcugcuucaugggaugc

SEQ ID NO: 16188 - RNA, 21 nt, Homo sapiens
aaucacugucuguuuccccuu

SEQ ID NO: 16189 - RNA, 22 nt, Homo sapiens
auugcacaucugcacuacagcc

SEQ ID NO: 16190 - RNA, 23 nt, Homo sapiens
ucagugaaggaacaacuaaauag

SEQ ID NO: 16191 - RNA, 22 nt, Homo sapiens
uggagugauaugguuauauggg

SEQ ID NO: 16192 - RNA, 22 nt, Homo sapiens
ugacuaggaaauuagaacuuuu

SEQ ID NO: 16193 - RNA, 22 nt, Homo sapiens
uugauagacaucugaguuguug

SEQ ID NO: 16194 - RNA, 22 nt, Homo sapiens
uugagaucaugcuacugcacuc

SEQ ID NO: 16195 - RNA, 21 nt, Homo sapiens
gaaauacugccuuaggagcug

SEQ ID NO: 16196 - RNA, 22 nt, Homo sapiens
aaguggaauguuuguggcacaa

SEQ ID NO: 16197 - RNA, 22 nt, Homo sapiens
uugauagacacauauccaugug

SEQ ID NO: 16198 - RNA, 23 nt, Homo sapiens
uccccgggagcaccagcuuguug

SEQ ID NO: 16199 - RNA, 22 nt, Homo sapiens
aucagagugaugguuuaaguau

SEQ ID NO: 16200 - RNA, 22 nt, Homo sapiens
augaguauguucuguauuuuca

SEQ ID NO: 16201 - RNA, 18 nt, Homo sapiens
uggacagugauuauccau

SEQ ID NO: 16202 - RNA, 22 nt, Homo sapiens
ggcagcuguguccuucguaagg

SEQ ID NO: 16203 - RNA, 22 nt, Homo sapiens
uaaguucauucaugaaacuuag

SEQ ID NO: 16204 - RNA, 20 nt, Homo sapiens
agacuagggagcagaaagcc

SEQ ID NO: 16205 - RNA, 22 nt, Homo sapiens
acccuuaagcacuaguucagcu

SEQ ID NO: 16206 - RNA, 18 nt, Homo sapiens
acaguguguaaggguucu

SEQ ID NO: 16207 - RNA, 22 nt, Homo sapiens
auugauaguuuaauaggaauug

SEQ ID NO: 16208 - RNA, 20 nt, Homo sapiens
cugcacauccacucuacuuc

SEQ ID NO: 16209 - RNA, 22 nt, Homo sapiens
guguaaaacaauuagaggauuu

SEQ ID NO: 16210 - RNA, 22 nt, Homo sapiens
ggaagaauauuaggggauuucg

SEQ ID NO: 16211 - RNA, 22 nt, Homo sapiens
aaggaacuggaauauuuugaac

SEQ ID NO: 16212 - RNA, 22 nt, Homo sapiens
gugcacaaucgugcauuccuug

SEQ ID NO: 16213 - RNA, 22 nt, Homo sapiens
gaggaguagggcacaaagccuu

SEQ ID NO: 16214 - RNA, 22 nt, Homo sapiens
uggaaguauagauaauugaaag

SEQ ID NO: 16215 - RNA, 22 nt, Homo sapiens
cuguagcuuuuauaugcuuagc

SEQ ID NO: 16216 - RNA, 20 nt, Homo sapiens
uggaaauuaaccuuucaggu

SEQ ID NO: 16217 - RNA, 22 nt, Homo sapiens
augacauugaaaagcaagugga

SEQ ID NO: 16218 - RNA, 17 nt, Homo sapiens
uuuaaugcuaggacucu

SEQ ID NO: 16219 - RNA, 22 nt, Homo sapiens
uuggaaaguuguuguaguuauu

SEQ ID NO: 16220 - RNA, 22 nt, Homo sapiens
uguggaaauaaaagaaagguua

SEQ ID NO: 16221 - RNA, 22 nt, Homo sapiens
gccccgggugaugcagccguca

SEQ ID NO: 16222 - RNA, 22 nt, Homo sapiens
uaagcuauagugaauaaauugc

SEQ ID NO: 16223 - RNA, 22 nt, Homo sapiens
uagaauggaagguugagaagaa

SEQ ID NO: 16224 - RNA, 17 nt, Homo sapiens
guuuggguacuggguaa

SEQ ID NO: 16225 - RNA, 22 nt, Homo sapiens
uuacuugagauggggugucacu

SEQ ID NO: 16226 - RNA, 18 nt, Homo sapiens
guauuccagccugaguga

SEQ ID NO: 16227 - RNA, 22 nt, Homo sapiens
ucgcugcgaccuccaccucccg

SEQ ID NO: 16228 - RNA, 22 nt, Homo sapiens
accucagcccggggaaguugag

SEQ ID NO: 16229 - RNA, 17 nt, Homo sapiens
auaugaauuuuggagau

SEQ ID NO: 16230 - RNA, 22 nt, Homo sapiens
uauuucaguugugcagguaguu

SEQ ID NO: 16231 - RNA, 22 nt, Homo sapiens
auaagugagugauucaguguua

SEQ ID NO: 16232 - RNA, 22 nt, Homo sapiens
aaacugaucugaaggccaggcu

SEQ ID NO: 16233 - RNA, 22 nt, Homo sapiens
uggaaaguaguucuaaucuaag

SEQ ID NO: 16234 - RNA, 22 nt, Homo sapiens
augcagaucacauuuuucuguc

SEQ ID NO: 16235 - RNA, 20 nt, Homo sapiens
ugacuuguccgagguccccc

SEQ ID NO: 16236 - RNA, 22 nt, Homo sapiens
uagcuggaauuacuugcaccug

SEQ ID NO: 16237 - RNA, 18 nt, Homo sapiens
uagaauauaggucauucu

SEQ ID NO: 16238 - RNA, 22 nt, Homo sapiens
ggacagugaaugccacuccucc

SEQ ID NO: 16239 - RNA, 22 nt, Homo sapiens
uggaaauuaacagggauugucc

SEQ ID NO: 16240 - RNA, 22 nt, Homo sapiens
uggaaguaaccaugaauggaau

SEQ ID NO: 16241 - RNA, 22 nt, Homo sapiens
gcaguguggguagagggcaaga

SEQ ID NO: 16242 - RNA, 22 nt, Homo sapiens
aagcuggauuuaguguggagca

SEQ ID NO: 16243 - RNA, 22 nt, Homo sapiens
cuagaacuagaacugcuggggu

SEQ ID NO: 16244 - RNA, 22 nt, Homo sapiens
auuuggguuuuacaucaggcua

SEQ ID NO: 16245 - RNA, 20 nt, Homo sapiens
uggaaaguaagucaugauau

SEQ ID NO: 16246 - RNA, 22 nt, Homo sapiens
uauuucaguugcguuucccgag

SEQ ID NO: 16247 - RNA, 18 nt, Homo sapiens
auucuacaggccuuuuga

SEQ ID NO: 16248 - RNA, 19 nt, Homo sapiens
uuuugcucuuuauaccuau

SEQ ID NO: 16249 - RNA, 20 nt, Homo sapiens
uauucacucuccagucuugc

SEQ ID NO: 16250 - RNA, 22 nt, Homo sapiens
aaugcacauauauuuccuuauu

SEQ ID NO: 16251 - RNA, 22 nt, Homo sapiens
aucagaaucucuagaggacugu

SEQ ID NO: 16252 - RNA, 22 nt, Homo sapiens
cuuuggccauagcuaaaugauu

SEQ ID NO: 16253 - RNA, 22 nt, Homo sapiens
uaugcacaugcaugcuugaaua

SEQ ID NO: 16254 - RNA, 22 nt, Homo sapiens
ggccuguaggguauugguaggg

SEQ ID NO: 16255 - RNA, 22 nt, Homo sapiens
augcacauggcuaacuuuuuuc

SEQ ID NO: 16256 - RNA, 22 nt, Homo sapiens
acugcacuuauccuccaauguu

SEQ ID NO: 16257 - RNA, 22 nt, Homo sapiens
uauggauuuuuuugacaagagc

SEQ ID NO: 16258 - RNA, 20 nt, Homo sapiens
uggaacuuaauugauggaca

SEQ ID NO: 16259 - RNA, 22 nt, Homo sapiens
uucagggacuuuagacaagaga

SEQ ID NO: 16260 - RNA, 22 nt, Homo sapiens
aucacuagaucauagguaaaca

SEQ ID NO: 16261 - RNA, 23 nt, Homo sapiens
uuugagugugauaaacacuguca

SEQ ID NO: 16262 - RNA, 22 nt, Homo sapiens
auugaaucuaaaaugagucucu

SEQ ID NO: 16263 - RNA, 22 nt, Homo sapiens
ugacuagggcucuaaacagcuc

SEQ ID NO: 16264 - RNA, 22 nt, Homo sapiens
ugacuauaggauaacaugcauu

SEQ ID NO: 16265 - RNA, 22 nt, Homo sapiens
guggcgagaucauagcucauug

SEQ ID NO: 16266 - RNA, 18 nt, Homo sapiens
ucccucagaauuauagaa

SEQ ID NO: 16267 - RNA, 22 nt, Homo sapiens
uguaaugaucaaaucagaguaa

SEQ ID NO: 16268 - RNA, 22 nt, Homo sapiens
uuccacaaugguugaacuagcu

SEQ ID NO: 16269 - RNA, 22 nt, Homo sapiens
uugagagaaaaggccaugccuu

SEQ ID NO: 16270 - RNA, 22 nt, Homo sapiens
uuccacaaugguugaacuaguu

SEQ ID NO: 16271 - RNA, 20 nt, Homo sapiens
uucagugcagguaacaaucc

SEQ ID NO: 16272 - RNA, 22 nt, Homo sapiens
uacuagaaccuuauucagagug

SEQ ID NO: 16273 - RNA, 22 nt, Homo sapiens
uucaguaaauguucuuacuaua

SEQ ID NO: 16274 - RNA, 22 nt, Homo sapiens
ugagauauugggaguaauguca

SEQ ID NO: 16275 - RNA, 17 nt, Homo sapiens
ugauaagugugagguga

SEQ ID NO: 16276 - RNA, 22 nt, Homo sapiens
ugaauagacacuaaagacugua

SEQ ID NO: 16277 - RNA, 22 nt, Homo sapiens
gaacuguuucuggugaaagagu

SEQ ID NO: 16278 - RNA, 22 nt, Homo sapiens
cuuuaugagguuggauggaucu

SEQ ID NO: 16279 - RNA, 22 nt, Homo sapiens
uuagaacuagaggaguuugagu

SEQ ID NO: 16280 - RNA, 22 nt, Homo sapiens
uggaagugaacaaccaaggcag

SEQ ID NO: 16281 - RNA, 22 nt, Homo sapiens
gcuaggagaucugcugcucucu

SEQ ID NO: 16282 - RNA, 22 nt, Homo sapiens
gcgguagcauagacugcaggac

SEQ ID NO: 16283 - RNA, 22 nt, Homo sapiens
gugagaacugugucuuauaaac

SEQ ID NO: 16284 - RNA, 22 nt, Homo sapiens
ucacaggguguuauuagaauua

SEQ ID NO: 16285 - RNA, 22 nt, Homo sapiens
auggacagacacuggccuucug

SEQ ID NO: 16286 - RNA, 22 nt, Homo sapiens
uauuuguccccuccaaaaguca

SEQ ID NO: 16287 - RNA, 22 nt, Homo sapiens
acagccauuccagccaaauacu

SEQ ID NO: 16288 - RNA, 22 nt, Homo sapiens
uggguaggaccagaaaugcacu

SEQ ID NO: 16289 - RNA, 23 nt, Homo sapiens
uggaaguauggaggaggcagaau

SEQ ID NO: 16290 - RNA, 22 nt, Homo sapiens
uuuaguucauuaaggaaucucc

SEQ ID NO: 16291 - RNA, 22 nt, Homo sapiens
aucugcacaucuguguuuuugu

SEQ ID NO: 16292 - RNA, 23 nt, Homo sapiens
ucacuagaguccuggaguuugag

SEQ ID NO: 16293 - RNA, 22 nt, Homo sapiens
gacuaggagauauguuuucuuc

SEQ ID NO: 16294 - RNA, 22 nt, Homo sapiens
uggaaguaaucaugagguagca

SEQ ID NO: 16295 - RNA, 22 nt, Homo sapiens
ugacuaggggcccuggcuucuu

SEQ ID NO: 16296 - RNA, 22 nt, Homo sapiens
gagauauuuagaaauguguucu

SEQ ID NO: 16297 - RNA, 22 nt, Homo sapiens
aaagucuagaggaucaugugug

SEQ ID NO: 16298 - RNA, 22 nt, Homo sapiens
cugaaagagcauuugaaugggu

SEQ ID NO: 16299 - RNA, 22 nt, Homo sapiens
uggaaguagauagauuguguca

SEQ ID NO: 16300 - RNA, 22 nt, Homo sapiens
auaaauucauuuaagcuccuua

SEQ ID NO: 16301 - RNA, 22 nt, Homo sapiens
augcacuuggcaggaugauucc

SEQ ID NO: 16302 - RNA, 22 nt, Homo sapiens
gcgugguguuagaaugagaagu

SEQ ID NO: 16303 - RNA, 22 nt, Homo sapiens
ggugcagcacaccaacauggca

SEQ ID NO: 16304 - RNA, 21 nt, Homo sapiens
uuugaucauuaaaagugaauc

SEQ ID NO: 16305 - RNA, 22 nt, Homo sapiens
uuuaguccucugaaaaucuaua

SEQ ID NO: 16306 - RNA, 22 nt, Homo sapiens
gugcacaaaucuuaaauguaca

SEQ ID NO: 16307 - RNA, 22 nt, Homo sapiens
uuaauguaucuaucacaucaca

SEQ ID NO: 16308 - RNA, 22 nt, Homo sapiens
gugauagaucugggauucagaa

SEQ ID NO: 16309 - RNA, 22 nt, Homo sapiens
gagguauagaacaccuuucaag

SEQ ID NO: 16310 - RNA, 20 nt, Homo sapiens
ucaaauucuuggccuccagc

SEQ ID NO: 16311 - RNA, 18 nt, Homo sapiens
gacaguguggcaauuccu

SEQ ID NO: 16312 - RNA, 22 nt, Homo sapiens
uuuaaugcgucucugaguuuug

SEQ ID NO: 16313 - RNA, 18 nt, Homo sapiens
acauucagcuugaagaua

SEQ ID NO: 16314 - RNA, 19 nt, Homo sapiens
ggcaauacuuucuuguugg

SEQ ID NO: 16315 - RNA, 22 nt, Homo sapiens
uucacacugggccuacucugug

SEQ ID NO: 16316 - RNA, 22 nt, Homo sapiens
augaggcaggaaaggcguaucu

SEQ ID NO: 16317 - RNA, 22 nt, Homo sapiens
ucacugaggucugagcuuuaug

SEQ ID NO: 16318 - RNA, 22 nt, Homo sapiens
uacauacuucacagacuuuaaa

SEQ ID NO: 16319 - RNA, 22 nt, Homo sapiens
ggaagaauaaugggccuuagag

SEQ ID NO: 16320 - RNA, 22 nt, Homo sapiens
ugagaugagagaaugcuugccu

SEQ ID NO: 16321 - RNA, 22 nt, Homo sapiens
uaaguauuaugugcugcauuuu

SEQ ID NO: 16322 - RNA, 22 nt, Homo sapiens
uugguccucccaugcucaagag

SEQ ID NO: 16323 - RNA, 22 nt, Homo sapiens
uugauagaucagggauuugauu

SEQ ID NO: 16324 - RNA, 22 nt, Homo sapiens
cuuuggcauuagccuguauaga

SEQ ID NO: 16325 - RNA, 22 nt, Homo sapiens
uuggauuuuaacaaacuaggug

SEQ ID NO: 16326 - RNA, 22 nt, Homo sapiens
aagcuggagugcaguggugcaa

SEQ ID NO: 16327 - RNA, 18 nt, Homo sapiens
uggauaguuguuggcaga

SEQ ID NO: 16328 - RNA, 22 nt, Homo sapiens
gugaaagauuaaaccagugugu

SEQ ID NO: 16329 - RNA, 22 nt, Homo sapiens
auacaguugccauuucuugugc

SEQ ID NO: 16330 - RNA, 20 nt, Homo sapiens
uggaccagagagguggggac

SEQ ID NO: 16331 - RNA, 22 nt, Homo sapiens
gacuaggagagcagcugcccau

SEQ ID NO: 16332 - RNA, 22 nt, Homo sapiens
gugcacaacaugcaguuuuguu

SEQ ID NO: 16333 - RNA, 20 nt, Homo sapiens
uggcucuuugcugcuaaagu

SEQ ID NO: 16334 - RNA, 22 nt, Homo sapiens
aaaugcacaaagauuuugcacu

SEQ ID NO: 16335 - RNA, 22 nt, Homo sapiens
ugagagacagacauuaucuuau

SEQ ID NO: 16336 - RNA, 22 nt, Homo sapiens
ugaacugagacuagacuuguuc

SEQ ID NO: 16337 - RNA, 22 nt, Homo sapiens
agcgccacugcacuccagccug

SEQ ID NO: 16338 - RNA, 22 nt, Homo sapiens
uggauaguuuacugaagagugg

SEQ ID NO: 16339 - RNA, 22 nt, Homo sapiens
uccccgagcccaggcugugacu

SEQ ID NO: 16340 - RNA, 22 nt, Homo sapiens
ugugucuuuuaucacacaaugu

SEQ ID NO: 16341 - RNA, 22 nt, Homo sapiens
uugugguuuuuaaaacuaggug

SEQ ID NO: 16342 - RNA, 22 nt, Homo sapiens
cauggcccugggcugggcgaac

SEQ ID NO: 16343 - RNA, 16 nt, Homo sapiens
uacauuuguuacaugg

SEQ ID NO: 16344 - RNA, 18 nt, Homo sapiens
gacaguguggcgauuccu

SEQ ID NO: 16345 - RNA, 22 nt, Homo sapiens
acccuggauucguggccuugaa

SEQ ID NO: 16346 - RNA, 22 nt, Homo sapiens
uaucacaguugcauauuuaagg

SEQ ID NO: 16347 - RNA, 22 nt, Homo sapiens
ccuguagcauccaagaagcugc

SEQ ID NO: 16348 - RNA, 22 nt, Homo sapiens
ugacuaggaggcuggaggauga

SEQ ID NO: 16349 - RNA, 23 nt, Homo sapiens
ggauggaaaguuuugagggccac

SEQ ID NO: 16350 - RNA, 22 nt, Homo sapiens
cacuuugguucaccugaguuuc

SEQ ID NO: 16351 - RNA, 16 nt, Homo sapiens
uguccaaauaaauaca

SEQ ID NO: 16352 - RNA, 22 nt, Homo sapiens
cucacuaguaaggcuguuuagu

SEQ ID NO: 16353 - RNA, 22 nt, Homo sapiens
uuugacuuuuagaauaugaguu

SEQ ID NO: 16354 - RNA, 22 nt, Staphylococcus aureus subsp. aureus Mu50
uuuuccaacuucucaguaaauu

SEQ ID NO: 16355 - RNA, 22 nt, Staphylococcus aureus subsp. aureus Mu50
uuuuagaaauugucaaugauga

SEQ ID NO: 16356 - RNA, 22 nt, Staphylococcus aureus subsp. aureus Mu50
uugacauuacgacagcacuugu

SEQ ID NO: 16357 - RNA, 22 nt, Staphylococcus aureus subsp. aureus Mu50
uuggaggcuaguauguugaaca

SEQ ID NO: 16358 - RNA, 22 nt, Staphylococcus aureus subsp. aureus Mu50
uuuaccaauaaugaugaacauu

SEQ ID NO: 16359 - RNA, 22 nt, Staphylococcus aureus subsp. aureus Mu50
uuuauuugaagcgguauauggu

SEQ ID NO: 16360 - RNA, 22 nt, Staphylococcus aureus subsp. aureus Mu50
uuaaugaagcuguaaacuuauu

SEQ ID NO: 16361 - RNA, 22 nt, Staphylococcus aureus subsp. aureus Mu50
uuaaugauguaaugaaauuagu

SEQ ID NO: 16362 - RNA, 22 nt, Staphylococcus aureus subsp. aureus Mu50
uuauaugaaacaagaacuugga

SEQ ID NO: 16363 - RNA, 23 nt, Staphylococcus aureus subsp. aureus Mu50
uggcuccguuucauuacguaaua

SEQ ID NO: 16364 - RNA, 22 nt, Staphylococcus aureus subsp. aureus Mu50
ugcuacaaacgcuugugcauua

SEQ ID NO: 16365 - RNA, 22 nt, Staphylococcus aureus subsp. aureus Mu50
ugcauguggcaucucuuguguu

SEQ ID NO: 16366 - RNA, 22 nt, Staphylococcus aureus subsp. aureus Mu50
ugcagaagugaaauuccuguga

SEQ ID NO: 16367 - RNA, 20 nt, Staphylococcus aureus subsp. aureus Mu50
ucuucaagcuguuucaucuc

SEQ ID NO: 16368 - RNA, 22 nt, Staphylococcus aureus subsp. aureus Mu50
ucuuuuaaucgaccuugagaaa

SEQ ID NO: 16369 - RNA, 22 nt, Staphylococcus aureus subsp. aureus Mu50
ugaaagcauuuaucgaacauug

SEQ ID NO: 16370 - RNA, 22 nt, Staphylococcus aureus subsp. aureus Mu50
ugaaaguguugacgguaugauu

SEQ ID NO: 16371 - RNA, 22 nt, Staphylococcus aureus subsp. aureus Mu50
cuguaucacauuagaagcuuuu

SEQ ID NO: 16372 - RNA, 22 nt, Staphylococcus aureus subsp. aureus Mu50
cuuuuucacauaucauaggucu

SEQ ID NO: 16373 - RNA, 22 nt, Staphylococcus aureus subsp. aureus Mu50
gaaaagaaagcauaugcaacuu

SEQ ID NO: 16374 - RNA, 22 nt, Staphylococcus aureus subsp. aureus Mu50
gaaaagcuccaaucaaaguuga

SEQ ID NO: 16375 - RNA, 22 nt, Staphylococcus aureus subsp. aureus Mu50
cuauaaauacaagugcauaugg

SEQ ID NO: 16376 - RNA, 22 nt, Staphylococcus aureus subsp. aureus Mu50
cuaauaauugugaauaugcaag

SEQ ID NO: 16377 - RNA, 22 nt, Staphylococcus aureus subsp. aureus Mu50
cagcuaaauuacuaccuucagu

SEQ ID NO: 16378 - RNA, 22 nt, Staphylococcus aureus subsp. aureus Mu50
caacuuuagguaaugucauguu

SEQ ID NO: 16379 - RNA, 22 nt, Staphylococcus aureus subsp. aureus Mu50
auuuugaugagcgugcaauacu

SEQ ID NO: 16380 - RNA, 22 nt, Staphylococcus aureus subsp. aureus Mu50
caaaagcauugaauaaaacugu

SEQ ID NO: 16381 - RNA, 20 nt, Staphylococcus aureus subsp. aureus Mu50
cacggcucgaacaagucuuu

SEQ ID NO: 16382 - RNA, 22 nt, Staphylococcus aureus subsp. aureus Mu50
augauggaagguaaauggcaaa

SEQ ID NO: 16383 - RNA, 21 nt, Staphylococcus aureus subsp. aureus Mu50
auuauuggcgucguuucgagu

SEQ ID NO: 16384 - RNA, 18 nt, Staphylococcus aureus subsp. aureus Mu50
auuucugucccacuccca

SEQ ID NO: 16385 - RNA, 19 nt, Staphylococcus aureus subsp. aureus Mu50
auuucugucccacucccac

SEQ ID NO: 16386 - RNA, 22 nt, Staphylococcus aureus subsp. aureus Mu50
auuucugucccacucccauugg

SEQ ID NO: 16387 - RNA, 22 nt, Staphylococcus aureus subsp. aureus Mu50
augcacauuuauuaguuuuaga

SEQ ID NO: 16388 - RNA, 22 nt, Staphylococcus aureus subsp. aureus Mu50
auauagauuaaaccgcacuucu

SEQ ID NO: 16389 - RNA, 18 nt, Staphylococcus aureus subsp. aureus Mu50
aguggcaauguauuagca

SEQ ID NO: 16390 - RNA, 22 nt, Staphylococcus aureus subsp. aureus Mu50
aguuugaaugauaacucauugc

SEQ ID NO: 16391 - RNA, 22 nt, Staphylococcus aureus subsp. aureus Mu50
auaaaguauauggaaauuuuac

SEQ ID NO: 16392 - RNA, 22 nt, Staphylococcus aureus subsp. aureus Mu50
auaaugaugcacaucgcguacu

SEQ ID NO: 16393 - RNA, 22 nt, Staphylococcus aureus subsp. aureus Mu50
auacauuagugucgauucguuu

SEQ ID NO: 16394 - RNA, 22 nt, Staphylococcus aureus subsp. aureus Mu50
auauuuaauguuaaggauguug

SEQ ID NO: 16395 - RNA, 22 nt, Staphylococcus aureus subsp. aureus Mu50
agauauccauuaugauguagau

SEQ ID NO: 16396 - RNA, 22 nt, Staphylococcus aureus subsp. aureus Mu50
agaagacuuauuuacugcguuu

SEQ ID NO: 16397 - RNA, 22 nt, Staphylococcus aureus subsp. aureus Mu50
agagacaaguuuagauugccau

SEQ ID NO: 16398 - RNA, 22 nt, Staphylococcus aureus subsp. aureus Mu50
acuagguaaucgucugagugaa

SEQ ID NO: 16399 - RNA, 22 nt, Staphylococcus aureus subsp. aureus Mu50
acuuuugagaugcacauuauca

SEQ ID NO: 16400 - RNA, 22 nt, Staphylococcus aureus subsp. aureus Mu50
acguuucagcguuccauucagc

SEQ ID NO: 16401 - RNA, 22 nt, Staphylococcus aureus subsp. aureus Mu50
acuccgucaaauugcacagcga

SEQ ID NO: 16402 - RNA, 22 nt, Staphylococcus aureus subsp. aureus Mu50
acuauuuguuaauaaauccauu

SEQ ID NO: 16403 - RNA, 19 nt, Staphylococcus aureus subsp. aureus Mu50
acuuugaagggagcauuuc

SEQ ID NO: 16404 - RNA, 22 nt, Staphylococcus aureus subsp. aureus Mu50
agaaaacagcaguaaaaucauu

SEQ ID NO: 16405 - RNA, 22 nt, Staphylococcus aureus subsp. aureus Mu50
agaaagugcgguuauuuauaca

SEQ ID NO: 16406 - RNA, 22 nt, Staphylococcus aureus subsp. aureus Mu50
agagauaaaauaaagagguacu

SEQ ID NO: 16407 - RNA, 23 nt, Staphylococcus aureus subsp. aureus Mu50
agacauuuaaugauaaauacuga

SEQ ID NO: 16408 - RNA, 22 nt, Staphylococcus aureus subsp. aureus Mu50
agauauuguugauauggcauuu

SEQ ID NO: 16409 - RNA, 22 nt, Staphylococcus aureus subsp. aureus Mu50
agccuguauacguuugaguggu

SEQ ID NO: 16410 - RNA, 22 nt, Staphylococcus aureus subsp. aureus Mu50
agcaugauacucaauaaaauug

SEQ ID NO: 16411 - RNA, 22 nt, Staphylococcus aureus subsp. aureus Mu50
aaacugcuaauguagucaugag

SEQ ID NO: 16412 - RNA, 22 nt, Staphylococcus aureus subsp. aureus Mu50
aacauuuucaauaauugauucg

SEQ ID NO: 16413 - RNA, 22 nt, Staphylococcus aureus subsp. aureus Mu50
aaaaauguccuccuguucauca

SEQ ID NO: 16414 - RNA, 22 nt, Staphylococcus aureus subsp. aureus Mu50
aauuuuuguacguucaauauca

SEQ ID NO: 16415 - RNA, 22 nt, Staphylococcus aureus subsp. aureus Mu50
aauuaacuuuguuaauagaguu

SEQ ID NO: 16416 - RNA, 22 nt, Staphylococcus aureus subsp. aureus Mu50
aauucuacaucaauccuacagg

SEQ ID NO: 16417 - RNA, 22 nt, Staphylococcus aureus subsp. aureus Mu50
aauugaggcggaauuagcgcgu

SEQ ID NO: 16418 - RNA, 22 nt, Staphylococcus aureus subsp. aureus Mu50
aauuuuaguagggacaacauug

SEQ ID NO: 16419 - RNA, 22 nt, Staphylococcus aureus subsp. aureus Mu50
aaugggagugggacagaaauga

SEQ ID NO: 16420 - RNA, 22 nt, Staphylococcus aureus subsp. aureus Mu50
aaugggguaaucaugaugugcu

SEQ ID NO: 16421 - RNA, 22 nt, Staphylococcus aureus subsp. aureus Mu50
aaugaaaugaagauugcacuca

SEQ ID NO: 16422 - RNA, 22 nt, Staphylococcus aureus subsp. aureus Mu50
aaugagagcccccuuuaccaca

SEQ ID NO: 16423 - RNA, 22 nt, Staphylococcus aureus subsp. aureus Mu50
aaugauaagcgacaguuaauaa

SEQ ID NO: 16424 - RNA, 22 nt, Staphylococcus aureus subsp. aureus Mu50
aauaaaguuauucauguagauu

SEQ ID NO: 16425 - RNA, 22 nt, Staphylococcus aureus subsp. aureus Mu50
aauacacuaaucgcacguacuc

SEQ ID NO: 16426 - RNA, 22 nt, Staphylococcus aureus subsp. aureus Mu50
aauagagaacagcaguaagacg

SEQ ID NO: 16427 - RNA, 22 nt, Staphylococcus aureus subsp. aureus Mu50
aauaguuguaccgacagcgccu

SEQ ID NO: 16428 - RNA, 22 nt, Staphylococcus aureus subsp. aureus Mu50
aaucaaauuauauugagccguu

SEQ ID NO: 16429 - RNA, 22 nt, Staphylococcus aureus subsp. aureus Mu50
acagaaauguagcuaacauuuu

SEQ ID NO: 16430 - RNA, 22 nt, Staphylococcus aureus subsp. aureus Mu50
acaguuuagugcgcaaauuaau

SEQ ID NO: 16431 - RNA, 22 nt, Staphylococcus aureus subsp. aureus Mu50
aaaaugaugauaaacuaguaua

SEQ ID NO: 16432 - RNA, 22 nt, Staphylococcus aureus subsp. aureus Mu50
aacaauuaaugaucuuacagaa

SEQ ID NO: 16433 - RNA, 22 nt, Staphylococcus aureus subsp. aureus Mu50
aaagcucucuucauaaucaugu

SEQ ID NO: 16434 - RNA, 22 nt, Staphylococcus aureus subsp. aureus Mu50
aaauacuuuccauguauggugu

SEQ ID NO: 16435 - RNA, 22 nt, Staphylococcus aureus subsp. aureus Mu50
acagcuggugagauagguguca

SEQ ID NO: 16436 - RNA, 22 nt, Staphylococcus aureus subsp. aureus Mu50
acagaaauaugauguaauuguu

SEQ ID NO: 16437 - RNA, 22 nt, Staphylococcus aureus subsp. aureus Mu50
aauuucagcacgacgauuaaau

SEQ ID NO: 16438 - RNA, 22 nt, Staphylococcus aureus subsp. aureus Mu50
acaucuaacaguaaacauuuag

SEQ ID NO: 16439 - RNA, 22 nt, Staphylococcus aureus subsp. aureus Mu50
acauugggcauaaucacagcua

SEQ ID NO: 16440 - RNA, 22 nt, Staphylococcus aureus subsp. aureus Mu50
acauuuauuugggcuguaacga

SEQ ID NO: 16441 - RNA, 22 nt, Staphylococcus aureus subsp. aureus Mu50
aauaaucuauauuaucuuucgu

SEQ ID NO: 16442 - RNA, 22 nt, Staphylococcus aureus subsp. aureus Mu50
aauuacuuuagccauugcuacc

SEQ ID NO: 16443 - RNA, 22 nt, Staphylococcus aureus subsp. aureus Mu50
aauuccaaaagccagaagguac

SEQ ID NO: 16444 - RNA, 22 nt, Staphylococcus aureus subsp. aureus Mu50
aauuuaaauuuagauccuguag

SEQ ID NO: 16445 - RNA, 22 nt, Staphylococcus aureus subsp. aureus Mu50
aagcgauuuuacuugaagauac

SEQ ID NO: 16446 - RNA, 22 nt, Staphylococcus aureus subsp. aureus Mu50
aagcuuuuuucaauucuaguca

SEQ ID NO: 16447 - RNA, 21 nt, Staphylococcus aureus subsp. aureus Mu50
aauaacaguuacaaaugcuga

SEQ ID NO: 16448 - RNA, 22 nt, Staphylococcus aureus subsp. aureus Mu50
gcuucaaugcuuuuagccauuu

SEQ ID NO: 16449 - RNA, 22 nt, Staphylococcus aureus subsp. aureus Mu50
gcugaaaugguaauaucuuuau

SEQ ID NO: 16450 - RNA, 22 nt, Staphylococcus aureus subsp. aureus Mu50
ucauuaaugucuacguaugaau

SEQ ID NO: 16451 - RNA, 22 nt, Staphylococcus aureus subsp. aureus Mu50
ucggucuaauuuuauagaaggu

SEQ ID NO: 16452 - RNA, 22 nt, Staphylococcus aureus subsp. aureus Mu50
ucaaauuacgugcuaaagcuug

SEQ ID NO: 16453 - RNA, 20 nt, Staphylococcus aureus subsp. aureus Mu50
uauuucaauugcuguugcug

SEQ ID NO: 16454 - RNA, 22 nt, Staphylococcus aureus subsp. aureus Mu50
uauaugagacggggucauuucu

SEQ ID NO: 16455 - RNA, 22 nt, Staphylococcus aureus subsp. aureus Mu50
uaucaaacauugaaugcacgcg

SEQ ID NO: 16456 - RNA, 22 nt, Staphylococcus aureus subsp. aureus Mu50
uagugguauugaaucugcugua

SEQ ID NO: 16457 - RNA, 22 nt, Staphylococcus aureus subsp. aureus Mu50
uaauugcacuaccaaugauuau

SEQ ID NO: 16458 - RNA, 22 nt, Staphylococcus aureus subsp. aureus Mu50
uacauuuugugacuaauagcgu

SEQ ID NO: 16459 - RNA, 22 nt, Staphylococcus aureus subsp. aureus Mu50
uaauauucgcacucauuauucc

SEQ ID NO: 16460 - RNA, 22 nt, Staphylococcus aureus subsp. aureus Mu50
uaaugauuuugguacgauacug

SEQ ID NO: 16461 - RNA, 22 nt, Staphylococcus aureus subsp. aureus Mu50
uaaaagcuucuaacaugauacg

SEQ ID NO: 16462 - RNA, 22 nt, Staphylococcus aureus subsp. aureus Mu50
uaaaauuauggauacacugauu

SEQ ID NO: 16463 - RNA, 20 nt, Staphylococcus aureus subsp. aureus Mu50
uaaagacuacuuacagcgua

SEQ ID NO: 16464 - RNA, 22 nt, Staphylococcus aureus subsp. aureus Mu50
gugcuacacguucaucaccauu

SEQ ID NO: 16465 - RNA, 22 nt, Staphylococcus aureus subsp. aureus Mu50
gugaaaaugaacguauugaugc

SEQ ID NO: 16466 - RNA, 22 nt, Staphylococcus aureus subsp. aureus Mu50
gugaguugaaguagcuugucau

SEQ ID NO: 16467 - RNA, 22 nt, Staphylococcus aureus subsp. aureus Mu50
guugauguugcuaacuucuuaa

SEQ ID NO: 16468 - RNA, 22 nt, Staphylococcus aureus subsp. aureus Mu50
gugugggauugcauuguucacu

SEQ ID NO: 16469 - RNA, 20 nt, Staphylococcus aureus subsp. aureus Mu50
ccagaugguuaugguuuuuu

SEQ ID NO: 16470 - RNA, 20 nt, Staphylococcus aureus subsp. aureus Mu50
caucaguuuuuuuauacgag

SEQ ID NO: 16471 - RNA, 22 nt, Staphylococcus aureus subsp. aureus Mu50
cauauaaagcgugcgugcuuuu

SEQ ID NO: 16472 - RNA, 21 nt, Staphylococcus aureus subsp. aureus Mu50
gaugggaauuucgacagugca

SEQ ID NO: 16473 - RNA, 22 nt, Staphylococcus aureus subsp. aureus Mu50
gcaaauguuacaccuguuucuu

SEQ ID NO: 16474 - RNA, 22 nt, Staphylococcus aureus subsp. aureus Mu50
gagauuuucgaagcacguaacc

SEQ ID NO: 16475 - RNA, 22 nt, Staphylococcus aureus subsp. aureus Mu50
gacguauuuuuuaucacauuga

SEQ ID NO: 16476 - RNA, 22 nt, Staphylococcus aureus subsp. aureus Mu50
cucgcggccuuuuuuauuguaa

SEQ ID NO: 16477 - RNA, 22 nt, Staphylococcus aureus subsp. aureus Mu50
gacauauuuuaauagugaauau

SEQ ID NO: 16478 - RNA, 22 nt, Staphylococcus aureus subsp. aureus Mu50
gaaaaaaucgauuggcguggcu

SEQ ID NO: 16479 - RNA, 22 nt, Staphylococcus aureus subsp. aureus Mu50
cuucaguagcaggcgguugcau

SEQ ID NO: 16480 - RNA, 22 nt, Staphylococcus aureus subsp. aureus Mu50
ugaaauacuaacauugacuucu

SEQ ID NO: 16481 - RNA, 22 nt, Staphylococcus aureus subsp. aureus Mu50
ugaaauauaaaauuguuugagg

SEQ ID NO: 16482 - RNA, 22 nt, Staphylococcus aureus subsp. aureus Mu50
ugaacaaccgggcagaaugaaa

SEQ ID NO: 16483 - RNA, 22 nt, Staphylococcus aureus subsp. aureus Mu50
ucgcugcaucguauaguuguug

SEQ ID NO: 16484 - RNA, 22 nt, Staphylococcus aureus subsp. aureus Mu50
uauaaauagagaagagcaguaa

SEQ ID NO: 16485 - RNA, 22 nt, Staphylococcus aureus subsp. aureus Mu50
uaucuccagaguauacaguauc

SEQ ID NO: 16486 - RNA, 22 nt, Staphylococcus aureus subsp. aureus Mu50
ucaaaaaugaagacauaguuaa

SEQ ID NO: 16487 - RNA, 22 nt, Staphylococcus aureus subsp. aureus Mu50
uagaaacagcaguaagaugauu

SEQ ID NO: 16488 - RNA, 22 nt, Staphylococcus aureus subsp. aureus Mu50
uaaguggauuguaauuauauua

SEQ ID NO: 16489 - RNA, 22 nt, Staphylococcus aureus subsp. aureus Mu50
ucauaauagauucuauuuuuaa

SEQ ID NO: 16490 - RNA, 22 nt, Staphylococcus aureus subsp. aureus Mu50
ucacuagagcuaugaaacuugg

SEQ ID NO: 16491 - RNA, 22 nt, Staphylococcus aureus subsp. aureus Mu50
ugcaucauuuaaagcugcuuca

SEQ ID NO: 16492 - RNA, 22 nt, Staphylococcus aureus subsp. aureus Mu50
ugauugguggguuuuucuucaa

SEQ ID NO: 16493 - RNA, 23 nt, Staphylococcus aureus subsp. aureus Mu50
ugcaaauguugagcgcauauuug

SEQ ID NO: 16494 - RNA, 22 nt, Staphylococcus aureus subsp. aureus Mu50
cagaugcugcagaugaauuaga

SEQ ID NO: 16495 - RNA, 22 nt, Staphylococcus aureus subsp. aureus Mu50
auuugaaaggagccgauaaugg

SEQ ID NO: 16496 - RNA, 22 nt, Staphylococcus aureus subsp. aureus Mu50
auuuuauauaaaaagaagaucc

SEQ ID NO: 16497 - RNA, 22 nt, Staphylococcus aureus subsp. aureus Mu50
caaaugcugucgucuacuuuua

SEQ ID NO: 16498 - RNA, 22 nt, Staphylococcus aureus subsp. aureus Mu50
auuauuuaccacuuaaacaagc

SEQ ID NO: 16499 - RNA, 22 nt, Staphylococcus aureus subsp. aureus Mu50
auuaaaugauucuuuauuggua

SEQ ID NO: 16500 - RNA, 21 nt, Staphylococcus aureus subsp. aureus Mu50
augcaucuuucugugcuuggu

SEQ ID NO: 16501 - RNA, 22 nt, Staphylococcus aureus subsp. aureus Mu50
auguaaaaaagcugauuucuau

SEQ ID NO: 16502 - RNA, 22 nt, Staphylococcus aureus subsp. aureus Mu50
auguucaucuacaguauuaugu

SEQ ID NO: 16503 - RNA, 22 nt, Staphylococcus aureus subsp. aureus Mu50
augacguuguugaauuaucuuc

SEQ ID NO: 16504 - RNA, 22 nt, Staphylococcus aureus subsp. aureus Mu50
aucuagaaucgcaugauaauuu

SEQ ID NO: 16505 - RNA, 22 nt, Staphylococcus aureus subsp. aureus Mu50
auagugaguuuguuacauauug

SEQ ID NO: 16506 - RNA, 22 nt, Staphylococcus aureus subsp. aureus Mu50
auauaaguuuuggugacugaau

SEQ ID NO: 16507 - RNA, 22 nt, Staphylococcus aureus subsp. aureus Mu50
auaaacauguuguuucugaaac

SEQ ID NO: 16508 - RNA, 22 nt, Staphylococcus aureus subsp. aureus Mu50
auauuugcuaaaaauacuuuga

SEQ ID NO: 16509 - RNA, 22 nt, Staphylococcus aureus subsp. aureus Mu50
auaugaaacuacucauuugaag

SEQ ID NO: 16510 - RNA, 22 nt, Staphylococcus aureus subsp. aureus Mu50
aucaugacuuaugugugaguga

SEQ ID NO: 16511 - RNA, 23 nt, Staphylococcus aureus subsp. aureus Mu50
ugugccauuugaaaauguuauga

SEQ ID NO: 16512 - RNA, 22 nt, Staphylococcus aureus subsp. aureus Mu50
uuaaaaaagcagugaaucauuu

SEQ ID NO: 16513 - RNA, 22 nt, Staphylococcus aureus subsp. aureus Mu50
uuaaaagucacaauacacauga

SEQ ID NO: 16514 - RNA, 23 nt, Staphylococcus aureus subsp. aureus Mu50
uuccaauuccaaaugcaauagca

SEQ ID NO: 16515 - RNA, 17 nt, Staphylococcus aureus subsp. aureus Mu50
uucauaucauuacuuug

SEQ ID NO: 16516 - RNA, 20 nt, Staphylococcus aureus subsp. aureus Mu50
uuauugauaguacucagcaa

SEQ ID NO: 16517 - RNA, 22 nt, Staphylococcus aureus subsp. aureus Mu50
uugaauggaguauaucagcuug

SEQ ID NO: 16518 - RNA, 22 nt, Staphylococcus aureus subsp. aureus Mu50
uugauaaggggaguguaguauu

SEQ ID NO: 16519 - RNA, 22 nt, Staphylococcus aureus subsp. aureus Mu50
uugauacagcugguacauuagu

SEQ ID NO: 16520 - RNA, 22 nt, Staphylococcus aureus subsp. aureus Mu50
aguuauaacgaaguuauuaugc

SEQ ID NO: 16521 - RNA, 22 nt, Staphylococcus aureus subsp. aureus Mu50
agguuuaacauuauuacaaauc

SEQ ID NO: 16522 - RNA, 22 nt, Staphylococcus aureus subsp. aureus Mu50
uuuuaugauaaagaaggauaua

SEQ ID NO: 16523 - RNA, 22 nt, Staphylococcus aureus subsp. aureus Mu50
uuuuauugaucgacacgguaag

SEQ ID NO: 16524 - RNA, 19 nt, Staphylococcus aureus subsp. aureus Mu50
uuugaacuuguauuuguag

SEQ ID NO: 16525 - RNA, 22 nt, Staphylococcus aureus subsp. aureus Mu50
uuugauucagucaguaaagaag

SEQ ID NO: 16526 - RNA, 22 nt, Staphylococcus aureus subsp. aureus Mu50
uuucaucagauugguacgaagc

SEQ ID NO: 16527 - RNA, 22 nt, Staphylococcus aureus subsp. aureus Mu50
uuucacauaguuaacaauugcu

SEQ ID NO: 16528 - RNA, 22 nt, Staphylococcus aureus subsp. aureus Mu50
uuucacauuuggauauuuacga

SEQ ID NO: 16529 - RNA, 22 nt, Staphylococcus aureus subsp. aureus Mu50
uugcagcacgugauucuggugc

SEQ ID NO: 16530 - RNA, 22 nt, Staphylococcus aureus subsp. aureus Mu50
uugugaaauauucggcgguacu

SEQ ID NO: 16531 - RNA, 22 nt, Staphylococcus aureus subsp. aureus Mu50
uuuaauugcugugcuuggugga

SEQ ID NO: 16532 - RNA, 22 nt, Staphylococcus aureus subsp. aureus Mu50
uugggcaucgcuuaaaugguuu

SEQ ID NO: 16533 - RNA, 22 nt, Staphylococcus aureus subsp. aureus Mu50
gcuuuauugaugaugucuuuau

SEQ ID NO: 16534 - RNA, 22 nt, Staphylococcus aureus subsp. aureus Mu50
ggaugccgacaguauuccgauu

SEQ ID NO: 16535 - RNA, 22 nt, Staphylococcus aureus subsp. aureus Mu50
guaguugacugaacgaaaaugc

SEQ ID NO: 16536 - RNA, 22 nt, Staphylococcus aureus subsp. aureus Mu50
guaaaaccuguugauacaacug

SEQ ID NO: 16537 - RNA, 22 nt, Staphylococcus aureus subsp. aureus Mu50
gagauauugguaaagcuuuugc

SEQ ID NO: 16538 - RNA, 22 nt, Staphylococcus aureus subsp. aureus Mu50
cuuuccaaguuaaagauuuacc

SEQ ID NO: 16539 - RNA, 22 nt, Staphylococcus aureus subsp. aureus Mu50
gcaacaauuguaaaguuugaaa

SEQ ID NO: 16540 - RNA, 22 nt, Homo sapiens
ugacuaggaggcuggaggauga

SEQ ID NO: 16541 - RNA, 22 nt, Homo sapiens
gugcacaaaucuuaaauguaca

SEQ ID NO: 16542 - RNA, 22 nt, Homo sapiens
uggcagcugcuucaugggaugc

SEQ ID NO: 16543 - RNA, 20 nt, Homo sapiens
uauucacucuccagucuugc

SEQ ID NO: 16544 - RNA, 22 nt, Homo sapiens
uugauagacacauauccaugug

SEQ ID NO: 16545 - RNA, 22 nt, Homo sapiens
aaaugcucucuacacguuucug

SEQ ID NO: 16546 - RNA, 22 nt, Homo sapiens
auggaguguggaacugggaauc

SEQ ID NO: 16547 - RNA, 22 nt, Homo sapiens
ggcagcucaggccccgcgcuga

SEQ ID NO: 16548 - RNA, 22 nt, Homo sapiens
gggaggucauuguucaaugcug

SEQ ID NO: 16549 - RNA, 22 nt, Homo sapiens
gugcacaacaugcaguuuuguu

SEQ ID NO: 16550 - RNA, 22 nt, Homo sapiens
caaaggcuucugaaacugcaga

SEQ ID NO: 16551 - RNA, 22 nt, Homo sapiens
uggaagugaacaaccaaggcag

SEQ ID NO: 16552 - RNA, 22 nt, Homo sapiens
aaaugcacaaagauuuugcacu

SEQ ID NO: 16553 - RNA, 22 nt, Homo sapiens
ugugguuuuaguaaaacuaugu

SEQ ID NO: 16554 - RNA, 22 nt, Homo sapiens
uaaguauuaugugcugcauuuu

SEQ ID NO: 16555 - RNA, 22 nt, Homo sapiens
accugguuuuaacauuguauua

SEQ ID NO: 16556 - RNA, 22 nt, Homo sapiens
guggcgagaucauagcucauug

SEQ ID NO: 16557 - RNA, 22 nt, Homo sapiens
ugacuagggcucuaaacagcuc

SEQ ID NO: 16558 - RNA, 22 nt, Homo sapiens
uacucaauugcagucaccuggc

SEQ ID NO: 16559 - RNA, 22 nt, Homo sapiens
cuggcugagugguaaguagagg

SEQ ID NO: 16560 - RNA, 22 nt, Homo sapiens
aaugcacauauauuuccuuauu

SEQ ID NO: 16561 - RNA, 22 nt, Homo sapiens
cucacggcccugcgcacuggca

SEQ ID NO: 16562 - RNA, 22 nt, Homo sapiens
uccccgagcccaggcugugacu

SEQ ID NO: 16563 - RNA, 22 nt, Homo sapiens
ugagguuggguaauuuaugaag

SEQ ID NO: 16564 - RNA, 22 nt, Homo sapiens
uggagugauaugguuauauggg

SEQ ID NO: 16565 - RNA, 22 nt, Homo sapiens
auaagugagugauucaguguua

SEQ ID NO: 16566 - RNA, 21 nt, Homo sapiens
uggucccauaagauuacaaug

SEQ ID NO: 16567 - RNA, 22 nt, Homo sapiens
ugggcggagacgugcagccgcc

SEQ ID NO: 16568 - RNA, 23 nt, Homo sapiens
ggauggaaaguuuugagggccac

SEQ ID NO: 16569 - RNA, 22 nt, Homo sapiens
ggcagacuguggaguucuuucu

SEQ ID NO: 16570 - RNA, 22 nt, Homo sapiens
uagcagcaccccacucuacugg

SEQ ID NO: 16571 - RNA, 22 nt, Homo sapiens
aucugggguuggcaaaguuugg

SEQ ID NO: 16572 - RNA, 22 nt, Homo sapiens
cugagaagaaacagguaaggac

SEQ ID NO: 16573 - RNA, 22 nt, Homo sapiens
gucagucugucccugccuggcg

SEQ ID NO: 16574 - RNA, 22 nt, Homo sapiens
gagcuggacuucuuaccuuuuc

SEQ ID NO: 16575 - RNA, 22 nt, Homo sapiens
uuuuuuaguuagcugggcauga

SEQ ID NO: 16576 - RNA, 22 nt, Homo sapiens
uugauauguuguuagauucagu

SEQ ID NO: 16577 - RNA, 22 nt, Homo sapiens
uagccucacaaagugcuuaaga

SEQ ID NO: 16578 - RNA, 22 nt, Homo sapiens
uaugcacacacguguuuaugug

SEQ ID NO: 16579 - RNA, 20 nt, Homo sapiens
uggcucuuugcugcuaaagu

SEQ ID NO: 16580 - RNA, 23 nt, Homo sapiens
ucacuagaguccuggaguuugag

SEQ ID NO: 16581 - RNA, 22 nt, Homo sapiens
uggaaguauagauaauugaaag

SEQ ID NO: 16582 - RNA, 22 nt, Homo sapiens
ugagaggugaauggcaggcuca

SEQ ID NO: 16583 - RNA, 22 nt, Homo sapiens
aucugcacaucuguguuuuugu

SEQ ID NO: 16584 - RNA, 22 nt, Homo sapiens
ggacuaggagcuaggaagaucu

SEQ ID NO: 16585 - RNA, 21 nt, Homo sapiens
uuucugggggagcauggcagg

SEQ ID NO: 16586 - RNA, 22 nt, Homo sapiens
uccaugugaaaaggucgugaua

SEQ ID NO: 16587 - RNA, 22 nt, Homo sapiens
uuucugggggugcugauggaaa

SEQ ID NO: 16588 - RNA, 19 nt, Homo sapiens
acagcugguuuugguuucu

SEQ ID NO: 16589 - RNA, 22 nt, Homo sapiens
uggauugagaagcuguggcuca

SEQ ID NO: 16590 - RNA, 22 nt, Homo sapiens
aggaaguaauaaguuugguucu

SEQ ID NO: 16591 - RNA, 20 nt, Homo sapiens
uggaaguaagaauauaggug

SEQ ID NO: 16592 - RNA, 22 nt, Homo sapiens
aaauugcacaaguggugauuug

SEQ ID NO: 16593 - RNA, 22 nt, Homo sapiens
uccaugugaaaucuaugaggac

SEQ ID NO: 16594 - RNA, 22 nt, Homo sapiens
acacuuucuggagcugcacaua

SEQ ID NO: 16595 - RNA, 22 nt, Homo sapiens
cuuuggcauuagccuguauaga

SEQ ID NO: 16596 - RNA, 22 nt, Homo sapiens
augugcacaugcuuacauguga

SEQ ID NO: 16597 - RNA, 22 nt, Homo sapiens
guccuggagaagcguggaccgg

SEQ ID NO: 16598 - RNA, 22 nt, Homo sapiens
gggaagugugcagaguucucuu

SEQ ID NO: 16599 - RNA, 22 nt, Homo sapiens
aguggaguguaaagcgucuuuu

SEQ ID NO: 16600 - RNA, 22 nt, Homo sapiens
cccuguguuguucaaggaucug

SEQ ID NO: 16601 - RNA, 22 nt, Homo sapiens
ugaaugcuucaugucugggcug

SEQ ID NO: 16602 - RNA, 22 nt, Homo sapiens
uucaggcaccauugucauugau

SEQ ID NO: 16603 - RNA, 22 nt, Homo sapiens
augagucacuuauuauuggggu

SEQ ID NO: 16604 - RNA, 23 nt, Homo sapiens
uccccgggagcaccagcuuguug

SEQ ID NO: 16605 - RNA, 22 nt, Homo sapiens
uucacacugggccuacucugug

SEQ ID NO: 16606 - RNA, 22 nt, Homo sapiens
uggcucuuucuagacuuaauua

SEQ ID NO: 16607 - RNA, 22 nt, Homo sapiens
aauacugagaugugagguacua

SEQ ID NO: 16608 - RNA, 22 nt, Homo sapiens
gacuaggagagcagcugcccau

SEQ ID NO: 16609 - RNA, 22 nt, Homo sapiens
gugaucuguccuucauagccug

SEQ ID NO: 16610 - RNA, 22 nt, Homo sapiens
agugaaaucugaagaaggucau

SEQ ID NO: 16611 - RNA, 22 nt, Homo sapiens
uuuccagguggccaacauuuua

SEQ ID NO: 16612 - RNA, 22 nt, Homo sapiens
ugauauauugaaugaugaaaca

SEQ ID NO: 16613 - RNA, 22 nt, Homo sapiens
aggaagguaaacuaacuugccu

SEQ ID NO: 16614 - RNA, 19 nt, Homo sapiens
uccccgggucuagugcagc

SEQ ID NO: 16615 - RNA, 21 nt, Homo sapiens
ugcagccauucagcccuaugc

SEQ ID NO: 16616 - RNA, 23 nt, Homo sapiens
ugccuagaugcugcccugggaca

SEQ ID NO: 16617 - RNA, 22 nt, Homo sapiens
gauggaguugucgccugggcug

SEQ ID NO: 16618 - RNA, 22 nt, Homo sapiens
ugaucucagcucacugguugaa

SEQ ID NO: 16619 - RNA, 22 nt, Homo sapiens
uggaguguaaauuaguucagcc

SEQ ID NO: 16620 - RNA, 22 nt, Homo sapiens
uguaaugaucaaaucagaguaa

SEQ ID NO: 16621 - RNA, 22 nt, Homo sapiens
aagcacccuuugucuggacaug

SEQ ID NO: 16622 - RNA, 22 nt, Homo sapiens
cuagcugcacuuccugcuacug

SEQ ID NO: 16623 - RNA, 22 nt, Homo sapiens
ucccauguagcuaggauuacag

SEQ ID NO: 16624 - RNA, 22 nt, Homo sapiens
uuccacaaugguugaacuagcu

SEQ ID NO: 16625 - RNA, 22 nt, Homo sapiens
cacuuugguucaccugaguuuc

SEQ ID NO: 16626 - RNA, 22 nt, Homo sapiens
ugguaccuuuuaaugacuaauu

SEQ ID NO: 16627 - RNA, 22 nt, Homo sapiens
ggccggguggccauggcugccc

SEQ ID NO: 16628 - RNA, 17 nt, Homo sapiens
ugauaagugugagguga

SEQ ID NO: 16629 - RNA, 22 nt, Homo sapiens
gcuaggagaucugcugcucucu

SEQ ID NO: 16630 - RNA, 22 nt, Homo sapiens
gcuggugacuuuaaguugaagc

SEQ ID NO: 16631 - RNA, 22 nt, Homo sapiens
ugaggauaguguugaaggcagg

SEQ ID NO: 16632 - RNA, 22 nt, Homo sapiens
uuacaguucugguggagaggua

SEQ ID NO: 16633 - RNA, 22 nt, Homo sapiens
cucacuaggaaguaaaguuugu

SEQ ID NO: 16634 - RNA, 22 nt, Homo sapiens
guggaagugucuggggccaggg

SEQ ID NO: 16635 - RNA, 22 nt, Homo sapiens
uugauagacaucugaguuguug

SEQ ID NO: 16636 - RNA, 22 nt, Homo sapiens
uuucaguguggcaggcauagcu

SEQ ID NO: 16637 - RNA, 22 nt, Homo sapiens
gaagcauugauccacaggcgug

SEQ ID NO: 16638 - RNA, 19 nt, Homo sapiens
ugcauugucugggaaaugg

SEQ ID NO: 16639 - RNA, 22 nt, Homo sapiens
ugagguugguauuacugucucu

SEQ ID NO: 16640 - RNA, 22 nt, Homo sapiens
ugacuaggaaauuagaacuuuu

SEQ ID NO: 16641 - RNA, 22 nt, Homo sapiens
uugauauguuguuggauucacu

SEQ ID NO: 16642 - RNA, 22 nt, Homo sapiens
uuugguguauaaaaaugcuagu

SEQ ID NO: 16643 - RNA, 21 nt, Homo sapiens
ugaaccccugcucucaagaaa

SEQ ID NO: 16644 - RNA, 22 nt, Homo sapiens
ggcagcuguguccuucguaagg

SEQ ID NO: 16645 - RNA, 22 nt, Homo sapiens
uuccacaaugguugaacuaauu

SEQ ID NO: 16646 - RNA, 17 nt, Homo sapiens
uuuuggauuagaaaucc

SEQ ID NO: 16647 - RNA, 22 nt, Homo sapiens
auaugcauacauguaugcagga

SEQ ID NO: 16648 - RNA, 22 nt, Homo sapiens
uuggaauguacucuagccuaug

SEQ ID NO: 16649 - RNA, 22 nt, Homo sapiens
uugugguuuuuaaaacuaggug

SEQ ID NO: 16650 - RNA, 20 nt, Homo sapiens
agacuagggagcagaaagcc

SEQ ID NO: 16651 - RNA, 22 nt, Homo sapiens
auaugcacuauacacacguaua

SEQ ID NO: 16652 - RNA, 22 nt, Homo sapiens
cagcaucauucaucugggguaa

SEQ ID NO: 16653 - RNA, 22 nt, Homo sapiens
uuccacaauggcugaacuaguu

SEQ ID NO: 16654 - RNA, 22 nt, Homo sapiens
uggcuccguuguacaggcugga

SEQ ID NO: 16655 - RNA, 22 nt, Homo sapiens
uuggucucaucaagagcagcuu

SEQ ID NO: 16656 - RNA, 22 nt, Homo sapiens
ugagucuguucucacauugcua

SEQ ID NO: 16657 - RNA, 22 nt, Homo sapiens
agcaccaauaacaguuucuagc

SEQ ID NO: 16658 - RNA, 22 nt, Homo sapiens
cugggaugugacuguugccccc

SEQ ID NO: 16659 - RNA, 22 nt, Homo sapiens
ucacaaguguauagacaugucc

SEQ ID NO: 16660 - RNA, 22 nt, Homo sapiens
gaagcgaggugauuagcagaca

SEQ ID NO: 16661 - RNA, 22 nt, Homo sapiens
auacuguuuuacaucauugccu

SEQ ID NO: 16662 - RNA, 18 nt, Homo sapiens
ucacuagacacugaaucu

SEQ ID NO: 16663 - RNA, 22 nt, Homo sapiens
uugggacuggaaggaguaaggg

SEQ ID NO: 16664 - RNA, 22 nt, Homo sapiens
ggaagguaauugucagcucaua

SEQ ID NO: 16665 - RNA, 22 nt, Homo sapiens
ucagaacugauacuagaacuuu

SEQ ID NO: 16666 - RNA, 22 nt, Homo sapiens
caugguguuaggcacugggaau

SEQ ID NO: 16667 - RNA, 22 nt, Homo sapiens
agcgccacugcacuccagccug

SEQ ID NO: 16668 - RNA, 22 nt, Homo sapiens
uagcuggaguuuuuguuauagg

SEQ ID NO: 16669 - RNA, 22 nt, Homo sapiens
uuggaagagaagggagauaaac

SEQ ID NO: 16670 - RNA, 22 nt, Homo sapiens
gugcacaaucgugcauuccuug

SEQ ID NO: 16671 - RNA, 22 nt, Homo sapiens
ggacuagggacauggggagcug

SEQ ID NO: 16672 - RNA, 22 nt, Homo sapiens
gcuggcuuucuccugaucucag

SEQ ID NO: 16673 - RNA, 22 nt, Homo sapiens
ugaauacugugcaaaggauuug

SEQ ID NO: 16674 - RNA, 22 nt, Homo sapiens
uggucccaugaacuuuagguca

SEQ ID NO: 16675 - RNA, 22 nt, Homo sapiens
caaugcauuauucucccacuuc

SEQ ID NO: 16676 - RNA, 22 nt, Homo sapiens
gucauugcuuaaggguucaugc

SEQ ID NO: 16677 - RNA, 22 nt, Homo sapiens
uggaagugucugugcccagcuc

SEQ ID NO: 16678 - RNA, 22 nt, Homo sapiens
auugauaguuuaauaggaauug

SEQ ID NO: 16679 - RNA, 22 nt, Homo sapiens
ucucacagaguugaacuuucuu

SEQ ID NO: 16680 - RNA, 22 nt, Homo sapiens
uuggcaaauagguuuuauugca

SEQ ID NO: 16681 - RNA, 22 nt, Homo sapiens
guuaagaaguguaacuuaaguu

SEQ ID NO: 16682 - RNA, 22 nt, Homo sapiens
aauacugaaaguauuuucaaau

SEQ ID NO: 16683 - RNA, 18 nt, Homo sapiens
gucucacaugguggaagc

SEQ ID NO: 16684 - RNA, 20 nt, Homo sapiens
uggaacuuaauugauggaca

SEQ ID NO: 16685 - RNA, 22 nt, Homo sapiens
auaugacugccagggcccaguc

SEQ ID NO: 16686 - RNA, 22 nt, Homo sapiens
uuccacaaugguugaacuaguu

SEQ ID NO: 16687 - RNA, 22 nt, Homo sapiens
aucacuagaucauagguaaaca

SEQ ID NO: 16688 - RNA, 22 nt, Homo sapiens
agugacaugggaucaaaucuga

SEQ ID NO: 16689 - RNA, 22 nt, Homo sapiens
aggucccauguccucccugacc

SEQ ID NO: 16690 - RNA, 22 nt, Homo sapiens
auagcagcuugucagggcagac

SEQ ID NO: 16691 - RNA, 22 nt, Homo sapiens
uggcuugauggcacaagguuuc

SEQ ID NO: 16692 - RNA, 17 nt, Homo sapiens
guuuggguacuggguaa

SEQ ID NO: 16693 - RNA, 22 nt, Homo sapiens
agcugguauuuugucaaggaua

SEQ ID NO: 16694 - RNA, 22 nt, Homo sapiens
auggauguucuagggaugugau

SEQ ID NO: 16695 - RNA, 22 nt, Homo sapiens
auugcacaucugcacuacagcc

SEQ ID NO: 16696 - RNA, 22 nt, Homo sapiens
uagcaccuuagcauuucuagug

SEQ ID NO: 16697 - RNA, 22 nt, Homo sapiens
ugaggcacucccuagcggggug

SEQ ID NO: 16698 - RNA, 22 nt, Homo sapiens
uuuggcuuuuguaauaacugcc

SEQ ID NO: 16699 - RNA, 22 nt, Homo sapiens
gaggaguagggcacaaagccuu

SEQ ID NO: 16700 - RNA, 22 nt, Homo sapiens
gagauguuuuguuaucaaagga

SEQ ID NO: 16701 - RNA, 22 nt, Homo sapiens
ucacuagaucaagggagagaaa

SEQ ID NO: 16702 - RNA, 22 nt, Homo sapiens
auggaggccuacagaauuuugg

SEQ ID NO: 16703 - RNA, 22 nt, Homo sapiens
uguucuugaguugggaguacaa

SEQ ID NO: 16704 - RNA, 22 nt, Homo sapiens
ugauacugugcauuagaggcua

SEQ ID NO: 16705 - RNA, 22 nt, Homo sapiens
gacuaggagauauguuuucuuc

SEQ ID NO: 16706 - RNA, 22 nt, Homo sapiens
agagaacugauuggaugugggc

SEQ ID NO: 16707 - RNA, 22 nt, Homo sapiens
augacauugaaaagcaagugga

SEQ ID NO: 16708 - RNA, 22 nt, Homo sapiens
agggcuuguuuaacuaucauua

SEQ ID NO: 16709 - RNA, 19 nt, Homo sapiens
uggagucaucaugcugcua

SEQ ID NO: 16710 - RNA, 18 nt, Homo sapiens
uuucaggguggacaugag

SEQ ID NO: 16711 - RNA, 22 nt, Homo sapiens
uacauacuucacagacuuuaaa

SEQ ID NO: 16712 - RNA, 22 nt, Homo sapiens
ucacaggguguuauuagaauua

SEQ ID NO: 16713 - RNA, 22 nt, Homo sapiens
aaaaguucuuugagccuugaca

SEQ ID NO: 16714 - RNA, 22 nt, Homo sapiens
ucucacagaguugaauguuucu

SEQ ID NO: 16715 - RNA, 22 nt, Homo sapiens
gccccgggugaugcagccguca

SEQ ID NO: 16716 - RNA, 22 nt, Homo sapiens
uauggauuuuuuugacaagagc

SEQ ID NO: 16717 - RNA, 22 nt, Homo sapiens
uggaaguaaccaugaauggaau

SEQ ID NO: 16718 - RNA, 22 nt, Homo sapiens
uugguccccuucaaccagcugu

SEQ ID NO: 16719 - RNA, 22 nt, Homo sapiens
gaaugauacuguuaacgaaaga

SEQ ID NO: 16720 - RNA, 22 nt, Homo sapiens
uggauugaaagcuuuaauauug

SEQ ID NO: 16721 - RNA, 21 nt, Homo sapiens
cugguccccuuuauguaugug

SEQ ID NO: 16722 - RNA, 22 nt, Homo sapiens
augacuagaggagggauggcca

SEQ ID NO: 16723 - RNA, 22 nt, Homo sapiens
cuggaggccugaacauaaaugg

SEQ ID NO: 16724 - RNA, 22 nt, Homo sapiens
uugguccucccaugcucaagag

SEQ ID NO: 16725 - RNA, 22 nt, Homo sapiens
cuguaauguaaugagacuacau

SEQ ID NO: 16726 - RNA, 22 nt, Homo sapiens
uuggagugugagagcagccugg

SEQ ID NO: 16727 - RNA, 17 nt, Homo sapiens
uuuaaugcuaggacucu

SEQ ID NO: 16728 - RNA, 22 nt, Homo sapiens
gugguguuugagcugccaggga

SEQ ID NO: 16729 - RNA, 22 nt, Homo sapiens
aagcuggagugcaguggugcaa

SEQ ID NO: 16730 - RNA, 22 nt, Homo sapiens
uugauagaucagggauuugauu

SEQ ID NO: 16731 - RNA, 20 nt, Homo sapiens
aucagagacuaggauugcca

SEQ ID NO: 16732 - RNA, 22 nt, Homo sapiens
uggaaguagauagauuguguca

SEQ ID NO: 16733 - RNA, 22 nt, Homo sapiens
auaaagccaugagcuugagaug

SEQ ID NO: 16734 - RNA, 22 nt, Homo sapiens
uucaggcaccauggucauugau

SEQ ID NO: 16735 - RNA, 19 nt, Homo sapiens
augagucugcaagaaccag

SEQ ID NO: 16736 - RNA, 19 nt, Homo sapiens
ggcaauacuuucuuguugg

SEQ ID NO: 16737 - RNA, 22 nt, Homo sapiens
uuaaaugcuagaauuuucuuug

SEQ ID NO: 16738 - RNA, 20 nt, Homo sapiens
cugcacauccacucuacuuc

SEQ ID NO: 16739 - RNA, 22 nt, Homo sapiens
auacaguugccauuucuugugc

SEQ ID NO: 16740 - RNA, 17 nt, Homo sapiens
ucuaauaauaugcauuu

SEQ ID NO: 16741 - RNA, 22 nt, Homo sapiens
uagcaccugugcacaccaggca

SEQ ID NO: 16742 - RNA, 22 nt, Homo sapiens
agaaugucaguauuggcuaaaa

SEQ ID NO: 16743 - RNA, 23 nt, Homo sapiens
ucaugaggccauucaaauccauu

SEQ ID NO: 16744 - RNA, 22 nt, Homo sapiens
gcgugguguuagaaugagaagu

SEQ ID NO: 16745 - RNA, 23 nt, Homo sapiens
ucugcggguguggacccuagugc

SEQ ID NO: 16746 - RNA, 22 nt, Homo sapiens
ccacaguggauuaaaguuacug

SEQ ID NO: 16747 - RNA, 22 nt, Homo sapiens
uuggacuucucaaggcaauaaa

SEQ ID NO: 16748 - RNA, 22 nt, Homo sapiens
gagcuagguuuugaauccagac

SEQ ID NO: 16749 - RNA, 22 nt, Homo sapiens
cacugcaguaaauugcgucggu

SEQ ID NO: 16750 - RNA, 17 nt, Homo sapiens
ugugauugaagucaucc

SEQ ID NO: 16751 - RNA, 22 nt, Homo sapiens
agcaccaauaaucagaguucuu

SEQ ID NO: 16752 - RNA, 22 nt, Homo sapiens
acccuggauucguggccuugaa

SEQ ID NO: 16753 - RNA, 22 nt, Homo sapiens
uagcaacauucagcucagguac

SEQ ID NO: 16754 - RNA, 22 nt, Homo sapiens
gugauagaucugggauucagaa

SEQ ID NO: 16755 - RNA, 22 nt, Homo sapiens
acccauguaggugggauuacag

SEQ ID NO: 16756 - RNA, 22 nt, Homo sapiens
acuagguaguaaucugcagaga

SEQ ID NO: 16757 - RNA, 22 nt, Homo sapiens
ucaggguacuuguggccaaagu

SEQ ID NO: 16758 - RNA, 22 nt, Homo sapiens
ucacucagaccuggugauaugc

SEQ ID NO: 16759 - RNA, 22 nt, Homo sapiens
ccccauguucucucugcagcuc

SEQ ID NO: 16760 - RNA, 21 nt, Homo sapiens
augugcacuaugucauuuaau

SEQ ID NO: 16761 - RNA, 22 nt, Homo sapiens
cuaggcuguagagaaguucagu

SEQ ID NO: 16762 - RNA, 22 nt, Homo sapiens
gacuagaaauuauuuagugagc

SEQ ID NO: 16763 - RNA, 22 nt, Homo sapiens
uggagacugaucccucuuuccu

SEQ ID NO: 16764 - RNA, 22 nt, Homo sapiens
cuagaacuagaacugcuggggu

SEQ ID NO: 16765 - RNA, 22 nt, Homo sapiens
augcacauggcuaacuuuuuuc

SEQ ID NO: 16766 - RNA, 22 nt, Homo sapiens
ugugguuuuuuucuccaauagg

SEQ ID NO: 16767 - RNA, 22 nt, Homo sapiens
ccucauggagaacaucugcuag

SEQ ID NO: 16768 - RNA, 22 nt, Homo sapiens
cauggcccugggcugggcgaac

SEQ ID NO: 16769 - RNA, 22 nt, Homo sapiens
ucauguguugcacugaggaccu

SEQ ID NO: 16770 - RNA, 22 nt, Homo sapiens
ucgcugcgaccuccaccucccg

SEQ ID NO: 16771 - RNA, 22 nt, Homo sapiens
agcuggcuguagcugcaagucu

SEQ ID NO: 16772 - RNA, 22 nt, Homo sapiens
uagcuggaauuacuugcaccug

SEQ ID NO: 16773 - RNA, 22 nt, Homo sapiens
ugacuaggggcccuggcuucuu

SEQ ID NO: 16774 - RNA, 22 nt, Homo sapiens
ugacucaguuguuagucuucau

SEQ ID NO: 16775 - RNA, 22 nt, Homo sapiens
auagcacaguguguguacacca

SEQ ID NO: 16776 - RNA, 22 nt, Homo sapiens
gugagaagaaaaauauggcugu

SEQ ID NO: 16777 - RNA, 22 nt, Homo sapiens
uaccacccuuuuuccagaagcc

SEQ ID NO: 16778 - RNA, 22 nt, Homo sapiens
gcuaggagauccacugcucucu

SEQ ID NO: 16779 - RNA, 22 nt, Homo sapiens
uugacaaggagccauugcaucu

SEQ ID NO: 16780 - RNA, 22 nt, Homo sapiens
cuugaucaaugugguacuugau

SEQ ID NO: 16781 - RNA, 22 nt, Homo sapiens
aagcuggauuucgcauccuguu

SEQ ID NO: 16782 - RNA, 22 nt, Homo sapiens
ugauauggcuuggcuaugucac

SEQ ID NO: 16783 - RNA, 22 nt, Homo sapiens
cacccuaucagauguccagaga

SEQ ID NO: 16784 - RNA, 20 nt, Homo sapiens
gauuagagagaggcugugca

SEQ ID NO: 16785 - RNA, 23 nt, Homo sapiens
ucgguccccuuggcugcccucgg

SEQ ID NO: 16786 - RNA, 22 nt, Homo sapiens
augugaaugugaucggauaguc

SEQ ID NO: 16787 - RNA, 22 nt, Homo sapiens
ucuuuggauggaaauuggaguc

SEQ ID NO: 16788 - RNA, 22 nt, Homo sapiens
uuggauuuuaacaaacuaggug

SEQ ID NO: 16789 - RNA, 22 nt, Homo sapiens
gaggcuagauggggaugugucc

SEQ ID NO: 16790 - RNA, 22 nt, Homo sapiens
auggucccauucauucacguau

SEQ ID NO: 16791 - RNA, 22 nt, Homo sapiens
uagugaauguuggcuauuaaua

SEQ ID NO: 16792 - RNA, 22 nt, Homo sapiens
gauggaguaauguaaucuugag

SEQ ID NO: 16793 - RNA, 22 nt, Homo sapiens
augcagaucacauuuuucuguc

SEQ ID NO: 16794 - RNA, 22 nt, Homo sapiens
uguggaguguaugugacagaga

SEQ ID NO: 16795 - RNA, 22 nt, Homo sapiens
guacaagugcaguuucguuaca

SEQ ID NO: 16796 - RNA, 22 nt, Homo sapiens
ucacacgugaacucaucacaga

SEQ ID NO: 16797 - RNA, 22 nt, Homo sapiens
aucagaaucucuagaggacugu

SEQ ID NO: 16798 - RNA, 23 nt, Homo sapiens
aggaaguaacuaucuuuucuguc

SEQ ID NO: 16799 - RNA, 22 nt, Homo sapiens
augacuauugcacuuuccuggu

SEQ ID NO: 16800 - RNA, 22 nt, Homo sapiens
uagcaucagauuccauauucua

SEQ ID NO: 16801 - RNA, 22 nt, Homo sapiens
aggcagcuguuauauacugagu

SEQ ID NO: 16802 - RNA, 22 nt, Homo sapiens
cagccgggugagguggcuuguu

SEQ ID NO: 16803 - RNA, 18 nt, Homo sapiens
ucccucagaauuauagaa

SEQ ID NO: 16804 - RNA, 22 nt, Homo sapiens
uagcaccaaacauauacucagu

SEQ ID NO: 16805 - RNA, 22 nt, Homo sapiens
agcugguauuuugucgaggacu

SEQ ID NO: 16806 - RNA, 22 nt, Homo sapiens
cauggauuuuuuugaauggcag

SEQ ID NO: 16807 - RNA, 22 nt, Homo sapiens
aagcuggagugcaguggugcga

SEQ ID NO: 16808 - RNA, 22 nt, Homo sapiens
cucacuaguaaggcuguuuagu

SEQ ID NO: 16809 - RNA, 22 nt, Homo sapiens
ccuucuuuuguaaggcugaaua

SEQ ID NO: 16810 - RNA, 22 nt, Homo sapiens
guccaaauccaugggauguaca

SEQ ID NO: 16811 - RNA, 22 nt, Homo sapiens
aagcuggauuuaguguggagca

SEQ ID NO: 16812 - RNA, 22 nt, Homo sapiens
gaugcagcuaggauuugugaca

SEQ ID NO: 16813 - RNA, 22 nt, Homo sapiens
accucagcccggggaaguugag

SEQ ID NO: 16814 - RNA, 22 nt, Homo sapiens
gugaacagaaccugggaucgaa

SEQ ID NO: 16815 - RNA, 23 nt, Homo sapiens
ugugcacauuuacauauauacac

SEQ ID NO: 16816 - RNA, 21 nt, Homo sapiens
gugucacagacaugacagaug

SEQ ID NO: 16817 - RNA, 22 nt, Homo sapiens
gcgguagcauagacugcaggac

SEQ ID NO: 16818 - RNA, 22 nt, Homo sapiens
acugaucaauguuaaggcuuau

SEQ ID NO: 16819 - RNA, 22 nt, Homo sapiens
ugagguuauuuguucaagaagu

SEQ ID NO: 16820 - RNA, 22 nt, Homo sapiens
aaacugaucugaaggccaggcu

SEQ ID NO: 16821 - RNA, 21 nt, Homo sapiens
uggucccauaagauuauaaug

SEQ ID NO: 16822 - RNA, 22 nt, Homo sapiens
cagcacauuacaaguacuuggu

SEQ ID NO: 16823 - RNA, 22 nt, Homo sapiens
uuagaacuagaggaguuugagu

SEQ ID NO: 16824 - RNA, 22 nt, Homo sapiens
uuggacuggaacuauaccauug

SEQ ID NO: 16825 - RNA, 22 nt, Homo sapiens
gagguauagaacaccuuucaag

SEQ ID NO: 16826 - RNA, 22 nt, Homo sapiens
uggaguguagaagccagccucc

SEQ ID NO: 16827 - RNA, 22 nt, Homo sapiens
augcacuuggcaggaugauucc

SEQ ID NO: 16828 - RNA, 22 nt, Homo sapiens
uggugagaaaugagaugcuuuu

SEQ ID NO: 16829 - RNA, 22 nt, Homo sapiens
agcccauguggcugaggcuucu

SEQ ID NO: 16830 - RNA, 22 nt, Homo sapiens
uagcugagacuacaguaggugc

SEQ ID NO: 16831 - RNA, 22 nt, Homo sapiens
acuauacuguaacuguauucag

SEQ ID NO: 16832 - RNA, 22 nt, Homo sapiens
ugacuagggacauucuuccacg

SEQ ID NO: 16833 - RNA, 21 nt, Homo sapiens
ugacuagggauaugugccacu

SEQ ID NO: 16834 - RNA, 22 nt, Homo sapiens
guaucacacuuauugaccugca

SEQ ID NO: 16835 - RNA, 22 nt, Homo sapiens
augaggcaggaaaggcguaucu

SEQ ID NO: 16836 - RNA, 22 nt, Homo sapiens
cuuuggccauagcuaaaugauu

SEQ ID NO: 16837 - RNA, 22 nt, Homo sapiens
aaucugggguuguuuggggagu

SEQ ID NO: 16838 - RNA, 22 nt, Homo sapiens
agcaccauuagcguugggccgg

SEQ ID NO: 16839 - RNA, 22 nt, Homo sapiens
ugucccaguuggguauugaauu

SEQ ID NO: 16840 - RNA, 22 nt, Homo sapiens
uaugcacaugcaugcuugaaua

SEQ ID NO: 16841 - RNA, 22 nt, Homo sapiens
gaugccuuuuuguccucaguua

SEQ ID NO: 16842 - RNA, 17 nt, Homo sapiens
ucccauguuucuucuac

SEQ ID NO: 16843 - RNA, 22 nt, Homo sapiens
uggacugagauuucagcugcca

SEQ ID NO: 16844 - RNA, 22 nt, Homo sapiens
uuuaucuguuuaaaacuguuca

SEQ ID NO: 16845 - RNA, 22 nt, Homo sapiens
ucuuugauuuuguuacuaagac

SEQ ID NO: 16846 - RNA, 22 nt, Homo sapiens
uacuagaaccuuauucagagug

SEQ ID NO: 16847 - RNA, 22 nt, Homo sapiens
caaaggcuuccacugcauccuu

SEQ ID NO: 16848 - RNA, 22 nt, Homo sapiens
uucagggacuuuagacaagaga

SEQ ID NO: 16849 - RNA, 22 nt, Homo sapiens
uuuaaugcgucucugaguuuug

SEQ ID NO: 16850 - RNA, 22 nt, Homo sapiens
cuuuaugagguuggauggaucu

SEQ ID NO: 16851 - RNA, 22 nt, Homo sapiens
ugaauagacacuaaagacugua

SEQ ID NO: 16852 - RNA, 22 nt, Homo sapiens
uggaaguaaucaugagguagca

SEQ ID NO: 16853 - RNA, 22 nt, Homo sapiens
gaacuguuucuggugaaagagu

SEQ ID NO: 16854 - RNA, 22 nt, Homo sapiens
aucagaaucucuagugggacca

SEQ ID NO: 16855 - RNA, 22 nt, Homo sapiens
ucacugaggucugagcuuuaug

SEQ ID NO: 16856 - RNA, 22 nt, Homo sapiens
ugguguuugagaagcugauguc

SEQ ID NO: 16857 - RNA, 22 nt, Homo sapiens
ugacuauaggauaacaugcauu

SEQ ID NO: 16858 - RNA, 22 nt, Homo sapiens
aucauacuguuuugauuacugu

SEQ ID NO: 16859 - RNA, 22 nt, Homo sapiens
uuaauguaucuaucacaucaca

SEQ ID NO: 16860 - RNA, 23 nt, Homo sapiens
uggaaguauggaggaggcagaau

SEQ ID NO: 16861 - RNA, 22 nt, Homo sapiens
gucauugguucuguuuauguga

SEQ ID NO: 16862 - RNA, 22 nt, Homo sapiens
uuggagugugcucauaacugcu

SEQ ID NO: 16863 - RNA, 22 nt, Homo sapiens
aagaccuaugcaggaagaaaug

SEQ ID NO: 16864 - RNA, 19 nt, Homo sapiens
uuucaauguaaggauggag

SEQ ID NO: 16865 - RNA, 22 nt, Streptococcus pneumoniae TIGR4
ugagcugggaagccugucaagg

SEQ ID NO: 16866 - RNA, 22 nt, Streptococcus pneumoniae TIGR4
ugacggaagaagagcgacaggu

SEQ ID NO: 16867 - RNA, 22 nt, Streptococcus pneumoniae TIGR4
uggaagaagcagauguuaucgu

SEQ ID NO: 16868 - RNA, 22 nt, Streptococcus pneumoniae TIGR4
uggaaguauuugccagagaugg

SEQ ID NO: 16869 - RNA, 22 nt, Streptococcus pneumoniae TIGR4
uggagccuuaacagcuguuuuu

SEQ ID NO: 16870 - RNA, 22 nt, Streptococcus pneumoniae TIGR4
uuuaaaaagaauacuggugucg

SEQ ID NO: 16871 - RNA, 22 nt, Streptococcus pneumoniae TIGR4
uuuaaaaagccuauuguaucaa

SEQ ID NO: 16872 - RNA, 22 nt, Streptococcus pneumoniae TIGR4
gcggcccagggcggagucguaa

SEQ ID NO: 16873 - RNA, 22 nt, Streptococcus pneumoniae TIGR4
gggaugaguaucuauucuauau

SEQ ID NO: 16874 - RNA, 22 nt, Streptococcus pneumoniae TIGR4
gggaugguggauccggauaagg

SEQ ID NO: 16875 - RNA, 23 nt, Streptococcus pneumoniae TIGR4
gggagcgcacuucgucauacuca

SEQ ID NO: 16876 - RNA, 22 nt, Streptococcus pneumoniae TIGR4
uugggaugucuuacagccgguu

SEQ ID NO: 16877 - RNA, 22 nt, Streptococcus pneumoniae TIGR4
uuuauugaguauaagaggucuu

SEQ ID NO: 16878 - RNA, 22 nt, Streptococcus pneumoniae TIGR4
uugagguuguagauagaacuga

SEQ ID NO: 16879 - RNA, 22 nt, Streptococcus pneumoniae TIGR4
uguuauaggcgaaauaggcugc

SEQ ID NO: 16880 - RNA, 22 nt, Streptococcus pneumoniae TIGR4
uguggcgacaaacugaugcgaa

SEQ ID NO: 16881 - RNA, 22 nt, Streptococcus pneumoniae TIGR4
caacagcuguguuguuuggaga

SEQ ID NO: 16882 - RNA, 20 nt, Streptococcus pneumoniae TIGR4
uggauugcucucaacugcac

SEQ ID NO: 16883 - RNA, 22 nt, Streptococcus pneumoniae TIGR4
ucauugaggacaaucugaagca

SEQ ID NO: 16884 - RNA, 22 nt, Streptococcus pneumoniae TIGR4
uacagacuuaaaagaaacagcu

SEQ ID NO: 16885 - RNA, 22 nt, Streptococcus pneumoniae TIGR4
gaacucuauuuucagacuugag

SEQ ID NO: 16886 - RNA, 22 nt, Streptococcus pneumoniae TIGR4
gauagaguucuuuuggucggcc

SEQ ID NO: 16887 - RNA, 22 nt, Streptococcus pneumoniae TIGR4
gcaguuggcaugcuugcuccua

SEQ ID NO: 16888 - RNA, 22 nt, Streptococcus pneumoniae TIGR4
cagcuggauagagcauucgccu

SEQ ID NO: 16889 - RNA, 22 nt, Streptococcus pneumoniae TIGR4
ggguagcuauacaggcuugcga

SEQ ID NO: 16890 - RNA, 22 nt, Streptococcus pneumoniae TIGR4
gggcaggcuuuggaggagcugu

SEQ ID NO: 16891 - RNA, 22 nt, Streptococcus pneumoniae TIGR4
gucauagaagucuuuuuaauua

SEQ ID NO: 16892 - RNA, 16 nt, Streptococcus pneumoniae TIGR4
uaaguucagcaagcuu

SEQ ID NO: 16893 - RNA, 22 nt, Streptococcus pneumoniae TIGR4
uauaaguuuugcuacuguugau

SEQ ID NO: 16894 - RNA, 22 nt, Streptococcus pneumoniae TIGR4
ucagucacauauauaauccaag

SEQ ID NO: 16895 - RNA, 22 nt, Streptococcus pneumoniae TIGR4
ucauauaaucguaccaauccau

SEQ ID NO: 16896 - RNA, 22 nt, Streptococcus pneumoniae TIGR4
uccugcaguugcuugcggugca

SEQ ID NO: 16897 - RNA, 22 nt, Streptococcus pneumoniae TIGR4
ggcuaggcaacugugguacuug

SEQ ID NO: 16898 - RNA, 21 nt, Streptococcus pneumoniae TIGR4
ggcugcuuugacacggcauuu

SEQ ID NO: 16899 - RNA, 22 nt, Streptococcus pneumoniae TIGR4
ggcucuaccaacuuuuucugag

SEQ ID NO: 16900 - RNA, 22 nt, Streptococcus pneumoniae TIGR4
aagcgaugcagcuccccccugu

SEQ ID NO: 16901 - RNA, 22 nt, Streptococcus pneumoniae TIGR4
aagauuacuaccaaguagaaac

SEQ ID NO: 16902 - RNA, 22 nt, Streptococcus pneumoniae TIGR4
aacuagaaaagguuuuccuuau

SEQ ID NO: 16903 - RNA, 22 nt, Streptococcus pneumoniae TIGR4
acagcugguuugaggccuugaa

SEQ ID NO: 16904 - RNA, 22 nt, Streptococcus pneumoniae TIGR4
acaauaacccacaaugaggcug

SEQ ID NO: 16905 - RNA, 20 nt, Streptococcus pneumoniae TIGR4
aacaacaauugacugcuauu

SEQ ID NO: 16906 - RNA, 22 nt, Streptococcus pneumoniae TIGR4
aaagauguucaguauagauuag

SEQ ID NO: 16907 - RNA, 22 nt, Streptococcus pneumoniae TIGR4
aaaaaaacuccguagucucuag

SEQ ID NO: 16908 - RNA, 22 nt, Streptococcus pneumoniae TIGR4
agcuagaacaguaucgagaacu

SEQ ID NO: 16909 - RNA, 22 nt, Streptococcus pneumoniae TIGR4
agccguccauugaaaucauuga

SEQ ID NO: 16910 - RNA, 22 nt, Streptococcus pneumoniae TIGR4
aggucacuugauagcuauauuu

SEQ ID NO: 16911 - RNA, 22 nt, Streptococcus pneumoniae TIGR4
agcugcagaguugaugcuuuua

SEQ ID NO: 16912 - RNA, 22 nt, Streptococcus pneumoniae TIGR4
agggcagcuucaccugucaaaa

SEQ ID NO: 16913 - RNA, 22 nt, Streptococcus pneumoniae TIGR4
agaagccuuuaaucuccuuuau

SEQ ID NO: 16914 - RNA, 22 nt, Streptococcus pneumoniae TIGR4
agaaucauuuggcuuuaaaggu

SEQ ID NO: 16915 - RNA, 22 nt, Streptococcus pneumoniae TIGR4
acuauauuucucaggauaagcc

SEQ ID NO: 16916 - RNA, 22 nt, Streptococcus pneumoniae TIGR4
accccccaccuuucuuaggauc

SEQ ID NO: 16917 - RNA, 22 nt, Streptococcus pneumoniae TIGR4
acuaggaagcucguuuaagguu

SEQ ID NO: 16918 - RNA, 20 nt, Streptococcus pneumoniae TIGR4
aggggcagaaugauauuucc

SEQ ID NO: 16919 - RNA, 22 nt, Streptococcus pneumoniae TIGR4
augauauugcacguuuaucagg

SEQ ID NO: 16920 - RNA, 20 nt, Streptococcus pneumoniae TIGR4
cagaagcgaccauggcucac

SEQ ID NO: 16921 - RNA, 20 nt, Streptococcus pneumoniae TIGR4
caugcggaaauuauggcuau

SEQ ID NO: 16922 - RNA, 22 nt, Streptococcus pneumoniae TIGR4
caggugaggacuuggcuuauag

SEQ ID NO: 16923 - RNA, 22 nt, Streptococcus pneumoniae TIGR4
cccuacucagcguaagauuucu

SEQ ID NO: 16924 - RNA, 22 nt, Streptococcus pneumoniae TIGR4
cauuuuacuugaaagugauuug

SEQ ID NO: 16925 - RNA, 22 nt, Streptococcus pneumoniae TIGR4
ccacacuugcuucagcuggagc

SEQ ID NO: 16926 - RNA, 22 nt, Streptococcus pneumoniae TIGR4
cuuuacaucgguuuagguuuuc

SEQ ID NO: 16927 - RNA, 22 nt, Streptococcus pneumoniae TIGR4
cgcugaggcugacgcacuggua

SEQ ID NO: 16928 - RNA, 22 nt, Homo sapiens
uggucccaugaacuuuagguca

SEQ ID NO: 16929 - RNA, 22 nt, Homo sapiens
accugguuuuaacauuguauua

SEQ ID NO: 16930 - RNA, 22 nt, Homo sapiens
aguggaguguaaagcgucuuuu

SEQ ID NO: 16931 - RNA, 22 nt, Homo sapiens
uccaugugaaaucuaugaggac

SEQ ID NO: 16932 - RNA, 22 nt, Homo sapiens
caaaggcuuccacugcauccuu

SEQ ID NO: 16933 - RNA, 22 nt, Homo sapiens
uugauauguuguuagauucagu

SEQ ID NO: 16934 - RNA, 22 nt, Homo sapiens
aaucugggguuguuuggggagu

SEQ ID NO: 16935 - RNA, 22 nt, Homo sapiens
cugagaagaaacagguaaggac

SEQ ID NO: 16936 - RNA, 22 nt, Homo sapiens
uucaggcaccauugucauugau

SEQ ID NO: 16937 - RNA, 22 nt, Homo sapiens
uuuuuuaguuagcugggcauga

SEQ ID NO: 16938 - RNA, 22 nt, Homo sapiens
augugaaugugaucggauaguc

SEQ ID NO: 16939 - RNA, 22 nt, Homo sapiens
auggaguguggaacugggaauc

SEQ ID NO: 16940 - RNA, 22 nt, Homo sapiens
uugguccccuucaaccagcugu

SEQ ID NO: 16941 - RNA, 22 nt, Homo sapiens
cacccuaucagauguccagaga

SEQ ID NO: 16942 - RNA, 22 nt, Homo sapiens
cucacggcccugcgcacuggca

SEQ ID NO: 16943 - RNA, 22 nt, Homo sapiens
uuucugggggugcugauggaaa

SEQ ID NO: 16944 - RNA, 22 nt, Homo sapiens
gucagucugucccugccuggcg

SEQ ID NO: 16945 - RNA, 21 nt, Homo sapiens
uuucugggggagcauggcagg

SEQ ID NO: 16946 - RNA, 22 nt, Homo sapiens
uuggaagagaagggagauaaac

SEQ ID NO: 16947 - RNA, 22 nt, Homo sapiens
ucauguguugcacugaggaccu

SEQ ID NO: 16948 - RNA, 22 nt, Homo sapiens
uuggaauguacucuagccuaug

SEQ ID NO: 16949 - RNA, 22 nt, Homo sapiens
ugaggcacucccuagcggggug

SEQ ID NO: 16950 - RNA, 22 nt, Homo sapiens
ugaauacugugcaaaggauuug

SEQ ID NO: 16951 - RNA, 22 nt, Homo sapiens
gaugccuuuuuguccucaguua

SEQ ID NO: 16952 - RNA, 22 nt, Homo sapiens
gcuggugacuuuaaguugaagc

SEQ ID NO: 16953 - RNA, 22 nt, Homo sapiens
ggaagguaauugucagcucaua

SEQ ID NO: 16954 - RNA, 22 nt, Homo sapiens
ugaucucagcucacugguugaa

SEQ ID NO: 16955 - RNA, 17 nt, Homo sapiens
ucccauguuucuucuac

SEQ ID NO: 16956 - RNA, 22 nt, Homo sapiens
gucauugguucuguuuauguga

SEQ ID NO: 16957 - RNA, 22 nt, Homo sapiens
uuggcaaauagguuuuauugca

SEQ ID NO: 16958 - RNA, 22 nt, Homo sapiens
ucucacagaguugaacuuucuu

SEQ ID NO: 16959 - RNA, 22 nt, Homo sapiens
caaaggcuucugaaacugcaga

SEQ ID NO: 16960 - RNA, 22 nt, Homo sapiens
guaucacacuuauugaccugca

SEQ ID NO: 16961 - RNA, 22 nt, Homo sapiens
gggaggucauuguucaaugcug

SEQ ID NO: 16962 - RNA, 22 nt, Homo sapiens
uagcagcaccccacucuacugg

SEQ ID NO: 16963 - RNA, 23 nt, Homo sapiens
ugccuagaugcugcccugggaca

SEQ ID NO: 16964 - RNA, 21 nt, Homo sapiens
cugguccccuuuauguaugug

SEQ ID NO: 16965 - RNA, 22 nt, Homo sapiens
aucugggguuggcaaaguuugg

SEQ ID NO: 16966 - RNA, 22 nt, Homo sapiens
uggauugagaagcuguggcuca

SEQ ID NO: 16967 - RNA, 22 nt, Homo sapiens
ccucauggagaacaucugcuag

SEQ ID NO: 16968 - RNA, 22 nt, Homo sapiens
aaaaguucuuugagccuugaca

SEQ ID NO: 16969 - RNA, 18 nt, Homo sapiens
gucucacaugguggaagc

SEQ ID NO: 16970 - RNA, 22 nt, Homo sapiens
cuugaucaaugugguacuugau

SEQ ID NO: 16971 - RNA, 22 nt, Homo sapiens
uuggacuucucaaggcaauaaa

SEQ ID NO: 16972 - RNA, 22 nt, Homo sapiens
ugagguuggguaauuuaugaag

SEQ ID NO: 16973 - RNA, 22 nt, Homo sapiens
uggcuugauggcacaagguuuc

SEQ ID NO: 16974 - RNA, 22 nt, Homo sapiens
gagauguuuuguuaucaaagga

SEQ ID NO: 16975 - RNA, 21 nt, Homo sapiens
uggucccauaagauuacaaug

SEQ ID NO: 16976 - RNA, 22 nt, Homo sapiens
auggucccauucauucacguau

SEQ ID NO: 16977 - RNA, 22 nt, Homo sapiens
uggaguguagaagccagccucc

SEQ ID NO: 16978 - RNA, 22 nt, Homo sapiens
gaggcuagauggggaugugucc

SEQ ID NO: 16979 - RNA, 22 nt, Homo sapiens
ugauacugugcauuagaggcua

SEQ ID NO: 16980 - RNA, 22 nt, Homo sapiens
ucucacagaguugaauguuucu

SEQ ID NO: 16981 - RNA, 22 nt, Homo sapiens
uucaggcaccauggucauugau

SEQ ID NO: 16982 - RNA, 19 nt, Homo sapiens
uggagucaucaugcugcua

SEQ ID NO: 16983 - RNA, 22 nt, Homo sapiens
acccauguaggugggauuacag

SEQ ID NO: 16984 - RNA, 22 nt, Homo sapiens
uagcaacauucagcucagguac

SEQ ID NO: 16985 - RNA, 22 nt, Homo sapiens
aaaugcucucuacacguuucug

SEQ ID NO: 16986 - RNA, 22 nt, Homo sapiens
ugguaccuuuuaaugacuaauu

SEQ ID NO: 16987 - RNA, 22 nt, Homo sapiens
gugguguuugagcugccaggga

SEQ ID NO: 16988 - RNA, 22 nt, Homo sapiens
agaaugucaguauuggcuaaaa

SEQ ID NO: 16989 - RNA, 22 nt, Homo sapiens
uuacaguucugguggagaggua

SEQ ID NO: 16990 - RNA, 22 nt, Homo sapiens
agcaccaauaaucagaguucuu

SEQ ID NO: 16991 - RNA, 22 nt, Homo sapiens
gauggaguugucgccugggcug

SEQ ID NO: 16992 - RNA, 22 nt, Homo sapiens
ugacucaguuguuagucuucau

SEQ ID NO: 16993 - RNA, 22 nt, Homo sapiens
auagcacaguguguguacacca

SEQ ID NO: 16994 - RNA, 22 nt, Homo sapiens
ugagaggugaauggcaggcuca

SEQ ID NO: 16995 - RNA, 22 nt, Homo sapiens
cccuguguuguucaaggaucug

SEQ ID NO: 16996 - RNA, 22 nt, Homo sapiens
aagcacccuuugucuggacaug

SEQ ID NO: 16997 - RNA, 22 nt, Homo sapiens
ggcagacuguggaguucuuucu

SEQ ID NO: 16998 - RNA, 22 nt, Homo sapiens
uagcaccaaacauauacucagu

SEQ ID NO: 16999 - RNA, 22 nt, Homo sapiens
uguucuugaguugggaguacaa

SEQ ID NO: 17000 - RNA, 22 nt, Homo sapiens
aggcagcuguuauauacugagu

SEQ ID NO: 17001 - RNA, 17 nt, Homo sapiens
uuuuggauuagaaaucc

SEQ ID NO: 17002 - RNA, 22 nt, Homo sapiens
agcugguauuuugucgaggacu

SEQ ID NO: 17003 - RNA, 22 nt, Homo sapiens
ugucccaguuggguauugaauu

SEQ ID NO: 17004 - RNA, 21 nt, Homo sapiens
uggucccauaagauuauaaug

SEQ ID NO: 17005 - RNA, 22 nt, Homo sapiens
uuggagugugagagcagccugg

SEQ ID NO: 17006 - RNA, 18 nt, Homo sapiens
uuucaggguggacaugag

SEQ ID NO: 17007 - RNA, 22 nt, Homo sapiens
ugagucuguucucacauugcua

SEQ ID NO: 17008 - RNA, 22 nt, Homo sapiens
cagcacauuacaaguacuuggu

SEQ ID NO: 17009 - RNA, 22 nt, Homo sapiens
cagcaucauucaucugggguaa

SEQ ID NO: 17010 - RNA, 22 nt, Homo sapiens
ucacaaguguauagacaugucc

SEQ ID NO: 17011 - RNA, 22 nt, Homo sapiens
ccccauguucucucugcagcuc

SEQ ID NO: 17012 - RNA, 22 nt, Homo sapiens
ugaaugcuucaugucugggcug

SEQ ID NO: 17013 - RNA, 22 nt, Homo sapiens
gaugcagcuaggauuugugaca

SEQ ID NO: 17014 - RNA, 22 nt, Homo sapiens
agcccauguggcugaggcuucu

SEQ ID NO: 17015 - RNA, 22 nt, Homo sapiens
gugagaagaaaaauauggcugu

SEQ ID NO: 17016 - RNA, 22 nt, Homo sapiens
uaccacccuuuuuccagaagcc

SEQ ID NO: 17017 - RNA, 17 nt, Homo sapiens
ugugauugaagucaucc

SEQ ID NO: 17018 - RNA, 22 nt, Homo sapiens
cuagcugcacuuccugcuacug

SEQ ID NO: 17019 - RNA, 23 nt, Homo sapiens
ucugcggguguggacccuagugc

SEQ ID NO: 17020 - RNA, 22 nt, Homo sapiens
ccacaguggauuaaaguuacug

SEQ ID NO: 17021 - RNA, 22 nt, Homo sapiens
uugauauguuguuggauucacu

SEQ ID NO: 17022 - RNA, 22 nt, Homo sapiens
ucccauguagcuaggauuacag

SEQ ID NO: 17023 - RNA, 22 nt, Homo sapiens
gugaucuguccuucauagccug

SEQ ID NO: 17024 - RNA, 22 nt, Homo sapiens
uagcaccuuagcauuucuagug

SEQ ID NO: 17025 - RNA, 19 nt, Homo sapiens
augagucugcaagaaccag

SEQ ID NO: 17026 - RNA, 22 nt, Homo sapiens
guccaaauccaugggauguaca

SEQ ID NO: 17027 - RNA, 22 nt, Homo sapiens
cuaggcuguagagaaguucagu

SEQ ID NO: 17028 - RNA, 22 nt, Homo sapiens
aggaagguaaacuaacuugccu

SEQ ID NO: 17029 - RNA, 22 nt, Homo sapiens
ugagguugguauuacugucucu

SEQ ID NO: 17030 - RNA, 22 nt, Homo sapiens
uggaguguaaauuaguucagcc

SEQ ID NO: 17031 - RNA, 22 nt, Homo sapiens
ucaggguacuuguggccaaagu

SEQ ID NO: 17032 - RNA, 22 nt, Homo sapiens
uacucaauugcagucaccuggc

SEQ ID NO: 17033 - RNA, 21 nt, Homo sapiens
gugucacagacaugacagaug

SEQ ID NO: 17034 - RNA, 22 nt, Homo sapiens
cauggauuuuuuugaauggcag

SEQ ID NO: 17035 - RNA, 22 nt, Homo sapiens
uagugaauguuggcuauuaaua

SEQ ID NO: 17036 - RNA, 22 nt, Homo sapiens
uggugagaaaugagaugcuuuu

SEQ ID NO: 17037 - RNA, 22 nt, Homo sapiens
ucuuuggauggaaauuggaguc

SEQ ID NO: 17038 - RNA, 22 nt, Homo sapiens
uguggaguguaugugacagaga

SEQ ID NO: 17039 - RNA, 20 nt, Homo sapiens
gauuagagagaggcugugca

SEQ ID NO: 17040 - RNA, 22 nt, Homo sapiens
guacaagugcaguuucguuaca

SEQ ID NO: 17041 - RNA, 22 nt, Homo sapiens
uggauugaaagcuuuaauauug

SEQ ID NO: 17042 - RNA, 22 nt, Homo sapiens
uagcaucagauuccauauucua

SEQ ID NO: 17043 - RNA, 22 nt, Homo sapiens
gauggaguaauguaaucuugag

SEQ ID NO: 17044 - RNA, 22 nt, Homo sapiens
uagcaccugugcacaccaggca

SEQ ID NO: 17045 - RNA, 22 nt, Homo sapiens
uuggacuggaacuauaccauug

SEQ ID NO: 17046 - RNA, 22 nt, Homo sapiens
ugauauggcuuggcuaugucac

SEQ ID NO: 17047 - RNA, 22 nt, Homo sapiens
uccaugugaaaaggucgugaua

SEQ ID NO: 17048 - RNA, 22 nt, Homo sapiens
gucauugcuuaaggguucaugc

SEQ ID NO: 17049 - RNA, 22 nt, Homo sapiens
uuggagugugcucauaacugcu

SEQ ID NO: 17050 - RNA, 22 nt, Homo sapiens
gcuggcuuucuccugaucucag

SEQ ID NO: 17051 - RNA, 22 nt, Homo sapiens
caugguguuaggcacugggaau

SEQ ID NO: 17052 - RNA, 22 nt, Homo sapiens
agcugguauuuugucaaggaua

SEQ ID NO: 17053 - RNA, 22 nt, Homo sapiens
ugguguuugagaagcugauguc

SEQ ID NO: 17054 - RNA, 22 nt, Homo sapiens
auggauguucuagggaugugau

SEQ ID NO: 17055 - RNA, 22 nt, Homo sapiens
auaugacugccagggcccaguc

SEQ ID NO: 17056 - RNA, 22 nt, Homo sapiens
agcuggcuguagcugcaagucu

SEQ ID NO: 17057 - RNA, 22 nt, Homo sapiens
aggucccauguccucccugacc

SEQ ID NO: 17058 - RNA, 22 nt, Homo sapiens
aagaccuaugcaggaagaaaug

SEQ ID NO: 17059 - RNA, 22 nt, Homo sapiens
cuggcugagugguaaguagagg

SEQ ID NO: 17060 - RNA, 22 nt, Homo sapiens
uuucaguguggcaggcauagcu

SEQ ID NO: 17061 - RNA, 22 nt, Homo sapiens
uagcugagacuacaguaggugc

SEQ ID NO: 17062 - RNA, 22 nt, Homo sapiens
agugaaaucugaagaaggucau

SEQ ID NO: 17063 - RNA, 22 nt, Homo sapiens
auagcagcuugucagggcagac

SEQ ID NO: 17064 - RNA, 22 nt, Homo sapiens
agcaccauuagcguugggccgg

SEQ ID NO: 17065 - RNA, 22 nt, Homo sapiens
agcaccaauaacaguuucuagc

SEQ ID NO: 17066 - RNA, 21 nt, Homo sapiens
ugaaccccugcucucaagaaa

SEQ ID NO: 17067 - RNA, 22 nt, Homo sapiens
ucuuugauuuuguuacuaagac

SEQ ID NO: 17068 - RNA, 22 nt, Homo sapiens
uuuaucuguuuaaaacuguuca

SEQ ID NO: 17069 - RNA, 22 nt, Homo sapiens
agggcuuguuuaacuaucauua

SEQ ID NO: 17070 - RNA, 22 nt, Homo sapiens
uggacugagauuucagcugcca

SEQ ID NO: 17071 - RNA, 22 nt, Streptococcus pyogenes M1 GAS
ugagagagcuuguugagcugga

SEQ ID NO: 17072 - RNA, 22 nt, Streptococcus pyogenes M1 GAS
ucugggaaagguuuucagggcu

SEQ ID NO: 17073 - RNA, 22 nt, Streptococcus pyogenes M1 GAS
ccuagucugucauuauggguuu

SEQ ID NO: 17074 - RNA, 22 nt, Streptococcus pyogenes M1 GAS
agcuggguaggcuggcgucaga

SEQ ID NO: 17075 - RNA, 22 nt, Streptococcus pyogenes M1 GAS
aaaaugguccagcagauuuggu

SEQ ID NO: 17076 - RNA, 22 nt, Streptococcus pyogenes M1 GAS
aagugucaacuaaaacagcuua

SEQ ID NO: 17077 - RNA, 22 nt, Streptococcus pyogenes M1 GAS
gccugugugauuuugcaagcua

SEQ ID NO: 17078 - RNA, 22 nt, Streptococcus pyogenes M1 GAS
gcaacaaacaguagucgguuag

SEQ ID NO: 17079 - RNA, 22 nt, Streptococcus pyogenes M1 GAS
gagcugggcuagcugguucuga

SEQ ID NO: 17080 - RNA, 22 nt, Streptococcus pyogenes M1 GAS
cucaggcaucuuacauuuugcc

SEQ ID NO: 17081 - RNA, 22 nt, Streptococcus pyogenes M1 GAS
ucucagaagcuauggagcgugu

SEQ ID NO: 17082 - RNA, 21 nt, Streptococcus pyogenes M1 GAS
uggcagaaaccuucucggcuc

SEQ ID NO: 17083 - RNA, 21 nt, Streptococcus pyogenes M1 GAS
ugagacagaucuggcuugacu

SEQ ID NO: 17084 - RNA, 22 nt, Streptococcus pyogenes M1 GAS
uuugauugguaugaucuagcau

SEQ ID NO: 17085 - RNA, 21 nt, Streptococcus pyogenes M1 GAS
uugauugaugaugcaaguaca

SEQ ID NO: 17086 - RNA, 22 nt, Streptococcus pyogenes M1 GAS
uuggagugauugcacugcuguu

SEQ ID NO: 17087 - RNA, 22 nt, Streptococcus pyogenes M1 GAS
uugggaagggauuugcuagccu

SEQ ID NO: 17088 - RNA, 22 nt, Streptococcus pyogenes M1 GAS
gcuaucuuuuggaaagccugcc

SEQ ID NO: 17089 - RNA, 22 nt, Streptococcus pyogenes M1 GAS
gcugaauuagguggcugggagg

SEQ ID NO: 17090 - RNA, 22 nt, Homo sapiens
uaucaguauggauucauggauu

SEQ ID NO: 17091 - RNA, 22 nt, Homo sapiens
gugguuuuuuucugccuuauag

SEQ ID NO: 17092 - RNA, 22 nt, Homo sapiens
uauggauuugccuauucuguau

SEQ ID NO: 17093 - RNA, 22 nt, Homo sapiens
auggaauguauagucauguagg

SEQ ID NO: 17094 - RNA, 22 nt, Homo sapiens
uuggaaauguguuugcauucag

SEQ ID NO: 17095 - RNA, 22 nt, Homo sapiens
gugguuuuuaaaguaccugugg

SEQ ID NO: 17096 - RNA, 22 nt, Homo sapiens
ccagucuuggugucuguagcac

SEQ ID NO: 17097 - RNA, 22 nt, Homo sapiens
agugacaugggaucaaaucuga

SEQ ID NO: 17098 - RNA, 22 nt, Homo sapiens
uuucccauuguucugcucugug

SEQ ID NO: 17099 - RNA, 22 nt, Homo sapiens
ugcagugucaauaauaauuagu

SEQ ID NO: 17100 - RNA, 19 nt, Homo sapiens
uuugaauauaaugcagcua

SEQ ID NO: 17101 - RNA, 22 nt, Homo sapiens
gagacugagucucacucuguca

SEQ ID NO: 17102 - RNA, 22 nt, Homo sapiens
cuuuggcaaugucauuuucaau

SEQ ID NO: 17103 - RNA, 22 nt, Homo sapiens
gaaucaauugaucuaugugucu

SEQ ID NO: 17104 - RNA, 22 nt, Homo sapiens
uauagcuaugggauguauuugc

SEQ ID NO: 17105 - RNA, 22 nt, Homo sapiens
aucuucucuugaagggugggga

SEQ ID NO: 17106 - RNA, 22 nt, Homo sapiens
ucucugagaaaaguuucuccca

SEQ ID NO: 17107 - RNA, 22 nt, Homo sapiens
ugcuguuguuugaugaaguaau

SEQ ID NO: 17108 - RNA, 22 nt, Homo sapiens
uugguucucuuagccaucuuaa

SEQ ID NO: 17109 - RNA, 22 nt, Homo sapiens
agugauuuuaacuuccagcaau

SEQ ID NO: 17110 - RNA, 22 nt, Homo sapiens
aaaucccuugcucucucagacc

SEQ ID NO: 17111 - RNA, 22 nt, Homo sapiens
ugugccacugcacuccugccug

SEQ ID NO: 17112 - RNA, 22 nt, Homo sapiens
aaacugcuuuccaugguggcug

SEQ ID NO: 17113 - RNA, 22 nt, Homo sapiens
gauguguuuuaggaucucagca

SEQ ID NO: 17114 - RNA, 18 nt, Homo sapiens
acauucagcuugaagaua

SEQ ID NO: 17115 - RNA, 22 nt, Homo sapiens
ucacaguccuguuuaggagagg

SEQ ID NO: 17116 - RNA, 16 nt, Homo sapiens
uuucccuuugguguuu

SEQ ID NO: 17117 - RNA, 22 nt, Homo sapiens
gucauguuuaacuucuugagga

SEQ ID NO: 17118 - RNA, 22 nt, Homo sapiens
ugauggcaauggcauucauuuu

SEQ ID NO: 17119 - RNA, 22 nt, Homo sapiens
uuucuacagggcuugccaggua

SEQ ID NO: 17120 - RNA, 21 nt, Homo sapiens
aauacucuagguuaagagagc

SEQ ID NO: 17121 - RNA, 22 nt, Homo sapiens
auguagugugauuuucacuaga

SEQ ID NO: 17122 - RNA, 22 nt, Homo sapiens
gugguuuucaacuccaccugca

SEQ ID NO: 17123 - RNA, 22 nt, Homo sapiens
cuggcagucugccucuucacug

SEQ ID NO: 17124 - RNA, 22 nt, Homo sapiens
ugaaacacacauugcccuuuau

SEQ ID NO: 17125 - RNA, 22 nt, Homo sapiens
cuccauuuaucugaaauuuuau

SEQ ID NO: 17126 - RNA, 22 nt, Homo sapiens
augaguauguucuguauuuuca

SEQ ID NO: 17127 - RNA, 22 nt, Homo sapiens
caggaaugugaggguucccugc

SEQ ID NO: 17128 - RNA, 22 nt, Homo sapiens
agaugcauugguggcauauuca

SEQ ID NO: 17129 - RNA, 22 nt, Homo sapiens
uggagugagaacuucaaugaug

SEQ ID NO: 17130 - RNA, 22 nt, Homo sapiens
agugcaauggugccaucauagc

SEQ ID NO: 17131 - RNA, 22 nt, Homo sapiens
uucuacaggcuguucaagaagc

SEQ ID NO: 17132 - RNA, 18 nt, Homo sapiens
augaagucaucacuuuua

SEQ ID NO: 17133 - RNA, 22 nt, Homo sapiens
agaacuguccauucagcaugaa

SEQ ID NO: 17134 - RNA, 22 nt, Homo sapiens
uucaagcuauggugaucuuuuc

SEQ ID NO: 17135 - RNA, 22 nt, Homo sapiens
cuggaauguuccuaaagauuca

SEQ ID NO: 17136 - RNA, 22 nt, Homo sapiens
agcuguuguuuuaagauacuaa

SEQ ID NO: 17137 - RNA, 22 nt, Homo sapiens
ugagaacugguagcacuuguga

SEQ ID NO: 17138 - RNA, 22 nt, Homo sapiens
auccugaagcuuuacugaauuc

SEQ ID NO: 17139 - RNA, 22 nt, Homo sapiens
ugcuaugucagccaggcugguc

SEQ ID NO: 17140 - RNA, 22 nt, Homo sapiens
cuacagcacugagcugugugca

SEQ ID NO: 17141 - RNA, 22 nt, Homo sapiens
augagauacuacaaaugaguuu

SEQ ID NO: 17142 - RNA, 22 nt, Homo sapiens
uaccacugccgagaaaacagau

SEQ ID NO: 17143 - RNA, 22 nt, Homo sapiens
agcuugugauuuagagugagag

SEQ ID NO: 17144 - RNA, 22 nt, Homo sapiens
uuucacagcaauugccuauugu

SEQ ID NO: 17145 - RNA, 22 nt, Homo sapiens
ugaaagguuuaauucugugaga

SEQ ID NO: 17146 - RNA, 22 nt, Homo sapiens
aucucaguuaauuccaucuuuc

SEQ ID NO: 17147 - RNA, 18 nt, Homo sapiens
uccauuuguaugggaugg

SEQ ID NO: 17148 - RNA, 22 nt, Homo sapiens
uauuagugccuaagucuuaggg

SEQ ID NO: 17149 - RNA, 22 nt, Homo sapiens
guguucaaacccaggucugucu

SEQ ID NO: 17150 - RNA, 22 nt, Homo sapiens
gcaaugcugucugugcacagau

SEQ ID NO: 17151 - RNA, 21 nt, Homo sapiens
uuacaauggcuccuugaaggu

SEQ ID NO: 17152 - RNA, 20 nt, Homo sapiens
gcaaauggaucccacaagcc

SEQ ID NO: 17153 - RNA, 22 nt, Homo sapiens
gaauaaacuagagaggacugag

SEQ ID NO: 17154 - RNA, 22 nt, Homo sapiens
cugugcuugauuauaugagugu

SEQ ID NO: 17155 - RNA, 22 nt, Homo sapiens
uggaauaucaugagaguuuguu

SEQ ID NO: 17156 - RNA, 19 nt, Homo sapiens
ugcagcaauguaaaagaca

SEQ ID NO: 17157 - RNA, 22 nt, Homo sapiens
uacaagcaggaaaugguauaug

SEQ ID NO: 17158 - RNA, 22 nt, Homo sapiens
auggauguucuagggaugugau

SEQ ID NO: 17159 - RNA, 22 nt, Homo sapiens
uugaguuuaucuaaagaccugg

SEQ ID NO: 17160 - RNA, 22 nt, Homo sapiens
gcugauguugaccuugaucacc

SEQ ID NO: 17161 - RNA, 21 nt, Homo sapiens
auauggaacuggugacguguu

SEQ ID NO: 17162 - RNA, 22 nt, Homo sapiens
augguauggaaggucuggagga

SEQ ID NO: 17163 - RNA, 22 nt, Homo sapiens
cagugcuuguuauuguucuauu

SEQ ID NO: 17164 - RNA, 22 nt, Homo sapiens
uuucuacagugaacgauuucua

SEQ ID NO: 17165 - RNA, 22 nt, Homo sapiens
aacugcuguuuggguacuggug

SEQ ID NO: 17166 - RNA, 22 nt, Homo sapiens
aaucccuuuguccagucucuuu

SEQ ID NO: 17167 - RNA, 21 nt, Homo sapiens
auagcacuucacuugguuaga

SEQ ID NO: 17168 - RNA, 22 nt, Homo sapiens
auagcacaugugcaaauggcug

SEQ ID NO: 17169 - RNA, 22 nt, Homo sapiens
uuaagaugcauuuugaaguuaa

SEQ ID NO: 17170 - RNA, 22 nt, Homo sapiens
auggaauguaaguuauguuugc

SEQ ID NO: 17171 - RNA, 22 nt, Homo sapiens
augcagagaaaucuaaaauaug

SEQ ID NO: 17172 - RNA, 22 nt, Homo sapiens
uggacuguaauagagaacagaa

SEQ ID NO: 17173 - RNA, 22 nt, Homo sapiens
ugugguuuuuuucuccaauagg

SEQ ID NO: 17174 - RNA, 22 nt, Homo sapiens
gcugugauucuguguagauagu

SEQ ID NO: 17175 - RNA, 22 nt, Homo sapiens
uuucccuuuagcuuagugauuu

SEQ ID NO: 17176 - RNA, 22 nt, Homo sapiens
uaccagcauuucucuuuaagua

SEQ ID NO: 17177 - RNA, 22 nt, Homo sapiens
ucuuuggaggcgaucuguuuga

SEQ ID NO: 17178 - RNA, 22 nt, Homo sapiens
agacaguguguguauauauggu

SEQ ID NO: 17179 - RNA, 22 nt, Homo sapiens
agugguuuuggaauggaauuca

SEQ ID NO: 17180 - RNA, 22 nt, Homo sapiens
acagugcuuucaauguucagua

SEQ ID NO: 17181 - RNA, 22 nt, Homo sapiens
guauggaagucaguuuguuggc

SEQ ID NO: 17182 - RNA, 18 nt, Homo sapiens
cuuugcagcuuccagagg

SEQ ID NO: 17183 - RNA, 22 nt, Homo sapiens
cagugcaugacuguauauuauc

SEQ ID NO: 17184 - RNA, 22 nt, Homo sapiens
cuguucaaauuguuugugaagu

SEQ ID NO: 17185 - RNA, 22 nt, Homo sapiens
augaaaacaugauuugccuguu

SEQ ID NO: 17186 - RNA, 22 nt, Homo sapiens
ugcuguguugcuggcuuaaaga

SEQ ID NO: 17187 - RNA, 22 nt, Homo sapiens
ugagauaaggaaauugaggcuc

SEQ ID NO: 17188 - RNA, 22 nt, Homo sapiens
ggcaguuuguuugugaggucca

SEQ ID NO: 17189 - RNA, 22 nt, Homo sapiens
ugguguuugagaagcugauguc

SEQ ID NO: 17190 - RNA, 22 nt, Homo sapiens
cagagaucaugcaacugcucgc

SEQ ID NO: 17191 - RNA, 22 nt, Homo sapiens
cuuuacaguuggacucacgagg

SEQ ID NO: 17192 - RNA, 22 nt, Homo sapiens
caugcacugaguccaccucugg

SEQ ID NO: 17193 - RNA, 22 nt, Homo sapiens
gagacugagucuugcucugucg

SEQ ID NO: 17194 - RNA, 22 nt, Homo sapiens
cuuuguaugucaugacaacugu

SEQ ID NO: 17195 - RNA, 22 nt, Homo sapiens
auaucccagugaugauugauag

SEQ ID NO: 17196 - RNA, 17 nt, Homo sapiens
ugacagaaacuuguugu

SEQ ID NO: 17197 - RNA, 22 nt, Homo sapiens
uugagauguaagauguuaauau

SEQ ID NO: 17198 - RNA, 22 nt, Homo sapiens
agaauguauauucuguaguugu

SEQ ID NO: 17199 - RNA, 22 nt, Homo sapiens
guaacacucuaaagggaugcac

SEQ ID NO: 17200 - RNA, 22 nt, Homo sapiens
cuuugauuauaaaaggguguuu

SEQ ID NO: 17201 - RNA, 22 nt, Homo sapiens
uuuggucacugccgccgccagc

SEQ ID NO: 17202 - RNA, 22 nt, Homo sapiens
uauuccauuugugaaaggaagu

SEQ ID NO: 17203 - RNA, 22 nt, Homo sapiens
gcugcuguuucucuuucagcau

SEQ ID NO: 17204 - RNA, 22 nt, Homo sapiens
uucccuuucugccuugaaucuu

SEQ ID NO: 17205 - RNA, 22 nt, Homo sapiens
uuugaauggaaguuuugugaaa

SEQ ID NO: 17206 - RNA, 22 nt, Homo sapiens
uguagcuuuugagauuuauauu

SEQ ID NO: 17207 - RNA, 19 nt, Homo sapiens
uuuguauguuuccaguaau

SEQ ID NO: 17208 - RNA, 22 nt, Homo sapiens
augaagucguuacuaccaauug

SEQ ID NO: 17209 - RNA, 22 nt, Homo sapiens
agugcauuugcaucucaauaua

SEQ ID NO: 17210 - RNA, 22 nt, Homo sapiens
gugugauuauuucaauugaugc

SEQ ID NO: 17211 - RNA, 22 nt, Homo sapiens
ugcucaguuuaaaacuuuugag

SEQ ID NO: 17212 - RNA, 22 nt, Homo sapiens
ugcuuguguucagguaaccuuu

SEQ ID NO: 17213 - RNA, 22 nt, Homo sapiens
acacuguagcugagggcaugcg

SEQ ID NO: 17214 - RNA, 22 nt, Homo sapiens
aacacuguuuccagucaugauc

SEQ ID NO: 17215 - RNA, 21 nt, Homo sapiens
ugcuuuggucauacuucuucc

SEQ ID NO: 17216 - RNA, 19 nt, Homo sapiens
ccugcuguucuuuugcacc

SEQ ID NO: 17217 - RNA, 22 nt, Homo sapiens
augacugaguagcauuccauua

SEQ ID NO: 17218 - RNA, 22 nt, Homo sapiens
uugauauguaguuggacuugau

SEQ ID NO: 17219 - RNA, 22 nt, Homo sapiens
uaucagcagagucauacuucaa

SEQ ID NO: 17220 - RNA, 22 nt, Homo sapiens
aguguuuuuacaagcacucugg

SEQ ID NO: 17221 - RNA, 23 nt, Homo sapiens
ggaaugaaaccugguuaugauau

SEQ ID NO: 17222 - RNA, 22 nt, Homo sapiens
uggauaguaauaaacauauagg

SEQ ID NO: 17223 - RNA, 20 nt, Homo sapiens
guccauuugcugccauugcu

SEQ ID NO: 17224 - RNA, 18 nt, Homo sapiens
ccauucaacagauuuguc

SEQ ID NO: 17225 - RNA, 22 nt, Homo sapiens
aucuugcauuugcuaaaaugca

SEQ ID NO: 17226 - RNA, 22 nt, Homo sapiens
uuaacacugccauugauacugu

SEQ ID NO: 17227 - RNA, 22 nt, Homo sapiens
aaguauguaucaagucauacuu

SEQ ID NO: 17228 - RNA, 22 nt, Homo sapiens
ugagaugaagcuagaagaaugg

SEQ ID NO: 17229 - RNA, 22 nt, Homo sapiens
uucaauaugucauuggcaggca

SEQ ID NO: 17230 - RNA, 22 nt, Homo sapiens
uagcacaucuucuuggccugca

SEQ ID NO: 17231 - RNA, 22 nt, Homo sapiens
ugaugacacugauuucuucaau

SEQ ID NO: 17232 - RNA, 22 nt, Homo sapiens
agguauguauguaugggagaaa

SEQ ID NO: 17233 - RNA, 22 nt, Homo sapiens
gaauggaacugacuauagcuga

SEQ ID NO: 17234 - RNA, 22 nt, Homo sapiens
gagagcauuaagccaucaucau

SEQ ID NO: 17235 - RNA, 22 nt, Homo sapiens
uggucaguugaguccuugccaa

SEQ ID NO: 17236 - RNA, 22 nt, Homo sapiens
cuuaacagugguauugaugacc

SEQ ID NO: 17237 - RNA, 19 nt, Homo sapiens
ugugaacaucacagagugu

SEQ ID NO: 17238 - RNA, 19 nt, Homo sapiens
gaucuguugaucaaugugu

SEQ ID NO: 17239 - RNA, 22 nt, Homo sapiens
uugcuuuguuacugcaguuucc

SEQ ID NO: 17240 - RNA, 22 nt, Homo sapiens
uaaauggauaaaugaauaccua

SEQ ID NO: 17241 - RNA, 22 nt, Homo sapiens
uccauugucuagauguaacaca

SEQ ID NO: 17242 - RNA, 22 nt, Homo sapiens
gagacugagucuugcuuuguca

SEQ ID NO: 17243 - RNA, 22 nt, Homo sapiens
ugacuaggaaauuagaacuuuu

SEQ ID NO: 17244 - RNA, 23 nt, Homo sapiens
gagaucauucuggaauuagagug

SEQ ID NO: 17245 - RNA, 22 nt, Homo sapiens
uggaaguauagauaauugaaag

SEQ ID NO: 17246 - RNA, 22 nt, Homo sapiens
guacacauacauauaugugugu

SEQ ID NO: 17247 - RNA, 22 nt, Homo sapiens
uuggucaggcuaaucucgaacg

SEQ ID NO: 17248 - RNA, 22 nt, Homo sapiens
uggaaaucuaaguuuggauuga

SEQ ID NO: 17249 - RNA, 22 nt, Homo sapiens
cugugcaaagcgcucucggggu

SEQ ID NO: 17250 - RNA, 19 nt, Homo sapiens
uggaacugauucaguucug

SEQ ID NO: 17251 - RNA, 22 nt, Homo sapiens
uaauauguuuugaaaucaggaa

SEQ ID NO: 17252 - RNA, 22 nt, Homo sapiens
auagcacaguguguguacacca

SEQ ID NO: 17253 - RNA, 22 nt, Homo sapiens
uagaaugucagcuucuugaggg

SEQ ID NO: 17254 - RNA, 22 nt, Homo sapiens
aaccuguaaccauaugaucagu

SEQ ID NO: 17255 - RNA, 22 nt, Homo sapiens
aagaugauguucuuuuucuuag

SEQ ID NO: 17256 - RNA, 22 nt, Homo sapiens
aucuacagccagucugguuugu

SEQ ID NO: 17257 - RNA, 22 nt, Homo sapiens
guacaguuuucaguguucacug

SEQ ID NO: 17258 - RNA, 22 nt, Homo sapiens
augagaugcaagauuagauggg

SEQ ID NO: 17259 - RNA, 22 nt, Homo sapiens
ugguccuuuccauuggagacac

SEQ ID NO: 17260 - RNA, 22 nt, Homo sapiens
acaaaguauggaauguuggugu

SEQ ID NO: 17261 - RNA, 22 nt, Homo sapiens
uuauacuacuauaaagagguag

SEQ ID NO: 17262 - RNA, 22 nt, Homo sapiens
uauuugauugacuuuagcagga

SEQ ID NO: 17263 - RNA, 20 nt, Homo sapiens
auguaauguaugauauguac

SEQ ID NO: 17264 - RNA, 22 nt, Homo sapiens
gagaucauguacuagaacaccu

SEQ ID NO: 17265 - RNA, 22 nt, Homo sapiens
uaucccaauguaauaucacaaa

SEQ ID NO: 17266 - RNA, 22 nt, Homo sapiens
uaucucauccuccuugauccca

SEQ ID NO: 17267 - RNA, 22 nt, Homo sapiens
cuucuugagacuuaggcuuugg

SEQ ID NO: 17268 - RNA, 22 nt, Homo sapiens
ugagaugaguugcgcucugucg

SEQ ID NO: 17269 - RNA, 22 nt, Homo sapiens
guauuuguugcagcagcacuau

SEQ ID NO: 17270 - RNA, 22 nt, Homo sapiens
gauguguuuccaggauuuguuu

SEQ ID NO: 17271 - RNA, 22 nt, Homo sapiens
augaggauagguuucuauuagg

SEQ ID NO: 17272 - RNA, 18 nt, Homo sapiens
aaacugcuuccuuggccu

SEQ ID NO: 17273 - RNA, 20 nt, Homo sapiens
uggagugaagguucuggacc

SEQ ID NO: 17274 - RNA, 22 nt, Homo sapiens
cuguuugaggguuugcuuucag

SEQ ID NO: 17275 - RNA, 22 nt, Homo sapiens
aguguuuuuaacaagaaagggu

SEQ ID NO: 17276 - RNA, 22 nt, Homo sapiens
uucauacaguggcugcacucca

SEQ ID NO: 17277 - RNA, 22 nt, Homo sapiens
uaucucuguggguagugcugaa

SEQ ID NO: 17278 - RNA, 23 nt, Homo sapiens
uugcauagacauccucauagauu

SEQ ID NO: 17279 - RNA, 22 nt, Homo sapiens
uaaauggauauugccaucuccu

SEQ ID NO: 17280 - RNA, 22 nt, Homo sapiens
uugaguuugaguauucuaaagc

SEQ ID NO: 17281 - RNA, 22 nt, Homo sapiens
guggcaguuuuaaauaugaaaa

SEQ ID NO: 17282 - RNA, 22 nt, Homo sapiens
auuccauuuguguggaauggcu

SEQ ID NO: 17283 - RNA, 22 nt, Homo sapiens
agugcauugcaucucugcuuca

SEQ ID NO: 17284 - RNA, 22 nt, Homo sapiens
ugcaguuuaggaacugguaaca

SEQ ID NO: 17285 - RNA, 22 nt, Homo sapiens
acaguguagugacugccaacuu

SEQ ID NO: 17286 - RNA, 22 nt, Homo sapiens
aucagugcauguuuguugagcu

SEQ ID NO: 17287 - RNA, 22 nt, Homo sapiens
ugagaugaacuugauuguuuua

SEQ ID NO: 17288 - RNA, 22 nt, Homo sapiens
uagacaacugaaacacugugca

SEQ ID NO: 17289 - RNA, 22 nt, Homo sapiens
gauuccauugcgaauuuucaga

SEQ ID NO: 17290 - RNA, 22 nt, Homo sapiens
uauacagcaaguuacugugcug

SEQ ID NO: 17291 - RNA, 22 nt, Homo sapiens
cugagacacucuuaucugcaua

SEQ ID NO: 17292 - RNA, 22 nt, Homo sapiens
caacaguaaagcauuuuuaagu

SEQ ID NO: 17293 - RNA, 22 nt, Homo sapiens
guguucaaagcugauugagauu

SEQ ID NO: 17294 - RNA, 20 nt, Homo sapiens
ugaugcaaaucuuuaaaagu

SEQ ID NO: 17295 - RNA, 22 nt, Homo sapiens
agcugugucuucuuaaagauuu

SEQ ID NO: 17296 - RNA, 22 nt, Homo sapiens
gagcugaucuuuucugauucca

SEQ ID NO: 17297 - RNA, 21 nt, Homo sapiens
aacagugcuuaguagauguuc

SEQ ID NO: 17298 - RNA, 18 nt, Homo sapiens
cugccagugugcucuccg

SEQ ID NO: 17299 - RNA, 22 nt, Homo sapiens
gagacugaguuuugcucuuguu

SEQ ID NO: 17300 - RNA, 22 nt, Homo sapiens
uugugaauggugccacaauaaa

SEQ ID NO: 17301 - RNA, 22 nt, Homo sapiens
acagugcuuggcacacaguaau

SEQ ID NO: 17302 - RNA, 22 nt, Homo sapiens
uagaauggaaggcauguuugcc

SEQ ID NO: 17303 - RNA, 22 nt, Homo sapiens
auggaacuggagaugguuauau

SEQ ID NO: 17304 - RNA, 22 nt, Homo sapiens
ugagaugagucucgcucuguca

SEQ ID NO: 17305 - RNA, 22 nt, Homo sapiens
guuggaauguauugcuacuucu

SEQ ID NO: 17306 - RNA, 22 nt, Homo sapiens
uaagacacuuaaaauguuacau

SEQ ID NO: 17307 - RNA, 22 nt, Homo sapiens
gagcaucaguggccucaucuca

SEQ ID NO: 17308 - RNA, 22 nt, Homo sapiens
uuucccugaaggcucugaaguc

SEQ ID NO: 17309 - RNA, 22 nt, Homo sapiens
aguauguagugcaaucagucag

SEQ ID NO: 17310 - RNA, 22 nt, Homo sapiens
guggaaugaaaacucucucaca

SEQ ID NO: 17311 - RNA, 22 nt, Homo sapiens
uggagagucauuuauaguauuu

SEQ ID NO: 17312 - RNA, 22 nt, Homo sapiens
ugagaugagaaucaguucuaau

SEQ ID NO: 17313 - RNA, 22 nt, Homo sapiens
acuguauagauggaguugauuu

SEQ ID NO: 17314 - RNA, 16 nt, Homo sapiens
gugcuguguuguuagg

SEQ ID NO: 17315 - RNA, 22 nt, Homo sapiens
cuucaaaguuggcuaggagaca

SEQ ID NO: 17316 - RNA, 22 nt, Homo sapiens
uugacauaaucauuucacagug

SEQ ID NO: 17317 - RNA, 22 nt, Homo sapiens
acauucagcuguuguuucaaug

SEQ ID NO: 17318 - RNA, 22 nt, Homo sapiens
uggauggagaggcuugugaugc

SEQ ID NO: 17319 - RNA, 22 nt, Homo sapiens
aguguuuuuaucaugaaagggu

SEQ ID NO: 17320 - RNA, 21 nt, Homo sapiens
uucucagaggcaggggauaaa

SEQ ID NO: 17321 - RNA, 22 nt, Homo sapiens
uuucugagaccaaaacuuguaa

SEQ ID NO: 17322 - RNA, 22 nt, Homo sapiens
gggaauguagcaaaucugcaau

SEQ ID NO: 17323 - RNA, 22 nt, Homo sapiens
aaguuaauguuuaagacuccua

SEQ ID NO: 17324 - RNA, 22 nt, Homo sapiens
cuauaacagugugguuuggaga

SEQ ID NO: 17325 - RNA, 22 nt, Homo sapiens
uugagauguauguauauaaugu

SEQ ID NO: 17326 - RNA, 22 nt, Homo sapiens
uugagauuuuccucaaauauuu

SEQ ID NO: 17327 - RNA, 22 nt, Homo sapiens
ugaacagucaucucucuuguau

SEQ ID NO: 17328 - RNA, 23 nt, Homo sapiens
agcaccuuuccuccacuaucugc

SEQ ID NO: 17329 - RNA, 20 nt, Homo sapiens
uggaaaguaagucaugauau

SEQ ID NO: 17330 - RNA, 22 nt, Homo sapiens
uuaaguaaucagagaagagaac

SEQ ID NO: 17331 - RNA, 22 nt, Homo sapiens
guggaauggaaugauuguguau

SEQ ID NO: 17332 - RNA, 22 nt, Homo sapiens
gaaauggaucagagcaagcuuu

SEQ ID NO: 17333 - RNA, 21 nt, Homo sapiens
ugaacacuggacugagugucc

SEQ ID NO: 17334 - RNA, 22 nt, Homo sapiens
agcuuguggugaauacugcuag

SEQ ID NO: 17335 - RNA, 22 nt, Homo sapiens
ugugguuuuaguaaaacuaugu

SEQ ID NO: 17336 - RNA, 21 nt, Homo sapiens
uaaaacuguaacuuuguccug

SEQ ID NO: 17337 - RNA, 22 nt, Homo sapiens
ucuugccacuucauccccuuuc

SEQ ID NO: 17338 - RNA, 22 nt, Homo sapiens
acuggauguuagggauuuuauu

SEQ ID NO: 17339 - RNA, 22 nt, Homo sapiens
auaaguauuuggacuuuacugu

SEQ ID NO: 17340 - RNA, 22 nt, Homo sapiens
uaaguauuaugugcugcauuuu

SEQ ID NO: 17341 - RNA, 22 nt, Homo sapiens
cugaaagagcauguaacacagu

SEQ ID NO: 17342 - RNA, 22 nt, Homo sapiens
uugugaaugaugucgcaauaaa

SEQ ID NO: 17343 - RNA, 22 nt, Homo sapiens
auacaagcaguccaacuccaua

SEQ ID NO: 17344 - RNA, 22 nt, Homo sapiens
gagacugagucuugcucuguca

SEQ ID NO: 17345 - RNA, 22 nt, Homo sapiens
guguucaaauucugacagagag

SEQ ID NO: 17346 - RNA, 22 nt, Homo sapiens
uugagauggaguuucaauauug

SEQ ID NO: 17347 - RNA, 19 nt, Homo sapiens
uuuguccugcccuuucuca

SEQ ID NO: 17348 - RNA, 22 nt, Homo sapiens
gaaaacugcuucucuggguuuc

SEQ ID NO: 17349 - RNA, 20 nt, Homo sapiens
gucugucuccgaguagaauu

SEQ ID NO: 17350 - RNA, 22 nt, Homo sapiens
auggaguguaauauugagagcu

SEQ ID NO: 17351 - RNA, 22 nt, Homo sapiens
gaucuguuuuccuauuguuugu

SEQ ID NO: 17352 - RNA, 20 nt, Homo sapiens
gcugugcuuaauacacuuuc

SEQ ID NO: 17353 - RNA, 22 nt, Homo sapiens
uugagaugauggauaugcuaau

SEQ ID NO: 17354 - RNA, 20 nt, Homo sapiens
uucuacagucacaggaagau

SEQ ID NO: 17355 - RNA, 22 nt, Homo sapiens
auggauugucuccuugugccau

SEQ ID NO: 17356 - RNA, 22 nt, Homo sapiens
uaaguucauucaugaaacuuag

SEQ ID NO: 17357 - RNA, 22 nt, Homo sapiens
aauaaagucugaagugugcuua

SEQ ID NO: 17358 - RNA, 22 nt, Homo sapiens
aguucaaaucgagccuggccau

SEQ ID NO: 17359 - RNA, 22 nt, Homo sapiens
ugugaacagaauuagucaccua

SEQ ID NO: 17360 - RNA, 22 nt, Homo sapiens
agguaagaugugacuugguguu

SEQ ID NO: 17361 - RNA, 22 nt, Homo sapiens
cauaaagauggaggaggccagg

SEQ ID NO: 17362 - RNA, 22 nt, Homo sapiens
cuuguuguggaggggagugcag

SEQ ID NO: 17363 - RNA, 22 nt, Homo sapiens
uucaagucaacaagcacuugag

SEQ ID NO: 17364 - RNA, 22 nt, Homo sapiens
uggcagugggagauauuuuauu

SEQ ID NO: 17365 - RNA, 21 nt, Homo sapiens
ugacagaaaauugaguuugcu

SEQ ID NO: 17366 - RNA, 22 nt, Homo sapiens
gagauugucaugauuacauugu

SEQ ID NO: 17367 - RNA, 22 nt, Homo sapiens
acaucccuuucccacccuucac

SEQ ID NO: 17368 - RNA, 22 nt, Homo sapiens
uugugaaugaugccgcaauaaa

SEQ ID NO: 17369 - RNA, 22 nt, Homo sapiens
aucccuuucugauacuuucccu

SEQ ID NO: 17370 - RNA, 22 nt, Homo sapiens
auguaacugggacacaagccuc

SEQ ID NO: 17371 - RNA, 22 nt, Homo sapiens
uggaaguaaccaugaauggaau

SEQ ID NO: 17372 - RNA, 22 nt, Homo sapiens
ucaaaugguccacgugaacauu

SEQ ID NO: 17373 - RNA, 22 nt, Homo sapiens
acaauguauauuuuacuguagg

SEQ ID NO: 17374 - RNA, 22 nt, Homo sapiens
cuuguggugcuuuuacgugggc

SEQ ID NO: 17375 - RNA, 22 nt, Homo sapiens
ugccuaguagaaggugaacaug

SEQ ID NO: 17376 - RNA, 22 nt, Homo sapiens
uuacagcagugccccacuccca

SEQ ID NO: 17377 - RNA, 22 nt, Homo sapiens
cauacaagcuacaaucacaaag

SEQ ID NO: 17378 - RNA, 22 nt, Homo sapiens
cugggaugugacuguugccccc

SEQ ID NO: 17379 - RNA, 22 nt, Homo sapiens
cagugcauaggaucuaaaauuu

SEQ ID NO: 17380 - RNA, 22 nt, Homo sapiens
aagaucaucauagagggcauga

SEQ ID NO: 17381 - RNA, 21 nt, Homo sapiens
auuccacuuuuccuucaggga

SEQ ID NO: 17382 - RNA, 22 nt, Homo sapiens
ugagaacagauggcuuuauuau

SEQ ID NO: 17383 - RNA, 22 nt, Homo sapiens
uaagugcaugauuacaugcaua

SEQ ID NO: 17384 - RNA, 22 nt, Homo sapiens
aguaaauuucugugcuuucaua

SEQ ID NO: 17385 - RNA, 22 nt, Homo sapiens
ugaaagguauagguucuggagg

SEQ ID NO: 17386 - RNA, 22 nt, Homo sapiens
ucagugccucaguuuuuaaaga

SEQ ID NO: 17387 - RNA, 22 nt, Homo sapiens
ugacuagugcccuuugcugccu

SEQ ID NO: 17388 - RNA, 22 nt, Homo sapiens
cugacagucucauugauuugcu

SEQ ID NO: 17389 - RNA, 22 nt, Homo sapiens
uuggcaguaucuacuacagcua

SEQ ID NO: 17390 - RNA, 22 nt, Homo sapiens
guggaaugcaguguugauucaa

SEQ ID NO: 17391 - RNA, 21 nt, Homo sapiens
uggucaguuuucucacuagga

SEQ ID NO: 17392 - RNA, 18 nt, Homo sapiens
auucuacaggccuuuuga

SEQ ID NO: 17393 - RNA, 22 nt, Homo sapiens
auggaaugccauuuauaaugga

SEQ ID NO: 17394 - RNA, 22 nt, Homo sapiens
cuacagcagcccaguccccgaa

SEQ ID NO: 17395 - RNA, 22 nt, Homo sapiens
uucaagucuuggcuuugccacc

SEQ ID NO: 17396 - RNA, 22 nt, Homo sapiens
ugcuuugguagaaaucuuuggu

SEQ ID NO: 17397 - RNA, 22 nt, Homo sapiens
uacuguacugcaguucugcaaa

SEQ ID NO: 17398 - RNA, 20 nt, Homo sapiens
cuccuucauuccuuuggacc

SEQ ID NO: 17399 - RNA, 22 nt, Homo sapiens
augcacuguauaggaucuugcg

SEQ ID NO: 17400 - RNA, 22 nt, Homo sapiens
uggaagucuucauuauguauag

SEQ ID NO: 17401 - RNA, 22 nt, Homo sapiens
ugauuuguuucaggaguuuucu

SEQ ID NO: 17402 - RNA, 22 nt, Homo sapiens
uugcugagucuuucuagguugc

SEQ ID NO: 17403 - RNA, 22 nt, Homo sapiens
uucuacagugacugcagccaua

SEQ ID NO: 17404 - RNA, 22 nt, Homo sapiens
gugacagucaaagacaugacuu

SEQ ID NO: 17405 - RNA, 22 nt, Homo sapiens
agaugauguuuacugagcauca

SEQ ID NO: 17406 - RNA, 22 nt, Homo sapiens
acagugcuguuguguuuucacg

SEQ ID NO: 17407 - RNA, 22 nt, Homo sapiens
ucaguagcauugcuuauacagu

SEQ ID NO: 17408 - RNA, 22 nt, Homo sapiens
guauuugauuauagcaugcuua

SEQ ID NO: 17409 - RNA, 22 nt, Homo sapiens
ugagaugaagugauguaaaaca

SEQ ID NO: 17410 - RNA, 19 nt, Homo sapiens
uuugcauagugagaauaua

SEQ ID NO: 17411 - RNA, 23 nt, Homo sapiens
ugacagucucccgauggcuaggc

SEQ ID NO: 17412 - RNA, 22 nt, Homo sapiens
auguaauguuaaauugcuaauu

SEQ ID NO: 17413 - RNA, 22 nt, Homo sapiens
ggcucguguuuucuguccaguu

SEQ ID NO: 17414 - RNA, 22 nt, Homo sapiens
ucauacaguaguccucacuugu

SEQ ID NO: 17415 - RNA, 22 nt, Homo sapiens
uuggucaucucccuccuuuuag

SEQ ID NO: 17416 - RNA, 22 nt, Homo sapiens
ucuacagccaguucaggaagaa

SEQ ID NO: 17417 - RNA, 22 nt, Homo sapiens
guggaagucuuugguauuggua

SEQ ID NO: 17418 - RNA, 22 nt, Homo sapiens
ugagaacaugcacuugagguug

SEQ ID NO: 17419 - RNA, 22 nt, Homo sapiens
gcuguguugugcccagcaucau

SEQ ID NO: 17420 - RNA, 22 nt, Homo sapiens
augagauauguuaaaaguuaaa

SEQ ID NO: 17421 - RNA, 22 nt, Homo sapiens
ugugguuuuucacauuuagaga

SEQ ID NO: 17422 - RNA, 22 nt, Homo sapiens
uauggauuuucagauucuuauc

SEQ ID NO: 17423 - RNA, 22 nt, Homo sapiens
gauguguugggaagauuucaag

SEQ ID NO: 17424 - RNA, 22 nt, Homo sapiens
uugggauaaucacaaaguaaaa

SEQ ID NO: 17425 - RNA, 22 nt, Homo sapiens
ugacagguuggaauuaugggag

SEQ ID NO: 17426 - RNA, 22 nt, Homo sapiens
uucaguaaauguucuuacuaua

SEQ ID NO: 17427 - RNA, 22 nt, Homo sapiens
agcugauggucuuguaugaugu

SEQ ID NO: 17428 - RNA, 22 nt, Homo sapiens
gugacaguggagacuuacuuca

SEQ ID NO: 17429 - RNA, 22 nt, Homo sapiens
uuauagcuaacaucugugaaaa

SEQ ID NO: 17430 - RNA, 22 nt, Homo sapiens
uggaaguagauagauuguguca

SEQ ID NO: 17431 - RNA, 22 nt, Homo sapiens
ugagaugauagauauguuaauu

SEQ ID NO: 17432 - RNA, 20 nt, Homo sapiens
uggaguuugaguucuuggag

SEQ ID NO: 17433 - RNA, 20 nt, Homo sapiens
ucaucaguuggugcucgcug

SEQ ID NO: 17434 - RNA, 22 nt, Homo sapiens
uuugugaaugucauaagcucca

SEQ ID NO: 17435 - RNA, 20 nt, Homo sapiens
uggcaccugacagauagcca

SEQ ID NO: 17436 - RNA, 22 nt, Homo sapiens
aagaugauguuguguuuucacu

SEQ ID NO: 17437 - RNA, 22 nt, Homo sapiens
agcugcauuuacuuuugcacaa

SEQ ID NO: 17438 - RNA, 22 nt, Homo sapiens
uagcaccucuuuggccuuucgu

SEQ ID NO: 17439 - RNA, 22 nt, Homo sapiens
auguguucaucacagcacaauu

SEQ ID NO: 17440 - RNA, 22 nt, Homo sapiens
uuagaauggaaaugcgagguua

SEQ ID NO: 17441 - RNA, 22 nt, Homo sapiens
uugugaauggugccgcaauaaa

SEQ ID NO: 17442 - RNA, 22 nt, Homo sapiens
uucccugagcaucuguugagcc

SEQ ID NO: 17443 - RNA, 22 nt, Homo sapiens
aagacuguaauccaucuugagu

SEQ ID NO: 17444 - RNA, 22 nt, Homo sapiens
ucauaguagucacuuaauaaau

SEQ ID NO: 17445 - RNA, 22 nt, Homo sapiens
ucagugcuuuuuguugucauca

SEQ ID NO: 17446 - RNA, 22 nt, Homo sapiens
uuggcagugcccgaugcugggg

SEQ ID NO: 17447 - RNA, 22 nt, Homo sapiens
ucagucuuuuuuuggcaagcau

SEQ ID NO: 17448 - RNA, 22 nt, Homo sapiens
uuaauacugcuuaacuuuagga

SEQ ID NO: 17449 - RNA, 22 nt, Homo sapiens
gauaaagauagcaauagggaca

SEQ ID NO: 17450 - RNA, 22 nt, Homo sapiens
uuaauguaauugauugauugac

SEQ ID NO: 17451 - RNA, 22 nt, Treponema pallidum subsp. pallidum str. Nichols
uugagggucguuugacgcaacu

SEQ ID NO: 17452 - RNA, 22 nt, Treponema pallidum subsp. pallidum str. Nichols
ugcuggugagaguuuucaagcg

SEQ ID NO: 17453 - RNA, 22 nt, Treponema pallidum subsp. pallidum str. Nichols
gugaugcacgugauuuugugcu

SEQ ID NO: 17454 - RNA, 18 nt, Treponema pallidum subsp. pallidum str. Nichols
guccuuuccggugaacuc

SEQ ID NO: 17455 - RNA, 22 nt, Treponema pallidum subsp. pallidum str. Nichols
guggcaguuuggauuugaacca

SEQ ID NO: 17456 - RNA, 22 nt, Treponema pallidum subsp. pallidum str. Nichols
uugauucgguuuuguacguucc

SEQ ID NO: 17457 - RNA, 22 nt, Treponema pallidum subsp. pallidum str. Nichols
aucaaugucgcggcagagaacu

SEQ ID NO: 17458 - RNA, 22 nt, Treponema pallidum subsp. pallidum str. Nichols
cugugguuccaucggacccuuc

SEQ ID NO: 17459 - RNA, 22 nt, Treponema pallidum subsp. pallidum str. Nichols
gaggaugaagcguaagguucau

SEQ ID NO: 17460 - RNA, 22 nt, Treponema pallidum subsp. pallidum str. Nichols
gccugaaagcugcacauacccg

SEQ ID NO: 17461 - RNA, 22 nt, Treponema pallidum subsp. pallidum str. Nichols
gcucuggaaaagauucgcuuca

SEQ ID NO: 17462 - RNA, 22 nt, Treponema pallidum subsp. pallidum str. Nichols
gcuguauccgaaauaccauuuu

SEQ ID NO: 17463 - RNA, 20 nt, Treponema pallidum subsp. pallidum str. Nichols
uccugcuccaacugacggug

SEQ ID NO: 17464 - RNA, 22 nt, Treponema pallidum subsp. pallidum str. Nichols
aacaagcaaucguuacucuuuu

SEQ ID NO: 17465 - RNA, 22 nt, Treponema pallidum subsp. pallidum str. Nichols
aagaacuaggagucugugucgc

SEQ ID NO: 17466 - RNA, 22 nt, Treponema pallidum subsp. pallidum str. Nichols
agaaaugaaaggacgcaucauu

SEQ ID NO: 17467 - RNA, 22 nt, Treponema pallidum subsp. pallidum str. Nichols
acgaagacgccucacggaagcu

SEQ ID NO: 17468 - RNA, 22 nt, Treponema pallidum subsp. pallidum str. Nichols
cccccauggagacugcaccuga

SEQ ID NO: 17469 - RNA, 22 nt, Treponema pallidum subsp. pallidum str. Nichols
cauaaucagcgcuaaaggaaau

SEQ ID NO: 17470 - RNA, 22 nt, Treponema pallidum subsp. pallidum str. Nichols
auuuuaaugcagcgucuugcgc

SEQ ID NO: 17471 - RNA, 22 nt, Treponema pallidum subsp. pallidum str. Nichols
auuccauuuuuggaucguaggc

SEQ ID NO: 17472 - RNA, 22 nt, Treponema pallidum subsp. pallidum str. Nichols
auguauguuuuaguucugugga

SEQ ID NO: 17473 - RNA, 22 nt, Treponema pallidum subsp. pallidum str. Nichols
aguguauucaaccauuugcuuu

SEQ ID NO: 17474 - RNA, 13 nt, Homo sapiens
aacugauguaagu

SEQ ID NO: 17475 - RNA, 20 nt, Homo sapiens
aagcacagugaucaaguuau

SEQ ID NO: 17476 - RNA, 14 nt, Homo sapiens
aagucccugcugcc

SEQ ID NO: 17477 - RNA, 14 nt, Homo sapiens
acauggcuggagcu

SEQ ID NO: 17478 - RNA, 15 nt, Homo sapiens
acggcuggagcugcc

SEQ ID NO: 17479 - RNA, 16 nt, Homo sapiens
acugaauuaugaaacu

SEQ ID NO: 17480 - RNA, 15 nt, Homo sapiens
acuguccauucuucc

SEQ ID NO: 17481 - RNA, 21 nt, Homo sapiens
agccgguccuugcugcaccug

SEQ ID NO: 17482 - RNA, 14 nt, Homo sapiens
aggaugcccacggc

SEQ ID NO: 17483 - RNA, 15 nt, Homo sapiens
agucccugcugcccu

SEQ ID NO: 17484 - RNA, 15 nt, Homo sapiens
aucuauauuuuacau

SEQ ID NO: 17485 - RNA, 17 nt, Homo sapiens
augcuguucaugaaaga

SEQ ID NO: 17486 - RNA, 18 nt, Homo sapiens
augcuguucaugaaagau

SEQ ID NO: 17487 - RNA, 20 nt, Homo sapiens
auuuaguauuuuguuucagu

SEQ ID NO: 17488 - RNA, 15 nt, Homo sapiens
caagucagucauuca

SEQ ID NO: 17489 - RNA, 17 nt, Homo sapiens
cacagugaucaaguuau

SEQ ID NO: 17490 - RNA, 13 nt, Homo sapiens
caccugugccguc

SEQ ID NO: 17491 - RNA, 13 nt, Homo sapiens
cacggcuggagcu

SEQ ID NO: 17492 - RNA, 14 nt, Homo sapiens
cacggcuggagcug

SEQ ID NO: 17493 - RNA, 16 nt, Homo sapiens
cagagcuacaggcccc

SEQ ID NO: 17494 - RNA, 17 nt, Homo sapiens
cagagcuacaggcccca

SEQ ID NO: 17495 - RNA, 15 nt, Homo sapiens
cagcugagcagaugu

SEQ ID NO: 17496 - RNA, 13 nt, Homo sapiens
caggaugcccacg

SEQ ID NO: 17497 - RNA, 21 nt, Homo sapiens
caggaugcccacggcuggagc

SEQ ID NO: 17498 - RNA, 16 nt, Homo sapiens
caggccccaucugguc

SEQ ID NO: 17499 - RNA, 17 nt, Homo sapiens
caggccccaucuggucc

SEQ ID NO: 17500 - RNA, 23 nt, Homo sapiens
cauggcuggagcuagaauuugau

SEQ ID NO: 17501 - RNA, 14 nt, Homo sapiens
cauucaggaugccc

SEQ ID NO: 17502 - RNA, 21 nt, Homo sapiens
cauucaggaugcccacggcug

SEQ ID NO: 17503 - RNA, 17 nt, Homo sapiens
ccaauaaagaguuccuu

SEQ ID NO: 17504 - RNA, 12 nt, Homo sapiens
ccacggcuggag

SEQ ID NO: 17505 - RNA, 21 nt, Homo sapiens
ccacuuuccaauaaagaguuc

SEQ ID NO: 17506 - RNA, 22 nt, Homo sapiens
ccacuuuccaauaaagaguucc

SEQ ID NO: 17507 - RNA, 18 nt, Homo sapiens
ccauuguugucugcaacu

SEQ ID NO: 17508 - RNA, 14 nt, Homo sapiens
cccacggcuggagc

SEQ ID NO: 17509 - RNA, 17 nt, Homo sapiens
ccccagagcuacaggcc

SEQ ID NO: 17510 - RNA, 23 nt, Homo sapiens
ccgguccuugcugcaccugugcc

SEQ ID NO: 17511 - RNA, 18 nt, Homo sapiens
ccuaagucccugcugccc

SEQ ID NO: 17512 - RNA, 18 nt, Homo sapiens
ccuaugaauaaauuuucu

SEQ ID NO: 17513 - RNA, 22 nt, Homo sapiens
ccucccauucaggaugcccacg

SEQ ID NO: 17514 - RNA, 20 nt, Homo sapiens
ccucucucauccacuuucca

SEQ ID NO: 17515 - RNA, 11 nt, Homo sapiens
ccuucugcucc

SEQ ID NO: 17516 - RNA, 21 nt, Homo sapiens
ccuugcugcaccugugccguc

SEQ ID NO: 17517 - RNA, 22 nt, Homo sapiens
ccuugcugcaccugugccgucc

SEQ ID NO: 17518 - RNA, 17 nt, Homo sapiens
cguccccagagcuacag

SEQ ID NO: 17519 - RNA, 14 nt, Homo sapiens
cgguccuugcugca

SEQ ID NO: 17520 - RNA, 21 nt, Homo sapiens
cuaugaauaaauuuucuucuu

SEQ ID NO: 17521 - RNA, 21 nt, Homo sapiens
cucugauacagaaaaguugaa

SEQ ID NO: 17522 - RNA, 22 nt, Homo sapiens
cucugauacagaaaaguugaau

SEQ ID NO: 17523 - RNA, 17 nt, Homo sapiens
cugcccuuccccuuccc

SEQ ID NO: 17524 - RNA, 14 nt, Homo sapiens
cugcugcccuuccc

SEQ ID NO: 17525 - RNA, 21 nt, Homo sapiens
cugguccuaagucccugcugc

SEQ ID NO: 17526 - RNA, 16 nt, Homo sapiens
aauuaagagagucuau

SEQ ID NO: 17527 - RNA, 23 nt, Homo sapiens
gaacucaaauacgugggcauuca

SEQ ID NO: 17528 - RNA, 14 nt, Homo sapiens
gagcagauguaaua

SEQ ID NO: 17529 - RNA, 14 nt, Homo sapiens
gagcuacaggcccc

SEQ ID NO: 17530 - RNA, 15 nt, Homo sapiens
gagcuacaggcccca

SEQ ID NO: 17531 - RNA, 13 nt, Homo sapiens
gcccacggcugga

SEQ ID NO: 17532 - RNA, 19 nt, Homo sapiens
gcccacggcuggagcugcc

SEQ ID NO: 17533 - RNA, 16 nt, Homo sapiens
gccccaucugguccua

SEQ ID NO: 17534 - RNA, 15 nt, Homo sapiens
gccgguccuugcugc

SEQ ID NO: 17535 - RNA, 16 nt, Homo sapiens
gccgguccuugcugca

SEQ ID NO: 17536 - RNA, 14 nt, Homo sapiens
gccguccccagagc

SEQ ID NO: 17537 - RNA, 14 nt, Homo sapiens
gcugcaccugugcc

SEQ ID NO: 17538 - RNA, 16 nt, Homo sapiens
gcugcaccugugccgu

SEQ ID NO: 17539 - RNA, 10 nt, Homo sapiens
ggagcugccu

SEQ ID NO: 17540 - RNA, 11 nt, Homo sapiens
ggagcugccuc

SEQ ID NO: 17541 - RNA, 12 nt, Homo sapiens
ggagcugccucu

SEQ ID NO: 17542 - RNA, 12 nt, Homo sapiens
ggaugcccacgg

SEQ ID NO: 17543 - RNA, 13 nt, Homo sapiens
ggaugcccacggc

SEQ ID NO: 17544 - RNA, 20 nt, Homo sapiens
ggguagcauuuguguugaag

SEQ ID NO: 17545 - RNA, 15 nt, Homo sapiens
gguccuaagucccug

SEQ ID NO: 17546 - RNA, 17 nt, Homo sapiens
gguccuugcugcaccug

SEQ ID NO: 17547 - RNA, 14 nt, Homo sapiens
guccccagagcuac

SEQ ID NO: 17548 - RNA, 19 nt, Homo sapiens
guccuaagucccugcugcc

SEQ ID NO: 17549 - RNA, 11 nt, Homo sapiens
gucccugcugc

SEQ ID NO: 17550 - RNA, 14 nt, Homo sapiens
gucccugcugcccu

SEQ ID NO: 17551 - RNA, 22 nt, Homo sapiens
uccaauaaagaguuccuucugc

SEQ ID NO: 17552 - RNA, 16 nt, Homo sapiens
uccccuucccacacug

SEQ ID NO: 17553 - RNA, 16 nt, Homo sapiens
ucccauucaggaugcc

SEQ ID NO: 17554 - RNA, 15 nt, Homo sapiens
ugcccacggcuggag

SEQ ID NO: 17555 - RNA, 15 nt, Homo sapiens
ugccguccccagagc

SEQ ID NO: 17556 - RNA, 14 nt, Homo sapiens
ugcugcccuucccc

SEQ ID NO: 17557 - RNA, 19 nt, Homo sapiens
uucaggaugcccacggcug

SEQ ID NO: 17558 - RNA, 20 nt, Homo sapiens
uuccugaacaggauauucuc

SEQ ID NO: 17559 - RNA, 13 nt, Homo sapiens
agcauccuggaau

SEQ ID NO: 17560 - RNA, 17 nt, Homo sapiens
agccgguccuugcugca

SEQ ID NO: 17561 - RNA, 20 nt, Homo sapiens
agccgguccuugcugcaccu

SEQ ID NO: 17562 - RNA, 12 nt, Homo sapiens
agcuacaggccc

SEQ ID NO: 17563 - RNA, 14 nt, Homo sapiens
agcuacaggcccca

SEQ ID NO: 17564 - RNA, 15 nt, Homo sapiens
agcuacaggccccau

SEQ ID NO: 17565 - RNA, 20 nt, Homo sapiens
agcugccucucucauccacu

SEQ ID NO: 17566 - RNA, 13 nt, Homo sapiens
aggaugcccacgg

SEQ ID NO: 17567 - RNA, 16 nt, Homo sapiens
aggugucuugcuggcu

SEQ ID NO: 17568 - RNA, 17 nt, Homo sapiens
aggugucuugcuggcuu

SEQ ID NO: 17569 - RNA, 11 nt, Homo sapiens
agucccugcug

SEQ ID NO: 17570 - RNA, 12 nt, Homo sapiens
agucccugcugc

SEQ ID NO: 17571 - RNA, 16 nt, Homo sapiens
agucccugcugcccuu

SEQ ID NO: 17572 - RNA, 15 nt, Homo sapiens
aguugaauuuuacau

SEQ ID NO: 17573 - RNA, 15 nt, Homo sapiens
auccucuguguggcu

SEQ ID NO: 17574 - RNA, 18 nt, Homo sapiens
auucaaauguauuacagu

SEQ ID NO: 17575 - RNA, 14 nt, Homo sapiens
auucaaaugucuau

SEQ ID NO: 17576 - RNA, 12 nt, Homo sapiens
auucaggaugcc

SEQ ID NO: 17577 - RNA, 16 nt, Homo sapiens
auucaggaugcccacg

SEQ ID NO: 17578 - RNA, 17 nt, Homo sapiens
auucaggaugcccacgg

SEQ ID NO: 17579 - RNA, 14 nt, Homo sapiens
caccugugccgucc

SEQ ID NO: 17580 - RNA, 21 nt, Homo sapiens
caccugugccguccccagagc

SEQ ID NO: 17581 - RNA, 14 nt, Homo sapiens
cagcugagcagaug

SEQ ID NO: 17582 - RNA, 14 nt, Homo sapiens
caggaugcccacgg

SEQ ID NO: 17583 - RNA, 14 nt, Homo sapiens
caggccccaucugg

SEQ ID NO: 17584 - RNA, 18 nt, Homo sapiens
caggccccaucugguccu

SEQ ID NO: 17585 - RNA, 15 nt, Homo sapiens
cauucaggaugccca

SEQ ID NO: 17586 - RNA, 22 nt, Homo sapiens
cauucaggaugcccacggcugg

SEQ ID NO: 17587 - RNA, 13 nt, Homo sapiens
ccagagcuacagg

SEQ ID NO: 17588 - RNA, 14 nt, Homo sapiens
ccagagcuacaggc

SEQ ID NO: 17589 - RNA, 17 nt, Homo sapiens
ccagagcuacaggcccc

SEQ ID NO: 17590 - RNA, 20 nt, Homo sapiens
ccauucaggaugcccacggc

SEQ ID NO: 17591 - RNA, 21 nt, Homo sapiens
ccauucaggaugcccacggcu

SEQ ID NO: 17592 - RNA, 22 nt, Homo sapiens
ccauucaggaugcccacggcug

SEQ ID NO: 17593 - RNA, 13 nt, Homo sapiens
cccacacugucca

SEQ ID NO: 17594 - RNA, 13 nt, Homo sapiens
cccacggcuggag

SEQ ID NO: 17595 - RNA, 18 nt, Homo sapiens
ccccagagcuacaggccc

SEQ ID NO: 17596 - RNA, 19 nt, Homo sapiens
ccccagagcuacaggcccc

SEQ ID NO: 17597 - RNA, 20 nt, Homo sapiens
ccccagagcuacaggcccca

SEQ ID NO: 17598 - RNA, 19 nt, Homo sapiens
cccauucaggaugcccacg

SEQ ID NO: 17599 - RNA, 18 nt, Homo sapiens
cccuucccacacugucca

SEQ ID NO: 17600 - RNA, 15 nt, Homo sapiens
ccgguccuugcugca

SEQ ID NO: 17601 - RNA, 14 nt, Homo sapiens
ccuaagucccugcu

SEQ ID NO: 17602 - RNA, 15 nt, Homo sapiens
ccuaagucccugcug

SEQ ID NO: 17603 - RNA, 16 nt, Homo sapiens
ccuaagucccugcugc

SEQ ID NO: 17604 - RNA, 19 nt, Homo sapiens
ccuaagucccugcugcccu

SEQ ID NO: 17605 - RNA, 19 nt, Homo sapiens
ccucccauucaggaugccc

SEQ ID NO: 17606 - RNA, 14 nt, Homo sapiens
ccucucucauccac

SEQ ID NO: 17607 - RNA, 15 nt, Homo sapiens
cgguccuugcugcac

SEQ ID NO: 17608 - RNA, 21 nt, Homo sapiens
cguccccagagcuacaggccc

SEQ ID NO: 17609 - RNA, 14 nt, Homo sapiens
cuaagucccugcug

SEQ ID NO: 17610 - RNA, 18 nt, Homo sapiens
cuaugaauaaauuuucuu

SEQ ID NO: 17611 - RNA, 14 nt, Homo sapiens
cuauuuacggaacu

SEQ ID NO: 17612 - RNA, 11 nt, Homo sapiens
cucccauucag

SEQ ID NO: 17613 - RNA, 12 nt, Homo sapiens
cucccauucagg

SEQ ID NO: 17614 - RNA, 15 nt, Homo sapiens
cugcugcccuucccc

SEQ ID NO: 17615 - RNA, 20 nt, Homo sapiens
cugguccuaagucccugcug

SEQ ID NO: 17616 - RNA, 22 nt, Homo sapiens
cugguccuaagucccugcugcc

SEQ ID NO: 17617 - RNA, 24 nt, Homo sapiens
gaacucaaauacgugggcauucaa

SEQ ID NO: 17618 - RNA, 18 nt, Homo sapiens
gagcugccucucucaucc

SEQ ID NO: 17619 - RNA, 19 nt, Homo sapiens
gagcugccucucucaucca

SEQ ID NO: 17620 - RNA, 12 nt, Homo sapiens
gaugcccacggc

SEQ ID NO: 17621 - RNA, 13 nt, Homo sapiens
gaugcccacggcu

SEQ ID NO: 17622 - RNA, 16 nt, Homo sapiens
gaugcccacggcugga

SEQ ID NO: 17623 - RNA, 17 nt, Homo sapiens
gcaccugugccgucccc

SEQ ID NO: 17624 - RNA, 23 nt, Homo sapiens
gcagauguaauagaaauaaaccu

SEQ ID NO: 17625 - RNA, 18 nt, Homo sapiens
gcccacggcuggagcugc

SEQ ID NO: 17626 - RNA, 15 nt, Homo sapiens
gccccaucugguccu

SEQ ID NO: 17627 - RNA, 17 nt, Homo sapiens
gccgguccuugcugcac

SEQ ID NO: 17628 - RNA, 19 nt, Homo sapiens
gccgguccuugcugcaccu

SEQ ID NO: 17629 - RNA, 20 nt, Homo sapiens
gccguccccagagcuacagg

SEQ ID NO: 17630 - RNA, 12 nt, Homo sapiens
gcuacaggcccc

SEQ ID NO: 17631 - RNA, 14 nt, Homo sapiens
gcuacaggccccau

SEQ ID NO: 17632 - RNA, 18 nt, Homo sapiens
gcuacaggccccaucugg

SEQ ID NO: 17633 - RNA, 14 nt, Homo sapiens
gcuacuuauuguag

SEQ ID NO: 17634 - RNA, 22 nt, Homo sapiens
gcuagaauuugauaugugaaca

SEQ ID NO: 17635 - RNA, 13 nt, Homo sapiens
gcugcaccugugc

SEQ ID NO: 17636 - RNA, 15 nt, Homo sapiens
gcugcaccugugccg

SEQ ID NO: 17637 - RNA, 13 nt, Homo sapiens
gcugagcagaugu

SEQ ID NO: 17638 - RNA, 22 nt, Homo sapiens
ggagcugccucucucauccacu

SEQ ID NO: 17639 - RNA, 14 nt, Homo sapiens
gggagcuuuuguag

SEQ ID NO: 17640 - RNA, 16 nt, Homo sapiens
gguccuaagucccugc

SEQ ID NO: 17641 - RNA, 19 nt, Homo sapiens
gguccuaagucccugcugc

SEQ ID NO: 17642 - RNA, 22 nt, Homo sapiens
gguccuaagucccugcugcccu

SEQ ID NO: 17643 - RNA, 23 nt, Homo sapiens
gguccuaagucccugcugcccuu

SEQ ID NO: 17644 - RNA, 20 nt, Homo sapiens
guccuaagucccugcugccc

SEQ ID NO: 17645 - RNA, 12 nt, Homo sapiens
gucccugcugcc

SEQ ID NO: 17646 - RNA, 13 nt, Homo sapiens
gucccugcugccc

SEQ ID NO: 17647 - RNA, 23 nt, Homo sapiens
guccauucuuccucccauucagg

SEQ ID NO: 17648 - RNA, 19 nt, Homo sapiens
guuuggacaaaauggaaua

SEQ ID NO: 17649 - RNA, 17 nt, Homo sapiens
uaaauagcuuuuuucuc

SEQ ID NO: 17650 - RNA, 15 nt, Homo sapiens
ucaacucauauuuuc

SEQ ID NO: 17651 - RNA, 12 nt, Homo sapiens
ucaggaugccca

SEQ ID NO: 17652 - RNA, 15 nt, Homo sapiens
ucaggaugcccacgg

SEQ ID NO: 17653 - RNA, 16 nt, Homo sapiens
ucaggaugcccacggc

SEQ ID NO: 17654 - RNA, 15 nt, Homo sapiens
ucccauucaggaugc

SEQ ID NO: 17655 - RNA, 17 nt, Homo sapiens
ucccauucaggaugccc

SEQ ID NO: 17656 - RNA, 22 nt, Homo sapiens
ucccauucaggaugcccacggc

SEQ ID NO: 17657 - RNA, 23 nt, Homo sapiens
ucccauucaggaugcccacggcu

SEQ ID NO: 17658 - RNA, 15 nt, Homo sapiens
uccccuucccacacu

SEQ ID NO: 17659 - RNA, 16 nt, Homo sapiens
ucccugcugcccuucc

SEQ ID NO: 17660 - RNA, 16 nt, Homo sapiens
uccuaagucccugcug

SEQ ID NO: 17661 - RNA, 17 nt, Homo sapiens
uccuaagucccugcugc

SEQ ID NO: 17662 - RNA, 18 nt, Homo sapiens
uucaggaugcccacggcu

SEQ ID NO: 17663 - RNA, 13 nt, Homo sapiens
uugcugcaccugu

SEQ ID NO: 17664 - RNA, 17 nt, Homo sapiens
uugcugcaccugugccg

SEQ ID NO: 17665 - RNA, 16 nt, Homo sapiens
aauacucuuauaucua

SEQ ID NO: 17666 - RNA, 12 nt, Homo sapiens
ggaaacaaguca

SEQ ID NO: 17667 - RNA, 17 nt, Homo sapiens
uauuuuuuucugaaauu

SEQ ID NO: 17668 - RNA, 19 nt, Homo sapiens
uaaauaucuagaaaugaua

SEQ ID NO: 17669 - RNA, 14 nt, Homo sapiens
cuucccacacuguc

SEQ ID NO: 17670 - RNA, 17 nt, Homo sapiens
aaguaaacggucucuca

SEQ ID NO: 17671 - RNA, 15 nt, Homo sapiens
acugucaauuuggca

SEQ ID NO: 17672 - RNA, 19 nt, Homo sapiens
uuagcaaaucuacugucaa

SEQ ID NO: 17673 - RNA, 17 nt, Homo sapiens
cugcaacucugaagggu

SEQ ID NO: 17674 - RNA, 15 nt, Homo sapiens
cucauccacuuucca

SEQ ID NO: 17675 - RNA, 17 nt, Homo sapiens
augaagauacugaaaua

SEQ ID NO: 17676 - RNA, 15 nt, Homo sapiens
cggcuggagcugccu

SEQ ID NO: 17677 - RNA, 19 nt, Homo sapiens
uggcuugccucuugcaauu

SEQ ID NO: 17678 - RNA, 20 nt, Homo sapiens
uuaauuugguuuucacauug

SEQ ID NO: 17679 - RNA, 15 nt, Homo sapiens
ugagcagauguaaua

SEQ ID NO: 17680 - RNA, 17 nt, Homo sapiens
gaacaggauauucucac

SEQ ID NO: 17681 - RNA, 17 nt, Homo sapiens
ucuugcaauucaauaca

SEQ ID NO: 17682 - RNA, 14 nt, Homo sapiens
gugcacuaaugugu

SEQ ID NO: 17683 - RNA, 22 nt, Homo sapiens
agugcuuugagauugugaaauu

SEQ ID NO: 17684 - RNA, 22 nt, Homo sapiens
gaucaaguuauuuuuaauuugg

SEQ ID NO: 17685 - RNA, 15 nt, Homo sapiens
auuugauaugugaac

SEQ ID NO: 17686 - RNA, 17 nt, Homo sapiens
ugcccuuccccuuccca

SEQ ID NO: 17687 - RNA, 17 nt, Homo sapiens
uuguuucagugcacuaa

SEQ ID NO: 17688 - RNA, 23 nt, Homo sapiens
gcugagcagauguaauagaaaua

SEQ ID NO: 17689 - RNA, 22 nt, Homo sapiens
uggacaaaauggaauacucuua

SEQ ID NO: 17690 - RNA, 14 nt, Homo sapiens
agguuuggacaaaa

SEQ ID NO: 17691 - RNA, 12 nt, Homo sapiens
cugaaauuuccu

SEQ ID NO: 17692 - RNA, 19 nt, Homo sapiens
auuuucaugcuguucauga

SEQ ID NO: 17693 - RNA, 18 nt, Homo sapiens
caaaucuacugucaauuu

SEQ ID NO: 17694 - RNA, 22 nt, Homo sapiens
uggcuugccucuugcaauucaa

SEQ ID NO: 17695 - RNA, 15 nt, Homo sapiens
auccuggaauaucuc

SEQ ID NO: 17696 - RNA, 17 nt, Homo sapiens
guccccagagcuacagg

SEQ ID NO: 17697 - RNA, 22 nt, Homo sapiens
uuaagagagucuauuuacggaa

SEQ ID NO: 17698 - RNA, 21 nt, Homo sapiens
ugaagcacagugaucaaguua

SEQ ID NO: 17699 - RNA, 16 nt, Homo sapiens
caagucagucauucag

SEQ ID NO: 17700 - RNA, 17 nt, Homo sapiens
uccccagagcuacaggc

SEQ ID NO: 17701 - RNA, 16 nt, Homo sapiens
uguagcauccuggaau

SEQ ID NO: 17702 - RNA, 19 nt, Homo sapiens
acaaaauggaauacucuua

SEQ ID NO: 17703 - RNA, 21 nt, Homo sapiens
ggcuggagcugccucucucau

SEQ ID NO: 17704 - RNA, 23 nt, Homo sapiens
ugcuggcuugccucuugcaauuc

SEQ ID NO: 17705 - RNA, 15 nt, Homo sapiens
uccccagagcuacag

SEQ ID NO: 17706 - RNA, 20 nt, Homo sapiens
acaaaauggaauacucuuau

SEQ ID NO: 17707 - RNA, 22 nt, Homo sapiens
uaaaccgaacugauguaaguaa

SEQ ID NO: 17708 - RNA, 21 nt, Homo sapiens
cuucccacacuguccauucuu

SEQ ID NO: 17709 - RNA, 14 nt, Homo sapiens
uggaauacucuuau

SEQ ID NO: 17710 - RNA, 16 nt, Homo sapiens
gaaauaaaccuaugaa

SEQ ID NO: 17711 - RNA, 14 nt, Homo sapiens
ucauccacuuucca

SEQ ID NO: 17712 - RNA, 17 nt, Homo sapiens
cauccuggaauaucucc

SEQ ID NO: 17713 - RNA, 18 nt, Homo sapiens
uuccccuucccacacugu

SEQ ID NO: 17714 - RNA, 15 nt, Homo sapiens
uaaaccuaugaauaa

SEQ ID NO: 17715 - RNA, 17 nt, Homo sapiens
gaaauaaaccuaugaau

SEQ ID NO: 17716 - RNA, 14 nt, Homo sapiens
uagguuuggacaaa

SEQ ID NO: 17717 - RNA, 16 nt, Homo sapiens
acaagucagucauuca

SEQ ID NO: 17718 - RNA, 16 nt, Homo sapiens
uagaagucacauuccu

SEQ ID NO: 17719 - RNA, 15 nt, Homo sapiens
ucauccacuuuccaa

SEQ ID NO: 17720 - RNA, 13 nt, Homo sapiens
agcuagaauuuga

SEQ ID NO: 17721 - RNA, 21 nt, Homo sapiens
aaaagcuacuuauuguagcau

SEQ ID NO: 17722 - RNA, 11 nt, Homo sapiens
auucaaaugua

SEQ ID NO: 17723 - RNA, 14 nt, Homo sapiens
uuuuacauggcugg

SEQ ID NO: 17724 - RNA, 13 nt, Homo sapiens
ucucauccacuuu

SEQ ID NO: 17725 - RNA, 16 nt, Homo sapiens
cugagcagauguaaua

SEQ ID NO: 17726 - RNA, 14 nt, Homo sapiens
cucucucauccacu

SEQ ID NO: 17727 - RNA, 18 nt, Homo sapiens
ccaauaaagaguuccuuc

SEQ ID NO: 17728 - RNA, 11 nt, Homo sapiens
ccuaugaauaa

SEQ ID NO: 17729 - RNA, 18 nt, Homo sapiens
auaucuagaaaugauaau

SEQ ID NO: 17730 - RNA, 23 nt, Homo sapiens
uagguuuggacaaaauggaauac

SEQ ID NO: 17731 - RNA, 19 nt, Homo sapiens
gaaacaagucagucauuca

SEQ ID NO: 17732 - RNA, 17 nt, Homo sapiens
uguguaagacaaaaagc

SEQ ID NO: 17733 - RNA, 16 nt, Homo sapiens
uuucuaggacugaauu

SEQ ID NO: 17734 - RNA, 22 nt, Homo sapiens
uggaaacaagucagucauucag

SEQ ID NO: 17735 - RNA, 15 nt, Homo sapiens
gaaauaaaccuauga

SEQ ID NO: 17736 - RNA, 12 nt, Homo sapiens
auccuggaauau

SEQ ID NO: 17737 - RNA, 16 nt, Homo sapiens
aauuucuaggacugaa

SEQ ID NO: 17738 - RNA, 13 nt, Homo sapiens
ugaagauacugaa

SEQ ID NO: 17739 - RNA, 17 nt, Homo sapiens
uucaaugccccugaauu

SEQ ID NO: 17740 - RNA, 21 nt, Homo sapiens
ccucucucauccacuuuccaa

SEQ ID NO: 17741 - RNA, 21 nt, Homo sapiens
acauggcuggagcuagaauuu

SEQ ID NO: 17742 - RNA, 14 nt, Homo sapiens
cucugaaggguaau

SEQ ID NO: 17743 - RNA, 14 nt, Homo sapiens
aaaauggaauacuc

SEQ ID NO: 17744 - RNA, 12 nt, Homo sapiens
aauaaaccuaug

SEQ ID NO: 17745 - RNA, 12 nt, Homo sapiens
gauaugauucaa

SEQ ID NO: 17746 - RNA, 20 nt, Homo sapiens
cuuauuguagcauccuggaa

SEQ ID NO: 17747 - RNA, 13 nt, Homo sapiens
ugauaauuugcua

SEQ ID NO: 17748 - RNA, 17 nt, Homo sapiens
ccucuaaauucuuucau

SEQ ID NO: 17749 - RNA, 21 nt, Homo sapiens
ucuugcaauucaauacagauc

SEQ ID NO: 17750 - RNA, 24 nt, Homo sapiens
acauuccugaacaggauauucuca

SEQ ID NO: 17751 - RNA, 21 nt, Homo sapiens
gagccgguccuugcugcaccu

SEQ ID NO: 17752 - RNA, 15 nt, Homo sapiens
auuucuaggacugaa

SEQ ID NO: 17753 - RNA, 17 nt, Homo sapiens
guucaugaaagauucaa

SEQ ID NO: 17754 - RNA, 13 nt, Homo sapiens
cacagugaucaag

SEQ ID NO: 17755 - RNA, 23 nt, Homo sapiens
gcccuuccccuucccacacuguc

SEQ ID NO: 17756 - RNA, 20 nt, Homo sapiens
ucuauaaaccgaacugaugu

SEQ ID NO: 17757 - RNA, 11 nt, Homo sapiens
uccuugcugca

SEQ ID NO: 17758 - RNA, 23 nt, Homo sapiens
uuaaauagcuuuuuucucugaua

SEQ ID NO: 17759 - RNA, 18 nt, Homo sapiens
uuucaugcuguucaugaa

SEQ ID NO: 17760 - RNA, 17 nt, Homo sapiens
gguccuugcugcaccug

SEQ ID NO: 17761 - RNA, 17 nt, Homo sapiens
agucauucagauaugau

SEQ ID NO: 17762 - RNA, 17 nt, Homo sapiens
ucaauuuggcagugaua

SEQ ID NO: 17763 - RNA, 13 nt, Homo sapiens
aacggucucucac

SEQ ID NO: 17764 - RNA, 16 nt, Homo sapiens
ugaacaggauauucuc

SEQ ID NO: 17765 - RNA, 15 nt, Homo sapiens
uugccucuugcaauu

SEQ ID NO: 17766 - RNA, 14 nt, Homo sapiens
agcugccucucuca

SEQ ID NO: 17767 - RNA, 14 nt, Homo sapiens
ccccaucugguccu

SEQ ID NO: 17768 - RNA, 19 nt, Homo sapiens
uauuuaauagguuuggaca

SEQ ID NO: 17769 - RNA, 16 nt, Homo sapiens
ucauaauaaauaucua

SEQ ID NO: 17770 - RNA, 19 nt, Homo sapiens
uagaagucacauuccugaa

SEQ ID NO: 17771 - RNA, 15 nt, Homo sapiens
acgugggcauucaaa

SEQ ID NO: 17772 - RNA, 13 nt, Homo sapiens
aaaaagcuacuua

SEQ ID NO: 17773 - RNA, 16 nt, Homo sapiens
cccagagcuacaggcc

SEQ ID NO: 17774 - RNA, 23 nt, Homo sapiens
agauucaaugccccugaauuuaa

SEQ ID NO: 17775 - RNA, 17 nt, Homo sapiens
uugcuuuucaacacaca

SEQ ID NO: 17776 - RNA, 12 nt, Homo sapiens
ucccacacuguc

SEQ ID NO: 17777 - RNA, 14 nt, Homo sapiens
cuuccucccauuca

SEQ ID NO: 17778 - RNA, 17 nt, Homo sapiens
gcccuuccccuucccac

SEQ ID NO: 17779 - RNA, 16 nt, Homo sapiens
auuucuaggacugaau

SEQ ID NO: 17780 - RNA, 17 nt, Homo sapiens
ccuucccacacugucca

SEQ ID NO: 17781 - RNA, 19 nt, Homo sapiens
uaaccucuaaauucuuuca

SEQ ID NO: 17782 - RNA, 19 nt, Homo sapiens
ucugguccuaagucccugc

SEQ ID NO: 17783 - RNA, 21 nt, Homo sapiens
uguaaguaaacggucucucac

SEQ ID NO: 17784 - RNA, 16 nt, Homo sapiens
ggcuggagcugccucu

SEQ ID NO: 17785 - RNA, 22 nt, Homo sapiens
agagucuauuuacggaacucaa

SEQ ID NO: 17786 - RNA, 15 nt, Homo sapiens
caagucagucauuca

SEQ ID NO: 17787 - RNA, 23 nt, Homo sapiens
agagucuauuuacggaacucaaa

SEQ ID NO: 17788 - RNA, 19 nt, Homo sapiens
acuaauguguaagacaaaa

SEQ ID NO: 17789 - RNA, 13 nt, Homo sapiens
cauccacuuucca

SEQ ID NO: 17790 - RNA, 16 nt, Homo sapiens
gaguuccuucugcucc

SEQ ID NO: 17791 - RNA, 20 nt, Homo sapiens
uagcaaaucuacugucaauu

SEQ ID NO: 17792 - RNA, 22 nt, Homo sapiens
acuuauuguagcauccuggaau

SEQ ID NO: 17793 - RNA, 20 nt, Homo sapiens
uacagaaaaguugaauuuua

SEQ ID NO: 17794 - RNA, 21 nt, Homo sapiens
gucuauuuacggaacucaaau

SEQ ID NO: 17795 - RNA, 17 nt, Homo sapiens
gaaaaggugucuugcug

SEQ ID NO: 17796 - RNA, 16 nt, Homo sapiens
cuucuugguucugaaa

SEQ ID NO: 17797 - RNA, 18 nt, Homo sapiens
cuauuuacggaacucaaa

SEQ ID NO: 17798 - RNA, 21 nt, Homo sapiens
uuagugcuuugagauugugaa

SEQ ID NO: 17799 - RNA, 22 nt, Homo sapiens
uuuguagaagucacauuccuga

SEQ ID NO: 17800 - RNA, 17 nt, Homo sapiens
uuuaauuugguuuucac

SEQ ID NO: 17801 - RNA, 13 nt, Homo sapiens
gaaagauucaaug

SEQ ID NO: 17802 - RNA, 19 nt, Homo sapiens
acagcuccaagaauuucua

SEQ ID NO: 17803 - RNA, 19 nt, Homo sapiens
cucugaaggguaauuauau

SEQ ID NO: 17804 - RNA, 13 nt, Homo sapiens
ugcugcaccugug

SEQ ID NO: 17805 - RNA, 23 nt, Homo sapiens
cucaaauacgugggcauucaaau

SEQ ID NO: 17806 - RNA, 17 nt, Homo sapiens
aaacgucuuaaauauuc

SEQ ID NO: 17807 - RNA, 15 nt, Homo sapiens
agauacugaaauaaa

SEQ ID NO: 17808 - RNA, 13 nt, Homo sapiens
cccacacugucca

SEQ ID NO: 17809 - RNA, 12 nt, Homo sapiens
ccuugcugcacc

SEQ ID NO: 17810 - RNA, 14 nt, Homo sapiens
uucaauacagauca

SEQ ID NO: 17811 - RNA, 13 nt, Homo sapiens
ugcccuuccccuu

SEQ ID NO: 17812 - RNA, 13 nt, Homo sapiens
aagacaaaaagcu

SEQ ID NO: 17813 - RNA, 15 nt, Homo sapiens
auuuggcagugauau

SEQ ID NO: 17814 - RNA, 23 nt, Homo sapiens
cuaaauucuuucauuuuaggggu

SEQ ID NO: 17815 - RNA, 13 nt, Homo sapiens
uaaaccuaugaau

SEQ ID NO: 17816 - RNA, 21 nt, Homo sapiens
gagcuuuuguagaagucacau

SEQ ID NO: 17817 - RNA, 14 nt, Homo sapiens
augauucaaauguc

SEQ ID NO: 17818 - RNA, 13 nt, Homo sapiens
cugcaacucugaa

SEQ ID NO: 17819 - RNA, 15 nt, Homo sapiens
aaaugauaauuugcu

SEQ ID NO: 17820 - RNA, 9 nt, Homo sapiens
acacugucc

SEQ ID NO: 17821 - RNA, 17 nt, Homo sapiens
uuguagaagucacauuc

SEQ ID NO: 17822 - RNA, 15 nt, Homo sapiens
ucaaugccccugaau

SEQ ID NO: 17823 - RNA, 23 nt, Homo sapiens
agcauccuggaauaucuccguca

SEQ ID NO: 17824 - RNA, 18 nt, Homo sapiens
gcuggcuugccucuugca

SEQ ID NO: 17825 - RNA, 21 nt, Homo sapiens
cagaucaguuuagcaaaucua

SEQ ID NO: 17826 - RNA, 19 nt, Homo sapiens
uguuugaagcacagugauc

SEQ ID NO: 17827 - RNA, 20 nt, Homo sapiens
gucauucagauaugauucaa

SEQ ID NO: 17828 - RNA, 13 nt, Homo sapiens
auguguaagacaa

SEQ ID NO: 17829 - RNA, 18 nt, Homo sapiens
ggaaacaagucagucauu

SEQ ID NO: 17830 - RNA, 22 nt, Homo sapiens
cacuacagcugagcagauguaa

SEQ ID NO: 17831 - RNA, 12 nt, Homo sapiens
cucuugcaauuc

SEQ ID NO: 17832 - RNA, 17 nt, Homo sapiens
aacaagucagucauuca

SEQ ID NO: 17833 - RNA, 14 nt, Homo sapiens
cuuuucaacacaca

SEQ ID NO: 17834 - RNA, 15 nt, Homo sapiens
ggaagguauuuaaua

SEQ ID NO: 17835 - RNA, 23 nt, Homo sapiens
auaaauuuucuucuugguucuga

SEQ ID NO: 17836 - RNA, 20 nt, Homo sapiens
gggagcuuuuguagaaguca

SEQ ID NO: 17837 - RNA, 16 nt, Homo sapiens
uuguguuugaagcaca

SEQ ID NO: 17838 - RNA, 14 nt, Homo sapiens
uauuuucaugcugu

SEQ ID NO: 17839 - RNA, 20 nt, Homo sapiens
agguuuggacaaaauggaau

SEQ ID NO: 17840 - RNA, 15 nt, Homo sapiens
uuggaagguauuuaa

SEQ ID NO: 17841 - RNA, 17 nt, Homo sapiens
caauucaauacagauca

SEQ ID NO: 17842 - RNA, 15 nt, Homo sapiens
auguguaagacaaaa

SEQ ID NO: 17843 - RNA, 16 nt, Homo sapiens
cuagaauuugauaugu

SEQ ID NO: 17844 - RNA, 22 nt, Homo sapiens
uguaagacaaaaagcuacuuau

SEQ ID NO: 17845 - RNA, 15 nt, Homo sapiens
aaaauggaauacucu

SEQ ID NO: 17846 - RNA, 18 nt, Homo sapiens
cauuggaaacaagucagu

SEQ ID NO: 17847 - RNA, 16 nt, Homo sapiens
uccauucuuccuccca

SEQ ID NO: 17848 - RNA, 17 nt, Homo sapiens
agucagucauucagaua

SEQ ID NO: 17849 - RNA, 21 nt, Homo sapiens
ugaauaaauuuucuucuuggu

SEQ ID NO: 17850 - RNA, 18 nt, Homo sapiens
auaaauaucuagaaauga

SEQ ID NO: 17851 - RNA, 16 nt, Homo sapiens
ggagcuagaauuugau

SEQ ID NO: 17852 - RNA, 15 nt, Homo sapiens
acaaaaagcuacuua

SEQ ID NO: 17853 - RNA, 17 nt, Homo sapiens
uuucagugcacuaaugu

SEQ ID NO: 17854 - RNA, 19 nt, Homo sapiens
gcuggagcugccucucuca

SEQ ID NO: 17855 - RNA, 23 nt, Homo sapiens
cugccucucucauccacuuucca

SEQ ID NO: 17856 - RNA, 21 nt, Homo sapiens
ucccacacuguccauucuucc

SEQ ID NO: 17857 - RNA, 22 nt, Homo sapiens
gaagagguuuuaaagcuuccau

SEQ ID NO: 17858 - RNA, 14 nt, Homo sapiens
uucaaauguauuac

SEQ ID NO: 17859 - RNA, 12 nt, Homo sapiens
uucccacacugu

SEQ ID NO: 17860 - RNA, 14 nt, Homo sapiens
agauaugauucaaa

SEQ ID NO: 17861 - RNA, 13 nt, Homo sapiens
uucccacacuguc

SEQ ID NO: 17862 - RNA, 15 nt, Homo sapiens
cuccaagaauuucua

SEQ ID NO: 17863 - RNA, 17 nt, Homo sapiens
cuaauguguaagacaaa

SEQ ID NO: 17864 - RNA, 23 nt, Homo sapiens
ucauguuuuugcuuuucaacaca

SEQ ID NO: 17865 - RNA, 20 nt, Homo sapiens
uguaauagaaauaaaccuau

SEQ ID NO: 17866 - RNA, 21 nt, Homo sapiens
uagcaaaucuacugucaauuu

SEQ ID NO: 17867 - RNA, 14 nt, Homo sapiens
ucuugguucugaaa

SEQ ID NO: 17868 - RNA, 21 nt, Homo sapiens
gggaaugaagauacugaaaua

SEQ ID NO: 17869 - RNA, 22 nt, Homo sapiens
uuaaauagcuuuuuucucugau

SEQ ID NO: 17870 - RNA, 13 nt, Homo sapiens
aauuauauaguua

SEQ ID NO: 17871 - RNA, 19 nt, Homo sapiens
cuuuucaacacacaaagca

SEQ ID NO: 17872 - RNA, 13 nt, Homo sapiens
aggacugaauuau

SEQ ID NO: 17873 - RNA, 14 nt, Homo sapiens
cuguccauucuucc

SEQ ID NO: 17874 - RNA, 22 nt, Homo sapiens
uuuggcagugauauucaucaua

SEQ ID NO: 17875 - RNA, 19 nt, Homo sapiens
aauaucuccgucaacucau

SEQ ID NO: 17876 - RNA, 18 nt, Homo sapiens
agcuagaauuugauaugu

SEQ ID NO: 17877 - RNA, 14 nt, Homo sapiens
gcuccaagaauuuc

SEQ ID NO: 17878 - RNA, 19 nt, Homo sapiens
aauuucuaggacugaauua

SEQ ID NO: 17879 - RNA, 17 nt, Homo sapiens
cagucauucagauauga

SEQ ID NO: 17880 - RNA, 15 nt, Homo sapiens
uucuucuugguucug

SEQ ID NO: 17881 - RNA, 20 nt, Homo sapiens
aauuuucuucuugguucuga

SEQ ID NO: 17882 - RNA, 19 nt, Homo sapiens
guccccagagcuacaggcc

SEQ ID NO: 17883 - RNA, 16 nt, Homo sapiens
ccuuccccuucccaca

SEQ ID NO: 17884 - RNA, 15 nt, Homo sapiens
uucccacacugucca

SEQ ID NO: 17885 - RNA, 18 nt, Homo sapiens
auauuuuuuucugaaauu

SEQ ID NO: 17886 - RNA, 15 nt, Homo sapiens
aaaaggugucuugcu

SEQ ID NO: 17887 - RNA, 14 nt, Homo sapiens
ccucuugcaauuca

SEQ ID NO: 17888 - RNA, 15 nt, Homo sapiens
ugccucuugcaauuc

SEQ ID NO: 17889 - RNA, 17 nt, Homo sapiens
aauagaaauaaaccuau

SEQ ID NO: 17890 - RNA, 23 nt, Homo sapiens
gagagucuauuuacggaacucaa

SEQ ID NO: 17891 - RNA, 20 nt, Homo sapiens
caauuuggcagugauauuca

SEQ ID NO: 17892 - RNA, 14 nt, Homo sapiens
cugauguaaguaaa

SEQ ID NO: 17893 - RNA, 20 nt, Homo sapiens
uuucucugauacagaaaagu

SEQ ID NO: 17894 - RNA, 18 nt, Homo sapiens
accucuaaauucuuucau

SEQ ID NO: 17895 - RNA, 15 nt, Homo sapiens
aucuauauuuuacau

SEQ ID NO: 17896 - RNA, 17 nt, Homo sapiens
uucagauaugauucaaa

SEQ ID NO: 17897 - RNA, 19 nt, Homo sapiens
ccugaauuuaaauagcuuu

SEQ ID NO: 17898 - RNA, 23 nt, Homo sapiens
aaugccccugaauuuaaauagcu

SEQ ID NO: 17899 - RNA, 15 nt, Homo sapiens
cauauuuucaugcug

SEQ ID NO: 17900 - RNA, 15 nt, Homo sapiens
aauuuaaauagcuuu

SEQ ID NO: 17901 - RNA, 14 nt, Homo sapiens
agcuuuuguagaag

SEQ ID NO: 17902 - RNA, 16 nt, Homo sapiens
aaucuacugucaauuu

SEQ ID NO: 17903 - RNA, 15 nt, Homo sapiens
aguuccuucugcucc

SEQ ID NO: 17904 - RNA, 16 nt, Homo sapiens
uggagcuagaauuuga

SEQ ID NO: 17905 - RNA, 19 nt, Homo sapiens
guaaguaaacggucucuca

SEQ ID NO: 17906 - RNA, 23 nt, Homo sapiens
auuuaaauagcuuuuuucucuga

SEQ ID NO: 17907 - RNA, 14 nt, Homo sapiens
ucccacacugucca

SEQ ID NO: 17908 - RNA, 17 nt, Homo sapiens
cauaaauuuaguauuuu

SEQ ID NO: 17909 - RNA, 17 nt, Homo sapiens
uuuugcuuuucaacaca

SEQ ID NO: 17910 - RNA, 11 nt, Homo sapiens
acacuguccau

SEQ ID NO: 17911 - RNA, 22 nt, Homo sapiens
uguaauagaaauaaaccuauga

SEQ ID NO: 17912 - RNA, 18 nt, Homo sapiens
ugccucucucauccacuu

SEQ ID NO: 17913 - RNA, 13 nt, Homo sapiens
ggcuggagcugcc

SEQ ID NO: 17914 - RNA, 21 nt, Homo sapiens
aaguugaauuuuacauggcug

SEQ ID NO: 17915 - RNA, 16 nt, Homo sapiens
aauguguaagacaaaa

SEQ ID NO: 17916 - RNA, 22 nt, Homo sapiens
uaauagaaauaaaccuaugaau

SEQ ID NO: 17917 - RNA, 18 nt, Homo sapiens
ggaggaaaaggugucuug

SEQ ID NO: 17918 - RNA, 15 nt, Homo sapiens
guaaacggucucuca

SEQ ID NO: 17919 - RNA, 18 nt, Homo sapiens
uccaauaaagaguuccuu

SEQ ID NO: 17920 - RNA, 21 nt, Homo sapiens
auaaauuuucuucuugguucu

SEQ ID NO: 17921 - RNA, 18 nt, Homo sapiens
uuaagagagucuauuuac

SEQ ID NO: 17922 - RNA, 22 nt, Homo sapiens
auauuuuuuucugaaauuuccu

SEQ ID NO: 17923 - RNA, 19 nt, Homo sapiens
ucaucauaauaaauaucua

SEQ ID NO: 17924 - RNA, 23 nt, Homo sapiens
cucuugcaauucaauacagauca

SEQ ID NO: 17925 - RNA, 22 nt, Homo sapiens
acugucaauuuggcagugauau

SEQ ID NO: 17926 - RNA, 14 nt, Homo sapiens
cuucuugguucuga

SEQ ID NO: 17927 - RNA, 12 nt, Homo sapiens
aaaccuaugaau

SEQ ID NO: 17928 - RNA, 23 nt, Homo sapiens
aagauucaaugccccugaauuua

SEQ ID NO: 17929 - RNA, 22 nt, Homo sapiens
guaauuauauaguuacccaaau

SEQ ID NO: 17930 - RNA, 17 nt, Homo sapiens
ugaacaggauauucuca

SEQ ID NO: 17931 - RNA, 21 nt, Homo sapiens
auucuuccucccauucaggau

SEQ ID NO: 17932 - RNA, 18 nt, Homo sapiens
ucuaggacugaauuauga

SEQ ID NO: 17933 - RNA, 20 nt, Homo sapiens
cagcugagcagauguaauag

SEQ ID NO: 17934 - RNA, 18 nt, Homo sapiens
guucaugaaagauucaau

SEQ ID NO: 17935 - RNA, 18 nt, Homo sapiens
uucaucauaauaaauauc

SEQ ID NO: 17936 - RNA, 18 nt, Homo sapiens
aauagaaauaaaccuaug

SEQ ID NO: 17937 - RNA, 13 nt, Homo sapiens
cggaacucaaaua

SEQ ID NO: 17938 - RNA, 15 nt, Homo sapiens
aguugaauuuuacau

SEQ ID NO: 17939 - RNA, 14 nt, Homo sapiens
gaagcacagugauc

SEQ ID NO: 17940 - RNA, 20 nt, Homo sapiens
auaaaccuaugaauaaauuu

SEQ ID NO: 17941 - RNA, 18 nt, Homo sapiens
agaaauaaaccuaugaau

SEQ ID NO: 17942 - RNA, 16 nt, Homo sapiens
uugagauugugaaauu

SEQ ID NO: 17943 - RNA, 22 nt, Homo sapiens
ugccucucucauccacuuucca

SEQ ID NO: 17944 - RNA, 15 nt, Homo sapiens
cccuucccacacugu

SEQ ID NO: 17945 - RNA, 22 nt, Homo sapiens
uaaauauaaagcaagauaauaa

SEQ ID NO: 17946 - RNA, 14 nt, Homo sapiens
cuauuuaagagaac

SEQ ID NO: 17947 - RNA, 11 nt, Homo sapiens
aguuaagaauc

SEQ ID NO: 17948 - RNA, 14 nt, Homo sapiens
auaguucuacucca

SEQ ID NO: 17949 - RNA, 16 nt, Homo sapiens
accuuacuucuucuca

SEQ ID NO: 17950 - RNA, 21 nt, Homo sapiens
acaggaauuuucauuguucua

SEQ ID NO: 17951 - RNA, 13 nt, Homo sapiens
uguucuauaacaa

SEQ ID NO: 17952 - RNA, 23 nt, Homo sapiens
uaaauauaaagcaagauaauaaa

SEQ ID NO: 17953 - RNA, 21 nt, Homo sapiens
cgauuauuauuuuagagcauc

SEQ ID NO: 17954 - RNA, 22 nt, Homo sapiens
aguucuacuccauuaaauauaa

SEQ ID NO: 17955 - RNA, 15 nt, Homo sapiens
accuuacuucuucuc

SEQ ID NO: 17956 - RNA, 12 nt, Homo sapiens
aagcaaauauaa

SEQ ID NO: 17957 - RNA, 21 nt, Homo sapiens
aagaucugcaacuacuaucca

SEQ ID NO: 17958 - RNA, 21 nt, Homo sapiens
aaucuuuauaguucuacucca

SEQ ID NO: 17959 - RNA, 17 nt, Homo sapiens
uauuuuagagcaucuca

SEQ ID NO: 17960 - RNA, 19 nt, Homo sapiens
auuauuuuagagcaucuca

SEQ ID NO: 17961 - RNA, 18 nt, Homo sapiens
uauuuuagagcaucucau

SEQ ID NO: 17962 - RNA, 22 nt, Homo sapiens
uuuauaauguagcagcucauaa

SEQ ID NO: 17963 - RNA, 20 nt, Homo sapiens
cugcaacuacuauccaacuu

SEQ ID NO: 17964 - RNA, 18 nt, Homo sapiens
ccaagaagauaaucucca

SEQ ID NO: 17965 - RNA, 13 nt, Homo sapiens
uucauuguucuau

SEQ ID NO: 17966 - RNA, 22 nt, Homo sapiens
uguguuccuaacaggaauuuuc

SEQ ID NO: 17967 - RNA, 15 nt, Homo sapiens
ggcuuucccaacagc

SEQ ID NO: 17968 - RNA, 18 nt, Homo sapiens
acagcaacuuguguuccu

SEQ ID NO: 17969 - RNA, 16 nt, Homo sapiens
uaacaggaauuuucau

SEQ ID NO: 17970 - RNA, 21 nt, Homo sapiens
ccaagaagauaaucuccaaag

SEQ ID NO: 17971 - RNA, 22 nt, Homo sapiens
agcuccaccuuacuucuucuca

SEQ ID NO: 17972 - RNA, 15 nt, Homo sapiens
aagagaacaagcaaa

SEQ ID NO: 17973 - RNA, 18 nt, Homo sapiens
uaauguagcagcucauaa

SEQ ID NO: 17974 - RNA, 11 nt, Homo sapiens
agaucugcaac

SEQ ID NO: 17975 - RNA, 20 nt, Homo sapiens
ccaagaagauaaucuccaaa

SEQ ID NO: 17976 - RNA, 14 nt, Homo sapiens
guagcagcucauaa

SEQ ID NO: 17977 - RNA, 20 nt, Homo sapiens
agaucugcaacuacuaucca

SEQ ID NO: 17978 - RNA, 19 nt, Homo sapiens
uaacaacaacaacaaaagc

SEQ ID NO: 17979 - RNA, 18 nt, Homo sapiens
uuauaauguagcagcuca

SEQ ID NO: 17980 - RNA, 20 nt, Homo sapiens
acuucuucucauacuauuua

SEQ ID NO: 17981 - RNA, 18 nt, Homo sapiens
aagaucugcaacuacuau

SEQ ID NO: 17982 - RNA, 15 nt, Homo sapiens
gcuuucccaacagcu

SEQ ID NO: 17983 - RNA, 18 nt, Homo sapiens
uuauuuuagagcaucuca

SEQ ID NO: 17984 - RNA, 17 nt, Homo sapiens
aauguagcagcucauaa

SEQ ID NO: 17985 - RNA, 22 nt, Homo sapiens
accuuacuucuucucauacuau

SEQ ID NO: 17986 - RNA, 14 nt, Homo sapiens
agcagcucauaaau

SEQ ID NO: 17987 - RNA, 21 nt, Homo sapiens
auuuuagagcaucucauuuau

SEQ ID NO: 17988 - RNA, 14 nt, Homo sapiens
auguagcagcucau

SEQ ID NO: 17989 - RNA, 20 nt, Homo sapiens
caaaguuaagaaucuuuaua

SEQ ID NO: 17990 - RNA, 22 nt, Homo sapiens
cauuuauaauguagcagcucau

SEQ ID NO: 17991 - RNA, 17 nt, Homo sapiens
aacagcuccaccuuacu

SEQ ID NO: 17992 - RNA, 13 nt, Homo sapiens
uacuucuucucau

SEQ ID NO: 17993 - RNA, 21 nt, Homo sapiens
uuauuauuuuagagcaucuca

SEQ ID NO: 17994 - RNA, 21 nt, Homo sapiens
uauuauuuuagagcaucucau

SEQ ID NO: 17995 - RNA, 21 nt, Homo sapiens
cuaacaggaauuuucauuguu

SEQ ID NO: 17996 - RNA, 18 nt, Homo sapiens
ucaaaguuaagaaucuuu

SEQ ID NO: 17997 - RNA, 20 nt, Homo sapiens
ucaaaguuaagaaucuuuau

SEQ ID NO: 17998 - RNA, 16 nt, Homo sapiens
aagaucugcaacuacu

SEQ ID NO: 17999 - RNA, 17 nt, Homo sapiens
auuuuagagcaucucau

SEQ ID NO: 18000 - RNA, 17 nt, Homo sapiens
cuucucauacuauuuaa

SEQ ID NO: 18001 - RNA, 14 nt, Homo sapiens
aauauaaagcaaga

SEQ ID NO: 18002 - RNA, 18 nt, Homo sapiens
uuacuucuucucauacua

SEQ ID NO: 18003 - RNA, 13 nt, Homo sapiens
auuucugcuuuca

SEQ ID NO: 18004 - RNA, 20 nt, Homo sapiens
uaaagaucugcaacuacuau

SEQ ID NO: 18005 - RNA, 22 nt, Homo sapiens
uacuauuuaagagaacaagcaa

SEQ ID NO: 18006 - RNA, 17 nt, Homo sapiens
auuuaagagaacaagca

SEQ ID NO: 18007 - RNA, 13 nt, Homo sapiens
uuacuucuucuca

SEQ ID NO: 18008 - RNA, 22 nt, Homo sapiens
guucuauaacaacaacaacaaa

SEQ ID NO: 18009 - RNA, 14 nt, Homo sapiens
acaggaauuuucau

SEQ ID NO: 18010 - RNA, 16 nt, Homo sapiens
guucuauaacaacaac

SEQ ID NO: 18011 - RNA, 19 nt, Homo sapiens
aagcaaauauaaacagcaa

SEQ ID NO: 18012 - RNA, 19 nt, Homo sapiens
augggcuuucccaacagcu

SEQ ID NO: 18013 - RNA, 12 nt, Homo sapiens
uccuaacaggaa

SEQ ID NO: 18014 - RNA, 19 nt, Homo sapiens
caaaguuaagaaucuuuau

SEQ ID NO: 18015 - RNA, 20 nt, Homo sapiens
uacuauuuaagagaacaagc

SEQ ID NO: 18016 - RNA, 22 nt, Homo sapiens
acuauuuaagagaacaagcaaa

SEQ ID NO: 18017 - RNA, 15 nt, Homo sapiens
uauuaaagaucugca

SEQ ID NO: 18018 - RNA, 18 nt, Homo sapiens
caccuuacuucuucucau

SEQ ID NO: 18019 - RNA, 19 nt, Homo sapiens
uccuaacaggaauuuucau

SEQ ID NO: 18020 - RNA, 21 nt, Homo sapiens
cuccaccuuacuucuucucau

SEQ ID NO: 18021 - RNA, 16 nt, Homo sapiens
auaauguagcagcuca

SEQ ID NO: 18022 - RNA, 12 nt, Homo sapiens
ucauuguucuau

SEQ ID NO: 18023 - RNA, 22 nt, Homo sapiens
uauuaaagaucugcaacuacua

SEQ ID NO: 18024 - RNA, 12 nt, Homo sapiens
agagcaucucau

SEQ ID NO: 18025 - RNA, 12 nt, Homo sapiens
uaguucuacucc

SEQ ID NO: 18026 - RNA, 20 nt, Homo sapiens
auuauuuuagagcaucucau

SEQ ID NO: 18027 - RNA, 16 nt, Homo sapiens
uauaguucuacuccau

SEQ ID NO: 18028 - RNA, 19 nt, Homo sapiens
gaucugcaacuacuaucca

SEQ ID NO: 18029 - RNA, 18 nt, Homo sapiens
auaaacagcaacuugugu

SEQ ID NO: 18030 - RNA, 15 nt, Homo sapiens
acuucuucucauacu

SEQ ID NO: 18031 - RNA, 21 nt, Homo sapiens
uccauuaaauauaaagcaaga

SEQ ID NO: 18032 - RNA, 18 nt, Homo sapiens
uuccuaacaggaauuuuc

SEQ ID NO: 18033 - RNA, 20 nt, Homo sapiens
uucaaaguuaagaaucuuua

SEQ ID NO: 18034 - RNA, 23 nt, Homo sapiens
agcuccaccuuacuucuucucau

SEQ ID NO: 18035 - RNA, 16 nt, Homo sapiens
ccaacagcuccaccuu

SEQ ID NO: 18036 - RNA, 19 nt, Homo sapiens
aucuuuauaguucuacucc

SEQ ID NO: 18037 - RNA, 16 nt, Homo sapiens
uccauuaaauauaaag

SEQ ID NO: 18038 - RNA, 15 nt, Homo sapiens
uacuucuucucauac

SEQ ID NO: 18039 - RNA, 17 nt, Homo sapiens
accuuacuucuucucau

SEQ ID NO: 18040 - RNA, 22 nt, Homo sapiens
aaucuuuauaguucuacuccau

SEQ ID NO: 18041 - RNA, 17 nt, Homo sapiens
cugcaacuacuauccaa

SEQ ID NO: 18042 - RNA, 21 nt, Homo sapiens
caccuuacuucuucucauacu

SEQ ID NO: 18043 - RNA, 15 nt, Homo sapiens
ugcaacuacuaucca

SEQ ID NO: 18044 - RNA, 21 nt, Homo sapiens
uaagagaacaagcaaauauaa

SEQ ID NO: 18045 - RNA, 17 nt, Homo sapiens
uccaccuuacuucuucu

SEQ ID NO: 18046 - RNA, 16 nt, Homo sapiens
gcaucucauuuauaau

SEQ ID NO: 18047 - RNA, 14 nt, Homo sapiens
uccauuaaauauaa

SEQ ID NO: 18048 - RNA, 15 nt, Homo sapiens
uccaccuuacuucuu

SEQ ID NO: 18049 - RNA, 18 nt, Homo sapiens
uccaccuuacuucuucuc

SEQ ID NO: 18050 - RNA, 12 nt, Homo sapiens
acaacaaaagcg

SEQ ID NO: 18051 - RNA, 13 nt, Homo sapiens
gaaucuuuauagu

SEQ ID NO: 18052 - RNA, 14 nt, Homo sapiens
gaaucuuuauaguu

SEQ ID NO: 18053 - RNA, 18 nt, Homo sapiens
gaaaaugguauuaaagau

SEQ ID NO: 18054 - RNA, 17 nt, Homo sapiens
acagcuccaccuuacuu

SEQ ID NO: 18055 - RNA, 12 nt, Homo sapiens
accuuacuucuu

SEQ ID NO: 18056 - RNA, 16 nt, Homo sapiens
acuauccaacuuauau

SEQ ID NO: 18057 - RNA, 15 nt, Homo sapiens
aucuuuauaguucua

SEQ ID NO: 18058 - RNA, 22 nt, Homo sapiens
aagagaacaagcaaauauaaac

SEQ ID NO: 18059 - RNA, 13 nt, Homo sapiens
aaugguauuaaag

SEQ ID NO: 18060 - RNA, 22 nt, Homo sapiens
acgaugggcuuucccaacagcu

SEQ ID NO: 18061 - RNA, 17 nt, Homo sapiens
acuucuucucauacuau

SEQ ID NO: 18062 - RNA, 19 nt, Homo sapiens
aaagaucugcaacuacuau

SEQ ID NO: 18063 - RNA, 10 nt, Homo sapiens
aaauauaaag

SEQ ID NO: 18064 - RNA, 21 nt, Homo sapiens
auccaacuuauauuucugcuu

SEQ ID NO: 18065 - RNA, 13 nt, Homo sapiens
auuucugcuuuca

SEQ ID NO: 18066 - RNA, 20 nt, Homo sapiens
ccaagaagauaaucuccaaa

SEQ ID NO: 18067 - RNA, 15 nt, Homo sapiens
uacuucuucucauac

SEQ ID NO: 18068 - RNA, 19 nt, Homo sapiens
caaaguuaagaaucuuuau

SEQ ID NO: 18069 - RNA, 19 nt, Homo sapiens
uaacaacaacaacaaaagc

SEQ ID NO: 18070 - RNA, 16 nt, Homo sapiens
guucuauaacaacaac

SEQ ID NO: 18071 - RNA, 19 nt, Homo sapiens
aagcaaauauaaacagcaa

SEQ ID NO: 18072 - RNA, 15 nt, Homo sapiens
uauuaaagaucugca

SEQ ID NO: 18073 - RNA, 21 nt, Homo sapiens
aaucuuuauaguucuacucca

SEQ ID NO: 18074 - RNA, 16 nt, Homo sapiens
uaacaggaauuuucau

SEQ ID NO: 18075 - RNA, 19 nt, Homo sapiens
auuauuuuagagcaucuca

SEQ ID NO: 18076 - RNA, 14 nt, Homo sapiens
auguagcagcucau

SEQ ID NO: 18077 - RNA, 14 nt, Homo sapiens
guagcagcucauaa

SEQ ID NO: 18078 - RNA, 18 nt, Homo sapiens
caccuuacuucuucucau

SEQ ID NO: 18079 - RNA, 15 nt, Homo sapiens
acuucuucucauacu

SEQ ID NO: 18080 - RNA, 13 nt, Homo sapiens
uucauuguucuau

SEQ ID NO: 18081 - RNA, 19 nt, Homo sapiens
aucuuuauaguucuacucc

SEQ ID NO: 18082 - RNA, 22 nt, Homo sapiens
agcuccaccuuacuucuucuca

SEQ ID NO: 18083 - RNA, 18 nt, Homo sapiens
uuacuucuucucauacua

SEQ ID NO: 18084 - RNA, 22 nt, Homo sapiens
aaucuuuauaguucuacuccau

SEQ ID NO: 18085 - RNA, 11 nt, Homo sapiens
agaucugcaac

SEQ ID NO: 18086 - RNA, 18 nt, Homo sapiens
uuauaauguagcagcuca

SEQ ID NO: 18087 - RNA, 18 nt, Homo sapiens
acagcaacuuguguuccu

SEQ ID NO: 18088 - RNA, 21 nt, Homo sapiens
ccaagaagauaaucuccaaag

SEQ ID NO: 18089 - RNA, 20 nt, Homo sapiens
caaaguuaagaaucuuuaua

SEQ ID NO: 18090 - RNA, 15 nt, Homo sapiens
aagagaacaagcaaa

SEQ ID NO: 18091 - RNA, 21 nt, Homo sapiens
caccuuacuucuucucauacu

SEQ ID NO: 18092 - RNA, 18 nt, Homo sapiens
uuccuaacaggaauuuuc

SEQ ID NO: 18093 - RNA, 18 nt, Homo sapiens
ccaagaagauaaucucca

SEQ ID NO: 18094 - RNA, 14 nt, Homo sapiens
aauauaaagcaaga

SEQ ID NO: 18095 - RNA, 18 nt, Homo sapiens
uauuuuagagcaucucau

SEQ ID NO: 18096 - RNA, 20 nt, Homo sapiens
uacuauuuaagagaacaagc

SEQ ID NO: 18097 - RNA, 12 nt, Homo sapiens
ucauuguucuau

SEQ ID NO: 18098 - RNA, 22 nt, Homo sapiens
uuuauaauguagcagcucauaa

SEQ ID NO: 18099 - RNA, 20 nt, Homo sapiens
cugcaacuacuauccaacuu

SEQ ID NO: 18100 - RNA, 23 nt, Homo sapiens
agcuccaccuuacuucuucucau

SEQ ID NO: 18101 - RNA, 17 nt, Homo sapiens
auuuaagagaacaagca

SEQ ID NO: 18102 - RNA, 19 nt, Homo sapiens
gaucugcaacuacuaucca

SEQ ID NO: 18103 - RNA, 20 nt, Homo sapiens
ucaaaguuaagaaucuuuau

SEQ ID NO: 18104 - RNA, 17 nt, Homo sapiens
uauuuuagagcaucuca

SEQ ID NO: 18105 - RNA, 18 nt, Homo sapiens
ucaaaguuaagaaucuuu

SEQ ID NO: 18106 - RNA, 12 nt, Homo sapiens
uaguucuacucc

SEQ ID NO: 18107 - RNA, 16 nt, Homo sapiens
uauaguucuacuccau

SEQ ID NO: 18108 - RNA, 22 nt, Homo sapiens
uacuauuuaagagaacaagcaa

SEQ ID NO: 18109 - RNA, 18 nt, Homo sapiens
uaauguagcagcucauaa

SEQ ID NO: 18110 - RNA, 16 nt, Homo sapiens
ccaacagcuccaccuu

SEQ ID NO: 18111 - RNA, 12 nt, Homo sapiens
uccuaacaggaa

SEQ ID NO: 18112 - RNA, 18 nt, Homo sapiens
uuauuuuagagcaucuca

SEQ ID NO: 18113 - RNA, 19 nt, Homo sapiens
uccuaacaggaauuuucau

SEQ ID NO: 18114 - RNA, 20 nt, Homo sapiens
agaucugcaacuacuaucca

SEQ ID NO: 18115 - RNA, 19 nt, Homo sapiens
augggcuuucccaacagcu

SEQ ID NO: 18116 - RNA, 22 nt, Homo sapiens
guucuauaacaacaacaacaaa

SEQ ID NO: 18117 - RNA, 17 nt, Homo sapiens
cuucucauacuauuuaa

SEQ ID NO: 18118 - RNA, 16 nt, Homo sapiens
auaauguagcagcuca

SEQ ID NO: 18119 - RNA, 22 nt, Homo sapiens
acuauuuaagagaacaagcaaa

SEQ ID NO: 18120 - RNA, 13 nt, Homo sapiens
uuacuucuucuca

SEQ ID NO: 18121 - RNA, 21 nt, Homo sapiens
cuccaccuuacuucuucucau

SEQ ID NO: 18122 - RNA, 16 nt, Homo sapiens
uccauuaaauauaaag

SEQ ID NO: 18123 - RNA, 20 nt, Homo sapiens
acuucuucucauacuauuua

SEQ ID NO: 18124 - RNA, 22 nt, Homo sapiens
uauuaaagaucugcaacuacua

SEQ ID NO: 18125 - RNA, 13 nt, Homo sapiens
uacuucuucucau

SEQ ID NO: 18126 - RNA, 21 nt, Homo sapiens
auuuuagagcaucucauuuau

SEQ ID NO: 18127 - RNA, 14 nt, Homo sapiens
acaggaauuuucau

SEQ ID NO: 18128 - RNA, 20 nt, Homo sapiens
uucaaaguuaagaaucuuua

SEQ ID NO: 18129 - RNA, 22 nt, Homo sapiens
cauuuauaauguagcagcucau

SEQ ID NO: 18130 - RNA, 17 nt, Homo sapiens
aacagcuccaccuuacu

SEQ ID NO: 18131 - RNA, 12 nt, Homo sapiens
agagcaucucau

SEQ ID NO: 18132 - RNA, 20 nt, Homo sapiens
auuauuuuagagcaucucau

SEQ ID NO: 18133 - RNA, 18 nt, Homo sapiens
auaaacagcaacuugugu

SEQ ID NO: 18134 - RNA, 21 nt, Homo sapiens
uccauuaaauauaaagcaaga

SEQ ID NO: 18135 - RNA, 15 nt, Homo sapiens
ugcaacuacuaucca

SEQ ID NO: 18136 - RNA, 21 nt, Homo sapiens
cuaacaggaauuuucauuguu

SEQ ID NO: 18137 - RNA, 22 nt, Homo sapiens
uguguuccuaacaggaauuuuc

SEQ ID NO: 18138 - RNA, 15 nt, Homo sapiens
ggcuuucccaacagc

SEQ ID NO: 18139 - RNA, 17 nt, Homo sapiens
accuuacuucuucucau

SEQ ID NO: 18140 - RNA, 21 nt, Homo sapiens
uauuauuuuagagcaucucau

SEQ ID NO: 18141 - RNA, 18 nt, Homo sapiens
aagaucugcaacuacuau

SEQ ID NO: 18142 - RNA, 17 nt, Homo sapiens
cugcaacuacuauccaa

SEQ ID NO: 18143 - RNA, 16 nt, Homo sapiens
aagaucugcaacuacu

SEQ ID NO: 18144 - RNA, 17 nt, Homo sapiens
auuuuagagcaucucau

SEQ ID NO: 18145 - RNA, 15 nt, Homo sapiens
gcuuucccaacagcu

SEQ ID NO: 18146 - RNA, 20 nt, Homo sapiens
uaaagaucugcaacuacuau

SEQ ID NO: 18147 - RNA, 21 nt, Homo sapiens
uuauuauuuuagagcaucuca

SEQ ID NO: 18148 - RNA, 14 nt, Homo sapiens
agcagcucauaaau

SEQ ID NO: 18149 - RNA, 22 nt, Homo sapiens
accuuacuucuucucauacuau

SEQ ID NO: 18150 - RNA, 17 nt, Homo sapiens
aauguagcagcucauaa

SEQ ID NO: 18151 - RNA, 20 nt, Homo sapiens
ucuucucauacuauuuaaga

SEQ ID NO: 18152 - RNA, 21 nt, Homo sapiens
auaguucuacuccauuaaaua

SEQ ID NO: 18153 - RNA, 13 nt, Homo sapiens
augguauuaaaga

SEQ ID NO: 18154 - RNA, 17 nt, Homo sapiens
auguagcagcucauaaa

SEQ ID NO: 18155 - RNA, 16 nt, Homo sapiens
uacuucuucucauacu

SEQ ID NO: 18156 - RNA, 17 nt, Homo sapiens
uacuucuucucauacua

SEQ ID NO: 18157 - RNA, 16 nt, Homo sapiens
auguagcagcucauaa

SEQ ID NO: 18158 - RNA, 16 nt, Homo sapiens
uauaguucuacuccau

SEQ ID NO: 18159 - RNA, 12 nt, Homo sapiens
ucauuguucuau

SEQ ID NO: 18160 - RNA, 21 nt, Homo sapiens
aaucuuuauaguucuacucca

SEQ ID NO: 18161 - RNA, 19 nt, Homo sapiens
caaaguuaagaaucuuuau

SEQ ID NO: 18162 - RNA, 22 nt, Homo sapiens
uguguuccuaacaggaauuuuc

SEQ ID NO: 18163 - RNA, 20 nt, Homo sapiens
ucaaaguuaagaaucuuuau

SEQ ID NO: 18164 - RNA, 15 nt, Homo sapiens
uacuucuucucauac

SEQ ID NO: 18165 - RNA, 12 nt, Homo sapiens
uaguucuacucc

SEQ ID NO: 18166 - RNA, 16 nt, Homo sapiens
aagaucugcaacuacu

SEQ ID NO: 18167 - RNA, 20 nt, Homo sapiens
caaaguuaagaaucuuuaua

SEQ ID NO: 18168 - RNA, 11 nt, Homo sapiens
agaucugcaac

SEQ ID NO: 18169 - RNA, 18 nt, Homo sapiens
caccuuacuucuucucau

SEQ ID NO: 18170 - RNA, 18 nt, Homo sapiens
uauuuuagagcaucucau

SEQ ID NO: 18171 - RNA, 22 nt, Homo sapiens
agcuccaccuuacuucuucuca

SEQ ID NO: 18172 - RNA, 17 nt, Homo sapiens
aacagcuccaccuuacu

SEQ ID NO: 18173 - RNA, 21 nt, Homo sapiens
caccuuacuucuucucauacu

SEQ ID NO: 18174 - RNA, 16 nt, Homo sapiens
uaacaggaauuuucau

SEQ ID NO: 18175 - RNA, 17 nt, Homo sapiens
uauuuuagagcaucuca

SEQ ID NO: 18176 - RNA, 18 nt, Homo sapiens
acagcaacuuguguuccu

SEQ ID NO: 18177 - RNA, 14 nt, Homo sapiens
agcagcucauaaau

SEQ ID NO: 18178 - RNA, 21 nt, Homo sapiens
cuaacaggaauuuucauuguu

SEQ ID NO: 18179 - RNA, 20 nt, Homo sapiens
agaucugcaacuacuaucca

SEQ ID NO: 18180 - RNA, 18 nt, Homo sapiens
uuacuucuucucauacua

SEQ ID NO: 18181 - RNA, 14 nt, Homo sapiens
auguagcagcucau

SEQ ID NO: 18182 - RNA, 21 nt, Homo sapiens
uauuauuuuagagcaucucau

SEQ ID NO: 18183 - RNA, 20 nt, Homo sapiens
uucaaaguuaagaaucuuua

SEQ ID NO: 18184 - RNA, 15 nt, Homo sapiens
acuucuucucauacu

SEQ ID NO: 18185 - RNA, 22 nt, Homo sapiens
acuauuuaagagaacaagcaaa

SEQ ID NO: 18186 - RNA, 15 nt, Homo sapiens
uauuaaagaucugca

SEQ ID NO: 18187 - RNA, 12 nt, Homo sapiens
agagcaucucau

SEQ ID NO: 18188 - RNA, 15 nt, Homo sapiens
ugcaacuacuaucca

SEQ ID NO: 18189 - RNA, 17 nt, Homo sapiens
cugcaacuacuauccaa

SEQ ID NO: 18190 - RNA, 20 nt, Homo sapiens
uaaagaucugcaacuacuau

SEQ ID NO: 18191 - RNA, 18 nt, Homo sapiens
aagaucugcaacuacuau

SEQ ID NO: 18192 - RNA, 19 nt, Homo sapiens
auuauuuuagagcaucuca

SEQ ID NO: 18193 - RNA, 19 nt, Homo sapiens
augggcuuucccaacagcu

SEQ ID NO: 18194 - RNA, 22 nt, Homo sapiens
uacuauuuaagagaacaagcaa

SEQ ID NO: 18195 - RNA, 18 nt, Homo sapiens
uaauguagcagcucauaa

SEQ ID NO: 18196 - RNA, 16 nt, Homo sapiens
uccauuaaauauaaag

SEQ ID NO: 18197 - RNA, 17 nt, Homo sapiens
auuuuagagcaucucau

SEQ ID NO: 18198 - RNA, 13 nt, Homo sapiens
uacuucuucucau

SEQ ID NO: 18199 - RNA, 21 nt, Homo sapiens
cuccaccuuacuucuucucau

SEQ ID NO: 18200 - RNA, 16 nt, Homo sapiens
auaauguagcagcuca

SEQ ID NO: 18201 - RNA, 19 nt, Homo sapiens
gaucugcaacuacuaucca

SEQ ID NO: 18202 - RNA, 19 nt, Homo sapiens
uccuaacaggaauuuucau

SEQ ID NO: 18203 - RNA, 22 nt, Homo sapiens
accuuacuucuucucauacuau

SEQ ID NO: 18204 - RNA, 17 nt, Homo sapiens
accuuacuucuucucau

SEQ ID NO: 18205 - RNA, 14 nt, Homo sapiens
aauauaaagcaaga

SEQ ID NO: 18206 - RNA, 20 nt, Homo sapiens
acuucuucucauacuauuua

SEQ ID NO: 18207 - RNA, 14 nt, Homo sapiens
acaggaauuuucau

SEQ ID NO: 18208 - RNA, 22 nt, Homo sapiens
cauuuauaauguagcagcucau

SEQ ID NO: 18209 - RNA, 12 nt, Homo sapiens
uccuaacaggaa

SEQ ID NO: 18210 - RNA, 17 nt, Homo sapiens
auuuaagagaacaagca

SEQ ID NO: 18211 - RNA, 20 nt, Homo sapiens
auuauuuuagagcaucucau

SEQ ID NO: 18212 - RNA, 22 nt, Homo sapiens
uauuaaagaucugcaacuacua

SEQ ID NO: 18213 - RNA, 17 nt, Homo sapiens
aauguagcagcucauaa

SEQ ID NO: 18214 - RNA, 21 nt, Homo sapiens
ccaagaagauaaucuccaaag

SEQ ID NO: 18215 - RNA, 13 nt, Homo sapiens
uuacuucuucuca

SEQ ID NO: 18216 - RNA, 21 nt, Homo sapiens
auuuuagagcaucucauuuau

SEQ ID NO: 18217 - RNA, 21 nt, Homo sapiens
uccauuaaauauaaagcaaga

SEQ ID NO: 18218 - RNA, 15 nt, Homo sapiens
aagagaacaagcaaa

SEQ ID NO: 18219 - RNA, 18 nt, Homo sapiens
uuauaauguagcagcuca

SEQ ID NO: 18220 - RNA, 23 nt, Homo sapiens
agcuccaccuuacuucuucucau

SEQ ID NO: 18221 - RNA, 13 nt, Homo sapiens
uucauuguucuau

SEQ ID NO: 18222 - RNA, 19 nt, Homo sapiens
aagcaaauauaaacagcaa

SEQ ID NO: 18223 - RNA, 17 nt, Homo sapiens
cuucucauacuauuuaa

SEQ ID NO: 18224 - RNA, 18 nt, Homo sapiens
ccaagaagauaaucucca

SEQ ID NO: 18225 - RNA, 20 nt, Homo sapiens
cugcaacuacuauccaacuu

SEQ ID NO: 18226 - RNA, 14 nt, Homo sapiens
guagcagcucauaa

SEQ ID NO: 18227 - RNA, 16 nt, Homo sapiens
ccaacagcuccaccuu

SEQ ID NO: 18228 - RNA, 18 nt, Homo sapiens
uuauuuuagagcaucuca

SEQ ID NO: 18229 - RNA, 22 nt, Homo sapiens
guucuauaacaacaacaacaaa

SEQ ID NO: 18230 - RNA, 20 nt, Homo sapiens
ccaagaagauaaucuccaaa

SEQ ID NO: 18231 - RNA, 19 nt, Homo sapiens
aucuuuauaguucuacucc

SEQ ID NO: 18232 - RNA, 22 nt, Homo sapiens
aaucuuuauaguucuacuccau

SEQ ID NO: 18233 - RNA, 18 nt, Homo sapiens
ucaaaguuaagaaucuuu

SEQ ID NO: 18234 - RNA, 22 nt, Homo sapiens
uuuauaauguagcagcucauaa

SEQ ID NO: 18235 - RNA, 13 nt, Homo sapiens
auuucugcuuuca

SEQ ID NO: 18236 - RNA, 19 nt, Homo sapiens
uaacaacaacaacaaaagc

SEQ ID NO: 18237 - RNA, 21 nt, Homo sapiens
uuauuauuuuagagcaucuca

SEQ ID NO: 18238 - RNA, 15 nt, Homo sapiens
ggcuuucccaacagc

SEQ ID NO: 18239 - RNA, 15 nt, Homo sapiens
gcuuucccaacagcu

SEQ ID NO: 18240 - RNA, 20 nt, Homo sapiens
uacuauuuaagagaacaagc

SEQ ID NO: 18241 - RNA, 18 nt, Homo sapiens
uuccuaacaggaauuuuc

SEQ ID NO: 18242 - RNA, 18 nt, Homo sapiens
auaaacagcaacuugugu

SEQ ID NO: 18243 - RNA, 16 nt, Homo sapiens
guucuauaacaacaac

SEQ ID NO: 18244 - RNA, 22 nt, Homo sapiens
uuaagaaucuuuauaguucuac

SEQ ID NO: 18245 - RNA, 13 nt, Homo sapiens
guucuauaacaac

SEQ ID NO: 18246 - RNA, 14 nt, Homo sapiens
guucuauaacaaca

SEQ ID NO: 18247 - RNA, 12 nt, Homo sapiens
guucuauaacaa

SEQ ID NO: 18248 - RNA, 13 nt, Homo sapiens
auuaaagaucugc

SEQ ID NO: 18249 - RNA, 19 nt, Homo sapiens
auccaacuuauauuucugc

SEQ ID NO: 18250 - RNA, 15 nt, Homo sapiens
aacaacaacaacaaa

SEQ ID NO: 18251 - RNA, 14 nt, Homo sapiens
agcaagauaauaaa

SEQ ID NO: 18252 - RNA, 19 nt, Homo sapiens
gaucugcaacuacuaucca

SEQ ID NO: 18253 - RNA, 15 nt, Homo sapiens
gcuuucccaacagcu

SEQ ID NO: 18254 - RNA, 14 nt, Homo sapiens
agcagcucauaaau

SEQ ID NO: 18255 - RNA, 16 nt, Homo sapiens
uauaguucuacuccau

SEQ ID NO: 18256 - RNA, 15 nt, Homo sapiens
ugcaacuacuaucca

SEQ ID NO: 18257 - RNA, 18 nt, Homo sapiens
ccaagaagauaaucucca

SEQ ID NO: 18258 - RNA, 18 nt, Homo sapiens
uauuuuagagcaucucau

SEQ ID NO: 18259 - RNA, 17 nt, Homo sapiens
uauuuuagagcaucuca

SEQ ID NO: 18260 - RNA, 18 nt, Homo sapiens
auaaacagcaacuugugu

SEQ ID NO: 18261 - RNA, 13 nt, Homo sapiens
uucauuguucuau

SEQ ID NO: 18262 - RNA, 21 nt, Homo sapiens
ccaagaagauaaucuccaaag

SEQ ID NO: 18263 - RNA, 22 nt, Homo sapiens
agcuccaccuuacuucuucuca

SEQ ID NO: 18264 - RNA, 22 nt, Homo sapiens
acuauuuaagagaacaagcaaa

SEQ ID NO: 18265 - RNA, 18 nt, Homo sapiens
acagcaacuuguguuccu

SEQ ID NO: 18266 - RNA, 18 nt, Homo sapiens
caccuuacuucuucucau

SEQ ID NO: 18267 - RNA, 20 nt, Homo sapiens
caaaguuaagaaucuuuaua

SEQ ID NO: 18268 - RNA, 21 nt, Homo sapiens
caccuuacuucuucucauacu

SEQ ID NO: 18269 - RNA, 14 nt, Homo sapiens
acaggaauuuucau

SEQ ID NO: 18270 - RNA, 17 nt, Homo sapiens
aacagcuccaccuuacu

SEQ ID NO: 18271 - RNA, 20 nt, Homo sapiens
uucaaaguuaagaaucuuua

SEQ ID NO: 18272 - RNA, 17 nt, Homo sapiens
cugcaacuacuauccaa

SEQ ID NO: 18273 - RNA, 16 nt, Homo sapiens
guucuauaacaacaac

SEQ ID NO: 18274 - RNA, 19 nt, Homo sapiens
uaacaacaacaacaaaagc

SEQ ID NO: 18275 - RNA, 18 nt, Homo sapiens
uuauuuuagagcaucuca

SEQ ID NO: 18276 - RNA, 19 nt, Homo sapiens
auuauuuuagagcaucuca

SEQ ID NO: 18277 - RNA, 20 nt, Homo sapiens
uaaagaucugcaacuacuau

SEQ ID NO: 18278 - RNA, 14 nt, Homo sapiens
auguagcagcucau

SEQ ID NO: 18279 - RNA, 16 nt, Homo sapiens
ccaacagcuccaccuu

SEQ ID NO: 18280 - RNA, 16 nt, Homo sapiens
uaacaggaauuuucau

SEQ ID NO: 18281 - RNA, 20 nt, Homo sapiens
ccaagaagauaaucuccaaa

SEQ ID NO: 18282 - RNA, 20 nt, Homo sapiens
agaucugcaacuacuaucca

SEQ ID NO: 18283 - RNA, 15 nt, Homo sapiens
uacuucuucucauac

SEQ ID NO: 18284 - RNA, 21 nt, Homo sapiens
uauuauuuuagagcaucucau

SEQ ID NO: 18285 - RNA, 15 nt, Homo sapiens
ggcuuucccaacagc

SEQ ID NO: 18286 - RNA, 21 nt, Homo sapiens
cuaacaggaauuuucauuguu

SEQ ID NO: 18287 - RNA, 21 nt, Homo sapiens
uuauuauuuuagagcaucuca

SEQ ID NO: 18288 - RNA, 16 nt, Homo sapiens
aagaucugcaacuacu

SEQ ID NO: 18289 - RNA, 22 nt, Homo sapiens
uguguuccuaacaggaauuuuc

SEQ ID NO: 18290 - RNA, 17 nt, Homo sapiens
auuuuagagcaucucau

SEQ ID NO: 18291 - RNA, 22 nt, Homo sapiens
accuuacuucuucucauacuau

SEQ ID NO: 18292 - RNA, 22 nt, Homo sapiens
cauuuauaauguagcagcucau

SEQ ID NO: 18293 - RNA, 20 nt, Homo sapiens
auuauuuuagagcaucucau

SEQ ID NO: 18294 - RNA, 17 nt, Homo sapiens
accuuacuucuucucau

SEQ ID NO: 18295 - RNA, 17 nt, Homo sapiens
aauguagcagcucauaa

SEQ ID NO: 18296 - RNA, 18 nt, Homo sapiens
aagaucugcaacuacuau

SEQ ID NO: 18297 - RNA, 14 nt, Homo sapiens
aauauaaagcaaga

SEQ ID NO: 18298 - RNA, 21 nt, Homo sapiens
uccauuaaauauaaagcaaga

SEQ ID NO: 18299 - RNA, 12 nt, Homo sapiens
agagcaucucau

SEQ ID NO: 18300 - RNA, 22 nt, Homo sapiens
uauuaaagaucugcaacuacua

SEQ ID NO: 18301 - RNA, 20 nt, Homo sapiens
uacuauuuaagagaacaagc

SEQ ID NO: 18302 - RNA, 13 nt, Homo sapiens
uuacuucuucuca

SEQ ID NO: 18303 - RNA, 19 nt, Homo sapiens
aucuuuauaguucuacucc

SEQ ID NO: 18304 - RNA, 18 nt, Homo sapiens
uuacuucuucucauacua

SEQ ID NO: 18305 - RNA, 20 nt, Homo sapiens
acuucuucucauacuauuua

SEQ ID NO: 18306 - RNA, 18 nt, Homo sapiens
uuauaauguagcagcuca

SEQ ID NO: 18307 - RNA, 16 nt, Homo sapiens
uccauuaaauauaaag

SEQ ID NO: 18308 - RNA, 15 nt, Homo sapiens
acuucuucucauacu

SEQ ID NO: 18309 - RNA, 11 nt, Homo sapiens
agaucugcaac

SEQ ID NO: 18310 - RNA, 22 nt, Homo sapiens
aaucuuuauaguucuacuccau

SEQ ID NO: 18311 - RNA, 18 nt, Homo sapiens
uuccuaacaggaauuuuc

SEQ ID NO: 18312 - RNA, 22 nt, Homo sapiens
guucuauaacaacaacaacaaa

SEQ ID NO: 18313 - RNA, 12 nt, Homo sapiens
uccuaacaggaa

SEQ ID NO: 18314 - RNA, 19 nt, Homo sapiens
aagcaaauauaaacagcaa

SEQ ID NO: 18315 - RNA, 13 nt, Homo sapiens
uacuucuucucau

SEQ ID NO: 18316 - RNA, 21 nt, Homo sapiens
cuccaccuuacuucuucucau

SEQ ID NO: 18317 - RNA, 21 nt, Homo sapiens
auuuuagagcaucucauuuau

SEQ ID NO: 18318 - RNA, 18 nt, Homo sapiens
uaauguagcagcucauaa

SEQ ID NO: 18319 - RNA, 15 nt, Homo sapiens
aagagaacaagcaaa

SEQ ID NO: 18320 - RNA, 19 nt, Homo sapiens
uccuaacaggaauuuucau

SEQ ID NO: 18321 - RNA, 13 nt, Homo sapiens
auuucugcuuuca

SEQ ID NO: 18322 - RNA, 19 nt, Homo sapiens
augggcuuucccaacagcu

SEQ ID NO: 18323 - RNA, 16 nt, Homo sapiens
auaauguagcagcuca

SEQ ID NO: 18324 - RNA, 21 nt, Homo sapiens
aaucuuuauaguucuacucca

SEQ ID NO: 18325 - RNA, 15 nt, Homo sapiens
uauuaaagaucugca

SEQ ID NO: 18326 - RNA, 14 nt, Homo sapiens
guagcagcucauaa

SEQ ID NO: 18327 - RNA, 17 nt, Homo sapiens
cuucucauacuauuuaa

SEQ ID NO: 18328 - RNA, 19 nt, Homo sapiens
caaaguuaagaaucuuuau

SEQ ID NO: 18329 - RNA, 12 nt, Homo sapiens
uaguucuacucc

SEQ ID NO: 18330 - RNA, 23 nt, Homo sapiens
agcuccaccuuacuucuucucau

SEQ ID NO: 18331 - RNA, 22 nt, Homo sapiens
uuuauaauguagcagcucauaa

SEQ ID NO: 18332 - RNA, 22 nt, Homo sapiens
uacuauuuaagagaacaagcaa

SEQ ID NO: 18333 - RNA, 20 nt, Homo sapiens
cugcaacuacuauccaacuu

SEQ ID NO: 18334 - RNA, 17 nt, Homo sapiens
auuuaagagaacaagca

SEQ ID NO: 18335 - RNA, 20 nt, Homo sapiens
ucaaaguuaagaaucuuuau

SEQ ID NO: 18336 - RNA, 12 nt, Homo sapiens
ucauuguucuau

SEQ ID NO: 18337 - RNA, 18 nt, Homo sapiens
ucaaaguuaagaaucuuu

SEQ ID NO: 18338 - RNA, 14 nt, Homo sapiens
auguagcagcucau

SEQ ID NO: 18339 - RNA, 21 nt, Homo sapiens
cuaacaggaauuuucauuguu

SEQ ID NO: 18340 - RNA, 22 nt, Homo sapiens
uguguuccuaacaggaauuuuc

SEQ ID NO: 18341 - RNA, 21 nt, Homo sapiens
uauuauuuuagagcaucucau

SEQ ID NO: 18342 - RNA, 22 nt, Homo sapiens
accuuacuucuucucauacuau

SEQ ID NO: 18343 - RNA, 21 nt, Homo sapiens
uuauuauuuuagagcaucuca

SEQ ID NO: 18344 - RNA, 18 nt, Homo sapiens
auaaacagcaacuugugu

SEQ ID NO: 18345 - RNA, 20 nt, Homo sapiens
auuauuuuagagcaucucau

SEQ ID NO: 18346 - RNA, 16 nt, Homo sapiens
aagaucugcaacuacu

SEQ ID NO: 18347 - RNA, 17 nt, Homo sapiens
auuuuagagcaucucau

SEQ ID NO: 18348 - RNA, 15 nt, Homo sapiens
ugcaacuacuaucca

SEQ ID NO: 18349 - RNA, 15 nt, Homo sapiens
ggcuuucccaacagc

SEQ ID NO: 18350 - RNA, 18 nt, Homo sapiens
aagaucugcaacuacuau

SEQ ID NO: 18351 - RNA, 18 nt, Homo sapiens
uuccuaacaggaauuuuc

SEQ ID NO: 18352 - RNA, 20 nt, Homo sapiens
agaucugcaacuacuaucca

SEQ ID NO: 18353 - RNA, 21 nt, Homo sapiens
uccauuaaauauaaagcaaga

SEQ ID NO: 18354 - RNA, 16 nt, Homo sapiens
uaacaggaauuuucau

SEQ ID NO: 18355 - RNA, 15 nt, Homo sapiens
gcuuucccaacagcu

SEQ ID NO: 18356 - RNA, 22 nt, Homo sapiens
agcuccaccuuacuucuucuca

SEQ ID NO: 18357 - RNA, 19 nt, Homo sapiens
uaacaacaacaacaaaagc

SEQ ID NO: 18358 - RNA, 22 nt, Homo sapiens
uauuaaagaucugcaacuacua

SEQ ID NO: 18359 - RNA, 14 nt, Homo sapiens
agcagcucauaaau

SEQ ID NO: 18360 - RNA, 17 nt, Homo sapiens
aauguagcagcucauaa

SEQ ID NO: 18361 - RNA, 15 nt, Homo sapiens
acuucuucucauacu

SEQ ID NO: 18362 - RNA, 18 nt, Homo sapiens
caccuuacuucuucucau

SEQ ID NO: 18363 - RNA, 11 nt, Homo sapiens
agaucugcaac

SEQ ID NO: 18364 - RNA, 16 nt, Homo sapiens
guucuauaacaacaac

SEQ ID NO: 18365 - RNA, 13 nt, Homo sapiens
uacuucuucucau

SEQ ID NO: 18366 - RNA, 13 nt, Homo sapiens
uucauuguucuau

SEQ ID NO: 18367 - RNA, 16 nt, Homo sapiens
uccauuaaauauaaag

SEQ ID NO: 18368 - RNA, 21 nt, Homo sapiens
cuccaccuuacuucuucucau

SEQ ID NO: 18369 - RNA, 18 nt, Homo sapiens
uuacuucuucucauacua

SEQ ID NO: 18370 - RNA, 19 nt, Homo sapiens
caaaguuaagaaucuuuau

SEQ ID NO: 18371 - RNA, 21 nt, Homo sapiens
aaucuuuauaguucuacucca

SEQ ID NO: 18372 - RNA, 23 nt, Homo sapiens
agcuccaccuuacuucuucucau

SEQ ID NO: 18373 - RNA, 15 nt, Homo sapiens
uacuucuucucauac

SEQ ID NO: 18374 - RNA, 21 nt, Homo sapiens
auuuuagagcaucucauuuau

SEQ ID NO: 18375 - RNA, 20 nt, Homo sapiens
uacuauuuaagagaacaagc

SEQ ID NO: 18376 - RNA, 19 nt, Homo sapiens
aucuuuauaguucuacucc

SEQ ID NO: 18377 - RNA, 20 nt, Homo sapiens
ccaagaagauaaucuccaaa

SEQ ID NO: 18378 - RNA, 20 nt, Homo sapiens
uaaagaucugcaacuacuau

SEQ ID NO: 18379 - RNA, 12 nt, Homo sapiens
agagcaucucau

SEQ ID NO: 18380 - RNA, 18 nt, Homo sapiens
uuauaauguagcagcuca

SEQ ID NO: 18381 - RNA, 13 nt, Homo sapiens
auuucugcuuuca

SEQ ID NO: 18382 - RNA, 22 nt, Homo sapiens
aaucuuuauaguucuacuccau

SEQ ID NO: 18383 - RNA, 19 nt, Homo sapiens
auuauuuuagagcaucuca

SEQ ID NO: 18384 - RNA, 15 nt, Homo sapiens
aagagaacaagcaaa

SEQ ID NO: 18385 - RNA, 17 nt, Homo sapiens
auuuaagagaacaagca

SEQ ID NO: 18386 - RNA, 22 nt, Homo sapiens
uuuauaauguagcagcucauaa

SEQ ID NO: 18387 - RNA, 18 nt, Homo sapiens
ucaaaguuaagaaucuuu

SEQ ID NO: 18388 - RNA, 15 nt, Homo sapiens
uauuaaagaucugca

SEQ ID NO: 18389 - RNA, 20 nt, Homo sapiens
ucaaaguuaagaaucuuuau

SEQ ID NO: 18390 - RNA, 20 nt, Homo sapiens
cugcaacuacuauccaacuu

SEQ ID NO: 18391 - RNA, 14 nt, Homo sapiens
guagcagcucauaa

SEQ ID NO: 18392 - RNA, 18 nt, Homo sapiens
uauuuuagagcaucucau

SEQ ID NO: 18393 - RNA, 12 nt, Homo sapiens
ucauuguucuau

SEQ ID NO: 18394 - RNA, 18 nt, Homo sapiens
uaauguagcagcucauaa

SEQ ID NO: 18395 - RNA, 22 nt, Homo sapiens
uacuauuuaagagaacaagcaa

SEQ ID NO: 18396 - RNA, 17 nt, Homo sapiens
uauuuuagagcaucuca

SEQ ID NO: 18397 - RNA, 12 nt, Homo sapiens
uccuaacaggaa

SEQ ID NO: 18398 - RNA, 22 nt, Homo sapiens
cauuuauaauguagcagcucau

SEQ ID NO: 18399 - RNA, 13 nt, Homo sapiens
uuacuucuucuca

SEQ ID NO: 18400 - RNA, 16 nt, Homo sapiens
uauaguucuacuccau

SEQ ID NO: 18401 - RNA, 19 nt, Homo sapiens
aagcaaauauaaacagcaa

SEQ ID NO: 18402 - RNA, 21 nt, Homo sapiens
caccuuacuucuucucauacu

SEQ ID NO: 18403 - RNA, 14 nt, Homo sapiens
aauauaaagcaaga

SEQ ID NO: 18404 - RNA, 16 nt, Homo sapiens
ccaacagcuccaccuu

SEQ ID NO: 18405 - RNA, 22 nt, Homo sapiens
acuauuuaagagaacaagcaaa

SEQ ID NO: 18406 - RNA, 20 nt, Homo sapiens
acuucuucucauacuauuua

SEQ ID NO: 18407 - RNA, 18 nt, Homo sapiens
uuauuuuagagcaucuca

SEQ ID NO: 18408 - RNA, 21 nt, Homo sapiens
ccaagaagauaaucuccaaag

SEQ ID NO: 18409 - RNA, 18 nt, Homo sapiens
acagcaacuuguguuccu

SEQ ID NO: 18410 - RNA, 17 nt, Homo sapiens
aacagcuccaccuuacu

SEQ ID NO: 18411 - RNA, 14 nt, Homo sapiens
acaggaauuuucau

SEQ ID NO: 18412 - RNA, 17 nt, Homo sapiens
accuuacuucuucucau

SEQ ID NO: 18413 - RNA, 20 nt, Homo sapiens
caaaguuaagaaucuuuaua

SEQ ID NO: 18414 - RNA, 19 nt, Homo sapiens
uccuaacaggaauuuucau

SEQ ID NO: 18415 - RNA, 17 nt, Homo sapiens
cuucucauacuauuuaa

SEQ ID NO: 18416 - RNA, 18 nt, Homo sapiens
ccaagaagauaaucucca

SEQ ID NO: 18417 - RNA, 17 nt, Homo sapiens
cugcaacuacuauccaa

SEQ ID NO: 18418 - RNA, 12 nt, Homo sapiens
uaguucuacucc

SEQ ID NO: 18419 - RNA, 19 nt, Homo sapiens
gaucugcaacuacuaucca

SEQ ID NO: 18420 - RNA, 16 nt, Homo sapiens
auaauguagcagcuca

SEQ ID NO: 18421 - RNA, 22 nt, Homo sapiens
guucuauaacaacaacaacaaa

SEQ ID NO: 18422 - RNA, 19 nt, Homo sapiens
augggcuuucccaacagcu

SEQ ID NO: 18423 - RNA, 20 nt, Homo sapiens
uucaaaguuaagaaucuuua

SEQ ID NO: 18424 - RNA, 18 nt, Homo sapiens
uuuucacaaagaacagga

SEQ ID NO: 18425 - RNA, 23 nt, Homo sapiens
uuuucucaauguuuagcagauuu

SEQ ID NO: 18426 - RNA, 14 nt, Homo sapiens
uuuuaaggcauauu

SEQ ID NO: 18427 - RNA, 16 nt, Homo sapiens
uuuuauaaacuuuacc

SEQ ID NO: 18428 - RNA, 13 nt, Homo sapiens
uuaaguaucugac

SEQ ID NO: 18429 - RNA, 14 nt, Homo sapiens
uuaaguaucugaca

SEQ ID NO: 18430 - RNA, 11 nt, Homo sapiens
uuaauaucauc

SEQ ID NO: 18431 - RNA, 13 nt, Homo sapiens
uuaauccucucaa

SEQ ID NO: 18432 - RNA, 17 nt, Homo sapiens
uuaauuauuucacuuua

SEQ ID NO: 18433 - RNA, 16 nt, Homo sapiens
uuacaggaacagaaga

SEQ ID NO: 18434 - RNA, 22 nt, Homo sapiens
uguuuccuagcacacacuuuug

SEQ ID NO: 18435 - RNA, 15 nt, Homo sapiens
uguuuuaaggaugcu

SEQ ID NO: 18436 - RNA, 20 nt, Homo sapiens
uguuaaguaucagcuacaau

SEQ ID NO: 18437 - RNA, 17 nt, Homo sapiens
uguuacuaaguuuuuau

SEQ ID NO: 18438 - RNA, 16 nt, Homo sapiens
uguucuugguuuguaa

SEQ ID NO: 18439 - RNA, 20 nt, Homo sapiens
uguugcuaucaauccaagaa

SEQ ID NO: 18440 - RNA, 12 nt, Homo sapiens
uuccaagaaaua

SEQ ID NO: 18441 - RNA, 13 nt, Homo sapiens
uuccaagaaauau

SEQ ID NO: 18442 - RNA, 13 nt, Homo sapiens
uuauuucacuuua

SEQ ID NO: 18443 - RNA, 20 nt, Homo sapiens
uucacuuuuauaagaaauag

SEQ ID NO: 18444 - RNA, 22 nt, Homo sapiens
uucccagucuucagcagagaag

SEQ ID NO: 18445 - RNA, 22 nt, Homo sapiens
uuaacugagaaggcuguggauu

SEQ ID NO: 18446 - RNA, 18 nt, Homo sapiens
uuacccucauguucuuaa

SEQ ID NO: 18447 - RNA, 14 nt, Homo sapiens
uuacuaaacaugua

SEQ ID NO: 18448 - RNA, 13 nt, Homo sapiens
uuacuguacauga

SEQ ID NO: 18449 - RNA, 22 nt, Homo sapiens
uuaguucaauccugauucauau

SEQ ID NO: 18450 - RNA, 19 nt, Homo sapiens
uuaguucaaucuggauuca

SEQ ID NO: 18451 - RNA, 18 nt, Homo sapiens
uuauaaaucgcuuuugau

SEQ ID NO: 18452 - RNA, 20 nt, Homo sapiens
uuauaagaaauaggaaauau

SEQ ID NO: 18453 - RNA, 20 nt, Homo sapiens
uugccgcuuaagcuuucagc

SEQ ID NO: 18454 - RNA, 17 nt, Homo sapiens
uugaagauuuaauuacu

SEQ ID NO: 18455 - RNA, 19 nt, Homo sapiens
uugaagcuuuaagaacuaa

SEQ ID NO: 18456 - RNA, 18 nt, Homo sapiens
uuccucacuuugaagagu

SEQ ID NO: 18457 - RNA, 16 nt, Homo sapiens
uuccuccgcugggccu

SEQ ID NO: 18458 - RNA, 21 nt, Homo sapiens
uucuuagggaaggauacaaaa

SEQ ID NO: 18459 - RNA, 19 nt, Homo sapiens
uuuaaauuaaauaaaauuu

SEQ ID NO: 18460 - RNA, 20 nt, Homo sapiens
uuuaaauuaaauaaaauuuu

SEQ ID NO: 18461 - RNA, 18 nt, Homo sapiens
uuuauugaaaugauuuca

SEQ ID NO: 18462 - RNA, 18 nt, Homo sapiens
uuucacaaagaacaggaa

SEQ ID NO: 18463 - RNA, 18 nt, Homo sapiens
uuugagaaauuaaguauc

SEQ ID NO: 18464 - RNA, 13 nt, Homo sapiens
uuugauguuuuaa

SEQ ID NO: 18465 - RNA, 18 nt, Homo sapiens
uuugguugcuuuaauauc

SEQ ID NO: 18466 - RNA, 14 nt, Homo sapiens
ugcuauuugcuguu

SEQ ID NO: 18467 - RNA, 22 nt, Homo sapiens
ugcuuuaauaucaucaguauug

SEQ ID NO: 18468 - RNA, 18 nt, Homo sapiens
uggaagccucuauugcca

SEQ ID NO: 18469 - RNA, 14 nt, Homo sapiens
uggauucauauuua

SEQ ID NO: 18470 - RNA, 16 nt, Homo sapiens
uggauuuaacagaaau

SEQ ID NO: 18471 - RNA, 15 nt, Homo sapiens
uggccccugccaccu

SEQ ID NO: 18472 - RNA, 22 nt, Homo sapiens
uggccuagcauacguacacauu

SEQ ID NO: 18473 - RNA, 17 nt, Homo sapiens
ugggccuggauggcugc

SEQ ID NO: 18474 - RNA, 16 nt, Homo sapiens
uggugguuucagaaau

SEQ ID NO: 18475 - RNA, 13 nt, Homo sapiens
ugguuuguaaauu

SEQ ID NO: 18476 - RNA, 18 nt, Homo sapiens
ugguuuguaaauuaacuu

SEQ ID NO: 18477 - RNA, 16 nt, Homo sapiens
ucuucugacacuaaaa

SEQ ID NO: 18478 - RNA, 21 nt, Homo sapiens
ucuugauugugggauacuauu

SEQ ID NO: 18479 - RNA, 21 nt, Homo sapiens
ucuuguaaggcauacugccuu

SEQ ID NO: 18480 - RNA, 18 nt, Homo sapiens
ucuuaaauaauaaagauc

SEQ ID NO: 18481 - RNA, 15 nt, Homo sapiens
ucuuaguaugugcau

SEQ ID NO: 18482 - RNA, 21 nt, Homo sapiens
ucuuaguaugugcauuuaauu

SEQ ID NO: 18483 - RNA, 24 nt, Homo sapiens
ucugcagcaauaaagcagcguuuc

SEQ ID NO: 18484 - RNA, 17 nt, Homo sapiens
ucgcuuuugauaaucaa

SEQ ID NO: 18485 - RNA, 18 nt, Homo sapiens
ucgcuuuugauaaucaac

SEQ ID NO: 18486 - RNA, 17 nt, Homo sapiens
ucuaguuugauuaaauu

SEQ ID NO: 18487 - RNA, 18 nt, Homo sapiens
ucuaguuugauuaaauuc

SEQ ID NO: 18488 - RNA, 19 nt, Homo sapiens
ucuaguuugauuaaauucu

SEQ ID NO: 18489 - RNA, 22 nt, Homo sapiens
ucuccaaaauaaaacuuuuuaa

SEQ ID NO: 18490 - RNA, 13 nt, Homo sapiens
ucuccaugauccc

SEQ ID NO: 18491 - RNA, 22 nt, Homo sapiens
ucuccaugaucccaccucccau

SEQ ID NO: 18492 - RNA, 20 nt, Homo sapiens
ucuccauggcccugccaugc

SEQ ID NO: 18493 - RNA, 15 nt, Homo sapiens
ucuauguuaauauuu

SEQ ID NO: 18494 - RNA, 21 nt, Homo sapiens
ucucaguugcagcccugcugc

SEQ ID NO: 18495 - RNA, 12 nt, Homo sapiens
ucuccuuggaua

SEQ ID NO: 18496 - RNA, 17 nt, Homo sapiens
uccguuaaaauaccagc

SEQ ID NO: 18497 - RNA, 21 nt, Homo sapiens
uccgcuauccaccaaaagggc

SEQ ID NO: 18498 - RNA, 14 nt, Homo sapiens
ucccuggccuuuca

SEQ ID NO: 18499 - RNA, 15 nt, Homo sapiens
uccuauuauauucau

SEQ ID NO: 18500 - RNA, 21 nt, Homo sapiens
uccugaaggaggcccugcccu

SEQ ID NO: 18501 - RNA, 15 nt, Homo sapiens
uccugcaaugaaguc

SEQ ID NO: 18502 - RNA, 19 nt, Homo sapiens
ugaaccguuugugauugcc

SEQ ID NO: 18503 - RNA, 20 nt, Homo sapiens
ugaaccguuugugauugcca

SEQ ID NO: 18504 - RNA, 21 nt, Homo sapiens
ugaacuuuuuguuuuguuucu

SEQ ID NO: 18505 - RNA, 14 nt, Homo sapiens
ugaagcuuuaagaa

SEQ ID NO: 18506 - RNA, 16 nt, Homo sapiens
ugaagauuuaauuacu

SEQ ID NO: 18507 - RNA, 14 nt, Homo sapiens
ugaaguaauaugca

SEQ ID NO: 18508 - RNA, 23 nt, Homo sapiens
ugaagugaaacugcuuguuuccu

SEQ ID NO: 18509 - RNA, 16 nt, Homo sapiens
ugacauaucacauguc

SEQ ID NO: 18510 - RNA, 23 nt, Homo sapiens
ugaccuccuccuucauggcaggc

SEQ ID NO: 18511 - RNA, 17 nt, Homo sapiens
ugacuuacuguacauga

SEQ ID NO: 18512 - RNA, 15 nt, Homo sapiens
ugagccuuuguugcu

SEQ ID NO: 18513 - RNA, 17 nt, Homo sapiens
ugagcggaccuucccag

SEQ ID NO: 18514 - RNA, 23 nt, Homo sapiens
ugauaaagaugagugagcaugcc

SEQ ID NO: 18515 - RNA, 11 nt, Homo sapiens
ugaugcugagc

SEQ ID NO: 18516 - RNA, 12 nt, Homo sapiens
ugaugcugagcc

SEQ ID NO: 18517 - RNA, 13 nt, Homo sapiens
ugauguuuuaagg

SEQ ID NO: 18518 - RNA, 22 nt, Homo sapiens
ugauucauauuuaauuugaaga

SEQ ID NO: 18519 - RNA, 23 nt, Homo sapiens
ugauucauauuuaauuugaagau

SEQ ID NO: 18520 - RNA, 24 nt, Homo sapiens
ugauucauauuuaauuugaagaua

SEQ ID NO: 18521 - RNA, 19 nt, Homo sapiens
ugauuuggggauauuuuuu

SEQ ID NO: 18522 - RNA, 17 nt, Homo sapiens
ugauuuuauaugcuauu

SEQ ID NO: 18523 - RNA, 14 nt, Homo sapiens
ugauuuuuguaauu

SEQ ID NO: 18524 - RNA, 15 nt, Homo sapiens
ugcacaucuguuuug

SEQ ID NO: 18525 - RNA, 18 nt, Homo sapiens
ugcacaucuguuuuguaa

SEQ ID NO: 18526 - RNA, 11 nt, Homo sapiens
ugcagcccugc

SEQ ID NO: 18527 - RNA, 15 nt, Homo sapiens
ugcagcccugcugcu

SEQ ID NO: 18528 - RNA, 13 nt, Homo sapiens
ugccaccuccugc

SEQ ID NO: 18529 - RNA, 14 nt, Homo sapiens
ugcccuuacaggaa

SEQ ID NO: 18530 - RNA, 12 nt, Homo sapiens
ugccugcccuga

SEQ ID NO: 18531 - RNA, 12 nt, Homo sapiens
ugcuacacacug

SEQ ID NO: 18532 - RNA, 15 nt, Homo sapiens
ugcugccugccugga

SEQ ID NO: 18533 - RNA, 13 nt, Homo sapiens
ugcugcugccugc

SEQ ID NO: 18534 - RNA, 14 nt, Homo sapiens
uccaauuaaggauu

SEQ ID NO: 18535 - RNA, 15 nt, Homo sapiens
uccaauuaaggauuu

SEQ ID NO: 18536 - RNA, 17 nt, Homo sapiens
uccagguuccugagccc

SEQ ID NO: 18537 - RNA, 18 nt, Homo sapiens
uccagguuccugagcccu

SEQ ID NO: 18538 - RNA, 15 nt, Homo sapiens
ucccauucacagaua

SEQ ID NO: 18539 - RNA, 13 nt, Homo sapiens
ucauauuuaauuu

SEQ ID NO: 18540 - RNA, 13 nt, Homo sapiens
ucauguugaaacu

SEQ ID NO: 18541 - RNA, 18 nt, Homo sapiens
ucauuaguuuugaagauu

SEQ ID NO: 18542 - RNA, 17 nt, Homo sapiens
ucauuauguuaauauuu

SEQ ID NO: 18543 - RNA, 15 nt, Homo sapiens
ucauucugccugccc

SEQ ID NO: 18544 - RNA, 14 nt, Homo sapiens
ucauucuuuuugaa

SEQ ID NO: 18545 - RNA, 16 nt, Homo sapiens
ucauucuuuuugaaau

SEQ ID NO: 18546 - RNA, 15 nt, Homo sapiens
ucauuuuuuuuaaga

SEQ ID NO: 18547 - RNA, 13 nt, Homo sapiens
uauuuuuuucuuu

SEQ ID NO: 18548 - RNA, 14 nt, Homo sapiens
ucaaccaccuuuca

SEQ ID NO: 18549 - RNA, 15 nt, Homo sapiens
ucaaccaccuuucag

SEQ ID NO: 18550 - RNA, 13 nt, Homo sapiens
uauuuauuuguuu

SEQ ID NO: 18551 - RNA, 16 nt, Homo sapiens
uauuuuagguguaaaa

SEQ ID NO: 18552 - RNA, 18 nt, Homo sapiens
uauaugugaugaucuacc

SEQ ID NO: 18553 - RNA, 18 nt, Homo sapiens
uaugcacacauuuuuuaa

SEQ ID NO: 18554 - RNA, 17 nt, Homo sapiens
uauuaaguauuuuauua

SEQ ID NO: 18555 - RNA, 18 nt, Homo sapiens
uauguuagagaauuuccu

SEQ ID NO: 18556 - RNA, 19 nt, Homo sapiens
uauguuagagaauuuccuu

SEQ ID NO: 18557 - RNA, 22 nt, Homo sapiens
uauugauuuccguuaaaauacc

SEQ ID NO: 18558 - RNA, 15 nt, Homo sapiens
ucaaguucaccagac

SEQ ID NO: 18559 - RNA, 19 nt, Homo sapiens
ucaauguuuagcagauuua

SEQ ID NO: 18560 - RNA, 20 nt, Homo sapiens
ucaauguuuagcagauuuaa

SEQ ID NO: 18561 - RNA, 20 nt, Homo sapiens
ucaauuuuaaggcauauuua

SEQ ID NO: 18562 - RNA, 19 nt, Homo sapiens
ucacugguggcuguuccug

SEQ ID NO: 18563 - RNA, 15 nt, Homo sapiens
ucagaucucuaacuu

SEQ ID NO: 18564 - RNA, 23 nt, Homo sapiens
ucagcucucaguugcagcccugc

SEQ ID NO: 18565 - RNA, 17 nt, Homo sapiens
uaacagaaauguacagc

SEQ ID NO: 18566 - RNA, 14 nt, Homo sapiens
uaaccagcagaaau

SEQ ID NO: 18567 - RNA, 15 nt, Homo sapiens
uaagaaaaaggaugc

SEQ ID NO: 18568 - RNA, 17 nt, Homo sapiens
uaagcauauacuagaua

SEQ ID NO: 18569 - RNA, 11 nt, Homo sapiens
uaaggaaacug

SEQ ID NO: 18570 - RNA, 12 nt, Homo sapiens
uaaggaaacugg

SEQ ID NO: 18571 - RNA, 13 nt, Homo sapiens
uaaggaaacuggg

SEQ ID NO: 18572 - RNA, 19 nt, Homo sapiens
uaauaugcacacauuuuuu

SEQ ID NO: 18573 - RNA, 18 nt, Homo sapiens
uaauuuuagacauucuuu

SEQ ID NO: 18574 - RNA, 15 nt, Homo sapiens
uaaauaauaaagauc

SEQ ID NO: 18575 - RNA, 19 nt, Homo sapiens
uaaauagcuaagauauaau

SEQ ID NO: 18576 - RNA, 20 nt, Homo sapiens
uaaaguguauuuuuuuacua

SEQ ID NO: 18577 - RNA, 16 nt, Homo sapiens
guuugugauugccauu

SEQ ID NO: 18578 - RNA, 10 nt, Homo sapiens
uaaaauuuuu

SEQ ID NO: 18579 - RNA, 17 nt, Homo sapiens
uaaacauguauguaaau

SEQ ID NO: 18580 - RNA, 17 nt, Homo sapiens
uaaagaugaaugucagu

SEQ ID NO: 18581 - RNA, 14 nt, Homo sapiens
uaaaggaagguucu

SEQ ID NO: 18582 - RNA, 19 nt, Homo sapiens
guugucaaugggaaaaaac

SEQ ID NO: 18583 - RNA, 19 nt, Homo sapiens
guuuauauagaaauguauu

SEQ ID NO: 18584 - RNA, 17 nt, Homo sapiens
guuucauaagaauucug

SEQ ID NO: 18585 - RNA, 18 nt, Homo sapiens
guuucauaagaauucugu

SEQ ID NO: 18586 - RNA, 23 nt, Homo sapiens
guuuccuagcacacacuuuuggu

SEQ ID NO: 18587 - RNA, 17 nt, Homo sapiens
uaccuuuuuuauacaua

SEQ ID NO: 18588 - RNA, 18 nt, Homo sapiens
uacauguauuuguuugca

SEQ ID NO: 18589 - RNA, 11 nt, Homo sapiens
uacuaaguuuu

SEQ ID NO: 18590 - RNA, 13 nt, Homo sapiens
uacuauuuaauua

SEQ ID NO: 18591 - RNA, 14 nt, Homo sapiens
uagaauguuuucaa

SEQ ID NO: 18592 - RNA, 19 nt, Homo sapiens
uagacaauuuauuauggca

SEQ ID NO: 18593 - RNA, 15 nt, Homo sapiens
uagagaauuuccuua

SEQ ID NO: 18594 - RNA, 15 nt, Homo sapiens
uagauagaugaagaa

SEQ ID NO: 18595 - RNA, 22 nt, Homo sapiens
uagcauaguaccucugcuauuu

SEQ ID NO: 18596 - RNA, 14 nt, Homo sapiens
uagcucucugaccu

SEQ ID NO: 18597 - RNA, 11 nt, Homo sapiens
uaggaacuuaa

SEQ ID NO: 18598 - RNA, 12 nt, Homo sapiens
uaggaacuuaaa

SEQ ID NO: 18599 - RNA, 19 nt, Homo sapiens
uaguaugaggcauuuguuu

SEQ ID NO: 18600 - RNA, 21 nt, Homo sapiens
uauaaauuuaucauuuaguua

SEQ ID NO: 18601 - RNA, 15 nt, Homo sapiens
guucaaagauauuuu

SEQ ID NO: 18602 - RNA, 13 nt, Homo sapiens
guugauggaaaua

SEQ ID NO: 18603 - RNA, 20 nt, Homo sapiens
guugcagcccugcugcugcc

SEQ ID NO: 18604 - RNA, 12 nt, Homo sapiens
guuauuuauaau

SEQ ID NO: 18605 - RNA, 15 nt, Homo sapiens
guuauuuauaaucac

SEQ ID NO: 18606 - RNA, 19 nt, Homo sapiens
guuauuuauaaucacuuuu

SEQ ID NO: 18607 - RNA, 19 nt, Homo sapiens
guuauuuauugaaaugauu

SEQ ID NO: 18608 - RNA, 22 nt, Homo sapiens
guuauuuuaucugcuaugcuau

SEQ ID NO: 18609 - RNA, 23 nt, Homo sapiens
guuauuuuaucugcuaugcuauu

SEQ ID NO: 18610 - RNA, 13 nt, Homo sapiens
gugugaggaaaac

SEQ ID NO: 18611 - RNA, 13 nt, Homo sapiens
guguuugagcauc

SEQ ID NO: 18612 - RNA, 15 nt, Homo sapiens
guuaucuucacuuuu

SEQ ID NO: 18613 - RNA, 12 nt, Homo sapiens
gugauuuuugua

SEQ ID NO: 18614 - RNA, 20 nt, Homo sapiens
gugcauuuggugguuucaga

SEQ ID NO: 18615 - RNA, 15 nt, Homo sapiens
gugggaccugggcca

SEQ ID NO: 18616 - RNA, 24 nt, Homo sapiens
gucccuagcccuuacguccuucca

SEQ ID NO: 18617 - RNA, 15 nt, Homo sapiens
guccgcuauccacca

SEQ ID NO: 18618 - RNA, 18 nt, Homo sapiens
gucucugaagugaaacug

SEQ ID NO: 18619 - RNA, 18 nt, Homo sapiens
gugagaccaaauugagcu

SEQ ID NO: 18620 - RNA, 16 nt, Homo sapiens
gugagcaucacaguuu

SEQ ID NO: 18621 - RNA, 17 nt, Homo sapiens
guauuuuuuuacuaaua

SEQ ID NO: 18622 - RNA, 22 nt, Homo sapiens
gucauuauguuaauauuucuga

SEQ ID NO: 18623 - RNA, 15 nt, Homo sapiens
guagaauauauuucc

SEQ ID NO: 18624 - RNA, 16 nt, Homo sapiens
guagaauauauuuccu

SEQ ID NO: 18625 - RNA, 13 nt, Homo sapiens
guaguuagcuuuc

SEQ ID NO: 18626 - RNA, 12 nt, Homo sapiens
guauggcaaacu

SEQ ID NO: 18627 - RNA, 19 nt, Homo sapiens
guauucucuccuguaccuc

SEQ ID NO: 18628 - RNA, 20 nt, Homo sapiens
gguagcuaaauauauauuuu

SEQ ID NO: 18629 - RNA, 17 nt, Homo sapiens
ggucacuuuacuguccc

SEQ ID NO: 18630 - RNA, 22 nt, Homo sapiens
gguggcuguuccugaaggaggc

SEQ ID NO: 18631 - RNA, 14 nt, Homo sapiens
guaaaggcaaacuu

SEQ ID NO: 18632 - RNA, 22 nt, Homo sapiens
guaacaacaauuauuugaagau

SEQ ID NO: 18633 - RNA, 13 nt, Homo sapiens
guaccauaauucu

SEQ ID NO: 18634 - RNA, 16 nt, Homo sapiens
ggaguaccauaauucu

SEQ ID NO: 18635 - RNA, 17 nt, Homo sapiens
ggaguaccauaauucug

SEQ ID NO: 18636 - RNA, 18 nt, Homo sapiens
ggaguaccauaauucugg

SEQ ID NO: 18637 - RNA, 15 nt, Homo sapiens
ggaugcuuguacaua

SEQ ID NO: 18638 - RNA, 12 nt, Homo sapiens
gcuuuugauaau

SEQ ID NO: 18639 - RNA, 11 nt, Homo sapiens
ggaaauauuuu

SEQ ID NO: 18640 - RNA, 16 nt, Homo sapiens
ggaauauauaaccagu

SEQ ID NO: 18641 - RNA, 18 nt, Homo sapiens
ggaccaggcacccccaga

SEQ ID NO: 18642 - RNA, 18 nt, Homo sapiens
ggaccugggccauaguca

SEQ ID NO: 18643 - RNA, 15 nt, Homo sapiens
ggauuccucacuuug

SEQ ID NO: 18644 - RNA, 16 nt, Homo sapiens
ggauuuaacagaaaug

SEQ ID NO: 18645 - RNA, 19 nt, Homo sapiens
ggcaaacugccaucauuua

SEQ ID NO: 18646 - RNA, 16 nt, Homo sapiens
ggcccugccaugcucu

SEQ ID NO: 18647 - RNA, 19 nt, Homo sapiens
ggcccugccaugcucucca

SEQ ID NO: 18648 - RNA, 20 nt, Homo sapiens
ggcaguggugguuuucuguu

SEQ ID NO: 18649 - RNA, 19 nt, Homo sapiens
ggcauauuuaacaaaauuu

SEQ ID NO: 18650 - RNA, 20 nt, Homo sapiens
ggcauauuuaacaaaauuug

SEQ ID NO: 18651 - RNA, 16 nt, Homo sapiens
gcuuauugguggcugu

SEQ ID NO: 18652 - RNA, 13 nt, Homo sapiens
gcugcauuuaaaa

SEQ ID NO: 18653 - RNA, 20 nt, Homo sapiens
gcuaggggggucagccagcc

SEQ ID NO: 18654 - RNA, 12 nt, Homo sapiens
gcuaguuuauau

SEQ ID NO: 18655 - RNA, 17 nt, Homo sapiens
gcucuccaaaccacuuu

SEQ ID NO: 18656 - RNA, 15 nt, Homo sapiens
gcuaccucuccagcc

SEQ ID NO: 18657 - RNA, 13 nt, Homo sapiens
gcuaccuuuguau

SEQ ID NO: 18658 - RNA, 11 nt, Homo sapiens
gcuaugcauuu

SEQ ID NO: 18659 - RNA, 12 nt, Homo sapiens
gcuaugcauuug

SEQ ID NO: 18660 - RNA, 15 nt, Homo sapiens
gcuaugcuauugaag

SEQ ID NO: 18661 - RNA, 19 nt, Homo sapiens
gcaugaaguaauaugcaca

SEQ ID NO: 18662 - RNA, 14 nt, Homo sapiens
gcaucacaguuuug

SEQ ID NO: 18663 - RNA, 16 nt, Homo sapiens
gcauuaucuagauacu

SEQ ID NO: 18664 - RNA, 20 nt, Homo sapiens
gcauuaucuagauacuguau

SEQ ID NO: 18665 - RNA, 15 nt, Homo sapiens
gcauuuguuugaacu

SEQ ID NO: 18666 - RNA, 13 nt, Homo sapiens
gccaccuccugcc

SEQ ID NO: 18667 - RNA, 15 nt, Homo sapiens
gccaccuccugccuc

SEQ ID NO: 18668 - RNA, 20 nt, Homo sapiens
gccacugugauagaggcuga

SEQ ID NO: 18669 - RNA, 20 nt, Homo sapiens
gcagcccugcugcugccugc

SEQ ID NO: 18670 - RNA, 13 nt, Homo sapiens
gcagugaggcgga

SEQ ID NO: 18671 - RNA, 19 nt, Homo sapiens
gcauaguaccucugcuauu

SEQ ID NO: 18672 - RNA, 22 nt, Homo sapiens
gcauaguaccucugcuauuugc

SEQ ID NO: 18673 - RNA, 12 nt, Homo sapiens
gcccugccaugc

SEQ ID NO: 18674 - RNA, 16 nt, Homo sapiens
gcccugcugcugccug

SEQ ID NO: 18675 - RNA, 18 nt, Homo sapiens
gcccuuacguccuuccac

SEQ ID NO: 18676 - RNA, 15 nt, Homo sapiens
gccgcuuaagcuuuc

SEQ ID NO: 18677 - RNA, 11 nt, Homo sapiens
gccucagcucu

SEQ ID NO: 18678 - RNA, 14 nt, Homo sapiens
gccucagcucucag

SEQ ID NO: 18679 - RNA, 23 nt, Homo sapiens
gccucuauugccaugagaguucu

SEQ ID NO: 18680 - RNA, 14 nt, Homo sapiens
gcgccuaauguguu

SEQ ID NO: 18681 - RNA, 20 nt, Homo sapiens
gcgcuaccucuccagccuca

SEQ ID NO: 18682 - RNA, 15 nt, Homo sapiens
gcggaccuucccagc

SEQ ID NO: 18683 - RNA, 17 nt, Homo sapiens
gcggaccuucccagcua

SEQ ID NO: 18684 - RNA, 14 nt, Homo sapiens
gcggaccuucccag

SEQ ID NO: 18685 - RNA, 17 nt, Homo sapiens
gcuaagauauaauuuaa

SEQ ID NO: 18686 - RNA, 15 nt, Homo sapiens
gcagcaauaaagcag

SEQ ID NO: 18687 - RNA, 22 nt, Homo sapiens
gcacacucucccauuauauuua

SEQ ID NO: 18688 - RNA, 14 nt, Homo sapiens
gcacgauuucuguu

SEQ ID NO: 18689 - RNA, 15 nt, Homo sapiens
gcacgauuucuguuu

SEQ ID NO: 18690 - RNA, 15 nt, Homo sapiens
gcacauauccuuagc

SEQ ID NO: 18691 - RNA, 17 nt, Homo sapiens
gcacaucuguuuuguaa

SEQ ID NO: 18692 - RNA, 17 nt, Homo sapiens
gaugcuuguacauaaug

SEQ ID NO: 18693 - RNA, 20 nt, Homo sapiens
gauggcaggaggcauccaaa

SEQ ID NO: 18694 - RNA, 11 nt, Homo sapiens
gaugaacuuuu

SEQ ID NO: 18695 - RNA, 23 nt, Homo sapiens
gauguuuucacaaagaacaggaa

SEQ ID NO: 18696 - RNA, 12 nt, Homo sapiens
gauuaaacuuaa

SEQ ID NO: 18697 - RNA, 18 nt, Homo sapiens
gauuaacucuaccugcac

SEQ ID NO: 18698 - RNA, 13 nt, Homo sapiens
gauucaauuuuaa

SEQ ID NO: 18699 - RNA, 13 nt, Homo sapiens
gauuccucacuuu

SEQ ID NO: 18700 - RNA, 14 nt, Homo sapiens
gauuccucacuuug

SEQ ID NO: 18701 - RNA, 12 nt, Homo sapiens
gauugugggaua

SEQ ID NO: 18702 - RNA, 20 nt, Homo sapiens
gauugugggauacuauuuaa

SEQ ID NO: 18703 - RNA, 19 nt, Homo sapiens
gauuuuauaugcuauuuau

SEQ ID NO: 18704 - RNA, 17 nt, Homo sapiens
gagcgcuaccucuccag

SEQ ID NO: 18705 - RNA, 13 nt, Homo sapiens
gaggaaagagaga

SEQ ID NO: 18706 - RNA, 14 nt, Homo sapiens
gaggaaagagagac

SEQ ID NO: 18707 - RNA, 14 nt, Homo sapiens
gaggagccugcaac

SEQ ID NO: 18708 - RNA, 19 nt, Homo sapiens
gaggaauccaagaaaaugg

SEQ ID NO: 18709 - RNA, 20 nt, Homo sapiens
gagccaggaaucacuggcug

SEQ ID NO: 18710 - RNA, 15 nt, Homo sapiens
gagggcuaauaucuu

SEQ ID NO: 18711 - RNA, 17 nt, Homo sapiens
gaggggcuucugggcag

SEQ ID NO: 18712 - RNA, 13 nt, Homo sapiens
gaggucucugaac

SEQ ID NO: 18713 - RNA, 12 nt, Homo sapiens
gauaaugcuaau

SEQ ID NO: 18714 - RNA, 16 nt, Homo sapiens
gaucaaugugacggca

SEQ ID NO: 18715 - RNA, 21 nt, Homo sapiens
gaucaaugugacggcagggaa

SEQ ID NO: 18716 - RNA, 11 nt, Homo sapiens
gaaauauuccu

SEQ ID NO: 18717 - RNA, 21 nt, Homo sapiens
gaaccguuugugauugccauu

SEQ ID NO: 18718 - RNA, 12 nt, Homo sapiens
gaaggauacaaa

SEQ ID NO: 18719 - RNA, 14 nt, Homo sapiens
gaauauauaaccag

SEQ ID NO: 18720 - RNA, 14 nt, Homo sapiens
gaaugaccuggccg

SEQ ID NO: 18721 - RNA, 15 nt, Homo sapiens
gacauacuaaccagc

SEQ ID NO: 18722 - RNA, 20 nt, Homo sapiens
gacauacuaaccagcagaaa

SEQ ID NO: 18723 - RNA, 17 nt, Homo sapiens
gacaugggccccagaua

SEQ ID NO: 18724 - RNA, 20 nt, Homo sapiens
gacaugggccccagauacca

SEQ ID NO: 18725 - RNA, 17 nt, Homo sapiens
gaccaggcacccccaga

SEQ ID NO: 18726 - RNA, 18 nt, Homo sapiens
gaccucugcagcaauaaa

SEQ ID NO: 18727 - RNA, 21 nt, Homo sapiens
gacugcuaguuuauauagaaa

SEQ ID NO: 18728 - RNA, 15 nt, Homo sapiens
gacuuacuguacaug

SEQ ID NO: 18729 - RNA, 15 nt, Homo sapiens
gacuucauuaauaau

SEQ ID NO: 18730 - RNA, 17 nt, Homo sapiens
gacuuggccccugccac

SEQ ID NO: 18731 - RNA, 19 nt, Homo sapiens
gacuuggccccugccaccu

SEQ ID NO: 18732 - RNA, 17 nt, Homo sapiens
gacuuguacucugaaag

SEQ ID NO: 18733 - RNA, 21 nt, Homo sapiens
gagaaggcuguggauuuaaug

SEQ ID NO: 18734 - RNA, 16 nt, Homo sapiens
gagaauaaaaaaugua

SEQ ID NO: 18735 - RNA, 14 nt, Homo sapiens
auguuucuugggga

SEQ ID NO: 18736 - RNA, 21 nt, Homo sapiens
augugaaacuggauuaaacuu

SEQ ID NO: 18737 - RNA, 15 nt, Homo sapiens
augugacggcaggga

SEQ ID NO: 18738 - RNA, 23 nt, Homo sapiens
auguguaaaauaagguuaugauu

SEQ ID NO: 18739 - RNA, 14 nt, Homo sapiens
auguuaauauuucu

SEQ ID NO: 18740 - RNA, 18 nt, Homo sapiens
auguuagagaauuuccuu

SEQ ID NO: 18741 - RNA, 22 nt, Homo sapiens
auggcccugccaugcucuccaa

SEQ ID NO: 18742 - RNA, 11 nt, Homo sapiens
auguaacaaca

SEQ ID NO: 18743 - RNA, 12 nt, Homo sapiens
auguaacaacaa

SEQ ID NO: 18744 - RNA, 21 nt, Homo sapiens
auggucggaaaacaugcuaca

SEQ ID NO: 18745 - RNA, 13 nt, Homo sapiens
augcacacauuuu

SEQ ID NO: 18746 - RNA, 22 nt, Homo sapiens
augcacagaguuguuacauuuu

SEQ ID NO: 18747 - RNA, 21 nt, Homo sapiens
augcaugaaguaauaugcaca

SEQ ID NO: 18748 - RNA, 13 nt, Homo sapiens
augcuauuuauua

SEQ ID NO: 18749 - RNA, 15 nt, Homo sapiens
augcucuccaaacca

SEQ ID NO: 18750 - RNA, 16 nt, Homo sapiens
augcugagcccggaaa

SEQ ID NO: 18751 - RNA, 12 nt, Homo sapiens
augcuuguacau

SEQ ID NO: 18752 - RNA, 14 nt, Homo sapiens
auucauauuuaauu

SEQ ID NO: 18753 - RNA, 14 nt, Homo sapiens
auucuauguuaaua

SEQ ID NO: 18754 - RNA, 18 nt, Homo sapiens
auucugccugcccugaaa

SEQ ID NO: 18755 - RNA, 12 nt, Homo sapiens
auuaaauaaaau

SEQ ID NO: 18756 - RNA, 13 nt, Homo sapiens
auuaaauaaaauu

SEQ ID NO: 18757 - RNA, 15 nt, Homo sapiens
auuaaggauuuuaug

SEQ ID NO: 18758 - RNA, 16 nt, Homo sapiens
auuauuugaagauuua

SEQ ID NO: 18759 - RNA, 19 nt, Homo sapiens
auuauuugaagauuuaauu

SEQ ID NO: 18760 - RNA, 20 nt, Homo sapiens
auuauuugaagauuuaauua

SEQ ID NO: 18761 - RNA, 14 nt, Homo sapiens
auugagaaggagcu

SEQ ID NO: 18762 - RNA, 18 nt, Homo sapiens
auuggcuagagguucaaa

SEQ ID NO: 18763 - RNA, 14 nt, Homo sapiens
auuuaguuauaaaa

SEQ ID NO: 18764 - RNA, 12 nt, Homo sapiens
auuuauaaucac

SEQ ID NO: 18765 - RNA, 19 nt, Homo sapiens
auuuauugaaaugauuuca

SEQ ID NO: 18766 - RNA, 14 nt, Homo sapiens
auuuauuuauucau

SEQ ID NO: 18767 - RNA, 21 nt, Homo sapiens
auuuccaagaaauauuccuua

SEQ ID NO: 18768 - RNA, 20 nt, Homo sapiens
auuuccguuaaaauaccagc

SEQ ID NO: 18769 - RNA, 23 nt, Homo sapiens
auuucuaaaucuccaaaauaaaa

SEQ ID NO: 18770 - RNA, 13 nt, Homo sapiens
auuugaagauuua

SEQ ID NO: 18771 - RNA, 13 nt, Homo sapiens
auuugaauauaaa

SEQ ID NO: 18772 - RNA, 14 nt, Homo sapiens
auuugaauauaaau

SEQ ID NO: 18773 - RNA, 21 nt, Homo sapiens
auuugaauauaaauuuaucau

SEQ ID NO: 18774 - RNA, 22 nt, Homo sapiens
auuugaauauaaauuuaucauu

SEQ ID NO: 18775 - RNA, 19 nt, Homo sapiens
auuugcuguuauuuuaucu

SEQ ID NO: 18776 - RNA, 14 nt, Homo sapiens
auuuaagauaugua

SEQ ID NO: 18777 - RNA, 15 nt, Homo sapiens
auuuaagauauguaa

SEQ ID NO: 18778 - RNA, 22 nt, Homo sapiens
auuucuuuugccguuauuaaaa

SEQ ID NO: 18779 - RNA, 13 nt, Homo sapiens
auuuguuugcaua

SEQ ID NO: 18780 - RNA, 20 nt, Homo sapiens
auuuuaaggcauauuuaaca

SEQ ID NO: 18781 - RNA, 23 nt, Homo sapiens
auuuuaauguuucuuggggaaua

SEQ ID NO: 18782 - RNA, 18 nt, Homo sapiens
caccuuaucuauguagaa

SEQ ID NO: 18783 - RNA, 19 nt, Homo sapiens
caccccggacuccuccgca

SEQ ID NO: 18784 - RNA, 21 nt, Homo sapiens
caccucagcugccuccccagc

SEQ ID NO: 18785 - RNA, 22 nt, Homo sapiens
caccucagcugccuccccagcu

SEQ ID NO: 18786 - RNA, 12 nt, Homo sapiens
caccucccauuc

SEQ ID NO: 18787 - RNA, 19 nt, Homo sapiens
caauguuuagcagauuuaa

SEQ ID NO: 18788 - RNA, 20 nt, Homo sapiens
caauuuuaaggcauauuuaa

SEQ ID NO: 18789 - RNA, 13 nt, Homo sapiens
cacacuuuugguu

SEQ ID NO: 18790 - RNA, 11 nt, Homo sapiens
cacacacuuuu

SEQ ID NO: 18791 - RNA, 18 nt, Homo sapiens
cacaguguguggucaaca

SEQ ID NO: 18792 - RNA, 21 nt, Homo sapiens
cacauuuuauuuuauuaugca

SEQ ID NO: 18793 - RNA, 13 nt, Homo sapiens
auuuuaggucaaa

SEQ ID NO: 18794 - RNA, 14 nt, Homo sapiens
auuuuaggucaaac

SEQ ID NO: 18795 - RNA, 13 nt, Homo sapiens
auuuuaugcuuua

SEQ ID NO: 18796 - RNA, 12 nt, Homo sapiens
auuuuucucaau

SEQ ID NO: 18797 - RNA, 12 nt, Homo sapiens
auuuuuguaauu

SEQ ID NO: 18798 - RNA, 22 nt, Homo sapiens
auuuuuguaauuuuuuuaucgu

SEQ ID NO: 18799 - RNA, 23 nt, Homo sapiens
auuuuuuuacuaauagacaauuu

SEQ ID NO: 18800 - RNA, 21 nt, Homo sapiens
auuuuuuuuuucaauaaaacu

SEQ ID NO: 18801 - RNA, 23 nt, Homo sapiens
caaacuuaacaaugacuuguacu

SEQ ID NO: 18802 - RNA, 17 nt, Homo sapiens
caaauugagcuaggggg

SEQ ID NO: 18803 - RNA, 22 nt, Homo sapiens
caacaauuauuugaagauuuaa

SEQ ID NO: 18804 - RNA, 14 nt, Homo sapiens
caaggucauuuuuu

SEQ ID NO: 18805 - RNA, 16 nt, Homo sapiens
auagacaauuuauuau

SEQ ID NO: 18806 - RNA, 21 nt, Homo sapiens
auauccuuagcccaucuuuca

SEQ ID NO: 18807 - RNA, 13 nt, Homo sapiens
auacuacaguuug

SEQ ID NO: 18808 - RNA, 23 nt, Homo sapiens
auacuauuuaauuauuucacuuu

SEQ ID NO: 18809 - RNA, 24 nt, Homo sapiens
auacuauuuaauuauuucacuuua

SEQ ID NO: 18810 - RNA, 15 nt, Homo sapiens
auacguacacauuuu

SEQ ID NO: 18811 - RNA, 17 nt, Homo sapiens
auaaaauuuuuauguaa

SEQ ID NO: 18812 - RNA, 19 nt, Homo sapiens
auaaacaagaccacguuuc

SEQ ID NO: 18813 - RNA, 16 nt, Homo sapiens
auaacuguuauuuaua

SEQ ID NO: 18814 - RNA, 22 nt, Homo sapiens
auaaugcgugcauaccacuuuu

SEQ ID NO: 18815 - RNA, 12 nt, Homo sapiens
auacauaaacaa

SEQ ID NO: 18816 - RNA, 13 nt, Homo sapiens
auacauaaacaag

SEQ ID NO: 18817 - RNA, 12 nt, Homo sapiens
agugcugcauuu

SEQ ID NO: 18818 - RNA, 16 nt, Homo sapiens
agugcugcauuuaaaa

SEQ ID NO: 18819 - RNA, 12 nt, Homo sapiens
agucuguuuuau

SEQ ID NO: 18820 - RNA, 12 nt, Homo sapiens
agugaaacugcu

SEQ ID NO: 18821 - RNA, 16 nt, Homo sapiens
aguucaaguucaccag

SEQ ID NO: 18822 - RNA, 13 nt, Homo sapiens
aguuuauauagaa

SEQ ID NO: 18823 - RNA, 22 nt, Homo sapiens
aguuuauauagaaauguauucu

SEQ ID NO: 18824 - RNA, 12 nt, Homo sapiens
aguguuuagcau

SEQ ID NO: 18825 - RNA, 15 nt, Homo sapiens
auaaaauauuuaaaa

SEQ ID NO: 18826 - RNA, 13 nt, Homo sapiens
aucucauuuaauc

SEQ ID NO: 18827 - RNA, 14 nt, Homo sapiens
aucuucacuuuuau

SEQ ID NO: 18828 - RNA, 17 nt, Homo sapiens
auccuccuccugcuucc

SEQ ID NO: 18829 - RNA, 16 nt, Homo sapiens
auccucucaaccaccu

SEQ ID NO: 18830 - RNA, 20 nt, Homo sapiens
aucgcuuuugauaaucaacu

SEQ ID NO: 18831 - RNA, 16 nt, Homo sapiens
auaugcuauuuauuaa

SEQ ID NO: 18832 - RNA, 16 nt, Homo sapiens
auauguaacaacaauu

SEQ ID NO: 18833 - RNA, 18 nt, Homo sapiens
auauucauucuuuuugaa

SEQ ID NO: 18834 - RNA, 14 nt, Homo sapiens
auauuuaauuugaa

SEQ ID NO: 18835 - RNA, 21 nt, Homo sapiens
auauuuauugauguuuucaca

SEQ ID NO: 18836 - RNA, 15 nt, Homo sapiens
aucaauccaagaacu

SEQ ID NO: 18837 - RNA, 15 nt, Homo sapiens
aucacccagaagaaa

SEQ ID NO: 18838 - RNA, 13 nt, Homo sapiens
agguuaugauuga

SEQ ID NO: 18839 - RNA, 19 nt, Homo sapiens
aguaauaugcacacauuuu

SEQ ID NO: 18840 - RNA, 16 nt, Homo sapiens
aguacguugugcauuu

SEQ ID NO: 18841 - RNA, 17 nt, Homo sapiens
aguacguugugcauuug

SEQ ID NO: 18842 - RNA, 20 nt, Homo sapiens
aguaucagcuacaauuguaa

SEQ ID NO: 18843 - RNA, 19 nt, Homo sapiens
aguaucccuacuguaauuu

SEQ ID NO: 18844 - RNA, 18 nt, Homo sapiens
aguaucugacaucucugc

SEQ ID NO: 18845 - RNA, 13 nt, Homo sapiens
aguaugugcauuu

SEQ ID NO: 18846 - RNA, 14 nt, Homo sapiens
aguaugugcauuua

SEQ ID NO: 18847 - RNA, 15 nt, Homo sapiens
aguaugugcauuuaa

SEQ ID NO: 18848 - RNA, 17 nt, Homo sapiens
aggggcuuaauuauuga

SEQ ID NO: 18849 - RNA, 20 nt, Homo sapiens
agguagaauguuuucaaaug

SEQ ID NO: 18850 - RNA, 10 nt, Homo sapiens
aggucauuuu

SEQ ID NO: 18851 - RNA, 10 nt, Homo sapiens
aggaugcaca

SEQ ID NO: 18852 - RNA, 16 nt, Homo sapiens
aggaugcacagaguug

SEQ ID NO: 18853 - RNA, 10 nt, Homo sapiens
aggaacagaa

SEQ ID NO: 18854 - RNA, 12 nt, Homo sapiens
aggagccugcaa

SEQ ID NO: 18855 - RNA, 13 nt, Homo sapiens
aggagccugcaac

SEQ ID NO: 18856 - RNA, 13 nt, Homo sapiens
aggcaucgccauu

SEQ ID NO: 18857 - RNA, 16 nt, Homo sapiens
aggcccuagcauuucu

SEQ ID NO: 18858 - RNA, 20 nt, Homo sapiens
aggcacccccagaaugaccu

SEQ ID NO: 18859 - RNA, 19 nt, Homo sapiens
aggcauauuuaacaaaauu

SEQ ID NO: 18860 - RNA, 23 nt, Homo sapiens
agcuagaaaacaggcaaauuccu

SEQ ID NO: 18861 - RNA, 19 nt, Homo sapiens
agcucucaguugcagcccu

SEQ ID NO: 18862 - RNA, 22 nt, Homo sapiens
agcucucugaccuccuccuuca

SEQ ID NO: 18863 - RNA, 17 nt, Homo sapiens
acgugauuuuuaaauua

SEQ ID NO: 18864 - RNA, 22 nt, Homo sapiens
acucagaauucucuaguuugau

SEQ ID NO: 18865 - RNA, 16 nt, Homo sapiens
acucuugauuguggga

SEQ ID NO: 18866 - RNA, 13 nt, Homo sapiens
acugcuuaacuuc

SEQ ID NO: 18867 - RNA, 13 nt, Homo sapiens
acuggcuguuaau

SEQ ID NO: 18868 - RNA, 18 nt, Homo sapiens
accuuuuuuauacauaaa

SEQ ID NO: 18869 - RNA, 21 nt, Homo sapiens
uuggauucaauuuuaaggcau

SEQ ID NO: 18870 - RNA, 18 nt, Homo sapiens
uuguaacuguaaagauga

SEQ ID NO: 18871 - RNA, 16 nt, Homo sapiens
uuguagcguacaucaa

SEQ ID NO: 18872 - RNA, 9 nt, Homo sapiens
uuuaauauc

SEQ ID NO: 18873 - RNA, 13 nt, Homo sapiens
uuuagcagauuua

SEQ ID NO: 18874 - RNA, 13 nt, Homo sapiens
uuuauguaauuau

SEQ ID NO: 18875 - RNA, 19 nt, Homo sapiens
uuucacaaagaacaggaaa

SEQ ID NO: 18876 - RNA, 14 nt, Homo sapiens
uuugccguuauuaa

SEQ ID NO: 18877 - RNA, 19 nt, Homo sapiens
uuuuaagaaaaaggaugca

SEQ ID NO: 18878 - RNA, 15 nt, Homo sapiens
uuuuaaggcauauuu

SEQ ID NO: 18879 - RNA, 23 nt, Homo sapiens
uuuuaaggcauauuuaacaaaau

SEQ ID NO: 18880 - RNA, 14 nt, Homo sapiens
uuuuaagugcugca

SEQ ID NO: 18881 - RNA, 22 nt, Homo sapiens
uuuuaucgucacugcuuaacuu

SEQ ID NO: 18882 - RNA, 19 nt, Homo sapiens
uuuucacaaagaacaggaa

SEQ ID NO: 18883 - RNA, 20 nt, Homo sapiens
uuuucacaaagaacaggaaa

SEQ ID NO: 18884 - RNA, 18 nt, Homo sapiens
accguuugugauugccau

SEQ ID NO: 18885 - RNA, 12 nt, Homo sapiens
accucugcuauu

SEQ ID NO: 18886 - RNA, 15 nt, Homo sapiens
accucuccagccuca

SEQ ID NO: 18887 - RNA, 22 nt, Homo sapiens
accucuccagccucagcucuca

SEQ ID NO: 18888 - RNA, 20 nt, Homo sapiens
accugggccauagucauucu

SEQ ID NO: 18889 - RNA, 15 nt, Homo sapiens
agccucuauugccau

SEQ ID NO: 18890 - RNA, 15 nt, Homo sapiens
agcacgauuucuguu

SEQ ID NO: 18891 - RNA, 14 nt, Homo sapiens
agaugaaugucagu

SEQ ID NO: 18892 - RNA, 13 nt, Homo sapiens
agauuuaagauau

SEQ ID NO: 18893 - RNA, 17 nt, Homo sapiens
agcaaggagauuuacaa

SEQ ID NO: 18894 - RNA, 20 nt, Homo sapiens
agcagcguuucuaugacaca

SEQ ID NO: 18895 - RNA, 20 nt, Homo sapiens
acuguuauuuauaaucacuu

SEQ ID NO: 18896 - RNA, 13 nt, Homo sapiens
acuuacuguacau

SEQ ID NO: 18897 - RNA, 14 nt, Homo sapiens
acuuacuguacaug

SEQ ID NO: 18898 - RNA, 16 nt, Homo sapiens
acuucauuaauaauaa

SEQ ID NO: 18899 - RNA, 17 nt, Homo sapiens
acuucauuaauaauaaa

SEQ ID NO: 18900 - RNA, 20 nt, Homo sapiens
acuuuaccuuuuuuauacau

SEQ ID NO: 18901 - RNA, 15 nt, Homo sapiens
acuuugauuuuauau

SEQ ID NO: 18902 - RNA, 17 nt, Homo sapiens
agaacaggaaaauaaaa

SEQ ID NO: 18903 - RNA, 11 nt, Homo sapiens
agaaguuuucu

SEQ ID NO: 18904 - RNA, 20 nt, Homo sapiens
agacaauuuauuauggcaca

SEQ ID NO: 18905 - RNA, 20 nt, Homo sapiens
agacauacuaaccagcagaa

SEQ ID NO: 18906 - RNA, 16 nt, Homo sapiens
agaguuguuacauuuu

SEQ ID NO: 18907 - RNA, 22 nt, Homo sapiens
agauauuuugcuuugugauuuu

SEQ ID NO: 18908 - RNA, 13 nt, Homo sapiens
agaucauugugaa

SEQ ID NO: 18909 - RNA, 16 nt, Homo sapiens
acagaguuguuacauu

SEQ ID NO: 18910 - RNA, 16 nt, Homo sapiens
acagcacuuacaauuu

SEQ ID NO: 18911 - RNA, 19 nt, Homo sapiens
acacuguuaucuucacuuu

SEQ ID NO: 18912 - RNA, 13 nt, Homo sapiens
acacuguuucaaa

SEQ ID NO: 18913 - RNA, 21 nt, Homo sapiens
acaguuuugguugcuuuaaua

SEQ ID NO: 18914 - RNA, 18 nt, Homo sapiens
acauaaggaaacuggguu

SEQ ID NO: 18915 - RNA, 19 nt, Homo sapiens
acauaaggaaacuggguuc

SEQ ID NO: 18916 - RNA, 17 nt, Homo sapiens
acauaucacaugucagc

SEQ ID NO: 18917 - RNA, 21 nt, Homo sapiens
acauauugauuuccguuaaaa

SEQ ID NO: 18918 - RNA, 14 nt, Homo sapiens
acauuucucauguu

SEQ ID NO: 18919 - RNA, 17 nt, Homo sapiens
acauuucucauguugaa

SEQ ID NO: 18920 - RNA, 21 nt, Homo sapiens
acauuuuucuuagggaaggau

SEQ ID NO: 18921 - RNA, 12 nt, Homo sapiens
accacagacaua

SEQ ID NO: 18922 - RNA, 18 nt, Homo sapiens
accacuuuuugcagcuuu

SEQ ID NO: 18923 - RNA, 14 nt, Homo sapiens
accaggcaccccca

SEQ ID NO: 18924 - RNA, 13 nt, Homo sapiens
accauaauucugg

SEQ ID NO: 18925 - RNA, 23 nt, Homo sapiens
accccagggcuugugugcacaua

SEQ ID NO: 18926 - RNA, 19 nt, Homo sapiens
uucacuuuuauaagaaaua

SEQ ID NO: 18927 - RNA, 17 nt, Homo sapiens
uucauaagaauucuguu

SEQ ID NO: 18928 - RNA, 17 nt, Homo sapiens
uuccaagaaauauuccu

SEQ ID NO: 18929 - RNA, 19 nt, Homo sapiens
uuccuuauucagaauuucu

SEQ ID NO: 18930 - RNA, 14 nt, Homo sapiens
uucuauguuaauau

SEQ ID NO: 18931 - RNA, 22 nt, Homo sapiens
uucucuagucauuuguuaauau

SEQ ID NO: 18932 - RNA, 15 nt, Homo sapiens
uucuugcaaaguauc

SEQ ID NO: 18933 - RNA, 17 nt, Homo sapiens
uugaccucugcagcaau

SEQ ID NO: 18934 - RNA, 20 nt, Homo sapiens
uugagaaggagcucccagga

SEQ ID NO: 18935 - RNA, 22 nt, Homo sapiens
uguuuucauagagaauauaaaa

SEQ ID NO: 18936 - RNA, 11 nt, Homo sapiens
uuaauguggaa

SEQ ID NO: 18937 - RNA, 12 nt, Homo sapiens
uuaauguggaaa

SEQ ID NO: 18938 - RNA, 23 nt, Homo sapiens
uuagagcagagagguuucgauau

SEQ ID NO: 18939 - RNA, 16 nt, Homo sapiens
uuagcagauuuaagau

SEQ ID NO: 18940 - RNA, 13 nt, Homo sapiens
uuauaugcuauuu

SEQ ID NO: 18941 - RNA, 10 nt, Homo sapiens
uuaucauuua

SEQ ID NO: 18942 - RNA, 17 nt, Homo sapiens
uuauccuuguuaaguau

SEQ ID NO: 18943 - RNA, 15 nt, Homo sapiens
uuauguguaaaauaa

SEQ ID NO: 18944 - RNA, 14 nt, Homo sapiens
uucaaacuuuacua

SEQ ID NO: 18945 - RNA, 22 nt, Homo sapiens
uucacaaagaacaggaaaauaa

SEQ ID NO: 18946 - RNA, 13 nt, Homo sapiens
uguuuauuuguuu

SEQ ID NO: 18947 - RNA, 13 nt, Homo sapiens
uguuucauaagaa

SEQ ID NO: 18948 - RNA, 14 nt, Homo sapiens
uguuuuaaggaugc

SEQ ID NO: 18949 - RNA, 12 nt, Homo sapiens
ugugauacaaug

SEQ ID NO: 18950 - RNA, 12 nt, Homo sapiens
ugugaugaucua

SEQ ID NO: 18951 - RNA, 23 nt, Homo sapiens
ugugcacaucuguuuuguaacug

SEQ ID NO: 18952 - RNA, 16 nt, Homo sapiens
ugugcauuuaauuaga

SEQ ID NO: 18953 - RNA, 14 nt, Homo sapiens
uguuaaucuuucaa

SEQ ID NO: 18954 - RNA, 15 nt, Homo sapiens
uguuaaucuuucaaa

SEQ ID NO: 18955 - RNA, 14 nt, Homo sapiens
uguuacauuuuuaa

SEQ ID NO: 18956 - RNA, 16 nt, Homo sapiens
uguuacauuuuuaagu

SEQ ID NO: 18957 - RNA, 16 nt, Homo sapiens
uguuacuaaguuuuua

SEQ ID NO: 18958 - RNA, 19 nt, Homo sapiens
uguuacuaaguuuuuaugg

SEQ ID NO: 18959 - RNA, 16 nt, Homo sapiens
uguuauuuauugaaau

SEQ ID NO: 18960 - RNA, 17 nt, Homo sapiens
uguuauuuauugaaaug

SEQ ID NO: 18961 - RNA, 16 nt, Homo sapiens
ugggguugggggggag

SEQ ID NO: 18962 - RNA, 17 nt, Homo sapiens
ugggguugggggggagg

SEQ ID NO: 18963 - RNA, 13 nt, Homo sapiens
uggggugggggug

SEQ ID NO: 18964 - RNA, 12 nt, Homo sapiens
uggugugaacua

SEQ ID NO: 18965 - RNA, 22 nt, Homo sapiens
uguaacuguaaagaugaauguc

SEQ ID NO: 18966 - RNA, 18 nt, Homo sapiens
uguaauuugugauacaau

SEQ ID NO: 18967 - RNA, 12 nt, Homo sapiens
uguaaaauaagg

SEQ ID NO: 18968 - RNA, 14 nt, Homo sapiens
uguaugugcacauc

SEQ ID NO: 18969 - RNA, 9 nt, Homo sapiens
uguauucuu

SEQ ID NO: 18970 - RNA, 20 nt, Homo sapiens
uguagcguacaucaaugaua

SEQ ID NO: 18971 - RNA, 14 nt, Homo sapiens
ugcugccugccugg

SEQ ID NO: 18972 - RNA, 14 nt, Homo sapiens
ugcugcugccugcc

SEQ ID NO: 18973 - RNA, 12 nt, Homo sapiens
ugcuuguacaua

SEQ ID NO: 18974 - RNA, 13 nt, Homo sapiens
ugcuuguacauaa

SEQ ID NO: 18975 - RNA, 14 nt, Homo sapiens
uggcacaucagcac

SEQ ID NO: 18976 - RNA, 20 nt, Homo sapiens
uggccagugagaucaaugug

SEQ ID NO: 18977 - RNA, 11 nt, Homo sapiens
uggccuuucau

SEQ ID NO: 18978 - RNA, 12 nt, Homo sapiens
uggccuuucaua

SEQ ID NO: 18979 - RNA, 18 nt, Homo sapiens
ugggcagacucuggucaa

SEQ ID NO: 18980 - RNA, 19 nt, Homo sapiens
cuauuuaauuauuucacuu

SEQ ID NO: 18981 - RNA, 21 nt, Homo sapiens
cuauguagaauauauuuccuu

SEQ ID NO: 18982 - RNA, 14 nt, Homo sapiens
cuauuuauuuauuu

SEQ ID NO: 18983 - RNA, 18 nt, Homo sapiens
cuauuuauuuauuuauuu

SEQ ID NO: 18984 - RNA, 22 nt, Homo sapiens
cuauuuauuuauuuauuuauuu

SEQ ID NO: 18985 - RNA, 12 nt, Homo sapiens
cucaccugugag

SEQ ID NO: 18986 - RNA, 16 nt, Homo sapiens
cucaguugcagcccug

SEQ ID NO: 18987 - RNA, 21 nt, Homo sapiens
cucaguugcagcccugcugcu

SEQ ID NO: 18988 - RNA, 18 nt, Homo sapiens
cuauuauauucauucuuu

SEQ ID NO: 18989 - RNA, 18 nt, Homo sapiens
cuaauuuuauuauaguaa

SEQ ID NO: 18990 - RNA, 20 nt, Homo sapiens
cuacaaaauauagcuuucau

SEQ ID NO: 18991 - RNA, 17 nt, Homo sapiens
cuagcauacguacacau

SEQ ID NO: 18992 - RNA, 15 nt, Homo sapiens
cuaggugcugcagcc

SEQ ID NO: 18993 - RNA, 23 nt, Homo sapiens
cuauccaccaaaagggcucccug

SEQ ID NO: 18994 - RNA, 16 nt, Homo sapiens
cuaaacauguauguaa

SEQ ID NO: 18995 - RNA, 20 nt, Homo sapiens
cgauuucuguuuagauaaua

SEQ ID NO: 18996 - RNA, 15 nt, Homo sapiens
cgcuuuugauaauca

SEQ ID NO: 18997 - RNA, 16 nt, Homo sapiens
cgcuuuugauaaucaa

SEQ ID NO: 18998 - RNA, 23 nt, Homo sapiens
cggauugagaaggagcucccagg

SEQ ID NO: 18999 - RNA, 21 nt, Homo sapiens
cugggaccaggcacccccaga

SEQ ID NO: 19000 - RNA, 21 nt, Homo sapiens
cugggcaagggaccugcuucu

SEQ ID NO: 19001 - RNA, 17 nt, Homo sapiens
cuggcguuguggggaug

SEQ ID NO: 19002 - RNA, 17 nt, Homo sapiens
cuguaauuugugauaca

SEQ ID NO: 19003 - RNA, 18 nt, Homo sapiens
cuguacaugaaaacacau

SEQ ID NO: 19004 - RNA, 17 nt, Homo sapiens
cuguuuuaugacuucau

SEQ ID NO: 19005 - RNA, 12 nt, Homo sapiens
cuuaaauaauaa

SEQ ID NO: 19006 - RNA, 22 nt, Homo sapiens
cuuaauuauugauguuuucaua

SEQ ID NO: 19007 - RNA, 12 nt, Homo sapiens
cuuacucuugau

SEQ ID NO: 19008 - RNA, 13 nt, Homo sapiens
cuucuauuuauuu

SEQ ID NO: 19009 - RNA, 14 nt, Homo sapiens
cuuggccccugcca

SEQ ID NO: 19010 - RNA, 22 nt, Homo sapiens
cuuuaccuuuuuuauacauaaa

SEQ ID NO: 19011 - RNA, 20 nt, Homo sapiens
cuuucaagggaccucuccau

SEQ ID NO: 19012 - RNA, 23 nt, Homo sapiens
cuuucucuaguucaaguucacca

SEQ ID NO: 19013 - RNA, 17 nt, Homo sapiens
cuuugaccucugcagca

SEQ ID NO: 19014 - RNA, 18 nt, Homo sapiens
cuuugaccucugcagcaa

SEQ ID NO: 19015 - RNA, 15 nt, Homo sapiens
cuuuuaaacuuugau

SEQ ID NO: 19016 - RNA, 18 nt, Homo sapiens
gaaaacacauuuuucuua

SEQ ID NO: 19017 - RNA, 15 nt, Homo sapiens
gaaaaguuucccagu

SEQ ID NO: 19018 - RNA, 16 nt, Homo sapiens
gaaaauaaaauauuua

SEQ ID NO: 19019 - RNA, 18 nt, Homo sapiens
gaaaauaaaauauuuaaa

SEQ ID NO: 19020 - RNA, 19 nt, Homo sapiens
cuuuuuuagaguugauacu

SEQ ID NO: 19021 - RNA, 16 nt, Homo sapiens
gaaagcugaguguuuc

SEQ ID NO: 19022 - RNA, 18 nt, Homo sapiens
cugcuauuugcuguuauu

SEQ ID NO: 19023 - RNA, 19 nt, Homo sapiens
cugcuauuugcuguuauuu

SEQ ID NO: 19024 - RNA, 11 nt, Homo sapiens
cuggacuuggc

SEQ ID NO: 19025 - RNA, 12 nt, Homo sapiens
cuggacuuggcc

SEQ ID NO: 19026 - RNA, 20 nt, Homo sapiens
cugccuggacuuggccccug

SEQ ID NO: 19027 - RNA, 12 nt, Homo sapiens
cugaauuucuuu

SEQ ID NO: 19028 - RNA, 15 nt, Homo sapiens
cugacacuaaaacac

SEQ ID NO: 19029 - RNA, 15 nt, Homo sapiens
cugcaaucuucucag

SEQ ID NO: 19030 - RNA, 15 nt, Homo sapiens
cugccaugcucucca

SEQ ID NO: 19031 - RNA, 22 nt, Homo sapiens
cucccuauuuuuuuucuguuau

SEQ ID NO: 19032 - RNA, 23 nt, Homo sapiens
cucccuauuuuuuuucuguuaua

SEQ ID NO: 19033 - RNA, 10 nt, Homo sapiens
cuccugccuc

SEQ ID NO: 19034 - RNA, 13 nt, Homo sapiens
cuccacauccugu

SEQ ID NO: 19035 - RNA, 13 nt, Homo sapiens
cuccauggcccug

SEQ ID NO: 19036 - RNA, 16 nt, Homo sapiens
cuccuuguguuacuaa

SEQ ID NO: 19037 - RNA, 23 nt, Homo sapiens
cucuccaugaucccaccucccau

SEQ ID NO: 19038 - RNA, 22 nt, Homo sapiens
cugaaccauggucggaaaacau

SEQ ID NO: 19039 - RNA, 22 nt, Homo sapiens
cugaaccguuugugauugccau

SEQ ID NO: 19040 - RNA, 13 nt, Homo sapiens
ccugcuuccuccg

SEQ ID NO: 19041 - RNA, 13 nt, Homo sapiens
ccuggauggcugc

SEQ ID NO: 19042 - RNA, 14 nt, Homo sapiens
ccuggauggcugcc

SEQ ID NO: 19043 - RNA, 16 nt, Homo sapiens
ccugccaccuccugcc

SEQ ID NO: 19044 - RNA, 16 nt, Homo sapiens
ccugccaugcucucca

SEQ ID NO: 19045 - RNA, 20 nt, Homo sapiens
ccuucauggcaggcaucgcc

SEQ ID NO: 19046 - RNA, 15 nt, Homo sapiens
ccuuuuuuauacaua

SEQ ID NO: 19047 - RNA, 21 nt, Homo sapiens
ccuacauguauuuguuugcau

SEQ ID NO: 19048 - RNA, 11 nt, Homo sapiens
ccuauaauuuu

SEQ ID NO: 19049 - RNA, 23 nt, Homo sapiens
cccuuacaggaacagaagaggaa

SEQ ID NO: 19050 - RNA, 16 nt, Homo sapiens
ccgcuauccaccaaaa

SEQ ID NO: 19051 - RNA, 14 nt, Homo sapiens
ccccaaguuaguuc

SEQ ID NO: 19052 - RNA, 15 nt, Homo sapiens
cccgugugccugagc

SEQ ID NO: 19053 - RNA, 15 nt, Homo sapiens
cccugagggucuggg

SEQ ID NO: 19054 - RNA, 11 nt, Homo sapiens
cccagauacca

SEQ ID NO: 19055 - RNA, 12 nt, Homo sapiens
cccagauaccau

SEQ ID NO: 19056 - RNA, 15 nt, Homo sapiens
ccacuuggacauggg

SEQ ID NO: 19057 - RNA, 16 nt, Homo sapiens
ccacuuggacaugggc

SEQ ID NO: 19058 - RNA, 13 nt, Homo sapiens
cauucugccugcc

SEQ ID NO: 19059 - RNA, 14 nt, Homo sapiens
cauucugccugccc

SEQ ID NO: 19060 - RNA, 18 nt, Homo sapiens
cauucuuuuugaaauguc

SEQ ID NO: 19061 - RNA, 17 nt, Homo sapiens
cauuucucauguugaaa

SEQ ID NO: 19062 - RNA, 17 nt, Homo sapiens
cauuugaaaauuuugau

SEQ ID NO: 19063 - RNA, 19 nt, Homo sapiens
caugucagccacugugaua

SEQ ID NO: 19064 - RNA, 14 nt, Homo sapiens
cauuaguuuugaag

SEQ ID NO: 19065 - RNA, 15 nt, Homo sapiens
cauuaguuuugaaga

SEQ ID NO: 19066 - RNA, 18 nt, Homo sapiens
cauuuguuaauauuucuu

SEQ ID NO: 19067 - RNA, 19 nt, Homo sapiens
cauuuguuaauauuucuuc

SEQ ID NO: 19068 - RNA, 21 nt, Homo sapiens
cauuuuauuuuauuaugcaug

SEQ ID NO: 19069 - RNA, 15 nt, Homo sapiens
ccaagaaauauuccu

SEQ ID NO: 19070 - RNA, 11 nt, Homo sapiens
ccaagcaaaug

SEQ ID NO: 19071 - RNA, 19 nt, Homo sapiens
caguuguuauuuauugaaa

SEQ ID NO: 19072 - RNA, 19 nt, Homo sapiens
cauaaacaagaccacguuu

SEQ ID NO: 19073 - RNA, 18 nt, Homo sapiens
cauaaccccggaagccaa

SEQ ID NO: 19074 - RNA, 12 nt, Homo sapiens
cauaccacuuuu

SEQ ID NO: 19075 - RNA, 21 nt, Homo sapiens
cauauuaccacagacauacua

SEQ ID NO: 19076 - RNA, 14 nt, Homo sapiens
cauauuuaacaaaa

SEQ ID NO: 19077 - RNA, 20 nt, Homo sapiens
cauauccuuagcccaucuuu

SEQ ID NO: 19078 - RNA, 14 nt, Homo sapiens
caucagcacgauuu

SEQ ID NO: 19079 - RNA, 18 nt, Homo sapiens
caucagcacgauuucugu

SEQ ID NO: 19080 - RNA, 24 nt, Homo sapiens
caucagcacgauuucuguuuagau

SEQ ID NO: 19081 - RNA, 17 nt, Homo sapiens
cauccaaaggcuccuga

SEQ ID NO: 19082 - RNA, 18 nt, Homo sapiens
caucgcuuaggagaaguc

SEQ ID NO: 19083 - RNA, 18 nt, Homo sapiens
caugaucccaccucccau

SEQ ID NO: 19084 - RNA, 18 nt, Homo sapiens
caugaugcugagcccgga

SEQ ID NO: 19085 - RNA, 16 nt, Homo sapiens
caugcaaggucauuuu

SEQ ID NO: 19086 - RNA, 14 nt, Homo sapiens
caggcacccccaga

SEQ ID NO: 19087 - RNA, 11 nt, Homo sapiens
caggaaaauaa

SEQ ID NO: 19088 - RNA, 22 nt, Homo sapiens
cagguaccuucucaccugugag

SEQ ID NO: 19089 - RNA, 20 nt, Homo sapiens
caguaguuagcuuucuuccu

SEQ ID NO: 19090 - RNA, 20 nt, Homo sapiens
cagcugccuccccagcucua

SEQ ID NO: 19091 - RNA, 19 nt, Homo sapiens
cagcguuucuaugacacau

SEQ ID NO: 19092 - RNA, 14 nt, Homo sapiens
cagcuacaauugua

SEQ ID NO: 19093 - RNA, 16 nt, Homo sapiens
cagccucagcucucag

SEQ ID NO: 19094 - RNA, 22 nt, Homo sapiens
cagccucagcucucaguugcag

SEQ ID NO: 19095 - RNA, 15 nt, Homo sapiens
caccugugagaccaa

SEQ ID NO: 19096 - RNA, 23 nt, Homo sapiens
cacuccaauuaaggauuuuaugc

SEQ ID NO: 19097 - RNA, 14 nt, Homo sapiens
cacugcauguuugu

SEQ ID NO: 19098 - RNA, 23 nt, Homo sapiens
cacuuggacaugggccccagaua

SEQ ID NO: 19099 - RNA, 10 nt, Homo sapiens
cagaauuucu

SEQ ID NO: 19100 - RNA, 19 nt, Homo sapiens
cagacauacuaaccagcag

SEQ ID NO: 19101 - RNA, 23 nt, Homo sapiens
cagauaacuguuauuuauaauca

SEQ ID NO: 19102 - RNA, 18 nt, Homo sapiens
cagcaauaaagcagcguu

SEQ ID NO: 19103 - RNA, 19 nt, Homo sapiens
cagcaauaaagcagcguuu

SEQ ID NO: 19104 - RNA, 13 nt, Homo sapiens
cagcagagaaguu

SEQ ID NO: 19105 - RNA, 16 nt, Homo sapiens
guucccgugugccuga

SEQ ID NO: 19106 - RNA, 14 nt, Homo sapiens
guugauggaaauac

SEQ ID NO: 19107 - RNA, 16 nt, Homo sapiens
guugcagcccugcugc

SEQ ID NO: 19108 - RNA, 18 nt, Homo sapiens
guugcagcccugcugcug

SEQ ID NO: 19109 - RNA, 19 nt, Homo sapiens
guugcagcccugcugcugc

SEQ ID NO: 19110 - RNA, 23 nt, Homo sapiens
guugcagcccugcugcugccugc

SEQ ID NO: 19111 - RNA, 14 nt, Homo sapiens
guuaaaauaccagc

SEQ ID NO: 19112 - RNA, 23 nt, Homo sapiens
guuaauauuucuucgugaugaca

SEQ ID NO: 19113 - RNA, 19 nt, Homo sapiens
guuaaucuuucaaaguguc

SEQ ID NO: 19114 - RNA, 16 nt, Homo sapiens
guuaucuucacuuuua

SEQ ID NO: 19115 - RNA, 17 nt, Homo sapiens
guuaucuucacuuuuau

SEQ ID NO: 19116 - RNA, 20 nt, Homo sapiens
gugugauuuggggauauuuu

SEQ ID NO: 19117 - RNA, 13 nt, Homo sapiens
guuauuaaaaauc

SEQ ID NO: 19118 - RNA, 15 nt, Homo sapiens
guuauuaaaaaucuc

SEQ ID NO: 19119 - RNA, 20 nt, Homo sapiens
guuauuuauaaucacuuuuu

SEQ ID NO: 19120 - RNA, 21 nt, Homo sapiens
guuauuuauaaucacuuuuuu

SEQ ID NO: 19121 - RNA, 19 nt, Homo sapiens
guuuauuuguuuuuccagu

SEQ ID NO: 19122 - RNA, 22 nt, Homo sapiens
guuucauaagaauucuguugau

SEQ ID NO: 19123 - RNA, 16 nt, Homo sapiens
guuucuaugacacaug

SEQ ID NO: 19124 - RNA, 22 nt, Homo sapiens
guuugcauaggugaucucauuu

SEQ ID NO: 19125 - RNA, 17 nt, Homo sapiens
uaaaaccugacagacca

SEQ ID NO: 19126 - RNA, 13 nt, Homo sapiens
uaaaagauacagu

SEQ ID NO: 19127 - RNA, 8 nt, Homo sapiens
uaaaauuu

SEQ ID NO: 19128 - RNA, 9 nt, Homo sapiens
uaaaauuuu

SEQ ID NO: 19129 - RNA, 21 nt, Homo sapiens
uaaaauuuuuauguaauuaua

SEQ ID NO: 19130 - RNA, 19 nt, Homo sapiens
gucucugaagugaaacugc

SEQ ID NO: 19131 - RNA, 17 nt, Homo sapiens
gugacuauuauauuucc

SEQ ID NO: 19132 - RNA, 14 nt, Homo sapiens
gugagaucaaugug

SEQ ID NO: 19133 - RNA, 20 nt, Homo sapiens
gugaugacauaucacauguc

SEQ ID NO: 19134 - RNA, 21 nt, Homo sapiens
gugggauacuauuuaauuauu

SEQ ID NO: 19135 - RNA, 15 nt, Homo sapiens
gugguuucagaaaug

SEQ ID NO: 19136 - RNA, 14 nt, Homo sapiens
uagauagaugaaga

SEQ ID NO: 19137 - RNA, 14 nt, Homo sapiens
uagcuuucuuccug

SEQ ID NO: 19138 - RNA, 19 nt, Homo sapiens
uacaucaaugauaaugcua

SEQ ID NO: 19139 - RNA, 22 nt, Homo sapiens
uaccacagacauacuaaccagc

SEQ ID NO: 19140 - RNA, 20 nt, Homo sapiens
uacuaauagacaauuuauua

SEQ ID NO: 19141 - RNA, 21 nt, Homo sapiens
uaaaguguauuuuuuuacuaa

SEQ ID NO: 19142 - RNA, 13 nt, Homo sapiens
uaaauaaaauuuu

SEQ ID NO: 19143 - RNA, 22 nt, Homo sapiens
uaaccagcagaaaugccuuacc

SEQ ID NO: 19144 - RNA, 16 nt, Homo sapiens
uaagaaaaaggaugca

SEQ ID NO: 19145 - RNA, 17 nt, Homo sapiens
uaagaaaaaggaugcac

SEQ ID NO: 19146 - RNA, 12 nt, Homo sapiens
uaacaaaauuug

SEQ ID NO: 19147 - RNA, 13 nt, Homo sapiens
uaauaauaaauuc

SEQ ID NO: 19148 - RNA, 22 nt, Homo sapiens
uaauauuucuucgugaugacau

SEQ ID NO: 19149 - RNA, 18 nt, Homo sapiens
uaauguggaaaugauguu

SEQ ID NO: 19150 - RNA, 12 nt, Homo sapiens
uaauuaugcagu

SEQ ID NO: 19151 - RNA, 14 nt, Homo sapiens
uacaauuguaaacu

SEQ ID NO: 19152 - RNA, 19 nt, Homo sapiens
uacacauuuuauuuuauua

SEQ ID NO: 19153 - RNA, 21 nt, Homo sapiens
uacauaaugcgugcauaccac

SEQ ID NO: 19154 - RNA, 19 nt, Homo sapiens
uacauguauuuguuugcau

SEQ ID NO: 19155 - RNA, 23 nt, Homo sapiens
uaguaaugugacuuggauucaau

SEQ ID NO: 19156 - RNA, 19 nt, Homo sapiens
uaguuuuacaguguuucug

SEQ ID NO: 19157 - RNA, 19 nt, Homo sapiens
uauacuauauuuuucucaa

SEQ ID NO: 19158 - RNA, 14 nt, Homo sapiens
uauagcuuucauaa

SEQ ID NO: 19159 - RNA, 15 nt, Homo sapiens
uauaguaaugugacu

SEQ ID NO: 19160 - RNA, 12 nt, Homo sapiens
uauauuuccuua

SEQ ID NO: 19161 - RNA, 16 nt, Homo sapiens
uaucugcuaugcuauu

SEQ ID NO: 19162 - RNA, 14 nt, Homo sapiens
uaugcuauuuauua

SEQ ID NO: 19163 - RNA, 12 nt, Homo sapiens
uauguaauuaua

SEQ ID NO: 19164 - RNA, 18 nt, Homo sapiens
uaugugcauuuaauuaga

SEQ ID NO: 19165 - RNA, 15 nt, Homo sapiens
uauucauuaguuuug

SEQ ID NO: 19166 - RNA, 16 nt, Homo sapiens
uauucucuccuguacc

SEQ ID NO: 19167 - RNA, 17 nt, Homo sapiens
uauugaagcauuuuaua

SEQ ID NO: 19168 - RNA, 21 nt, Homo sapiens
uauugauuuccguuaaaauac

SEQ ID NO: 19169 - RNA, 15 nt, Homo sapiens
uauuuauuuauucau

SEQ ID NO: 19170 - RNA, 13 nt, Homo sapiens
uauuuauuuauuu

SEQ ID NO: 19171 - RNA, 18 nt, Homo sapiens
uauuuuuuucuuuucuuu

SEQ ID NO: 19172 - RNA, 15 nt, Homo sapiens
ucaaagauagggagg

SEQ ID NO: 19173 - RNA, 16 nt, Homo sapiens
ucaaagauagggaggg

SEQ ID NO: 19174 - RNA, 12 nt, Homo sapiens
ucaagccugccu

SEQ ID NO: 19175 - RNA, 11 nt, Homo sapiens
ucaauaaaacu

SEQ ID NO: 19176 - RNA, 12 nt, Homo sapiens
ucaauaaaacuu

SEQ ID NO: 19177 - RNA, 17 nt, Homo sapiens
ucauuaauaauaaauuc

SEQ ID NO: 19178 - RNA, 13 nt, Homo sapiens
ucauuaguuuuga

SEQ ID NO: 19179 - RNA, 14 nt, Homo sapiens
ucauuaguuuugaa

SEQ ID NO: 19180 - RNA, 17 nt, Homo sapiens
ucauucuuuuugaaaug

SEQ ID NO: 19181 - RNA, 18 nt, Homo sapiens
ucauucuuuuugaaaugu

SEQ ID NO: 19182 - RNA, 22 nt, Homo sapiens
ucacuuuacuguccccaucauc

SEQ ID NO: 19183 - RNA, 15 nt, Homo sapiens
ucacuuuuauaagaa

SEQ ID NO: 19184 - RNA, 13 nt, Homo sapiens
ucagccagcccuc

SEQ ID NO: 19185 - RNA, 15 nt, Homo sapiens
ucagcuacaauugua

SEQ ID NO: 19186 - RNA, 21 nt, Homo sapiens
ucagcucagcuaaugaagugu

SEQ ID NO: 19187 - RNA, 24 nt, Homo sapiens
ucagcucucaguugcagcccugcu

SEQ ID NO: 19188 - RNA, 16 nt, Homo sapiens
ucauauuuaauuugaa

SEQ ID NO: 19189 - RNA, 14 nt, Homo sapiens
ucauguugaaacuu

SEQ ID NO: 19190 - RNA, 18 nt, Homo sapiens
uccguuaaaauaccagcc

SEQ ID NO: 19191 - RNA, 16 nt, Homo sapiens
uccuauuauauucauu

SEQ ID NO: 19192 - RNA, 17 nt, Homo sapiens
uccuauuauauucauuc

SEQ ID NO: 19193 - RNA, 22 nt, Homo sapiens
uccuccgcugggccuggauggc

SEQ ID NO: 19194 - RNA, 22 nt, Homo sapiens
uccugaaggaggcccugcccuu

SEQ ID NO: 19195 - RNA, 15 nt, Homo sapiens
uccuucauggcaggc

SEQ ID NO: 19196 - RNA, 22 nt, Homo sapiens
ugcccugaaagucccagaucaa

SEQ ID NO: 19197 - RNA, 16 nt, Homo sapiens
ugccuccccagcucua

SEQ ID NO: 19198 - RNA, 14 nt, Homo sapiens
ugcuaugcuauuga

SEQ ID NO: 19199 - RNA, 19 nt, Homo sapiens
ugcuauugggguugggggg

SEQ ID NO: 19200 - RNA, 20 nt, Homo sapiens
ugcuauugggguuggggggg

SEQ ID NO: 19201 - RNA, 14 nt, Homo sapiens
ugagccuugaacuu

SEQ ID NO: 19202 - RNA, 15 nt, Homo sapiens
ugauagaggcuggcg

SEQ ID NO: 19203 - RNA, 16 nt, Homo sapiens
ugauagaggcuggcgg

SEQ ID NO: 19204 - RNA, 13 nt, Homo sapiens
ugauucauauuua

SEQ ID NO: 19205 - RNA, 15 nt, Homo sapiens
ugauuuccguuaaaa

SEQ ID NO: 19206 - RNA, 20 nt, Homo sapiens
ugauuuggggauauuuuuuu

SEQ ID NO: 19207 - RNA, 15 nt, Homo sapiens
ugauuuuuguaauuu

SEQ ID NO: 19208 - RNA, 18 nt, Homo sapiens
ugauuuuuguaauuuuuu

SEQ ID NO: 19209 - RNA, 19 nt, Homo sapiens
ugauuuuuguaauuuuuuu

SEQ ID NO: 19210 - RNA, 13 nt, Homo sapiens
ugaugcugagccc

SEQ ID NO: 19211 - RNA, 17 nt, Homo sapiens
ugaugcugagcccggaa

SEQ ID NO: 19212 - RNA, 22 nt, Homo sapiens
ugcaaucuucucagaaggcaaa

SEQ ID NO: 19213 - RNA, 17 nt, Homo sapiens
ugcacaucuguuuugua

SEQ ID NO: 19214 - RNA, 23 nt, Homo sapiens
ugagcaucacaguuuugguugcu

SEQ ID NO: 19215 - RNA, 20 nt, Homo sapiens
ugagcaugccccugaaccau

SEQ ID NO: 19216 - RNA, 23 nt, Homo sapiens
ugcaugaaguaauaugcacacau

SEQ ID NO: 19217 - RNA, 12 nt, Homo sapiens
ucuaaaaguuua

SEQ ID NO: 19218 - RNA, 13 nt, Homo sapiens
ucuauuagcccuu

SEQ ID NO: 19219 - RNA, 19 nt, Homo sapiens
ucucaccucccaacguccc

SEQ ID NO: 19220 - RNA, 18 nt, Homo sapiens
ucucugaagugaaacugc

SEQ ID NO: 19221 - RNA, 22 nt, Homo sapiens
ucuuaguaugugcauuuaauua

SEQ ID NO: 19222 - RNA, 18 nt, Homo sapiens
ucuuuccaaaguacacug

SEQ ID NO: 19223 - RNA, 21 nt, Homo sapiens
ugaaccguuugugauugccau

SEQ ID NO: 19224 - RNA, 16 nt, Homo sapiens
ugaacuaaacuuucac

SEQ ID NO: 19225 - RNA, 18 nt, Homo sapiens
ugaagcauuuuauaaauc

SEQ ID NO: 19226 - RNA, 17 nt, Homo sapiens
ugaccuccuccuucaug

SEQ ID NO: 19227 - RNA, 22 nt, Homo sapiens
ugaccuccuccuucauggcagg

SEQ ID NO: 19228 - RNA, 16 nt, Homo sapiens
ugacuuacuguacaug

SEQ ID NO: 19229 - RNA, 15 nt, Homo sapiens
ugagaucauugugaa

SEQ ID NO: 19230 - RNA, 19 nt, Homo sapiens
gucccuagcccuuacgucc

SEQ ID NO: 19231 - RNA, 20 nt, Homo sapiens
gucccuagcccuuacguccu

SEQ ID NO: 19232 - RNA, 14 nt, Homo sapiens
gucauuuuuuuuaa

SEQ ID NO: 19233 - RNA, 18 nt, Homo sapiens
gucacuuuacugucccca

SEQ ID NO: 19234 - RNA, 16 nt, Homo sapiens
guacucugaaaguuuu

SEQ ID NO: 19235 - RNA, 21 nt, Homo sapiens
guagaauguuuucaaauguuc

SEQ ID NO: 19236 - RNA, 22 nt, Homo sapiens
guaggugacuauuauauuucca

SEQ ID NO: 19237 - RNA, 13 nt, Homo sapiens
guauggcaaacug

SEQ ID NO: 19238 - RNA, 16 nt, Homo sapiens
ggugguuucagaaaug

SEQ ID NO: 19239 - RNA, 13 nt, Homo sapiens
guaaaggcaaacu

SEQ ID NO: 19240 - RNA, 21 nt, Homo sapiens
guaacuguaaagaugaauguc

SEQ ID NO: 19241 - RNA, 13 nt, Homo sapiens
guacaucaaugau

SEQ ID NO: 19242 - RNA, 23 nt, Homo sapiens
guacauuuuuuuuuucaauaaaa

SEQ ID NO: 19243 - RNA, 22 nt, Homo sapiens
ggcacccccagaaugaccuggc

SEQ ID NO: 19244 - RNA, 15 nt, Homo sapiens
ggcaggcaucgccau

SEQ ID NO: 19245 - RNA, 16 nt, Homo sapiens
ggcaggcaucgccauu

SEQ ID NO: 19246 - RNA, 13 nt, Homo sapiens
ggcccugccaugc

SEQ ID NO: 19247 - RNA, 21 nt, Homo sapiens
ggcauacugccuuguuuaaug

SEQ ID NO: 19248 - RNA, 21 nt, Homo sapiens
ggccagugagaucaaugugac

SEQ ID NO: 19249 - RNA, 11 nt, Homo sapiens
ggcuaugcauu

SEQ ID NO: 19250 - RNA, 11 nt, Homo sapiens
gggaccugggc

SEQ ID NO: 19251 - RNA, 16 nt, Homo sapiens
ggauuccucacuuuga

SEQ ID NO: 19252 - RNA, 22 nt, Homo sapiens
ggauuuaacagaaauguacagc

SEQ ID NO: 19253 - RNA, 23 nt, Homo sapiens
ggagccugcaacaugccagccac

SEQ ID NO: 19254 - RNA, 16 nt, Homo sapiens
ggacaugggccccaga

SEQ ID NO: 19255 - RNA, 12 nt, Homo sapiens
gcugcugccugc

SEQ ID NO: 19256 - RNA, 23 nt, Homo sapiens
gcugggccuggauggcugccuca

SEQ ID NO: 19257 - RNA, 18 nt, Homo sapiens
gcuguuaaucuuucaaag

SEQ ID NO: 19258 - RNA, 20 nt, Homo sapiens
gcuucuauuagcccuucucc

SEQ ID NO: 19259 - RNA, 22 nt, Homo sapiens
gcuuucauaacaucgaaaaguu

SEQ ID NO: 19260 - RNA, 15 nt, Homo sapiens
gcuuuugugcauuau

SEQ ID NO: 19261 - RNA, 15 nt, Homo sapiens
ggaaacguauucaaa

SEQ ID NO: 19262 - RNA, 19 nt, Homo sapiens
ggaaacuccacauccugug

SEQ ID NO: 19263 - RNA, 14 nt, Homo sapiens
gcuuuaauaucauc

SEQ ID NO: 19264 - RNA, 19 nt, Homo sapiens
ggaaauauuuuaauguuuc

SEQ ID NO: 19265 - RNA, 20 nt, Homo sapiens
ggaaauauuuuaauguuucu

SEQ ID NO: 19266 - RNA, 14 nt, Homo sapiens
ggaacagaagagga

SEQ ID NO: 19267 - RNA, 23 nt, Homo sapiens
ggaacaugagccuuuguugcuau

SEQ ID NO: 19268 - RNA, 18 nt, Homo sapiens
ggaagccucuauugccau

SEQ ID NO: 19269 - RNA, 17 nt, Homo sapiens
gcugccuccccagcucu

SEQ ID NO: 19270 - RNA, 12 nt, Homo sapiens
gcugcauuuaaa

SEQ ID NO: 19271 - RNA, 20 nt, Homo sapiens
gcucucaguugcagcccugc

SEQ ID NO: 19272 - RNA, 21 nt, Homo sapiens
gcucucaguugcagcccugcu

SEQ ID NO: 19273 - RNA, 18 nt, Homo sapiens
gcucuccaaaccacuuuu

SEQ ID NO: 19274 - RNA, 19 nt, Homo sapiens
gcucuccaaaccacuuuuu

SEQ ID NO: 19275 - RNA, 22 nt, Homo sapiens
gcucucugaccuccuccuucau

SEQ ID NO: 19276 - RNA, 23 nt, Homo sapiens
gcugaaccguuugugauugccau

SEQ ID NO: 19277 - RNA, 24 nt, Homo sapiens
gcugaaccguuugugauugccauu

SEQ ID NO: 19278 - RNA, 19 nt, Homo sapiens
gcuagaaaacaggcaaauu

SEQ ID NO: 19279 - RNA, 14 nt, Homo sapiens
gcuaugcuauugaa

SEQ ID NO: 19280 - RNA, 22 nt, Homo sapiens
gcgcuaccucuccagccucagc

SEQ ID NO: 19281 - RNA, 18 nt, Homo sapiens
gcggaccuucccagcuag

SEQ ID NO: 19282 - RNA, 14 nt, Homo sapiens
gcuaccucuccagc

SEQ ID NO: 19283 - RNA, 17 nt, Homo sapiens
gcuaaauauauauuuua

SEQ ID NO: 19284 - RNA, 15 nt, Homo sapiens
cuuucauauuuuagc

SEQ ID NO: 19285 - RNA, 14 nt, Homo sapiens
cuuuucuuuucuuu

SEQ ID NO: 19286 - RNA, 20 nt, Homo sapiens
cuuuugauaaucaacugggc

SEQ ID NO: 19287 - RNA, 19 nt, Homo sapiens
cuuggacaugggccccaga

SEQ ID NO: 19288 - RNA, 15 nt, Homo sapiens
cuuggauucaauuuu

SEQ ID NO: 19289 - RNA, 13 nt, Homo sapiens
cuuguacucuaca

SEQ ID NO: 19290 - RNA, 20 nt, Homo sapiens
cuuguuaaguaucagcuaca

SEQ ID NO: 19291 - RNA, 17 nt, Homo sapiens
gaaaauaaaauauuuaa

SEQ ID NO: 19292 - RNA, 18 nt, Homo sapiens
gaaauaggaaauauuuua

SEQ ID NO: 19293 - RNA, 19 nt, Homo sapiens
gaaauaggaaauauuuuaa

SEQ ID NO: 19294 - RNA, 22 nt, Homo sapiens
gaaauauuccuuaagauauuaa

SEQ ID NO: 19295 - RNA, 14 nt, Homo sapiens
gaaauauuuuaaug

SEQ ID NO: 19296 - RNA, 14 nt, Homo sapiens
gaaauuaaguaucu

SEQ ID NO: 19297 - RNA, 13 nt, Homo sapiens
gaacagaagagga

SEQ ID NO: 19298 - RNA, 18 nt, Homo sapiens
aauauauuuccuuauuca

SEQ ID NO: 19299 - RNA, 16 nt, Homo sapiens
aauaucuuaucuuccu

SEQ ID NO: 19300 - RNA, 20 nt, Homo sapiens
aauauguuagagaauuuccu

SEQ ID NO: 19301 - RNA, 22 nt, Homo sapiens
aauaucccuuggacauuuuaug

SEQ ID NO: 19302 - RNA, 21 nt, Homo sapiens
aauccucucaaccaccuuuca

SEQ ID NO: 19303 - RNA, 12 nt, Homo sapiens
aaucucaaauuu

SEQ ID NO: 19304 - RNA, 13 nt, Homo sapiens
aaucuccaaaaua

SEQ ID NO: 19305 - RNA, 12 nt, Homo sapiens
aaugauuucaca

SEQ ID NO: 19306 - RNA, 20 nt, Homo sapiens
aaugguuaaaagagguuuuu

SEQ ID NO: 19307 - RNA, 22 nt, Homo sapiens
aaugguuaaaagagguuuuucu

SEQ ID NO: 19308 - RNA, 22 nt, Homo sapiens
cuguccccaucaucacccagca

SEQ ID NO: 19309 - RNA, 17 nt, Homo sapiens
cuguguuagagcagaga

SEQ ID NO: 19310 - RNA, 12 nt, Homo sapiens
cuguucuuucug

SEQ ID NO: 19311 - RNA, 24 nt, Homo sapiens
cuuaauuauugauguuuucauaga

SEQ ID NO: 19312 - RNA, 21 nt, Homo sapiens
cuuacucuugauugugggaua

SEQ ID NO: 19313 - RNA, 18 nt, Homo sapiens
cuuagggaaggauacaaa

SEQ ID NO: 19314 - RNA, 19 nt, Homo sapiens
cuucuccauggcccugcca

SEQ ID NO: 19315 - RNA, 17 nt, Homo sapiens
cuucugggcagacucug

SEQ ID NO: 19316 - RNA, 15 nt, Homo sapiens
cuugagccuugaacu

SEQ ID NO: 19317 - RNA, 17 nt, Homo sapiens
cugcuauuugcuguuau

SEQ ID NO: 19318 - RNA, 23 nt, Homo sapiens
cugccucaccucucaccucccaa

SEQ ID NO: 19319 - RNA, 23 nt, Homo sapiens
cugccucagguguccgcuaucca

SEQ ID NO: 19320 - RNA, 21 nt, Homo sapiens
cugccuggacuuggccccugc

SEQ ID NO: 19321 - RNA, 21 nt, Homo sapiens
cugccuuguuuaauguuaauu

SEQ ID NO: 19322 - RNA, 21 nt, Homo sapiens
cugcugccugccuggacuugg

SEQ ID NO: 19323 - RNA, 10 nt, Homo sapiens
cugcugcugc

SEQ ID NO: 19324 - RNA, 19 nt, Homo sapiens
cuggaagccucuauugcca

SEQ ID NO: 19325 - RNA, 20 nt, Homo sapiens
cuggaagccucuauugccau

SEQ ID NO: 19326 - RNA, 19 nt, Homo sapiens
cugcccugaaagucccaga

SEQ ID NO: 19327 - RNA, 18 nt, Homo sapiens
cugagcggaccuucccag

SEQ ID NO: 19328 - RNA, 15 nt, Homo sapiens
cugccaucauuuacu

SEQ ID NO: 19329 - RNA, 17 nt, Homo sapiens
cugaccuccuccuucau

SEQ ID NO: 19330 - RNA, 11 nt, Homo sapiens
cugaauuucuu

SEQ ID NO: 19331 - RNA, 13 nt, Homo sapiens
cugaauuucuuuu

SEQ ID NO: 19332 - RNA, 20 nt, Homo sapiens
cugauaaagaugagugagca

SEQ ID NO: 19333 - RNA, 20 nt, Homo sapiens
cuauguagaauauauuuccu

SEQ ID NO: 19334 - RNA, 18 nt, Homo sapiens
cuauuuaauuauuucacu

SEQ ID NO: 19335 - RNA, 18 nt, Homo sapiens
cuauuuauuaaguauuuu

SEQ ID NO: 19336 - RNA, 16 nt, Homo sapiens
cucagcugccucccca

SEQ ID NO: 19337 - RNA, 14 nt, Homo sapiens
cucagguguccgcu

SEQ ID NO: 19338 - RNA, 18 nt, Homo sapiens
cuagauacuguaucauga

SEQ ID NO: 19339 - RNA, 12 nt, Homo sapiens
cucacuuugaag

SEQ ID NO: 19340 - RNA, 22 nt, Homo sapiens
cuccaaaccacuuuuugcagcu

SEQ ID NO: 19341 - RNA, 17 nt, Homo sapiens
cuccaugaucccaccuc

SEQ ID NO: 19342 - RNA, 14 nt, Homo sapiens
cuccauggcccugc

SEQ ID NO: 19343 - RNA, 17 nt, Homo sapiens
cucccaacuauaaaacu

SEQ ID NO: 19344 - RNA, 15 nt, Homo sapiens
cucccauucacagau

SEQ ID NO: 19345 - RNA, 24 nt, Homo sapiens
cucccuauuuuuuuucuguuauau

SEQ ID NO: 19346 - RNA, 12 nt, Homo sapiens
cguacacauuuu

SEQ ID NO: 19347 - RNA, 11 nt, Homo sapiens
cguccuuccac

SEQ ID NO: 19348 - RNA, 12 nt, Homo sapiens
cguccuuccacu

SEQ ID NO: 19349 - RNA, 14 nt, Homo sapiens
cguccuuccacuuc

SEQ ID NO: 19350 - RNA, 20 nt, Homo sapiens
cguccuuccacuuccaagau

SEQ ID NO: 19351 - RNA, 16 nt, Homo sapiens
cuaaaguguauuuuuu

SEQ ID NO: 19352 - RNA, 17 nt, Homo sapiens
cuaaaguguauuuuuuu

SEQ ID NO: 19353 - RNA, 20 nt, Homo sapiens
cggacuccuccgcauccucc

SEQ ID NO: 19354 - RNA, 17 nt, Homo sapiens
cgcuuuugauaaucaac

SEQ ID NO: 19355 - RNA, 13 nt, Homo sapiens
gaauguuuucaaa

SEQ ID NO: 19356 - RNA, 13 nt, Homo sapiens
gaagcaucguguc

SEQ ID NO: 19357 - RNA, 23 nt, Homo sapiens
gaagauucuauguuaauauuuua

SEQ ID NO: 19358 - RNA, 13 nt, Homo sapiens
gaagugaaacugc

SEQ ID NO: 19359 - RNA, 13 nt, Homo sapiens
gacacagcugcag

SEQ ID NO: 19360 - RNA, 19 nt, Homo sapiens
gacacagcugcagaggcca

SEQ ID NO: 19361 - RNA, 16 nt, Homo sapiens
gacacaugcaagguca

SEQ ID NO: 19362 - RNA, 16 nt, Homo sapiens
gacacaugggugcuau

SEQ ID NO: 19363 - RNA, 17 nt, Homo sapiens
gacacaugggugcuauu

SEQ ID NO: 19364 - RNA, 15 nt, Homo sapiens
gacaugggccccaga

SEQ ID NO: 19365 - RNA, 14 nt, Homo sapiens
gaccacguuucuaa

SEQ ID NO: 19366 - RNA, 18 nt, Homo sapiens
gaccaggcacccccagaa

SEQ ID NO: 19367 - RNA, 19 nt, Homo sapiens
aauuuuaaggcauauuuaa

SEQ ID NO: 19368 - RNA, 18 nt, Homo sapiens
aauuuaaacgugauuuuu

SEQ ID NO: 19369 - RNA, 10 nt, Homo sapiens
aauuuccuua

SEQ ID NO: 19370 - RNA, 13 nt, Homo sapiens
aauuuccuuacuc

SEQ ID NO: 19371 - RNA, 21 nt, Homo sapiens
aauuauauauacuauauuuuu

SEQ ID NO: 19372 - RNA, 19 nt, Homo sapiens
aauuauugauguuuucaua

SEQ ID NO: 19373 - RNA, 14 nt, Homo sapiens
aauuauuucacuuu

SEQ ID NO: 19374 - RNA, 12 nt, Homo sapiens
aauguauucuuu

SEQ ID NO: 19375 - RNA, 21 nt, Homo sapiens
aauguauucuuuuaguuuuua

SEQ ID NO: 19376 - RNA, 23 nt, Homo sapiens
aaugugacuuggauucaauuuua

SEQ ID NO: 19377 - RNA, 14 nt, Homo sapiens
aauguguuugagca

SEQ ID NO: 19378 - RNA, 18 nt, Homo sapiens
aauguuuagcagauuuaa

SEQ ID NO: 19379 - RNA, 14 nt, Homo sapiens
gaacuaaaauguuc

SEQ ID NO: 19380 - RNA, 20 nt, Homo sapiens
gaagacaaugacuuacugua

SEQ ID NO: 19381 - RNA, 13 nt, Homo sapiens
acaccaggauuua

SEQ ID NO: 19382 - RNA, 13 nt, Homo sapiens
acaccucagcugc

SEQ ID NO: 19383 - RNA, 14 nt, Homo sapiens
gaacagaagaggaa

SEQ ID NO: 19384 - RNA, 15 nt, Homo sapiens
gaggaaagagagaca

SEQ ID NO: 19385 - RNA, 15 nt, Homo sapiens
gaggggaaggcaaca

SEQ ID NO: 19386 - RNA, 12 nt, Homo sapiens
gagguaccagcc

SEQ ID NO: 19387 - RNA, 12 nt, Homo sapiens
gauacuauuuaa

SEQ ID NO: 19388 - RNA, 20 nt, Homo sapiens
gauauguaacaacaauuauu

SEQ ID NO: 19389 - RNA, 22 nt, Homo sapiens
gauguuuucacaaagaacagga

SEQ ID NO: 19390 - RNA, 17 nt, Homo sapiens
gauguuuucauagagaa

SEQ ID NO: 19391 - RNA, 13 nt, Homo sapiens
gauuaaacuuaau

SEQ ID NO: 19392 - RNA, 20 nt, Homo sapiens
gauuaacucuaccugcacac

SEQ ID NO: 19393 - RNA, 13 nt, Homo sapiens
gagacacaugggu

SEQ ID NO: 19394 - RNA, 14 nt, Homo sapiens
gaccuccuccuuca

SEQ ID NO: 19395 - RNA, 16 nt, Homo sapiens
gaccucugcagcaaua

SEQ ID NO: 19396 - RNA, 21 nt, Homo sapiens
gaccugcuucuauuagcccuu

SEQ ID NO: 19397 - RNA, 18 nt, Homo sapiens
gacucuggucaagaagca

SEQ ID NO: 19398 - RNA, 18 nt, Homo sapiens
gacuuggccccugccacc

SEQ ID NO: 19399 - RNA, 16 nt, Homo sapiens
gacuuguacucugaaa

SEQ ID NO: 19400 - RNA, 15 nt, Homo sapiens
gagaauaaaaaaugu

SEQ ID NO: 19401 - RNA, 13 nt, Homo sapiens
gccucagcucuca

SEQ ID NO: 19402 - RNA, 17 nt, Homo sapiens
gccucaaucaguauuca

SEQ ID NO: 19403 - RNA, 23 nt, Homo sapiens
gccucaaucaguauucauauuua

SEQ ID NO: 19404 - RNA, 15 nt, Homo sapiens
gccucuauugccaug

SEQ ID NO: 19405 - RNA, 16 nt, Homo sapiens
gccucuauugccauga

SEQ ID NO: 19406 - RNA, 15 nt, Homo sapiens
gccugcaacaugcca

SEQ ID NO: 19407 - RNA, 13 nt, Homo sapiens
gcccuagcauuuc

SEQ ID NO: 19408 - RNA, 14 nt, Homo sapiens
gcccugcugcugcc

SEQ ID NO: 19409 - RNA, 16 nt, Homo sapiens
gcccuggccuagcaua

SEQ ID NO: 19410 - RNA, 19 nt, Homo sapiens
gcccuuacguccuuccacu

SEQ ID NO: 19411 - RNA, 22 nt, Homo sapiens
gccccugccaccuccugccuca

SEQ ID NO: 19412 - RNA, 15 nt, Homo sapiens
gauuuaacagaaaug

SEQ ID NO: 19413 - RNA, 23 nt, Homo sapiens
gcacacucucccauuauauuuau

SEQ ID NO: 19414 - RNA, 19 nt, Homo sapiens
gcacgcauggaaaaguuuc

SEQ ID NO: 19415 - RNA, 20 nt, Homo sapiens
gcacgcauggaaaaguuucc

SEQ ID NO: 19416 - RNA, 14 nt, Homo sapiens
gcacuuacaauuuu

SEQ ID NO: 19417 - RNA, 21 nt, Homo sapiens
gcagagagguuucgauauuua

SEQ ID NO: 19418 - RNA, 22 nt, Homo sapiens
gcagagagguuucgauauuuau

SEQ ID NO: 19419 - RNA, 19 nt, Homo sapiens
gcagauuuaagauauguaa

SEQ ID NO: 19420 - RNA, 19 nt, Homo sapiens
gcaguggugguuuucuguu

SEQ ID NO: 19421 - RNA, 15 nt, Homo sapiens
gcaucacaguuuugg

SEQ ID NO: 19422 - RNA, 16 nt, Homo sapiens
gcaucgcuuaggagaa

SEQ ID NO: 19423 - RNA, 21 nt, Homo sapiens
gccauagucauucugccugcc

SEQ ID NO: 19424 - RNA, 12 nt, Homo sapiens
gccaucauuuac

SEQ ID NO: 19425 - RNA, 16 nt, Homo sapiens
agcaaggagauuuaca

SEQ ID NO: 19426 - RNA, 17 nt, Homo sapiens
agaucaccaucaauuuu

SEQ ID NO: 19427 - RNA, 12 nt, Homo sapiens
agauauaauuua

SEQ ID NO: 19428 - RNA, 21 nt, Homo sapiens
agaauucuguugauggaaaua

SEQ ID NO: 19429 - RNA, 17 nt, Homo sapiens
agacaagaaggaaagau

SEQ ID NO: 19430 - RNA, 17 nt, Homo sapiens
agacacaugggugcuau

SEQ ID NO: 19431 - RNA, 23 nt, Homo sapiens
agaaugaccuggccgcagugagg

SEQ ID NO: 19432 - RNA, 14 nt, Homo sapiens
aggauggcaggagg

SEQ ID NO: 19433 - RNA, 14 nt, Homo sapiens
aggagccugcaaca

SEQ ID NO: 19434 - RNA, 16 nt, Homo sapiens
aggagcucccaggagg

SEQ ID NO: 19435 - RNA, 14 nt, Homo sapiens
aggaggcccugccc

SEQ ID NO: 19436 - RNA, 16 nt, Homo sapiens
aggaacagaagaggaa

SEQ ID NO: 19437 - RNA, 12 nt, Homo sapiens
aggcaucgccau

SEQ ID NO: 19438 - RNA, 20 nt, Homo sapiens
aggcccugcccuuacaggaa

SEQ ID NO: 19439 - RNA, 18 nt, Homo sapiens
aggcuccugagacacaug

SEQ ID NO: 19440 - RNA, 22 nt, Homo sapiens
agccugccucaaucaguauuca

SEQ ID NO: 19441 - RNA, 16 nt, Homo sapiens
agcggaccuucccagc

SEQ ID NO: 19442 - RNA, 17 nt, Homo sapiens
agcggaccuucccagcu

SEQ ID NO: 19443 - RNA, 18 nt, Homo sapiens
agcggaccuucccagcua

SEQ ID NO: 19444 - RNA, 15 nt, Homo sapiens
agcuaagauauaauu

SEQ ID NO: 19445 - RNA, 13 nt, Homo sapiens
agcucacuggugg

SEQ ID NO: 19446 - RNA, 13 nt, Homo sapiens
agcucuaucccaa

SEQ ID NO: 19447 - RNA, 20 nt, Homo sapiens
agcugccuccccagcucuau

SEQ ID NO: 19448 - RNA, 22 nt, Homo sapiens
agcugccuccccagcucuaucc

SEQ ID NO: 19449 - RNA, 23 nt, Homo sapiens
agcugccuccccagcucuauccc

SEQ ID NO: 19450 - RNA, 19 nt, Homo sapiens
acuguuauuuauaaucacu

SEQ ID NO: 19451 - RNA, 14 nt, Homo sapiens
agaaauaggaaaua

SEQ ID NO: 19452 - RNA, 16 nt, Homo sapiens
agaacaggaaaauaaa

SEQ ID NO: 19453 - RNA, 15 nt, Homo sapiens
agaagaggaaagaga

SEQ ID NO: 19454 - RNA, 17 nt, Homo sapiens
agaagaggaaagagaga

SEQ ID NO: 19455 - RNA, 19 nt, Homo sapiens
acugaguacguugugcauu

SEQ ID NO: 19456 - RNA, 14 nt, Homo sapiens
acucuaccugcaca

SEQ ID NO: 19457 - RNA, 20 nt, Homo sapiens
accuuucagauaacuguuau

SEQ ID NO: 19458 - RNA, 21 nt, Homo sapiens
accuuucagauaacuguuauu

SEQ ID NO: 19459 - RNA, 22 nt, Homo sapiens
accuuucagauaacuguuauuu

SEQ ID NO: 19460 - RNA, 19 nt, Homo sapiens
acgucccuagcccuuacgu

SEQ ID NO: 19461 - RNA, 20 nt, Homo sapiens
acgucccuagcccuuacguc

SEQ ID NO: 19462 - RNA, 16 nt, Homo sapiens
acgugauuuuuaaauu

SEQ ID NO: 19463 - RNA, 12 nt, Homo sapiens
acuaaacuuuca

SEQ ID NO: 19464 - RNA, 11 nt, Homo sapiens
acuauaaaacu

SEQ ID NO: 19465 - RNA, 21 nt, Homo sapiens
accugcuucuauuagcccuuc

SEQ ID NO: 19466 - RNA, 15 nt, Homo sapiens
accuggaauauauaa

SEQ ID NO: 19467 - RNA, 22 nt, Homo sapiens
accccagggcuugugugcacau

SEQ ID NO: 19468 - RNA, 24 nt, Homo sapiens
accccagggcuugugugcacauau

SEQ ID NO: 19469 - RNA, 13 nt, Homo sapiens
accuccugccuca

SEQ ID NO: 19470 - RNA, 24 nt, Homo sapiens
aaugugacuuggauucaauuuuaa

SEQ ID NO: 19471 - RNA, 13 nt, Homo sapiens
aaugaaguguuua

SEQ ID NO: 19472 - RNA, 20 nt, Homo sapiens
aauuauugauguuuucauag

SEQ ID NO: 19473 - RNA, 15 nt, Homo sapiens
aauuauuucacuuua

SEQ ID NO: 19474 - RNA, 11 nt, Homo sapiens
aagucuguuuu

SEQ ID NO: 19475 - RNA, 13 nt, Homo sapiens
aauacacuguuau

SEQ ID NO: 19476 - RNA, 14 nt, Homo sapiens
aauaucuuaucuuc

SEQ ID NO: 19477 - RNA, 22 nt, Homo sapiens
aauauuuuagguguaaaauaau

SEQ ID NO: 19478 - RNA, 14 nt, Homo sapiens
aauacacuguuauc

SEQ ID NO: 19479 - RNA, 15 nt, Homo sapiens
aauacacuguuaucu

SEQ ID NO: 19480 - RNA, 20 nt, Homo sapiens
aauacuguuugagguuuuua

SEQ ID NO: 19481 - RNA, 21 nt, Homo sapiens
aauacuguuugagguuuuuaa

SEQ ID NO: 19482 - RNA, 21 nt, Homo sapiens
aauagcuaagauauaauuuaa

SEQ ID NO: 19483 - RNA, 15 nt, Homo sapiens
aauauaaauuuauca

SEQ ID NO: 19484 - RNA, 12 nt, Homo sapiens
aauauauuuccu

SEQ ID NO: 19485 - RNA, 13 nt, Homo sapiens
aaguauuuuauua

SEQ ID NO: 19486 - RNA, 16 nt, Homo sapiens
aauaaaaaauguaagu

SEQ ID NO: 19487 - RNA, 17 nt, Homo sapiens
acaguuacucagaauuc

SEQ ID NO: 19488 - RNA, 14 nt, Homo sapiens
acaugggccccaga

SEQ ID NO: 19489 - RNA, 17 nt, Homo sapiens
acauuuuaugucuuucu

SEQ ID NO: 19490 - RNA, 16 nt, Homo sapiens
accacuuuuugcagcu

SEQ ID NO: 19491 - RNA, 17 nt, Homo sapiens
accacuuuuugcagcuu

SEQ ID NO: 19492 - RNA, 14 nt, Homo sapiens
accagacucuauaa

SEQ ID NO: 19493 - RNA, 15 nt, Homo sapiens
accagacucuauaaa

SEQ ID NO: 19494 - RNA, 13 nt, Homo sapiens
accagcagaaaug

SEQ ID NO: 19495 - RNA, 22 nt, Homo sapiens
acaaaggggcuuaauuauugau

SEQ ID NO: 19496 - RNA, 22 nt, Homo sapiens
acaacaauuauuugaagauuua

SEQ ID NO: 19497 - RNA, 18 nt, Homo sapiens
acaccaggauuuaaguuu

SEQ ID NO: 19498 - RNA, 14 nt, Homo sapiens
acaccucagcugcc

SEQ ID NO: 19499 - RNA, 16 nt, Homo sapiens
acacuaaaacaccuca

SEQ ID NO: 19500 - RNA, 20 nt, Homo sapiens
acacuccaauuaaggauuuu

SEQ ID NO: 19501 - RNA, 17 nt, Homo sapiens
acacuguccuauuauau

SEQ ID NO: 19502 - RNA, 20 nt, Homo sapiens
acacuguuaucuucacuuuu

SEQ ID NO: 19503 - RNA, 19 nt, Homo sapiens
aacuguuuagaugaauguc

SEQ ID NO: 19504 - RNA, 19 nt, Homo sapiens
aaguaucccuacuguaauu

SEQ ID NO: 19505 - RNA, 17 nt, Homo sapiens
aacuccacauccugugg

SEQ ID NO: 19506 - RNA, 18 nt, Homo sapiens
aacuccacauccuguggg

SEQ ID NO: 19507 - RNA, 17 nt, Homo sapiens
aacuggauuaaacuuaa

SEQ ID NO: 19508 - RNA, 15 nt, Homo sapiens
aagcugaguguuuca

SEQ ID NO: 19509 - RNA, 15 nt, Homo sapiens
aaggagcucccagga

SEQ ID NO: 19510 - RNA, 22 nt, Homo sapiens
aaggcaggggaauguaugugca

SEQ ID NO: 19511 - RNA, 19 nt, Homo sapiens
aagguuaugauugaaucua

SEQ ID NO: 19512 - RNA, 20 nt, Homo sapiens
aagguuaugauugaaucuac

SEQ ID NO: 19513 - RNA, 17 nt, Homo sapiens
aagaugagugagcaugc

SEQ ID NO: 19514 - RNA, 18 nt, Homo sapiens
aagagagacacagcugca

SEQ ID NO: 19515 - RNA, 13 nt, Homo sapiens
aaggaaagauuuu

SEQ ID NO: 19516 - RNA, 14 nt, Homo sapiens
aaggaaagauuuug

SEQ ID NO: 19517 - RNA, 15 nt, Homo sapiens
aaggaaagauuuugu

SEQ ID NO: 19518 - RNA, 20 nt, Homo sapiens
aaggcauauuuaacaaaauu

SEQ ID NO: 19519 - RNA, 20 nt, Homo sapiens
aacugccaucauuuacuuuu

SEQ ID NO: 19520 - RNA, 15 nt, Homo sapiens
aacuuauuuguacau

SEQ ID NO: 19521 - RNA, 16 nt, Homo sapiens
aacuuauuuguacauu

SEQ ID NO: 19522 - RNA, 17 nt, Homo sapiens
aacuuauuuguacauuu

SEQ ID NO: 19523 - RNA, 16 nt, Homo sapiens
aacuuucacaccccag

SEQ ID NO: 19524 - RNA, 18 nt, Homo sapiens
aacuuuuccaaugacauu

SEQ ID NO: 19525 - RNA, 20 nt, Homo sapiens
aaccucugugagcaucacag

SEQ ID NO: 19526 - RNA, 14 nt, Homo sapiens
aacccagggaagac

SEQ ID NO: 19527 - RNA, 15 nt, Homo sapiens
aacccagggaagaca

SEQ ID NO: 19528 - RNA, 15 nt, Homo sapiens
aaccucucccaacua

SEQ ID NO: 19529 - RNA, 18 nt, Homo sapiens
aaccucucccaacuauaa

SEQ ID NO: 19530 - RNA, 19 nt, Homo sapiens
aacaugccagccacuguga

SEQ ID NO: 19531 - RNA, 22 nt, Homo sapiens
aaccaccuuucagauaacuguu

SEQ ID NO: 19532 - RNA, 16 nt, Homo sapiens
aaaugggggugcauuu

SEQ ID NO: 19533 - RNA, 17 nt, Homo sapiens
aaaugggggugcauuug

SEQ ID NO: 19534 - RNA, 21 nt, Homo sapiens
aaauguauucuuuuaguuuuu

SEQ ID NO: 19535 - RNA, 15 nt, Homo sapiens
aaagcugaguguuuc

SEQ ID NO: 19536 - RNA, 17 nt, Homo sapiens
aaaggaagguucuggug

SEQ ID NO: 19537 - RNA, 11 nt, Homo sapiens
aaagucccaga

SEQ ID NO: 19538 - RNA, 12 nt, Homo sapiens
aaaguguauuuu

SEQ ID NO: 19539 - RNA, 17 nt, Homo sapiens
aaaauguucuaaauauc

SEQ ID NO: 19540 - RNA, 12 nt, Homo sapiens
aaacacauuuuu

SEQ ID NO: 19541 - RNA, 15 nt, Homo sapiens
aaacaccaggauuua

SEQ ID NO: 19542 - RNA, 23 nt, Homo sapiens
aaacaugcuacacacugcauguu

SEQ ID NO: 19543 - RNA, 24 nt, Homo sapiens
aaacaugcuacacacugcauguuu

SEQ ID NO: 19544 - RNA, 22 nt, Homo sapiens
aaacuuugauuuuauaugcuau

SEQ ID NO: 19545 - RNA, 24 nt, Homo sapiens
aaacuuugauuuuauaugcuauuu

SEQ ID NO: 19546 - RNA, 11 nt, Homo sapiens
aaagaacagga

SEQ ID NO: 19547 - RNA, 12 nt, Homo sapiens
aaagaacaggaa

SEQ ID NO: 19548 - RNA, 15 nt, Homo sapiens
aaagauacaguuacu

SEQ ID NO: 19549 - RNA, 16 nt, Homo sapiens
aaauauaggaacuuaa

SEQ ID NO: 19550 - RNA, 22 nt, Homo sapiens
aaauguucuccagucauuaugu

SEQ ID NO: 19551 - RNA, 23 nt, Homo sapiens
aaauguucuccagucauuauguu

SEQ ID NO: 19552 - RNA, 13 nt, Homo sapiens
aaaugauguuuca

SEQ ID NO: 19553 - RNA, 21 nt, Homo sapiens
aaaugguuaaaagagguuuuu

SEQ ID NO: 19554 - RNA, 11 nt, Homo sapiens
aaauguauucu

SEQ ID NO: 19555 - RNA, 17 nt, Homo sapiens
aaauguauucuuuuagu

SEQ ID NO: 19556 - RNA, 21 nt, Homo sapiens
aaaguuuuggaaacguauuca

SEQ ID NO: 19557 - RNA, 13 nt, Homo sapiens
aaagaacaggaaa

SEQ ID NO: 19558 - RNA, 18 nt, Homo sapiens
aaauuaaauaaaauuuuu

SEQ ID NO: 19559 - RNA, 11 nt, Homo sapiens
aaauuaacuuu

SEQ ID NO: 19560 - RNA, 15 nt, Homo sapiens
aaauagcuaagauau

SEQ ID NO: 19561 - RNA, 13 nt, Homo sapiens
aacauuucucaug

SEQ ID NO: 19562 - RNA, 14 nt, Homo sapiens
aaccagcagaaaug

SEQ ID NO: 19563 - RNA, 22 nt, Homo sapiens
aacagaccgggguucccgugug

SEQ ID NO: 19564 - RNA, 17 nt, Homo sapiens
aacccagggaagacaag

SEQ ID NO: 19565 - RNA, 13 nt, Homo sapiens
aaagaugaauguc

SEQ ID NO: 19566 - RNA, 16 nt, Homo sapiens
aaagcugaguguuuca

SEQ ID NO: 19567 - RNA, 24 nt, Homo sapiens
aaacguauucaaacaauuugaaua

SEQ ID NO: 19568 - RNA, 12 nt, Homo sapiens
aaacgugauuuu

SEQ ID NO: 19569 - RNA, 15 nt, Homo sapiens
aaacgugauuuuuaa

SEQ ID NO: 19570 - RNA, 23 nt, Homo sapiens
aaacgugauuuuuaaauuaaaua

SEQ ID NO: 19571 - RNA, 16 nt, Homo sapiens
aaacuuugauuuuaua

SEQ ID NO: 19572 - RNA, 23 nt, Homo sapiens
aaacuuugauuuuauaugcuauu

SEQ ID NO: 19573 - RNA, 15 nt, Homo sapiens
aaacuuuuccaauga

SEQ ID NO: 19574 - RNA, 19 nt, Homo sapiens
aaaacaccaggauuuaagu

SEQ ID NO: 19575 - RNA, 11 nt, Homo sapiens
aaacacauuuu

SEQ ID NO: 19576 - RNA, 14 nt, Homo sapiens
aaacagaccggggu

SEQ ID NO: 19577 - RNA, 12 nt, Homo sapiens
aucauuuacuuu

SEQ ID NO: 19578 - RNA, 13 nt, Homo sapiens
aucacccagaaga

SEQ ID NO: 19579 - RNA, 14 nt, Homo sapiens
aucacccagaagaa

SEQ ID NO: 19580 - RNA, 17 nt, Homo sapiens
aucaauccaagaacuua

SEQ ID NO: 19581 - RNA, 15 nt, Homo sapiens
auaugcuauuuauua

SEQ ID NO: 19582 - RNA, 15 nt, Homo sapiens
auauguaacaacaau

SEQ ID NO: 19583 - RNA, 21 nt, Homo sapiens
auauuuaacaaaauuugaaua

SEQ ID NO: 19584 - RNA, 16 nt, Homo sapiens
auauuuccaagaaaua

SEQ ID NO: 19585 - RNA, 11 nt, Homo sapiens
auauuuccuua

SEQ ID NO: 19586 - RNA, 23 nt, Homo sapiens
auauuuccuuauucagaauuucu

SEQ ID NO: 19587 - RNA, 13 nt, Homo sapiens
aucgcuuuugaua

SEQ ID NO: 19588 - RNA, 18 nt, Homo sapiens
aucuagauacuguaucau

SEQ ID NO: 19589 - RNA, 16 nt, Homo sapiens
aucucauuuaauccuc

SEQ ID NO: 19590 - RNA, 22 nt, Homo sapiens
aucuucacuuuuauaagaaaua

SEQ ID NO: 19591 - RNA, 22 nt, Homo sapiens
aucuucucagaaggcaaaugac

SEQ ID NO: 19592 - RNA, 18 nt, Homo sapiens
auguagaauauauuuccu

SEQ ID NO: 19593 - RNA, 16 nt, Homo sapiens
auggcuuuugugcauu

SEQ ID NO: 19594 - RNA, 20 nt, Homo sapiens
augugacuuggauucaauuu

SEQ ID NO: 19595 - RNA, 17 nt, Homo sapiens
auguuagagaauuuccu

SEQ ID NO: 19596 - RNA, 13 nt, Homo sapiens
augcuuguacaua

SEQ ID NO: 19597 - RNA, 13 nt, Homo sapiens
auggcaggcaucg

SEQ ID NO: 19598 - RNA, 13 nt, Homo sapiens
auggcccugccau

SEQ ID NO: 19599 - RNA, 20 nt, Homo sapiens
augaaaacacauuuuucuua

SEQ ID NO: 19600 - RNA, 22 nt, Homo sapiens
augauuucacagugugugguca

SEQ ID NO: 19601 - RNA, 14 nt, Homo sapiens
augcacacauuuuu

SEQ ID NO: 19602 - RNA, 21 nt, Homo sapiens
augcacagaguuguuacauuu

SEQ ID NO: 19603 - RNA, 23 nt, Homo sapiens
augcacagaguuguuacauuuuu

SEQ ID NO: 19604 - RNA, 23 nt, Homo sapiens
augcaugaaguaauaugcacaca

SEQ ID NO: 19605 - RNA, 17 nt, Homo sapiens
augccaaguuguuugag

SEQ ID NO: 19606 - RNA, 15 nt, Homo sapiens
augacuucauuaaua

SEQ ID NO: 19607 - RNA, 13 nt, Homo sapiens
augagaucauugu

SEQ ID NO: 19608 - RNA, 23 nt, Homo sapiens
augcugagcccggaaacuccaca

SEQ ID NO: 19609 - RNA, 15 nt, Homo sapiens
agugugaggaaaacc

SEQ ID NO: 19610 - RNA, 23 nt, Homo sapiens
aguguguggucaacauuucucau

SEQ ID NO: 19611 - RNA, 11 nt, Homo sapiens
aguuauaaaaa

SEQ ID NO: 19612 - RNA, 15 nt, Homo sapiens
aguucaauccugauu

SEQ ID NO: 19613 - RNA, 21 nt, Homo sapiens
aguucaauccugauucauauu

SEQ ID NO: 19614 - RNA, 21 nt, Homo sapiens
aguucaaucuggauucauauu

SEQ ID NO: 19615 - RNA, 18 nt, Homo sapiens
aguugcagcccugcugcu

SEQ ID NO: 19616 - RNA, 14 nt, Homo sapiens
aguuuauauagaaa

SEQ ID NO: 19617 - RNA, 17 nt, Homo sapiens
aguuuuacaguguuucu

SEQ ID NO: 19618 - RNA, 12 nt, Homo sapiens
auaaaauauuua

SEQ ID NO: 19619 - RNA, 14 nt, Homo sapiens
auaaaauauuuaaa

SEQ ID NO: 19620 - RNA, 18 nt, Homo sapiens
auaaacaagaccacguuu

SEQ ID NO: 19621 - RNA, 23 nt, Homo sapiens
auaaaucgcuuuugauaaucaac

SEQ ID NO: 19622 - RNA, 20 nt, Homo sapiens
auaaauucccuggccuuuca

SEQ ID NO: 19623 - RNA, 13 nt, Homo sapiens
auaagaauucugu

SEQ ID NO: 19624 - RNA, 21 nt, Homo sapiens
auaaugcgugcauaccacuuu

SEQ ID NO: 19625 - RNA, 19 nt, Homo sapiens
auaauuaaggguaugauua

SEQ ID NO: 19626 - RNA, 20 nt, Homo sapiens
auaauuaaggguaugauuaa

SEQ ID NO: 19627 - RNA, 12 nt, Homo sapiens
auacuacaguuu

SEQ ID NO: 19628 - RNA, 14 nt, Homo sapiens
auacuacaguuugu

SEQ ID NO: 19629 - RNA, 13 nt, Homo sapiens
auacuauuuaauu

SEQ ID NO: 19630 - RNA, 14 nt, Homo sapiens
auacuauuuaauua

SEQ ID NO: 19631 - RNA, 12 nt, Homo sapiens
auacuguuugag

SEQ ID NO: 19632 - RNA, 18 nt, Homo sapiens
auacuguuugagguuuuu

SEQ ID NO: 19633 - RNA, 17 nt, Homo sapiens
auacauaaacaagacca

SEQ ID NO: 19634 - RNA, 20 nt, Homo sapiens
auagccagguaccuucucac

SEQ ID NO: 19635 - RNA, 21 nt, Homo sapiens
auagccagguaccuucucacc

SEQ ID NO: 19636 - RNA, 21 nt, Homo sapiens
auagcuaagauauaauuuaaa

SEQ ID NO: 19637 - RNA, 17 nt, Homo sapiens
auauaugugaugaucua

SEQ ID NO: 19638 - RNA, 16 nt, Homo sapiens
auauauuuccuuauuc

SEQ ID NO: 19639 - RNA, 17 nt, Homo sapiens
auauauuuccuuauuca

SEQ ID NO: 19640 - RNA, 16 nt, Homo sapiens
auaucuuaucuuccua

SEQ ID NO: 19641 - RNA, 13 nt, Homo sapiens
agucuguuuuaug

SEQ ID NO: 19642 - RNA, 13 nt, Homo sapiens
agugaaacugcuu

SEQ ID NO: 19643 - RNA, 15 nt, Homo sapiens
agguuucgauauuua

SEQ ID NO: 19644 - RNA, 21 nt, Homo sapiens
agguuuuucuuaaauaauaaa

SEQ ID NO: 19645 - RNA, 18 nt, Homo sapiens
aguaucccuacuguaauu

SEQ ID NO: 19646 - RNA, 13 nt, Homo sapiens
agugcugcauuua

SEQ ID NO: 19647 - RNA, 17 nt, Homo sapiens
aggcuguggauuuaaug

SEQ ID NO: 19648 - RNA, 16 nt, Homo sapiens
aggggggucagccagc

SEQ ID NO: 19649 - RNA, 17 nt, Homo sapiens
agggugcacacaggaug

SEQ ID NO: 19650 - RNA, 15 nt, Homo sapiens
cagcugcagaggcca

SEQ ID NO: 19651 - RNA, 15 nt, Homo sapiens
cagccucagcucuca

SEQ ID NO: 19652 - RNA, 17 nt, Homo sapiens
cagaguuguuacauuuu

SEQ ID NO: 19653 - RNA, 15 nt, Homo sapiens
cagaucucuaacuuc

SEQ ID NO: 19654 - RNA, 17 nt, Homo sapiens
cagcaauaaagcagcgu

SEQ ID NO: 19655 - RNA, 22 nt, Homo sapiens
cagcaauaaagcagcguuucua

SEQ ID NO: 19656 - RNA, 14 nt, Homo sapiens
cagcacgauuucug

SEQ ID NO: 19657 - RNA, 12 nt, Homo sapiens
cagcagagaagu

SEQ ID NO: 19658 - RNA, 22 nt, Homo sapiens
cagccacugugauagaggcuga

SEQ ID NO: 19659 - RNA, 17 nt, Homo sapiens
cacuggcuguuaaucuu

SEQ ID NO: 19660 - RNA, 16 nt, Homo sapiens
cacuguuaucuucacu

SEQ ID NO: 19661 - RNA, 14 nt, Homo sapiens
cacuuccaagaucu

SEQ ID NO: 19662 - RNA, 22 nt, Homo sapiens
cacuuggacaugggccccagau

SEQ ID NO: 19663 - RNA, 14 nt, Homo sapiens
cacuacauucuguu

SEQ ID NO: 19664 - RNA, 21 nt, Homo sapiens
caccuggaauauauaaccagu

SEQ ID NO: 19665 - RNA, 12 nt, Homo sapiens
cacccccagaau

SEQ ID NO: 19666 - RNA, 12 nt, Homo sapiens
cacauccugugg

SEQ ID NO: 19667 - RNA, 13 nt, Homo sapiens
cacauccuguggg

SEQ ID NO: 19668 - RNA, 16 nt, Homo sapiens
cacagauaccucucuu

SEQ ID NO: 19669 - RNA, 13 nt, Homo sapiens
cacaguuuugguu

SEQ ID NO: 19670 - RNA, 14 nt, Homo sapiens
cacaguuuugguug

SEQ ID NO: 19671 - RNA, 17 nt, Homo sapiens
cacauaaggaaacuggg

SEQ ID NO: 19672 - RNA, 19 nt, Homo sapiens
caauccugauucauauuua

SEQ ID NO: 19673 - RNA, 20 nt, Homo sapiens
caauccugauucauauuuaa

SEQ ID NO: 19674 - RNA, 19 nt, Homo sapiens
caauuuuaaggcauauuua

SEQ ID NO: 19675 - RNA, 12 nt, Homo sapiens
cacacacuuuug

SEQ ID NO: 19676 - RNA, 22 nt, Homo sapiens
caauaaagcagcguuucuauga

SEQ ID NO: 19677 - RNA, 13 nt, Homo sapiens
caagggaccugcu

SEQ ID NO: 19678 - RNA, 15 nt, Homo sapiens
caaggucauuuuuuu

SEQ ID NO: 19679 - RNA, 23 nt, Homo sapiens
caagaaaauggccagugagauca

SEQ ID NO: 19680 - RNA, 14 nt, Homo sapiens
caagaaauauuccu

SEQ ID NO: 19681 - RNA, 17 nt, Homo sapiens
auuuuaaggcauauuua

SEQ ID NO: 19682 - RNA, 20 nt, Homo sapiens
auuuuagacauucuuuaucu

SEQ ID NO: 19683 - RNA, 21 nt, Homo sapiens
auuuuagacauucuuuaucuu

SEQ ID NO: 19684 - RNA, 15 nt, Homo sapiens
auuuuauuuuauuau

SEQ ID NO: 19685 - RNA, 17 nt, Homo sapiens
auuuuucucaauguuua

SEQ ID NO: 19686 - RNA, 12 nt, Homo sapiens
auuuuuuuucug

SEQ ID NO: 19687 - RNA, 21 nt, Homo sapiens
auuuuuuuucuguuauauaaa

SEQ ID NO: 19688 - RNA, 17 nt, Homo sapiens
auuuugauguuuuaagg

SEQ ID NO: 19689 - RNA, 19 nt, Homo sapiens
caaacugccaucauuuacu

SEQ ID NO: 19690 - RNA, 21 nt, Homo sapiens
caaacugccaucauuuacuuu

SEQ ID NO: 19691 - RNA, 17 nt, Homo sapiens
caacaugccagccacug

SEQ ID NO: 19692 - RNA, 14 nt, Homo sapiens
caaccaccuuucag

SEQ ID NO: 19693 - RNA, 18 nt, Homo sapiens
caaauugagcuagggggg

SEQ ID NO: 19694 - RNA, 17 nt, Homo sapiens
auuuauccuuguuaagu

SEQ ID NO: 19695 - RNA, 18 nt, Homo sapiens
auuuauugaaaugauuuc

SEQ ID NO: 19696 - RNA, 13 nt, Homo sapiens
auuucacuuuaga

SEQ ID NO: 19697 - RNA, 24 nt, Homo sapiens
auuuguuugcauaggugaucucau

SEQ ID NO: 19698 - RNA, 22 nt, Homo sapiens
auugauguuuucacaaagaaca

SEQ ID NO: 19699 - RNA, 14 nt, Homo sapiens
auugauguuuucau

SEQ ID NO: 19700 - RNA, 16 nt, Homo sapiens
auguuuagcagauuua

SEQ ID NO: 19701 - RNA, 19 nt, Homo sapiens
auguuuagcagauuuaaga

SEQ ID NO: 19702 - RNA, 10 nt, Homo sapiens
auguuuucaa

SEQ ID NO: 19703 - RNA, 10 nt, Homo sapiens
auguuuucau

SEQ ID NO: 19704 - RNA, 14 nt, Homo sapiens
auuaaauaaaauuu

SEQ ID NO: 19705 - RNA, 15 nt, Homo sapiens
auuaaggguaugauu

SEQ ID NO: 19706 - RNA, 10 nt, Homo sapiens
auuauauuua

SEQ ID NO: 19707 - RNA, 16 nt, Homo sapiens
auucauuaguuuugaa

SEQ ID NO: 19708 - RNA, 14 nt, Homo sapiens
auucuguuaaucau

SEQ ID NO: 19709 - RNA, 18 nt, Homo sapiens
ccugauucauauuuaauu

SEQ ID NO: 19710 - RNA, 20 nt, Homo sapiens
ccugcccuuacaggaacaga

SEQ ID NO: 19711 - RNA, 21 nt, Homo sapiens
ccugcccuuacaggaacagaa

SEQ ID NO: 19712 - RNA, 16 nt, Homo sapiens
cccgugugccugagcg

SEQ ID NO: 19713 - RNA, 17 nt, Homo sapiens
cccugaaagucccagau

SEQ ID NO: 19714 - RNA, 18 nt, Homo sapiens
cccugaaagucccagauc

SEQ ID NO: 19715 - RNA, 19 nt, Homo sapiens
cccugaaagucccagauca

SEQ ID NO: 19716 - RNA, 12 nt, Homo sapiens
cccuuacaggaa

SEQ ID NO: 19717 - RNA, 17 nt, Homo sapiens
cccuuacaggaacagaa

SEQ ID NO: 19718 - RNA, 15 nt, Homo sapiens
ccgcuauccaccaaa

SEQ ID NO: 19719 - RNA, 12 nt, Homo sapiens
cccugccaccuc

SEQ ID NO: 19720 - RNA, 19 nt, Homo sapiens
ccggaagccaaaccucugu

SEQ ID NO: 19721 - RNA, 18 nt, Homo sapiens
ccaggauuuaaguuucac

SEQ ID NO: 19722 - RNA, 16 nt, Homo sapiens
ccaggcacccccagaa

SEQ ID NO: 19723 - RNA, 16 nt, Homo sapiens
ccagguaccuucucac

SEQ ID NO: 19724 - RNA, 14 nt, Homo sapiens
ccagaaugaccugg

SEQ ID NO: 19725 - RNA, 16 nt, Homo sapiens
ccagaucaagccugcc

SEQ ID NO: 19726 - RNA, 11 nt, Homo sapiens
ccacguuucua

SEQ ID NO: 19727 - RNA, 13 nt, Homo sapiens
cauucuuuuugaa

SEQ ID NO: 19728 - RNA, 14 nt, Homo sapiens
cauucuuuuugaaa

SEQ ID NO: 19729 - RNA, 17 nt, Homo sapiens
cauuuguuaauauuucu

SEQ ID NO: 19730 - RNA, 12 nt, Homo sapiens
cauuuguuugaa

SEQ ID NO: 19731 - RNA, 22 nt, Homo sapiens
cauuuuauaaaucgcuuuugau

SEQ ID NO: 19732 - RNA, 14 nt, Homo sapiens
cauuuuaugucuuu

SEQ ID NO: 19733 - RNA, 22 nt, Homo sapiens
cauuuuauuuuauuaugcauga

SEQ ID NO: 19734 - RNA, 18 nt, Homo sapiens
ccaagcaaauggccaaug

SEQ ID NO: 19735 - RNA, 17 nt, Homo sapiens
cauggcaggcaucgcca

SEQ ID NO: 19736 - RNA, 14 nt, Homo sapiens
cauguucuuaauuc

SEQ ID NO: 19737 - RNA, 13 nt, Homo sapiens
cauuaguuuugaa

SEQ ID NO: 19738 - RNA, 13 nt, Homo sapiens
caucgccauucuu

SEQ ID NO: 19739 - RNA, 23 nt, Homo sapiens
caucuuucaagggaccucuccau

SEQ ID NO: 19740 - RNA, 21 nt, Homo sapiens
caugcucuccaaaccacuuuu

SEQ ID NO: 19741 - RNA, 22 nt, Homo sapiens
caugcucuccaaaccacuuuuu

SEQ ID NO: 19742 - RNA, 22 nt, Homo sapiens
caguuguuauuuauugaaauga

SEQ ID NO: 19743 - RNA, 20 nt, Homo sapiens
cauaaacaagaccacguuuc

SEQ ID NO: 19744 - RNA, 21 nt, Homo sapiens
cauaaacaagaccacguuucu

SEQ ID NO: 19745 - RNA, 19 nt, Homo sapiens
cauaaccccggaagccaaa

SEQ ID NO: 19746 - RNA, 23 nt, Homo sapiens
cauacacaccccggacuccuccg

SEQ ID NO: 19747 - RNA, 16 nt, Homo sapiens
cauacguacacauuuu

SEQ ID NO: 19748 - RNA, 13 nt, Homo sapiens
cauacuaaccagc

SEQ ID NO: 19749 - RNA, 20 nt, Homo sapiens
caucaauuuuaguugucaau

SEQ ID NO: 19750 - RNA, 19 nt, Homo sapiens
caucagcacgauuucuguu

SEQ ID NO: 19751 - RNA, 16 nt, Homo sapiens
caugaaaacacauuuu

SEQ ID NO: 19752 - RNA, 10 nt, Homo sapiens
caggaaaaua

SEQ ID NO: 19753 - RNA, 15 nt, Homo sapiens
cagcucucaguugca

SEQ ID NO: 19754 - RNA, 23 nt, Homo sapiens
cagcucucaguugcagcccugcu

SEQ ID NO: 19755 - RNA, 13 nt, Homo sapiens
cagguguccgcua

SEQ ID NO: 19756 - RNA, 18 nt, Homo sapiens
caguaguuagcuuucuuc

SEQ ID NO: 19757 - RNA, 19 nt, Homo sapiens
gauacuauuuaauuauuuc

SEQ ID NO: 19758 - RNA, 21 nt, Homo sapiens
agauauuuugcuuugugauuu

SEQ ID NO: 19759 - RNA, 14 nt, Homo sapiens
gcuuagaacaaagg

SEQ ID NO: 19760 - RNA, 16 nt, Homo sapiens
gcccugccaugcucuc

SEQ ID NO: 19761 - RNA, 21 nt, Homo sapiens
cacuggcuguuaaucuuucaa

SEQ ID NO: 19762 - RNA, 17 nt, Homo sapiens
aaaaauaaagcacuuau

SEQ ID NO: 19763 - RNA, 13 nt, Homo sapiens
caggcaucgccau

SEQ ID NO: 19764 - RNA, 17 nt, Homo sapiens
caaaauauagcuuucau

SEQ ID NO: 19765 - RNA, 18 nt, Homo sapiens
caacaugccagccacugu

SEQ ID NO: 19766 - RNA, 20 nt, Homo sapiens
ucacuggcuguuaaucuuuc

SEQ ID NO: 19767 - RNA, 16 nt, Homo sapiens
aagccucuauugccau

SEQ ID NO: 19768 - RNA, 14 nt, Homo sapiens
agcacacacuuuug

SEQ ID NO: 19769 - RNA, 13 nt, Homo sapiens
auccuccuccugc

SEQ ID NO: 19770 - RNA, 20 nt, Homo sapiens
aaacuccacauccuguggga

SEQ ID NO: 19771 - RNA, 21 nt, Homo sapiens
cacaguuuugguugcuuuaau

SEQ ID NO: 19772 - RNA, 19 nt, Homo sapiens
cauucacagauaccucucu

SEQ ID NO: 19773 - RNA, 17 nt, Homo sapiens
agacauacuaaccagca

SEQ ID NO: 19774 - RNA, 21 nt, Homo sapiens
uugcaaaguaucccuacugua

SEQ ID NO: 19775 - RNA, 21 nt, Homo sapiens
uggccagugagaucaauguga

SEQ ID NO: 19776 - RNA, 13 nt, Homo sapiens
ugcuuugugauuu

SEQ ID NO: 19777 - RNA, 17 nt, Homo sapiens
uuauuauggcacaucag

SEQ ID NO: 19778 - RNA, 19 nt, Homo sapiens
gguugcuuuaauaucauca

SEQ ID NO: 19779 - RNA, 14 nt, Homo sapiens
uuccucacuuugaa

SEQ ID NO: 19780 - RNA, 23 nt, Homo sapiens
guaauuuuuuuaucgucacugcu

SEQ ID NO: 19781 - RNA, 18 nt, Homo sapiens
ggaagccucuauugccau

SEQ ID NO: 19782 - RNA, 19 nt, Homo sapiens
uaaaacuaggugcugcagc

SEQ ID NO: 19783 - RNA, 18 nt, Homo sapiens
uuccaguaguuagcuuuc

SEQ ID NO: 19784 - RNA, 12 nt, Homo sapiens
uuuaaacuuuga

SEQ ID NO: 19785 - RNA, 22 nt, Homo sapiens
ucaaacccaaguuaguucaauc

SEQ ID NO: 19786 - RNA, 18 nt, Homo sapiens
uggaagccucuauugcca

SEQ ID NO: 19787 - RNA, 15 nt, Homo sapiens
guuuuuaagccuuaa

SEQ ID NO: 19788 - RNA, 17 nt, Homo sapiens
cuaggggggucagccag

SEQ ID NO: 19789 - RNA, 16 nt, Homo sapiens
caagccugccucaauc

SEQ ID NO: 19790 - RNA, 17 nt, Homo sapiens
auuuauaaucacuuuuu

SEQ ID NO: 19791 - RNA, 22 nt, Homo sapiens
auauuuccaagaaauauuccuu

SEQ ID NO: 19792 - RNA, 13 nt, Homo sapiens
aaauguacagcaa

SEQ ID NO: 19793 - RNA, 16 nt, Homo sapiens
ugaacuaaacuuucac

SEQ ID NO: 19794 - RNA, 19 nt, Homo sapiens
caucuuucaagggaccucu

SEQ ID NO: 19795 - RNA, 18 nt, Homo sapiens
ccuggauuccucacuuug

SEQ ID NO: 19796 - RNA, 21 nt, Homo sapiens
aauaggaaauauuuuaauguu

SEQ ID NO: 19797 - RNA, 19 nt, Homo sapiens
uaagaaaaaggaugcacag

SEQ ID NO: 19798 - RNA, 15 nt, Homo sapiens
cagccccugggacca

SEQ ID NO: 19799 - RNA, 12 nt, Homo sapiens
ugauugccauuu

SEQ ID NO: 19800 - RNA, 20 nt, Homo sapiens
auguaacaacaauuauuuga

SEQ ID NO: 19801 - RNA, 19 nt, Homo sapiens
uguuagagaauuuccuuac

SEQ ID NO: 19802 - RNA, 22 nt, Homo sapiens
uuuagcauaguaccucugcuau

SEQ ID NO: 19803 - RNA, 18 nt, Homo sapiens
uuuaucugcuaugcuauu

SEQ ID NO: 19804 - RNA, 14 nt, Homo sapiens
ugcacacucuccca

SEQ ID NO: 19805 - RNA, 20 nt, Homo sapiens
ccugagcccuacugugucuc

SEQ ID NO: 19806 - RNA, 21 nt, Homo sapiens
ggaagccaaaccucugugagc

SEQ ID NO: 19807 - RNA, 22 nt, Homo sapiens
ucccaggaggggcuucugggca

SEQ ID NO: 19808 - RNA, 16 nt, Homo sapiens
cauuuaauccucucaa

SEQ ID NO: 19809 - RNA, 16 nt, Homo sapiens
ggcuccugagacacau

SEQ ID NO: 19810 - RNA, 22 nt, Homo sapiens
cucuggaagccucuauugccau

SEQ ID NO: 19811 - RNA, 19 nt, Homo sapiens
auauaaaaauaaagcacuu

SEQ ID NO: 19812 - RNA, 14 nt, Homo sapiens
cucucuuguagcuc

SEQ ID NO: 19813 - RNA, 14 nt, Homo sapiens
ugcauuuaauuaga

SEQ ID NO: 19814 - RNA, 23 nt, Homo sapiens
ggaauauguuagagaauuuccuu

SEQ ID NO: 19815 - RNA, 19 nt, Homo sapiens
aaggauuuuaugcuuuaaa

SEQ ID NO: 19816 - RNA, 21 nt, Homo sapiens
cuugauugugggauacuauuu

SEQ ID NO: 19817 - RNA, 15 nt, Homo sapiens
ucaccucucaccucc

SEQ ID NO: 19818 - RNA, 20 nt, Homo sapiens
gcaacaugccagccacugug

SEQ ID NO: 19819 - RNA, 19 nt, Homo sapiens
uaguucaauccugauucau

SEQ ID NO: 19820 - RNA, 17 nt, Homo sapiens
acauaaugcgugcauac

SEQ ID NO: 19821 - RNA, 22 nt, Homo sapiens
guuugcagauauucucuaguca

SEQ ID NO: 19822 - RNA, 19 nt, Homo sapiens
ugugaacuaaacuuucaca

SEQ ID NO: 19823 - RNA, 13 nt, Homo sapiens
gcaggcaucgcca

SEQ ID NO: 19824 - RNA, 23 nt, Homo sapiens
aaauacacuguuaucuucacuuu

SEQ ID NO: 19825 - RNA, 20 nt, Homo sapiens
guaauuugugauacaaugcu

SEQ ID NO: 19826 - RNA, 12 nt, Homo sapiens
uguagcucucug

SEQ ID NO: 19827 - RNA, 15 nt, Homo sapiens
uuagaugaaugucag

SEQ ID NO: 19828 - RNA, 16 nt, Homo sapiens
cccuagcccuuacguc

SEQ ID NO: 19829 - RNA, 18 nt, Homo sapiens
cagcucucaguugcagcc

SEQ ID NO: 19830 - RNA, 22 nt, Homo sapiens
uuucaagggaccucuccaugau

SEQ ID NO: 19831 - RNA, 18 nt, Homo sapiens
cuacuguaauuugugaua

SEQ ID NO: 19832 - RNA, 20 nt, Homo sapiens
acaggauggcaggaggcauc

SEQ ID NO: 19833 - RNA, 17 nt, Homo sapiens
auaauaaagaucaugua

SEQ ID NO: 19834 - RNA, 21 nt, Homo sapiens
ugcaaucuucucagaaggcaa

SEQ ID NO: 19835 - RNA, 17 nt, Homo sapiens
aaagcugaguguuucac

SEQ ID NO: 19836 - RNA, 17 nt, Homo sapiens
gcauacugccuuguuua

SEQ ID NO: 19837 - RNA, 18 nt, Homo sapiens
uagcagauuuaagauaug

SEQ ID NO: 19838 - RNA, 20 nt, Homo sapiens
acuccacuuggacaugggcc

SEQ ID NO: 19839 - RNA, 15 nt, Homo sapiens
uguaacuguaaagau

SEQ ID NO: 19840 - RNA, 16 nt, Homo sapiens
caggauuuaaguuuca

SEQ ID NO: 19841 - RNA, 18 nt, Homo sapiens
caugucagccacugugau

SEQ ID NO: 19842 - RNA, 14 nt, Homo sapiens
ggcccugccaugcu

SEQ ID NO: 19843 - RNA, 17 nt, Homo sapiens
aagcaugugagacuggu

SEQ ID NO: 19844 - RNA, 21 nt, Homo sapiens
cuauguuaauauuuuaugugu

SEQ ID NO: 19845 - RNA, 19 nt, Homo sapiens
cugcagccccugggaccag

SEQ ID NO: 19846 - RNA, 22 nt, Homo sapiens
caggauggcaggaggcauccaa

SEQ ID NO: 19847 - RNA, 18 nt, Homo sapiens
gacucuggucaagaagca

SEQ ID NO: 19848 - RNA, 16 nt, Homo sapiens
cgcuaccucuccagcc

SEQ ID NO: 19849 - RNA, 18 nt, Homo sapiens
cccauucacagauaccuc

SEQ ID NO: 19850 - RNA, 17 nt, Homo sapiens
aggaugcuuguacauaa

SEQ ID NO: 19851 - RNA, 18 nt, Homo sapiens
ucugcuauuugcuguuau

SEQ ID NO: 19852 - RNA, 19 nt, Homo sapiens
caauguuuagcagauuuaa

SEQ ID NO: 19853 - RNA, 15 nt, Homo sapiens
auauuuuauguguaa

SEQ ID NO: 19854 - RNA, 13 nt, Homo sapiens
cuagauacuguau

SEQ ID NO: 19855 - RNA, 19 nt, Homo sapiens
uuuuuaagugcugcauuua

SEQ ID NO: 19856 - RNA, 21 nt, Homo sapiens
agcauacguacacauuuuauu

SEQ ID NO: 19857 - RNA, 14 nt, Homo sapiens
cagauaccaugaug

SEQ ID NO: 19858 - RNA, 14 nt, Homo sapiens
uggaaacguauuca

SEQ ID NO: 19859 - RNA, 20 nt, Homo sapiens
accuucccagcuagaauuca

SEQ ID NO: 19860 - RNA, 21 nt, Homo sapiens
cuuguagcucucugaccuccu

SEQ ID NO: 19861 - RNA, 15 nt, Homo sapiens
guagcguacaucaau

SEQ ID NO: 19862 - RNA, 15 nt, Homo sapiens
aagucccagaucaag

SEQ ID NO: 19863 - RNA, 15 nt, Homo sapiens
uagagaauuuccuua

SEQ ID NO: 19864 - RNA, 17 nt, Homo sapiens
guaauuugugauacaau

SEQ ID NO: 19865 - RNA, 21 nt, Homo sapiens
uggaagccucuauugccauga

SEQ ID NO: 19866 - RNA, 16 nt, Homo sapiens
agaucucuaacuucac

SEQ ID NO: 19867 - RNA, 21 nt, Homo sapiens
cuucugacacuaaaacaccuc

SEQ ID NO: 19868 - RNA, 19 nt, Homo sapiens
ccaaugagaucauugugaa

SEQ ID NO: 19869 - RNA, 18 nt, Homo sapiens
ccuuagcccaucuuucaa

SEQ ID NO: 19870 - RNA, 11 nt, Homo sapiens
ucuauguuaau

SEQ ID NO: 19871 - RNA, 20 nt, Homo sapiens
gccucagggugcacacagga

SEQ ID NO: 19872 - RNA, 20 nt, Homo sapiens
caugaugcugagcccggaaa

SEQ ID NO: 19873 - RNA, 19 nt, Homo sapiens
cuuucaagggaccucucca

SEQ ID NO: 19874 - RNA, 23 nt, Homo sapiens
uuucuuguaaggcauacugccuu

SEQ ID NO: 19875 - RNA, 16 nt, Homo sapiens
cuggcuaugcauuuga

SEQ ID NO: 19876 - RNA, 12 nt, Homo sapiens
uugugcauuugg

SEQ ID NO: 19877 - RNA, 14 nt, Homo sapiens
aacauguauguaaa

SEQ ID NO: 19878 - RNA, 22 nt, Homo sapiens
gauacuguaucaugacaaagac

SEQ ID NO: 19879 - RNA, 19 nt, Homo sapiens
uccaaaguacacuguuuca

SEQ ID NO: 19880 - RNA, 12 nt, Homo sapiens
auauauuuuaga

SEQ ID NO: 19881 - RNA, 18 nt, Homo sapiens
gagacacaugggugcuau

SEQ ID NO: 19882 - RNA, 21 nt, Homo sapiens
uuacuaaacauguauguaaau

SEQ ID NO: 19883 - RNA, 17 nt, Homo sapiens
uguugcuaucaauccaa

SEQ ID NO: 19884 - RNA, 21 nt, Homo sapiens
cuaaaguguauuuuuuuacua

SEQ ID NO: 19885 - RNA, 20 nt, Homo sapiens
agcauaguaccucugcuauu

SEQ ID NO: 19886 - RNA, 20 nt, Homo sapiens
ugugauugacgggacuguug

SEQ ID NO: 19887 - RNA, 12 nt, Homo sapiens
uuauuucacuuu

SEQ ID NO: 19888 - RNA, 12 nt, Homo sapiens
uaaauagcuaag

SEQ ID NO: 19889 - RNA, 16 nt, Homo sapiens
ucuagauacuguauca

SEQ ID NO: 19890 - RNA, 17 nt, Homo sapiens
ugaguacguugugcauu

SEQ ID NO: 19891 - RNA, 22 nt, Homo sapiens
agccuuggauacuccauggggu

SEQ ID NO: 19892 - RNA, 17 nt, Homo sapiens
accucuugagccuugaa

SEQ ID NO: 19893 - RNA, 24 nt, Homo sapiens
uuguaacuguaaagaugaauguca

SEQ ID NO: 19894 - RNA, 20 nt, Homo sapiens
uuuugaagauucuauguuaa

SEQ ID NO: 19895 - RNA, 14 nt, Homo sapiens
augugaugaucuac

SEQ ID NO: 19896 - RNA, 20 nt, Homo sapiens
acacugcauguuugugauug

SEQ ID NO: 19897 - RNA, 18 nt, Homo sapiens
uuucuaugacacaugcaa

SEQ ID NO: 19898 - RNA, 17 nt, Homo sapiens
ucagcugccuccccagc

SEQ ID NO: 19899 - RNA, 22 nt, Homo sapiens
uaugaggcauuuguuugaacug

SEQ ID NO: 19900 - RNA, 18 nt, Homo sapiens
uccauggcccugccaugc

SEQ ID NO: 19901 - RNA, 13 nt, Homo sapiens
aaucuaaauggaa

SEQ ID NO: 19902 - RNA, 15 nt, Homo sapiens
cagcuacaauuguaa

SEQ ID NO: 19903 - RNA, 14 nt, Homo sapiens
cuagauagucaaua

SEQ ID NO: 19904 - RNA, 23 nt, Homo sapiens
agguaccuucucaccugugagac

SEQ ID NO: 19905 - RNA, 22 nt, Homo sapiens
cuuucaagggaccucuccauga

SEQ ID NO: 19906 - RNA, 20 nt, Homo sapiens
aagauauguaacaacaauua

SEQ ID NO: 19907 - RNA, 18 nt, Homo sapiens
ucuccauggcccugccau

SEQ ID NO: 19908 - RNA, 19 nt, Homo sapiens
gcauuuggugguuucagaa

SEQ ID NO: 19909 - RNA, 21 nt, Homo sapiens
aagacugaguacguugugcau

SEQ ID NO: 19910 - RNA, 22 nt, Homo sapiens
aacuguuauuuauaaucacuuu

SEQ ID NO: 19911 - RNA, 12 nt, Homo sapiens
uaugugcacauc

SEQ ID NO: 19912 - RNA, 15 nt, Homo sapiens
uauuuauaaucacuu

SEQ ID NO: 19913 - RNA, 22 nt, Homo sapiens
cugaggagccugcaacaugcca

SEQ ID NO: 19914 - RNA, 22 nt, Homo sapiens
guugauggaaauacacuguuau

SEQ ID NO: 19915 - RNA, 15 nt, Homo sapiens
gcuugugugcacaua

SEQ ID NO: 19916 - RNA, 22 nt, Homo sapiens
cuccugagacacaugggugcua

SEQ ID NO: 19917 - RNA, 14 nt, Homo sapiens
aguaguuagcuuuc

SEQ ID NO: 19918 - RNA, 22 nt, Homo sapiens
cagcugccuccccagcucuauc

SEQ ID NO: 19919 - RNA, 19 nt, Homo sapiens
cuaggggggucagccagcc

SEQ ID NO: 19920 - RNA, 16 nt, Homo sapiens
ggaacaugagccuuug

SEQ ID NO: 19921 - RNA, 14 nt, Homo sapiens
ucucaguugcagcc

SEQ ID NO: 19922 - RNA, 18 nt, Homo sapiens
ccuuauucagaauuucua

SEQ ID NO: 19923 - RNA, 18 nt, Homo sapiens
uguacucugaaaguuuug

SEQ ID NO: 19924 - RNA, 16 nt, Homo sapiens
gggaccucuccaugau

SEQ ID NO: 19925 - RNA, 14 nt, Homo sapiens
cuccuccuucaugg

SEQ ID NO: 19926 - RNA, 23 nt, Homo sapiens
aauaucccuuggacauuuuaugu

SEQ ID NO: 19927 - RNA, 20 nt, Homo sapiens
cuucccagcuagaauucacu

SEQ ID NO: 19928 - RNA, 18 nt, Homo sapiens
ccagugagaucaauguga

SEQ ID NO: 19929 - RNA, 16 nt, Homo sapiens
gaauauauuuccuuau

SEQ ID NO: 19930 - RNA, 21 nt, Homo sapiens
gucaaacccaaguuaguucaa

SEQ ID NO: 19931 - RNA, 21 nt, Homo sapiens
uuuaagaaaaaggaugcacag

SEQ ID NO: 19932 - RNA, 17 nt, Homo sapiens
uacuuuuaaacuuugau

SEQ ID NO: 19933 - RNA, 16 nt, Homo sapiens
cuguuaucuucacuuu

SEQ ID NO: 19934 - RNA, 20 nt, Homo sapiens
uucccagcuagaauucacuc

SEQ ID NO: 19935 - RNA, 19 nt, Homo sapiens
ugggccccagauaccauga

SEQ ID NO: 19936 - RNA, 20 nt, Homo sapiens
ccagggcuugugugcacaua

SEQ ID NO: 19937 - RNA, 16 nt, Homo sapiens
aaacaccaggauuuaa

SEQ ID NO: 19938 - RNA, 13 nt, Homo sapiens
ucuccagccucag

SEQ ID NO: 19939 - RNA, 16 nt, Homo sapiens
augauuucacagugug

SEQ ID NO: 19940 - RNA, 13 nt, Homo sapiens
acaaaauauagcu

SEQ ID NO: 19941 - RNA, 14 nt, Homo sapiens
uguuagagcagaga

SEQ ID NO: 19942 - RNA, 13 nt, Homo sapiens
agagaauuuccuu

SEQ ID NO: 19943 - RNA, 17 nt, Homo sapiens
cauucuccuuguguuac

SEQ ID NO: 19944 - RNA, 23 nt, Homo sapiens
cugcaaucuucucagaaggcaaa

SEQ ID NO: 19945 - RNA, 16 nt, Homo sapiens
caauuugaauauaaau

SEQ ID NO: 19946 - RNA, 15 nt, Homo sapiens
ccuggccgcagugag

SEQ ID NO: 19947 - RNA, 13 nt, Homo sapiens
gcccuagcauuuc

SEQ ID NO: 19948 - RNA, 19 nt, Homo sapiens
augguaguuuuacaguguu

SEQ ID NO: 19949 - RNA, 23 nt, Homo sapiens
uuagagaauuuccuuacucuuga

SEQ ID NO: 19950 - RNA, 14 nt, Homo sapiens
cuauuauauucauu

SEQ ID NO: 19951 - RNA, 18 nt, Homo sapiens
cuuuuuccagguuccuga

SEQ ID NO: 19952 - RNA, 14 nt, Homo sapiens
aggggcaguggugg

SEQ ID NO: 19953 - RNA, 18 nt, Homo sapiens
uauggcuuuugugcauua

SEQ ID NO: 19954 - RNA, 14 nt, Homo sapiens
augcuauuuauuaa

SEQ ID NO: 19955 - RNA, 13 nt, Homo sapiens
cuauuauauucau

SEQ ID NO: 19956 - RNA, 13 nt, Homo sapiens
auuucacagugug

SEQ ID NO: 19957 - RNA, 13 nt, Homo sapiens
aaggaagguucug

SEQ ID NO: 19958 - RNA, 13 nt, Homo sapiens
caucucugcaauc

SEQ ID NO: 19959 - RNA, 16 nt, Homo sapiens
cucaaccaccuuucag

SEQ ID NO: 19960 - RNA, 13 nt, Homo sapiens
ugcuaucaaucca

SEQ ID NO: 19961 - RNA, 19 nt, Homo sapiens
acacugcauguuugugauu

SEQ ID NO: 19962 - RNA, 18 nt, Homo sapiens
agaagaaaauaguggugu

SEQ ID NO: 19963 - RNA, 12 nt, Homo sapiens
acuuuaccuuuu

SEQ ID NO: 19964 - RNA, 13 nt, Homo sapiens
cuauugccaugag

SEQ ID NO: 19965 - RNA, 16 nt, Homo sapiens
uaaagaugaaugucag

SEQ ID NO: 19966 - RNA, 17 nt, Homo sapiens
agcuagaauucacucca

SEQ ID NO: 19967 - RNA, 18 nt, Homo sapiens
uaucccaaccucucccaa

SEQ ID NO: 19968 - RNA, 15 nt, Homo sapiens
uaauuuuauuauagu

SEQ ID NO: 19969 - RNA, 14 nt, Homo sapiens
uuccugacugcuag

SEQ ID NO: 19970 - RNA, 22 nt, Homo sapiens
ucaucaguauugaagcauuuua

SEQ ID NO: 19971 - RNA, 17 nt, Homo sapiens
acaaugacuuacuguac

SEQ ID NO: 19972 - RNA, 20 nt, Homo sapiens
aucgucacugcuuaacuuca

SEQ ID NO: 19973 - RNA, 21 nt, Homo sapiens
guacacuguuucaaacuuuac

SEQ ID NO: 19974 - RNA, 16 nt, Homo sapiens
cuagaauucacuccac

SEQ ID NO: 19975 - RNA, 22 nt, Homo sapiens
caacaauuauuugaagauuuaa

SEQ ID NO: 19976 - RNA, 18 nt, Homo sapiens
gcauaguaccucugcuau

SEQ ID NO: 19977 - RNA, 23 nt, Homo sapiens
uucucuaguucaaguucaccaga

SEQ ID NO: 19978 - RNA, 17 nt, Homo sapiens
ucagaaauguguuauca

SEQ ID NO: 19979 - RNA, 20 nt, Homo sapiens
ucacaguuuugguugcuuua

SEQ ID NO: 19980 - RNA, 12 nt, Homo sapiens
uuaagccuuaaa

SEQ ID NO: 19981 - RNA, 22 nt, Homo sapiens
augcaguguuucccucuguguu

SEQ ID NO: 19982 - RNA, 14 nt, Homo sapiens
caaugauaaugcua

SEQ ID NO: 19983 - RNA, 17 nt, Homo sapiens
cuaaacauguauguaaa

SEQ ID NO: 19984 - RNA, 15 nt, Homo sapiens
uuauuuuaucugcua

SEQ ID NO: 19985 - RNA, 23 nt, Homo sapiens
cugcaacaugccagccacuguga

SEQ ID NO: 19986 - RNA, 15 nt, Homo sapiens
uaauuauuucacuuu

SEQ ID NO: 19987 - RNA, 12 nt, Homo sapiens
gcggaccuuccc

SEQ ID NO: 19988 - RNA, 21 nt, Homo sapiens
ccagugagaucaaugugacgg

SEQ ID NO: 19989 - RNA, 23 nt, Homo sapiens
auucauucuuuuugaaaugucaa

SEQ ID NO: 19990 - RNA, 19 nt, Homo sapiens
cuguuauuuuaucugcuau

SEQ ID NO: 19991 - RNA, 15 nt, Homo sapiens
aaaacaggcaaauuc

SEQ ID NO: 19992 - RNA, 13 nt, Homo sapiens
gccauucuugcug

SEQ ID NO: 19993 - RNA, 20 nt, Homo sapiens
gacaggaggggaaggcaaca

SEQ ID NO: 19994 - RNA, 17 nt, Homo sapiens
ugccuuguuuaauguua

SEQ ID NO: 19995 - RNA, 19 nt, Homo sapiens
cugaggagccugcaacaug

SEQ ID NO: 19996 - RNA, 19 nt, Homo sapiens
cugaguacguugugcauuu

SEQ ID NO: 19997 - RNA, 23 nt, Homo sapiens
cacguuucuaaaggcuaccuuug

SEQ ID NO: 19998 - RNA, 12 nt, Homo sapiens
caugagccuuug

SEQ ID NO: 19999 - RNA, 15 nt, Homo sapiens
ucucaccugugagac

SEQ ID NO: 20000 - RNA, 14 nt, Homo sapiens
gcuaucaauccaag

SEQ ID NO: 20001 - RNA, 10 nt, Homo sapiens
acccccagaa

SEQ ID NO: 20002 - RNA, 20 nt, Homo sapiens
cuaucaaguauuauaccuuu

SEQ ID NO: 20003 - RNA, 21 nt, Homo sapiens
uauguaaauagcuaagauaua

SEQ ID NO: 20004 - RNA, 17 nt, Homo sapiens
agguuccugagcccuac

SEQ ID NO: 20005 - RNA, 17 nt, Homo sapiens
ugaaguaauaugcacac

SEQ ID NO: 20006 - RNA, 23 nt, Homo sapiens
uggaccauaaccccggaagccaa

SEQ ID NO: 20007 - RNA, 22 nt, Homo sapiens
gucaaccccaaguuaguucaau

SEQ ID NO: 20008 - RNA, 20 nt, Homo sapiens
uacaggaacagaagaggaaa

SEQ ID NO: 20009 - RNA, 21 nt, Homo sapiens
ugguaguuuuacaguguuucu

SEQ ID NO: 20010 - RNA, 21 nt, Homo sapiens
uuuagcauaguaccucugcua

SEQ ID NO: 20011 - RNA, 14 nt, Homo sapiens
gaaaugauuucaca

SEQ ID NO: 20012 - RNA, 11 nt, Homo sapiens
uuuacaguguu

SEQ ID NO: 20013 - RNA, 16 nt, Homo sapiens
uacguugugcauuugg

SEQ ID NO: 20014 - RNA, 22 nt, Homo sapiens
uaguuacuaaacauguauguaa

SEQ ID NO: 20015 - RNA, 21 nt, Homo sapiens
uagaauauauuuccuuauuca

SEQ ID NO: 20016 - RNA, 21 nt, Homo sapiens
acuucuuaguaugugcauuua

SEQ ID NO: 20017 - RNA, 19 nt, Homo sapiens
ugaagguagaauguuuuca

SEQ ID NO: 20018 - RNA, 19 nt, Homo sapiens
caauaaagcagcguuucua

SEQ ID NO: 20019 - RNA, 23 nt, Homo sapiens
cucuccaugaucccaccucccau

SEQ ID NO: 20020 - RNA, 13 nt, Homo sapiens
ucuggugugaacu

SEQ ID NO: 20021 - RNA, 18 nt, Homo sapiens
cuccacuuggacaugggc

SEQ ID NO: 20022 - RNA, 14 nt, Homo sapiens
accucuccagccuc

SEQ ID NO: 20023 - RNA, 11 nt, Homo sapiens
uaccuucucac

SEQ ID NO: 20024 - RNA, 18 nt, Homo sapiens
ucaaauguucuccaguca

SEQ ID NO: 20025 - RNA, 21 nt, Homo sapiens
gaaccacucuaucaaguauua

SEQ ID NO: 20026 - RNA, 13 nt, Homo sapiens
ucugcuaugcuau

SEQ ID NO: 20027 - RNA, 17 nt, Homo sapiens
uccaguaguuagcuuuc

SEQ ID NO: 20028 - RNA, 17 nt, Homo sapiens
uucacuccacuuggaca

SEQ ID NO: 20029 - RNA, 15 nt, Homo sapiens
auuuaauccucucaa

SEQ ID NO: 20030 - RNA, 14 nt, Homo sapiens
aauguaugugcaca

SEQ ID NO: 20031 - RNA, 12 nt, Homo sapiens
uaaaacaccuca

SEQ ID NO: 20032 - RNA, 16 nt, Homo sapiens
auggcuuuugugcauu

SEQ ID NO: 20033 - RNA, 23 nt, Homo sapiens
acccaaguuaguucaauccugau

SEQ ID NO: 20034 - RNA, 17 nt, Homo sapiens
gaauucacuccacuugg

SEQ ID NO: 20035 - RNA, 22 nt, Homo sapiens
cuauuuaauuauuucacuuuag

SEQ ID NO: 20036 - RNA, 23 nt, Homo sapiens
guuaguucaauccugauucauau

SEQ ID NO: 20037 - RNA, 21 nt, Homo sapiens
uccaagaucuuuuuccagguu

SEQ ID NO: 20038 - RNA, 17 nt, Homo sapiens
guauggcaaacugccau

SEQ ID NO: 20039 - RNA, 18 nt, Homo sapiens
aauuauuugaagauuuaa

SEQ ID NO: 20040 - RNA, 17 nt, Homo sapiens
ccaggcacccccagaau

SEQ ID NO: 20041 - RNA, 15 nt, Homo sapiens
uucaauccugauuca

SEQ ID NO: 20042 - RNA, 20 nt, Homo sapiens
agaaaauaguggugugauuu

SEQ ID NO: 20043 - RNA, 16 nt, Homo sapiens
auguuuagcagauuua

SEQ ID NO: 20044 - RNA, 19 nt, Homo sapiens
auuuaacagaaauguacag

SEQ ID NO: 20045 - RNA, 20 nt, Homo sapiens
uaugcaugaaguaauaugca

SEQ ID NO: 20046 - RNA, 21 nt, Homo sapiens
aaugacuuacuguacaugaaa

SEQ ID NO: 20047 - RNA, 18 nt, Homo sapiens
cacuguuaucuucacuuu

SEQ ID NO: 20048 - RNA, 17 nt, Homo sapiens
aaugauuucacagugug

SEQ ID NO: 20049 - RNA, 23 nt, Homo sapiens
ucccagcuagaauucacuccacu

SEQ ID NO: 20050 - RNA, 21 nt, Homo sapiens
agggcuugugugcacauaucc

SEQ ID NO: 20051 - RNA, 17 nt, Homo sapiens
ucuggcuaugcauuuga

SEQ ID NO: 20052 - RNA, 13 nt, Homo sapiens
agucuucuauuua

SEQ ID NO: 20053 - RNA, 21 nt, Homo sapiens
uccgcauccuccuccugcuuc

SEQ ID NO: 20054 - RNA, 18 nt, Homo sapiens
accuuuuuuauacauaaa

SEQ ID NO: 20055 - RNA, 13 nt, Homo sapiens
cccaucaucaccc

SEQ ID NO: 20056 - RNA, 17 nt, Homo sapiens
uuuguagcguacaucaa

SEQ ID NO: 20057 - RNA, 19 nt, Homo sapiens
acugaguacguugugcauu

SEQ ID NO: 20058 - RNA, 22 nt, Homo sapiens
cugcuaugcuauugaaguuuug

SEQ ID NO: 20059 - RNA, 23 nt, Homo sapiens
ucuccaaaccacuuuuugcagcu

SEQ ID NO: 20060 - RNA, 22 nt, Homo sapiens
aagaucuuuuuccagguuccug

SEQ ID NO: 20061 - RNA, 17 nt, Homo sapiens
uauaauuuaaacgugau

SEQ ID NO: 20062 - RNA, 17 nt, Homo sapiens
acauaucacaugucagc

SEQ ID NO: 20063 - RNA, 14 nt, Homo sapiens
uuugagcucuggaa

SEQ ID NO: 20064 - RNA, 22 nt, Homo sapiens
gucaaacccaaguuaguucaau

SEQ ID NO: 20065 - RNA, 14 nt, Homo sapiens
cguugugcauuugg

SEQ ID NO: 20066 - RNA, 20 nt, Homo sapiens
ccauaaccccggaagccaaa

SEQ ID NO: 20067 - RNA, 17 nt, Homo sapiens
ucaauccaagaacuuau

SEQ ID NO: 20068 - RNA, 23 nt, Homo sapiens
ggucacuuuacuguccccaucau

SEQ ID NO: 20069 - RNA, 23 nt, Homo sapiens
aauauagcuuucauaacaucgaa

SEQ ID NO: 20070 - RNA, 18 nt, Homo sapiens
uaauaucaucaguauuga

SEQ ID NO: 20071 - RNA, 15 nt, Homo sapiens
cuagcccuuacgucc

SEQ ID NO: 20072 - RNA, 14 nt, Homo sapiens
gcccugccaugcuc

SEQ ID NO: 20073 - RNA, 16 nt, Homo sapiens
gauuccucacuuugaa

SEQ ID NO: 20074 - RNA, 14 nt, Homo sapiens
auccugugggaccu

SEQ ID NO: 20075 - RNA, 18 nt, Homo sapiens
cuuaguaugugcauuuaa

SEQ ID NO: 20076 - RNA, 19 nt, Homo sapiens
uaagaacuaaaauguucua

SEQ ID NO: 20077 - RNA, 17 nt, Homo sapiens
gaccugggccauaguca

SEQ ID NO: 20078 - RNA, 22 nt, Homo sapiens
accuuuguauucucuccuguac

SEQ ID NO: 20079 - RNA, 19 nt, Homo sapiens
cuaaauaucccuuggacau

SEQ ID NO: 20080 - RNA, 14 nt, Homo sapiens
auauucucuaguca

SEQ ID NO: 20081 - RNA, 16 nt, Homo sapiens
uuaagcuuucagcuca

SEQ ID NO: 20082 - RNA, 20 nt, Homo sapiens
ccugagacacaugggugcua

SEQ ID NO: 20083 - RNA, 14 nt, Homo sapiens
guaugaggcauuug

SEQ ID NO: 20084 - RNA, 13 nt, Homo sapiens
ugacuuacuguac

SEQ ID NO: 20085 - RNA, 23 nt, Homo sapiens
aaguuuuuauggcuuuugugcau

SEQ ID NO: 20086 - RNA, 18 nt, Homo sapiens
ggaaucacuggcuguuaa

SEQ ID NO: 20087 - RNA, 16 nt, Homo sapiens
aacuuuuccaaugaca

SEQ ID NO: 20088 - RNA, 18 nt, Homo sapiens
cugacacuaaaacaccuc

SEQ ID NO: 20089 - RNA, 21 nt, Homo sapiens
gaacaugagccuuuguugcua

SEQ ID NO: 20090 - RNA, 18 nt, Homo sapiens
guuagagaauuuccuuac

SEQ ID NO: 20091 - RNA, 17 nt, Homo sapiens
augagccuuuguugcua

SEQ ID NO: 20092 - RNA, 20 nt, Homo sapiens
caaucuucucagaaggcaaa

SEQ ID NO: 20093 - RNA, 18 nt, Homo sapiens
agcuagaauucacuccac

SEQ ID NO: 20094 - RNA, 12 nt, Homo sapiens
uuucaaacuuua

SEQ ID NO: 20095 - RNA, 20 nt, Homo sapiens
cauuaauaauaaauucccug

SEQ ID NO: 20096 - RNA, 15 nt, Homo sapiens
ugcgccuaauguguu

SEQ ID NO: 20097 - RNA, 20 nt, Homo sapiens
uaaaacaccucagcugccuc

SEQ ID NO: 20098 - RNA, 13 nt, Homo sapiens
uacguugugcauu

SEQ ID NO: 20099 - RNA, 21 nt, Homo sapiens
gaccauaaccccggaagccaa

SEQ ID NO: 20100 - RNA, 20 nt, Homo sapiens
ucaauguuuagcagauuuaa

SEQ ID NO: 20101 - RNA, 17 nt, Homo sapiens
cugaguacguugugcau

SEQ ID NO: 20102 - RNA, 16 nt, Homo sapiens
uaacaaugacuuguac

SEQ ID NO: 20103 - RNA, 21 nt, Homo sapiens
aauccaagaacuuauuuguac

SEQ ID NO: 20104 - RNA, 15 nt, Homo sapiens
aaauuuuuauguaau

SEQ ID NO: 20105 - RNA, 13 nt, Homo sapiens
gugauacaaugcu

SEQ ID NO: 20106 - RNA, 13 nt, Homo sapiens
uagaagauucuau

SEQ ID NO: 20107 - RNA, 17 nt, Homo sapiens
ugaaagucccagaucaa

SEQ ID NO: 20108 - RNA, 21 nt, Homo sapiens
guaaaugggggugcauuugag

SEQ ID NO: 20109 - RNA, 17 nt, Homo sapiens
cacaugcaaggucauuu

SEQ ID NO: 20110 - RNA, 16 nt, Homo sapiens
gcuaccucuccagccu

SEQ ID NO: 20111 - RNA, 17 nt, Homo sapiens
uauauaugugaugaucu

SEQ ID NO: 20112 - RNA, 15 nt, Homo sapiens
ggcuugugugcacau

SEQ ID NO: 20113 - RNA, 19 nt, Homo sapiens
ugauuuuauaugcuauuua

SEQ ID NO: 20114 - RNA, 16 nt, Homo sapiens
ugacaucucugcaauc

SEQ ID NO: 20115 - RNA, 18 nt, Homo sapiens
augacauaucacauguca

SEQ ID NO: 20116 - RNA, 20 nt, Homo sapiens
cuuuuauaaacuuuaccuuu

SEQ ID NO: 20117 - RNA, 15 nt, Homo sapiens
uucgugaugacauau

SEQ ID NO: 20118 - RNA, 21 nt, Homo sapiens
aucuuucaaagugucuugaau

SEQ ID NO: 20119 - RNA, 12 nt, Homo sapiens
ucaaauguucuc

SEQ ID NO: 20120 - RNA, 19 nt, Homo sapiens
aaaaaacaccaggauuuaa

SEQ ID NO: 20121 - RNA, 16 nt, Homo sapiens
aaaaaggaugcacaga

SEQ ID NO: 20122 - RNA, 21 nt, Homo sapiens
cuccgcauccuccuccugcuu

SEQ ID NO: 20123 - RNA, 21 nt, Homo sapiens
gcuuaauuauugauguuuuca

SEQ ID NO: 20124 - RNA, 15 nt, Homo sapiens
uguuaucuucacuuu

SEQ ID NO: 20125 - RNA, 16 nt, Homo sapiens
agcauacguacacauu

SEQ ID NO: 20126 - RNA, 20 nt, Homo sapiens
uccucgaggcccuagcauuu

SEQ ID NO: 20127 - RNA, 13 nt, Homo sapiens
ugcagauauucuc

SEQ ID NO: 20128 - RNA, 14 nt, Homo sapiens
ugaagacaaugacu

SEQ ID NO: 20129 - RNA, 23 nt, Homo sapiens
acuuugaccucugcagcaauaaa

SEQ ID NO: 20130 - RNA, 13 nt, Homo sapiens
uuuauaugcuauu

SEQ ID NO: 20131 - RNA, 16 nt, Homo sapiens
uuuugguugcuuuaau

SEQ ID NO: 20132 - RNA, 20 nt, Homo sapiens
cucucaguugcagcccugcu

SEQ ID NO: 20133 - RNA, 19 nt, Homo sapiens
ccagccuuggauacuccau

SEQ ID NO: 20134 - RNA, 23 nt, Homo sapiens
caaagacugaguacguugugcau

SEQ ID NO: 20135 - RNA, 21 nt, Homo sapiens
ggccagugagaucaaugugac

SEQ ID NO: 20136 - RNA, 15 nt, Homo sapiens
ugccauuugagcucu

SEQ ID NO: 20137 - RNA, 16 nt, Homo sapiens
cugggccauagucauu

SEQ ID NO: 20138 - RNA, 14 nt, Homo sapiens
uacguugugcauuu

SEQ ID NO: 20139 - RNA, 14 nt, Homo sapiens
aaaccuauguuugc

SEQ ID NO: 20140 - RNA, 17 nt, Homo sapiens
aauuuucccucuucacu

SEQ ID NO: 20141 - RNA, 15 nt, Homo sapiens
gaccuccuccuucau

SEQ ID NO: 20142 - RNA, 15 nt, Homo sapiens
gauaccaugaugcug

SEQ ID NO: 20143 - RNA, 12 nt, Homo sapiens
auguuuucacaa

SEQ ID NO: 20144 - RNA, 15 nt, Homo sapiens
aucuagauacuguau

SEQ ID NO: 20145 - RNA, 18 nt, Homo sapiens
aauucccuggccuuucau

SEQ ID NO: 20146 - RNA, 18 nt, Homo sapiens
uguuauuuuaucugcuau

SEQ ID NO: 20147 - RNA, 14 nt, Homo sapiens
aguaauaugcacac

SEQ ID NO: 20148 - RNA, 22 nt, Homo sapiens
uaugcaugaaguaauaugcaca

SEQ ID NO: 20149 - RNA, 13 nt, Homo sapiens
ccgugugccugag

SEQ ID NO: 20150 - RNA, 15 nt, Homo sapiens
auuuaagauauguaa

SEQ ID NO: 20151 - RNA, 21 nt, Homo sapiens
uuuccagguuccugagcccua

SEQ ID NO: 20152 - RNA, 16 nt, Homo sapiens
auguauguaaauagcu

SEQ ID NO: 20153 - RNA, 20 nt, Homo sapiens
ugagccuuuguugcuaucaa

SEQ ID NO: 20154 - RNA, 16 nt, Homo sapiens
agccuuggauacucca

SEQ ID NO: 20155 - RNA, 15 nt, Homo sapiens
uaaagaucauguaaa

SEQ ID NO: 20156 - RNA, 22 nt, Homo sapiens
aucuuucaagggaccucuccau

SEQ ID NO: 20157 - RNA, 16 nt, Homo sapiens
ugauuuuauaugcuau

SEQ ID NO: 20158 - RNA, 17 nt, Homo sapiens
gaagacaaugacuuacu

SEQ ID NO: 20159 - RNA, 20 nt, Homo sapiens
accaucaauuuuaguuguca

SEQ ID NO: 20160 - RNA, 23 nt, Homo sapiens
aagcauuuuauaaaucgcuuuug

SEQ ID NO: 20161 - RNA, 15 nt, Homo sapiens
aauauauaaccagug

SEQ ID NO: 20162 - RNA, 18 nt, Homo sapiens
cugcagccccugggacca

SEQ ID NO: 20163 - RNA, 21 nt, Homo sapiens
cuucgugaugacauaucacau

SEQ ID NO: 20164 - RNA, 19 nt, Homo sapiens
uuuuauggcuuuugugcau

SEQ ID NO: 20165 - RNA, 17 nt, Homo sapiens
ugcagccccugggacca

SEQ ID NO: 20166 - RNA, 21 nt, Homo sapiens
cuauuuaauuauuucacuuua

SEQ ID NO: 20167 - RNA, 15 nt, Homo sapiens
cuuacuguacaugaa

SEQ ID NO: 20168 - RNA, 20 nt, Homo sapiens
ucaaagauauuuugcuuugu

SEQ ID NO: 20169 - RNA, 14 nt, Homo sapiens
cucucugaccuccu

SEQ ID NO: 20170 - RNA, 17 nt, Homo sapiens
uguccgcuauccaccaa

SEQ ID NO: 20171 - RNA, 19 nt, Homo sapiens
uaauucuuagcucauucuc

SEQ ID NO: 20172 - RNA, 14 nt, Homo sapiens
gcagacucugguca

SEQ ID NO: 20173 - RNA, 15 nt, Homo sapiens
aggauuuaaguuuca

SEQ ID NO: 20174 - RNA, 16 nt, Homo sapiens
agguaccuucucaccu

SEQ ID NO: 20175 - RNA, 20 nt, Homo sapiens
acaauuauuugaagauuuaa

SEQ ID NO: 20176 - RNA, 16 nt, Homo sapiens
cugagacacaugggug

SEQ ID NO: 20177 - RNA, 21 nt, Homo sapiens
caacuauaaaacuaggugcug

SEQ ID NO: 20178 - RNA, 13 nt, Homo sapiens
gaaauaggaaaua

SEQ ID NO: 20179 - RNA, 19 nt, Homo sapiens
cguuucuaugacacaugca

SEQ ID NO: 20180 - RNA, 17 nt, Homo sapiens
uucaagggaccucucca

SEQ ID NO: 20181 - RNA, 21 nt, Homo sapiens
aaggaaacuggguuccugcaa

SEQ ID NO: 20182 - RNA, 19 nt, Homo sapiens
ucucugaccuccuccuuca

SEQ ID NO: 20183 - RNA, 18 nt, Homo sapiens
ucagaaggcaaaugacuu

SEQ ID NO: 20184 - RNA, 14 nt, Homo sapiens
ucaucacccagcac

SEQ ID NO: 20185 - RNA, 17 nt, Homo sapiens
gcggauccaagcaaaug

SEQ ID NO: 20186 - RNA, 22 nt, Homo sapiens
ccaugaucccaccucccauuca

SEQ ID NO: 20187 - RNA, 19 nt, Homo sapiens
cugcuaguuuauauagaaa

SEQ ID NO: 20188 - RNA, 23 nt, Homo sapiens
ucuuucaagggaccucuccauga

SEQ ID NO: 20189 - RNA, 13 nt, Homo sapiens
uauuucacuuuag

SEQ ID NO: 20190 - RNA, 21 nt, Homo sapiens
uguaaacuaguuacuaaacau

SEQ ID NO: 20191 - RNA, 20 nt, Homo sapiens
gauauuuauugauguuuuca

SEQ ID NO: 20192 - RNA, 18 nt, Homo sapiens
uacuguaauuugugauac

SEQ ID NO: 20193 - RNA, 23 nt, Homo sapiens
guaacuguaaagaugaaugucag

SEQ ID NO: 20194 - RNA, 20 nt, Homo sapiens
aaucuuucaaagugucuuga

SEQ ID NO: 20195 - RNA, 19 nt, Homo sapiens
acaaugacuuguacucuga

SEQ ID NO: 20196 - RNA, 21 nt, Homo sapiens
cuuaauuauugauguuuucau

SEQ ID NO: 20197 - RNA, 19 nt, Homo sapiens
caauuauuugaagauuuaa

SEQ ID NO: 20198 - RNA, 20 nt, Homo sapiens
auguuagagaauuuccuuac

SEQ ID NO: 20199 - RNA, 21 nt, Homo sapiens
cuuguacauaaugcgugcaua

SEQ ID NO: 20200 - RNA, 23 nt, Homo sapiens
cuuaaaggaagguucugguguga

SEQ ID NO: 20201 - RNA, 17 nt, Homo sapiens
caauaaaacuuuuccaa

SEQ ID NO: 20202 - RNA, 14 nt, Homo sapiens
gugcacauauccuu

SEQ ID NO: 20203 - RNA, 20 nt, Homo sapiens
aauauaaauuuaucauuuag

SEQ ID NO: 20204 - RNA, 21 nt, Homo sapiens
uagcucucugaccuccuccuu

SEQ ID NO: 20205 - RNA, 16 nt, Homo sapiens
aacucuaccugcacac

SEQ ID NO: 20206 - RNA, 13 nt, Homo sapiens
cuccuuguguuac

SEQ ID NO: 20207 - RNA, 21 nt, Homo sapiens
gaaacuccacauccuguggga

SEQ ID NO: 20208 - RNA, 21 nt, Homo sapiens
uggauucaauuuuaaggcaua

SEQ ID NO: 20209 - RNA, 18 nt, Homo sapiens
aaaugauuucacagugug

SEQ ID NO: 20210 - RNA, 17 nt, Homo sapiens
guacguugugcauuugg

SEQ ID NO: 20211 - RNA, 12 nt, Homo sapiens
augggccccaga

SEQ ID NO: 20212 - RNA, 23 nt, Homo sapiens
auccugauucauauuuaauuuga

SEQ ID NO: 20213 - RNA, 21 nt, Homo sapiens
uuucuuccuuuuuuaguucuu

SEQ ID NO: 20214 - RNA, 20 nt, Homo sapiens
ugaaccguuugugauugcca

SEQ ID NO: 20215 - RNA, 18 nt, Homo sapiens
acggucacuuuacugucc

SEQ ID NO: 20216 - RNA, 17 nt, Homo sapiens
ugucagccacugugaua

SEQ ID NO: 20217 - RNA, 14 nt, Homo sapiens
ggaaauacacuguu

SEQ ID NO: 20218 - RNA, 16 nt, Homo sapiens
uagagaauuuccuuac

SEQ ID NO: 20219 - RNA, 21 nt, Homo sapiens
uguauguaaauagcuaagaua

SEQ ID NO: 20220 - RNA, 17 nt, Homo sapiens
caaaccucugugagcau

SEQ ID NO: 20221 - RNA, 22 nt, Homo sapiens
auauccuuagcccaucuuucaa

SEQ ID NO: 20222 - RNA, 20 nt, Homo sapiens
accucucuuguagcucucug

SEQ ID NO: 20223 - RNA, 23 nt, Homo sapiens
auacuauuuaauuauuucacuuu

SEQ ID NO: 20224 - RNA, 12 nt, Homo sapiens
acuguacaugaa

SEQ ID NO: 20225 - RNA, 17 nt, Homo sapiens
uuuuuccagguuccuga

SEQ ID NO: 20226 - RNA, 13 nt, Homo sapiens
gauucuauguuaa

SEQ ID NO: 20227 - RNA, 15 nt, Homo sapiens
uuaauauuucugagg

SEQ ID NO: 20228 - RNA, 20 nt, Homo sapiens
aaugguaguuuuacaguguu

SEQ ID NO: 20229 - RNA, 18 nt, Homo sapiens
cagggaaauguaugugug

SEQ ID NO: 20230 - RNA, 16 nt, Homo sapiens
caauccugauucauau

SEQ ID NO: 20231 - RNA, 20 nt, Homo sapiens
uauugauguuuucacaaaga

SEQ ID NO: 20232 - RNA, 18 nt, Homo sapiens
uaaccagcagaaaugccu

SEQ ID NO: 20233 - RNA, 19 nt, Homo sapiens
uuaaggauuuuaugcuuua

SEQ ID NO: 20234 - RNA, 14 nt, Homo sapiens
agcccucuucugac

SEQ ID NO: 20235 - RNA, 16 nt, Homo sapiens
uagaggcugaggaauc

SEQ ID NO: 20236 - RNA, 16 nt, Homo sapiens
cggcagggaaauguau

SEQ ID NO: 20237 - RNA, 15 nt, Homo sapiens
uacaaaagcauguga

SEQ ID NO: 20238 - RNA, 22 nt, Homo sapiens
uccuucauggcaggcaucgcca

SEQ ID NO: 20239 - RNA, 22 nt, Homo sapiens
ucuugaaauauaggaacuuaaa

SEQ ID NO: 20240 - RNA, 20 nt, Homo sapiens
uaacaaaauuugaauagccc

SEQ ID NO: 20241 - RNA, 14 nt, Homo sapiens
gcagauuuaagaua

SEQ ID NO: 20242 - RNA, 23 nt, Homo sapiens
guuuagcauaguaccucugcuau

SEQ ID NO: 20243 - RNA, 15 nt, Homo sapiens
cugaaccguuuguga

SEQ ID NO: 20244 - RNA, 15 nt, Homo sapiens
ccacuuuuugcagcu

SEQ ID NO: 20245 - RNA, 22 nt, Homo sapiens
gccaguaaaugggggugcauuu

SEQ ID NO: 20246 - RNA, 15 nt, Homo sapiens
gauuucuguuuagau

SEQ ID NO: 20247 - RNA, 21 nt, Homo sapiens
acuuggacaugggccccagau

SEQ ID NO: 20248 - RNA, 21 nt, Homo sapiens
auugccaugagaguucuguca

SEQ ID NO: 20249 - RNA, 16 nt, Homo sapiens
uuuaaaugcaccugga

SEQ ID NO: 20250 - RNA, 16 nt, Homo sapiens
uuugaagauagaaggu

SEQ ID NO: 20251 - RNA, 14 nt, Homo sapiens
auuauauucauucu

SEQ ID NO: 20252 - RNA, 17 nt, Homo sapiens
agagaauaaaaaaugua

SEQ ID NO: 20253 - RNA, 14 nt, Homo sapiens
uaguggugugauuu

SEQ ID NO: 20254 - RNA, 14 nt, Homo sapiens
uaucaucaguauug

SEQ ID NO: 20255 - RNA, 19 nt, Homo sapiens
cuauuuuuuuucuguuaua

SEQ ID NO: 20256 - RNA, 19 nt, Homo sapiens
aaccguuugugauugccau

SEQ ID NO: 20257 - RNA, 16 nt, Homo sapiens
cguuugugauugccau

SEQ ID NO: 20258 - RNA, 21 nt, Homo sapiens
auaaugcgugcauaccacuuu

SEQ ID NO: 20259 - RNA, 13 nt, Homo sapiens
ucuucacuugguu

SEQ ID NO: 20260 - RNA, 22 nt, Homo sapiens
uaaaaauauauagcgacauccu

SEQ ID NO: 20261 - RNA, 21 nt, Homo sapiens
cggucacuuuacuguccccau

SEQ ID NO: 20262 - RNA, 23 nt, Homo sapiens
aucacaguuuugguugcuuuaau

SEQ ID NO: 20263 - RNA, 18 nt, Homo sapiens
agccagguaccuucucac

SEQ ID NO: 20264 - RNA, 23 nt, Homo sapiens
aaggaagguucuggugugaacua

SEQ ID NO: 20265 - RNA, 15 nt, Homo sapiens
acuuuacugucccca

SEQ ID NO: 20266 - RNA, 18 nt, Homo sapiens
caucaguauugaagcauu

SEQ ID NO: 20267 - RNA, 15 nt, Homo sapiens
ugagaucauugugaa

SEQ ID NO: 20268 - RNA, 16 nt, Homo sapiens
ugagguaccagccuug

SEQ ID NO: 20269 - RNA, 14 nt, Homo sapiens
gcuaugcauuugaa

SEQ ID NO: 20270 - RNA, 12 nt, Homo sapiens
accuccugccuc

SEQ ID NO: 20271 - RNA, 14 nt, Homo sapiens
ccagccacugugau

SEQ ID NO: 20272 - RNA, 15 nt, Homo sapiens
agcuuucucuaguuc

SEQ ID NO: 20273 - RNA, 13 nt, Homo sapiens
agaugaaugucag

SEQ ID NO: 20274 - RNA, 20 nt, Homo sapiens
aucauuuacuuuuaaacuuu

SEQ ID NO: 20275 - RNA, 22 nt, Homo sapiens
cacaccccagacgaugucuuca

SEQ ID NO: 20276 - RNA, 17 nt, Homo sapiens
gaaagcugaguguuuca

SEQ ID NO: 20277 - RNA, 17 nt, Homo sapiens
cuagaaaacaggcaaau

SEQ ID NO: 20278 - RNA, 16 nt, Homo sapiens
gaaggcaaaugacuuu

SEQ ID NO: 20279 - RNA, 16 nt, Homo sapiens
cauauuaccacagaca

SEQ ID NO: 20280 - RNA, 13 nt, Homo sapiens
auauauacuauau

SEQ ID NO: 20281 - RNA, 16 nt, Homo sapiens
accuucucaccuguga

SEQ ID NO: 20282 - RNA, 16 nt, Homo sapiens
ugcuaguuuauauaga

SEQ ID NO: 20283 - RNA, 19 nt, Homo sapiens
cagccuuggauacuccaug

SEQ ID NO: 20284 - RNA, 23 nt, Homo sapiens
agauaacuguuauuuauaaucac

SEQ ID NO: 20285 - RNA, 15 nt, Homo sapiens
cccuuggacauuuua

SEQ ID NO: 20286 - RNA, 12 nt, Homo sapiens
aauuauuugaag

SEQ ID NO: 20287 - RNA, 12 nt, Homo sapiens
gucaacauuucu

SEQ ID NO: 20288 - RNA, 20 nt, Homo sapiens
cuccauggggugggggugga

SEQ ID NO: 20289 - RNA, 20 nt, Homo sapiens
guaccuucucaccugugaga

SEQ ID NO: 20290 - RNA, 18 nt, Homo sapiens
aaggaaacuggguuccug

SEQ ID NO: 20291 - RNA, 20 nt, Homo sapiens
cugagcccggaaacuccaca

SEQ ID NO: 20292 - RNA, 14 nt, Homo sapiens
ugcugccugccugg

SEQ ID NO: 20293 - RNA, 15 nt, Homo sapiens
uuauaaaucgcuuuu

SEQ ID NO: 20294 - RNA, 20 nt, Homo sapiens
cuggaagccucuauugccau

SEQ ID NO: 20295 - RNA, 22 nt, Homo sapiens
agaguucugucacggucacuuu

SEQ ID NO: 20296 - RNA, 17 nt, Homo sapiens
uugauuuuauaugcuau

SEQ ID NO: 20297 - RNA, 14 nt, Homo sapiens
ucauuauguuaaua

SEQ ID NO: 20298 - RNA, 11 nt, Homo sapiens
uuugagcucug

SEQ ID NO: 20299 - RNA, 20 nt, Homo sapiens
caagaucuuuuuccagguuc

SEQ ID NO: 20300 - RNA, 20 nt, Homo sapiens
aucuccaaaauaaaacuuuu

SEQ ID NO: 20301 - RNA, 14 nt, Homo sapiens
uaugaggcauuugu

SEQ ID NO: 20302 - RNA, 23 nt, Homo sapiens
acauuuuuaagugcugcauuuaa

SEQ ID NO: 20303 - RNA, 19 nt, Homo sapiens
uuaauaucaucaguauuga

SEQ ID NO: 20304 - RNA, 16 nt, Homo sapiens
ucacugcuuaacuuca

SEQ ID NO: 20305 - RNA, 18 nt, Homo sapiens
ucuaaaggcuaccuuugu

SEQ ID NO: 20306 - RNA, 15 nt, Homo sapiens
cucccaacgucccua

SEQ ID NO: 20307 - RNA, 16 nt, Homo sapiens
auugaaaugauuucac

SEQ ID NO: 20308 - RNA, 18 nt, Homo sapiens
gcaugaaguaauaugcac

SEQ ID NO: 20309 - RNA, 19 nt, Homo sapiens
cacaguuuugguugcuuua

SEQ ID NO: 20310 - RNA, 18 nt, Homo sapiens
aauacaccacuacauucu

SEQ ID NO: 20311 - RNA, 14 nt, Homo sapiens
accugcuucuauua

SEQ ID NO: 20312 - RNA, 15 nt, Homo sapiens
ucccauucacagaua

SEQ ID NO: 20313 - RNA, 22 nt, Homo sapiens
cucuuguagcucucugaccucc

SEQ ID NO: 20314 - RNA, 18 nt, Homo sapiens
aaaggaugcacagaguug

SEQ ID NO: 20315 - RNA, 14 nt, Homo sapiens
cugugauagaggcu

SEQ ID NO: 20316 - RNA, 12 nt, Homo sapiens
uacguugugcau

SEQ ID NO: 20317 - RNA, 21 nt, Homo sapiens
acacauuuuuuaaaugcaccu

SEQ ID NO: 20318 - RNA, 14 nt, Homo sapiens
auaaagcagcguuu

SEQ ID NO: 20319 - RNA, 19 nt, Homo sapiens
agccucuauugccaugaga

SEQ ID NO: 20320 - RNA, 17 nt, Homo sapiens
gccuuggauacuccaug

SEQ ID NO: 20321 - RNA, 15 nt, Homo sapiens
cacuuuagaaagcug

SEQ ID NO: 20322 - RNA, 22 nt, Homo sapiens
cuuguagcucucugaccuccuc

SEQ ID NO: 20323 - RNA, 17 nt, Homo sapiens
aagugaagacaaugacu

SEQ ID NO: 20324 - RNA, 18 nt, Homo sapiens
aacuggguuccugcaaug

SEQ ID NO: 20325 - RNA, 21 nt, Homo sapiens
uggccaaugagaucauuguga

SEQ ID NO: 20326 - RNA, 16 nt, Homo sapiens
uucaaucuggauucau

SEQ ID NO: 20327 - RNA, 16 nt, Homo sapiens
gauuuuaugcuuuaaa

SEQ ID NO: 20328 - RNA, 19 nt, Homo sapiens
uggccagugagaucaaugu

SEQ ID NO: 20329 - RNA, 17 nt, Homo sapiens
cagugagaucaauguga

SEQ ID NO: 20330 - RNA, 21 nt, Homo sapiens
aggaggggaaggcaacauaca

SEQ ID NO: 20331 - RNA, 17 nt, Homo sapiens
auaguaccucugcuauu

SEQ ID NO: 20332 - RNA, 20 nt, Homo sapiens
augcuuuaaacauugguucu

SEQ ID NO: 20333 - RNA, 11 nt, Homo sapiens
cuuuugugcau

SEQ ID NO: 20334 - RNA, 16 nt, Homo sapiens
ucuacaaaauauagcu

SEQ ID NO: 20335 - RNA, 22 nt, Homo sapiens
ccaucuuucaagggaccucucc

SEQ ID NO: 20336 - RNA, 22 nt, Homo sapiens
aagacugaguacguugugcauu

SEQ ID NO: 20337 - RNA, 11 nt, Homo sapiens
uaguuagcuuu

SEQ ID NO: 20338 - RNA, 18 nt, Homo sapiens
cuuugauuuuauaugcua

SEQ ID NO: 20339 - RNA, 23 nt, Homo sapiens
guuuuuauggcuuuugugcauua

SEQ ID NO: 20340 - RNA, 19 nt, Homo sapiens
agacaaugacuuacuguac

SEQ ID NO: 20341 - RNA, 13 nt, Homo sapiens
acguugugcauuu

SEQ ID NO: 20342 - RNA, 15 nt, Homo sapiens
ggaaaugauguuuca

SEQ ID NO: 20343 - RNA, 14 nt, Homo sapiens
uaauaucaucagua

SEQ ID NO: 20344 - RNA, 15 nt, Homo sapiens
ugacauaucacaugu

SEQ ID NO: 20345 - RNA, 21 nt, Homo sapiens
uugugcauuaucuagauacug

SEQ ID NO: 20346 - RNA, 17 nt, Homo sapiens
auagaagguuugcagau

SEQ ID NO: 20347 - RNA, 13 nt, Homo sapiens
uuaucuucacuuu

SEQ ID NO: 20348 - RNA, 20 nt, Homo sapiens
guaaaugggggugcauuuga

SEQ ID NO: 20349 - RNA, 22 nt, Homo sapiens
uugggggggaggugagguacca

SEQ ID NO: 20350 - RNA, 19 nt, Homo sapiens
aacaugccagccacuguga

SEQ ID NO: 20351 - RNA, 14 nt, Homo sapiens
aguacguugugcau

SEQ ID NO: 20352 - RNA, 18 nt, Homo sapiens
ugaagucucugaagugaa

SEQ ID NO: 20353 - RNA, 14 nt, Homo sapiens
agcuaagauauaau

SEQ ID NO: 20354 - RNA, 17 nt, Homo sapiens
uaguaugaggcauuugu

SEQ ID NO: 20355 - RNA, 21 nt, Homo sapiens
agaauguuuucaaauguucuc

SEQ ID NO: 20356 - RNA, 16 nt, Homo sapiens
uggauuccucacuuug

SEQ ID NO: 20357 - RNA, 19 nt, Homo sapiens
uagaugaagaagcuagaaa

SEQ ID NO: 20358 - RNA, 22 nt, Homo sapiens
agucucugaagugaaacugcuu

SEQ ID NO: 20359 - RNA, 21 nt, Homo sapiens
ugaaccguuugugauugccau

SEQ ID NO: 20360 - RNA, 18 nt, Homo sapiens
aaugauuucacagugugu

SEQ ID NO: 20361 - RNA, 10 nt, Homo sapiens
ggacaugggc

SEQ ID NO: 20362 - RNA, 14 nt, Homo sapiens
acacuaaaacaccu

SEQ ID NO: 20363 - RNA, 20 nt, Homo sapiens
uugagaaauuaaguaucuga

SEQ ID NO: 20364 - RNA, 18 nt, Homo sapiens
auugacuauagugugagc

SEQ ID NO: 20365 - RNA, 20 nt, Homo sapiens
uuuucacaaagaacaggaaa

SEQ ID NO: 20366 - RNA, 20 nt, Homo sapiens
cauucuuuuugaaaugucaa

SEQ ID NO: 20367 - RNA, 12 nt, Homo sapiens
accaccuuucag

SEQ ID NO: 20368 - RNA, 12 nt, Homo sapiens
cuuaagcuuuca

SEQ ID NO: 20369 - RNA, 14 nt, Homo sapiens
ucuucauaccuaca

SEQ ID NO: 20370 - RNA, 15 nt, Homo sapiens
gccagugagaucaau

SEQ ID NO: 20371 - RNA, 20 nt, Homo sapiens
uuaaggauuuuaugcuuuaa

SEQ ID NO: 20372 - RNA, 13 nt, Homo sapiens
agaauauauuucc

SEQ ID NO: 20373 - RNA, 19 nt, Homo sapiens
uggaagccucuauugccau

SEQ ID NO: 20374 - RNA, 21 nt, Homo sapiens
ugagcuaggggggucagccag

SEQ ID NO: 20375 - RNA, 11 nt, Homo sapiens
uuuuugcagcu

SEQ ID NO: 20376 - RNA, 22 nt, Homo sapiens
aguuuuuauggcuuuugugcau

SEQ ID NO: 20377 - RNA, 22 nt, Homo sapiens
acugaguacguugugcauuugg

SEQ ID NO: 20378 - RNA, 19 nt, Homo sapiens
ccuggauuccucacuuuga

SEQ ID NO: 20379 - RNA, 15 nt, Homo sapiens
gaguaccauaauucu

SEQ ID NO: 20380 - RNA, 16 nt, Homo sapiens
uaacagaaauguacag

SEQ ID NO: 20381 - RNA, 19 nt, Homo sapiens
cccagggcuugugugcaca

SEQ ID NO: 20382 - RNA, 21 nt, Homo sapiens
ucaauaaaacuuuuccaauga

SEQ ID NO: 20383 - RNA, 15 nt, Homo sapiens
cccagcuagaauuca

SEQ ID NO: 20384 - RNA, 14 nt, Homo sapiens
augacuuacuguac

SEQ ID NO: 20385 - RNA, 15 nt, Homo sapiens
ggauacuauuuaauu

SEQ ID NO: 20386 - RNA, 23 nt, Homo sapiens
aauccaagaaaauggccagugag

SEQ ID NO: 20387 - RNA, 15 nt, Homo sapiens
uugugggauacuauu

SEQ ID NO: 20388 - RNA, 18 nt, Homo sapiens
auuaucuagauacuguau

SEQ ID NO: 20389 - RNA, 23 nt, Homo sapiens
gaagaaaauaguggugugauuug

SEQ ID NO: 20390 - RNA, 13 nt, Homo sapiens
ugagguaccagcc

SEQ ID NO: 20391 - RNA, 20 nt, Homo sapiens
acaccaggauuuaaguuuca

SEQ ID NO: 20392 - RNA, 12 nt, Homo sapiens
auaacuguuauu

SEQ ID NO: 20393 - RNA, 17 nt, Homo sapiens
uugcuaucaauccaaga

SEQ ID NO: 20394 - RNA, 12 nt, Homo sapiens
uccugcaaugaa

SEQ ID NO: 20395 - RNA, 17 nt, Homo sapiens
caaugagaucauuguga

SEQ ID NO: 20396 - RNA, 17 nt, Homo sapiens
auaaaauuuuuauguaa

SEQ ID NO: 20397 - RNA, 14 nt, Homo sapiens
gaaauauuccuuaa

SEQ ID NO: 20398 - RNA, 16 nt, Homo sapiens
cacugcuuaacuucac

SEQ ID NO: 20399 - RNA, 16 nt, Homo sapiens
acauuuuaugucuuuc

SEQ ID NO: 20400 - RNA, 20 nt, Homo sapiens
aauucucuaguuugauuaaa

SEQ ID NO: 20401 - RNA, 19 nt, Homo sapiens
agguucuggugugaacuaa

SEQ ID NO: 20402 - RNA, 13 nt, Homo sapiens
gcauuuguuugaa

SEQ ID NO: 20403 - RNA, 17 nt, Homo sapiens
auuuuaaggcauauuua

SEQ ID NO: 20404 - RNA, 18 nt, Homo sapiens
aucgcuuuugauaaucaa

SEQ ID NO: 20405 - RNA, 14 nt, Homo sapiens
guuugugauugcca

SEQ ID NO: 20406 - RNA, 19 nt, Homo sapiens
aacuauaaaacuaggugcu

SEQ ID NO: 20407 - RNA, 16 nt, Homo sapiens
aauuauugauguuuuc

SEQ ID NO: 20408 - RNA, 17 nt, Homo sapiens
cagauaccaugaugcug

SEQ ID NO: 20409 - RNA, 12 nt, Homo sapiens
gaccugcuucua

SEQ ID NO: 20410 - RNA, 12 nt, Homo sapiens
agacaaugacuu

SEQ ID NO: 20411 - RNA, 15 nt, Homo sapiens
uuuucccucuucacu

SEQ ID NO: 20412 - RNA, 16 nt, Homo sapiens
augucagccacuguga

SEQ ID NO: 20413 - RNA, 18 nt, Homo sapiens
aguacguugugcauuugg

SEQ ID NO: 20414 - RNA, 15 nt, Homo sapiens
guuugugauugccau

SEQ ID NO: 20415 - RNA, 17 nt, Homo sapiens
agaaaaaggaugcacag

SEQ ID NO: 20416 - RNA, 13 nt, Homo sapiens
auaaucacuuuuu

SEQ ID NO: 20417 - RNA, 16 nt, Homo sapiens
uuagcccaucuuucaa

SEQ ID NO: 20418 - RNA, 19 nt, Homo sapiens
ugaaaugauuucacagugu

SEQ ID NO: 20419 - RNA, 21 nt, Homo sapiens
cugugagaccaaauugagcua

SEQ ID NO: 20420 - RNA, 12 nt, Homo sapiens
cuaccucuccag

SEQ ID NO: 20421 - RNA, 16 nt, Homo sapiens
aauuauauauacuaua

SEQ ID NO: 20422 - RNA, 19 nt, Homo sapiens
guucuuuccaaaguacacu

SEQ ID NO: 20423 - RNA, 21 nt, Homo sapiens
aacaaugacuuguacucugaa

SEQ ID NO: 20424 - RNA, 21 nt, Homo sapiens
ucaaacccaaguuaguucaau

SEQ ID NO: 20425 - RNA, 12 nt, Homo sapiens
uagauacuguau

SEQ ID NO: 20426 - RNA, 15 nt, Homo sapiens
cagcacuuacaauuu

SEQ ID NO: 20427 - RNA, 20 nt, Homo sapiens
ccaaugagaucauugugaag

SEQ ID NO: 20428 - RNA, 19 nt, Homo sapiens
auauauuuccuuauucaga

SEQ ID NO: 20429 - RNA, 23 nt, Homo sapiens
uggauugugccuaauguguuuga

SEQ ID NO: 20430 - RNA, 18 nt, Homo sapiens
acaugccagccacuguga

SEQ ID NO: 20431 - RNA, 14 nt, Homo sapiens
cuggguuccugcaa

SEQ ID NO: 20432 - RNA, 17 nt, Homo sapiens
gaaugucaguuguuauu

SEQ ID NO: 20433 - RNA, 17 nt, Homo sapiens
aguaauaugcacacauu

SEQ ID NO: 20434 - RNA, 16 nt, Homo sapiens
guccuauuauauucau

SEQ ID NO: 20435 - RNA, 17 nt, Homo sapiens
ugggccauagucauucu

SEQ ID NO: 20436 - RNA, 22 nt, Homo sapiens
cuauuuauuuauuuauucauua

SEQ ID NO: 20437 - RNA, 14 nt, Homo sapiens
uaucuucacuuuua

SEQ ID NO: 20438 - RNA, 19 nt, Homo sapiens
gucacuuuacuguccccau

SEQ ID NO: 20439 - RNA, 12 nt, Homo sapiens
cugcacacuguc

SEQ ID NO: 20440 - RNA, 20 nt, Homo sapiens
ugugaaggcaggggaaugua

SEQ ID NO: 20441 - RNA, 15 nt, Homo sapiens
cauaaugcgugcaua

SEQ ID NO: 20442 - RNA, 19 nt, Homo sapiens
cacuguuaucuucacuuuu

SEQ ID NO: 20443 - RNA, 19 nt, Homo sapiens
agcccuuacguccuuccac

SEQ ID NO: 20444 - RNA, 20 nt, Homo sapiens
uuucauaagaauucuguuga

SEQ ID NO: 20445 - RNA, 13 nt, Homo sapiens
acuccacuuggac

SEQ ID NO: 20446 - RNA, 20 nt, Homo sapiens
aguucuaugagggcuaauau

SEQ ID NO: 20447 - RNA, 19 nt, Homo sapiens
gcuccugagacacaugggu

SEQ ID NO: 20448 - RNA, 21 nt, Homo sapiens
guuuucacaaagaacaggaaa

SEQ ID NO: 20449 - RNA, 13 nt, Homo sapiens
auauaaauuuauc

SEQ ID NO: 20450 - RNA, 22 nt, Homo sapiens
cccaacuauaaaacuaggugcu

SEQ ID NO: 20451 - RNA, 13 nt, Homo sapiens
ccauuugagcucu

SEQ ID NO: 20452 - RNA, 15 nt, Homo sapiens
uuaguucuucaaaga

SEQ ID NO: 20453 - RNA, 16 nt, Homo sapiens
uuauugauguuuucau

SEQ ID NO: 20454 - RNA, 16 nt, Homo sapiens
aguaaaggcaaacuua

SEQ ID NO: 20455 - RNA, 15 nt, Homo sapiens
guacguugugcauuu

SEQ ID NO: 20456 - RNA, 20 nt, Homo sapiens
gcccugaaagucccagauca

SEQ ID NO: 20457 - RNA, 19 nt, Homo sapiens
guacaucaaugauaaugcu

SEQ ID NO: 20458 - RNA, 21 nt, Homo sapiens
ucuugaauuguaggugacuau

SEQ ID NO: 20459 - RNA, 15 nt, Homo sapiens
cucuuguagcucucu

SEQ ID NO: 20460 - RNA, 18 nt, Homo sapiens
ccaugagaguucugucac

SEQ ID NO: 20461 - RNA, 22 nt, Homo sapiens
uuugcagcuuucucuaguucaa

SEQ ID NO: 20462 - RNA, 18 nt, Homo sapiens
uaugcuauugaaguuuug

SEQ ID NO: 20463 - RNA, 12 nt, Homo sapiens
uuuacaacuggg

SEQ ID NO: 20464 - RNA, 16 nt, Homo sapiens
aguaugaggcauuugu

SEQ ID NO: 20465 - RNA, 23 nt, Homo sapiens
uucccagcuagaauucacuccac

SEQ ID NO: 20466 - RNA, 24 nt, Homo sapiens
uccaauuaaggauuuuaugcuuua

SEQ ID NO: 20467 - RNA, 22 nt, Homo sapiens
cugugucucaggugugcccuga

SEQ ID NO: 20468 - RNA, 13 nt, Homo sapiens
cucagaaggcaaa

SEQ ID NO: 20469 - RNA, 19 nt, Homo sapiens
aaacuuucacaccccagac

SEQ ID NO: 20470 - RNA, 14 nt, Homo sapiens
uaacagaaauguac

SEQ ID NO: 20471 - RNA, 20 nt, Homo sapiens
uuaauuacuucuuaguaugu

SEQ ID NO: 20472 - RNA, 18 nt, Homo sapiens
gacaugggccccagauac

SEQ ID NO: 20473 - RNA, 17 nt, Homo sapiens
auuuauugaaaugauuu

SEQ ID NO: 20474 - RNA, 16 nt, Homo sapiens
auucacagauaccucu

SEQ ID NO: 20475 - RNA, 20 nt, Homo sapiens
uuaucugcuaugcuauugaa

SEQ ID NO: 20476 - RNA, 18 nt, Homo sapiens
caagaaaauggccaguga

SEQ ID NO: 20477 - RNA, 19 nt, Homo sapiens
aaaugauuucacagugugu

SEQ ID NO: 20478 - RNA, 16 nt, Homo sapiens
caauuauuugaagauu

SEQ ID NO: 20479 - RNA, 20 nt, Homo sapiens
uccucucaaccaccuuucag

SEQ ID NO: 20480 - RNA, 16 nt, Homo sapiens
uuuccagguuccugag

SEQ ID NO: 20481 - RNA, 16 nt, Homo sapiens
uuucuucgugaugaca

SEQ ID NO: 20482 - RNA, 15 nt, Homo sapiens
auggcuuuugugcau

SEQ ID NO: 20483 - RNA, 15 nt, Homo sapiens
aggaaagauuuuguu

SEQ ID NO: 20484 - RNA, 15 nt, Homo sapiens
uggauggcugccuca

SEQ ID NO: 20485 - RNA, 13 nt, Homo sapiens
acuaggugcugca

SEQ ID NO: 20486 - RNA, 23 nt, Homo sapiens
uuaaauaaaauuuuuauguaauu

SEQ ID NO: 20487 - RNA, 15 nt, Homo sapiens
gucacuuuacugucc

SEQ ID NO: 20488 - RNA, 16 nt, Homo sapiens
cuccaauuaaggauuu

SEQ ID NO: 20489 - RNA, 20 nt, Homo sapiens
cuagcccuuacguccuucca

SEQ ID NO: 20490 - RNA, 16 nt, Homo sapiens
uagccagguaccuucu

SEQ ID NO: 20491 - RNA, 22 nt, Homo sapiens
ucauuuacuuuuaaacuuugau

SEQ ID NO: 20492 - RNA, 20 nt, Homo sapiens
acauuuuuuuuuucaauaaa

SEQ ID NO: 20493 - RNA, 18 nt, Homo sapiens
uucuuuuugaaaugucaa

SEQ ID NO: 20494 - RNA, 21 nt, Homo sapiens
auuugagcucuggaagccucu

SEQ ID NO: 20495 - RNA, 22 nt, Homo sapiens
auuaaggauuuuaugcuuuaaa

SEQ ID NO: 20496 - RNA, 18 nt, Homo sapiens
uccuuagcccaucuuuca

SEQ ID NO: 20497 - RNA, 22 nt, Homo sapiens
caauuaaggauuuuaugcuuua

SEQ ID NO: 20498 - RNA, 21 nt, Homo sapiens
cugaaaccccagggcuugugu

SEQ ID NO: 20499 - RNA, 23 nt, Homo sapiens
cuugcaaaguaucccuacuguaa

SEQ ID NO: 20500 - RNA, 13 nt, Homo sapiens
ucauuuguuaaua

SEQ ID NO: 20501 - RNA, 16 nt, Homo sapiens
uggaaauacacuguua

SEQ ID NO: 20502 - RNA, 17 nt, Homo sapiens
acggcagggaaauguau

SEQ ID NO: 20503 - RNA, 16 nt, Homo sapiens
auuuaucauuuaguua

SEQ ID NO: 20504 - RNA, 14 nt, Homo sapiens
agaugaaugucagu

SEQ ID NO: 20505 - RNA, 20 nt, Homo sapiens
acaguuuugguugcuuuaau

SEQ ID NO: 20506 - RNA, 19 nt, Homo sapiens
augucagccacugugauag

SEQ ID NO: 20507 - RNA, 14 nt, Homo sapiens
aagaaauauuccuu

SEQ ID NO: 20508 - RNA, 22 nt, Homo sapiens
agaaauuaaguaucugacaucu

SEQ ID NO: 20509 - RNA, 22 nt, Homo sapiens
ugaagauagaagguuugcagau

SEQ ID NO: 20510 - RNA, 18 nt, Homo sapiens
ugccaccuccugccucag

SEQ ID NO: 20511 - RNA, 19 nt, Homo sapiens
caacaugccagccacugug

SEQ ID NO: 20512 - RNA, 22 nt, Homo sapiens
cuuuguugcuaucaauccaaga

SEQ ID NO: 20513 - RNA, 18 nt, Homo sapiens
cccuuggacauuuuaugu

SEQ ID NO: 20514 - RNA, 17 nt, Homo sapiens
auguaauuauauauacu

SEQ ID NO: 20515 - RNA, 21 nt, Homo sapiens
uuuuaagaaaaaggaugcaca

SEQ ID NO: 20516 - RNA, 19 nt, Homo sapiens
uucugucacggucacuuua

SEQ ID NO: 20517 - RNA, 22 nt, Homo sapiens
ggaaaaaacaccaggauuuaag

SEQ ID NO: 20518 - RNA, 14 nt, Homo sapiens
auuuuaucugcuau

SEQ ID NO: 20519 - RNA, 17 nt, Homo sapiens
acgcauggaaaaguuuc

SEQ ID NO: 20520 - RNA, 21 nt, Homo sapiens
ugccucaccucucaccuccca

SEQ ID NO: 20521 - RNA, 21 nt, Homo sapiens
agaucaagccugccucaauca

SEQ ID NO: 20522 - RNA, 13 nt, Homo sapiens
aauucacuccacu

SEQ ID NO: 20523 - RNA, 22 nt, Homo sapiens
caccauauuaccacagacauac

SEQ ID NO: 20524 - RNA, 18 nt, Homo sapiens
cgagcgcuaccucuccag

SEQ ID NO: 20525 - RNA, 19 nt, Homo sapiens
ggaagguucuggugugaac

SEQ ID NO: 20526 - RNA, 16 nt, Homo sapiens
ugcuuguacauaaugc

SEQ ID NO: 20527 - RNA, 12 nt, Homo sapiens
cucuauugccau

SEQ ID NO: 20528 - RNA, 21 nt, Homo sapiens
aagucuguuuuaugacuucau

SEQ ID NO: 20529 - RNA, 21 nt, Homo sapiens
gaaggcuguggauuuaaugug

SEQ ID NO: 20530 - RNA, 22 nt, Homo sapiens
ucugccugcccugaaaguccca

SEQ ID NO: 20531 - RNA, 14 nt, Homo sapiens
gaacaugagccuuu

SEQ ID NO: 20532 - RNA, 13 nt, Homo sapiens
uugaacuuugacc

SEQ ID NO: 20533 - RNA, 14 nt, Homo sapiens
uagaguugauacua

SEQ ID NO: 20534 - RNA, 23 nt, Homo sapiens
cuuucaagggaccucuccaugau

SEQ ID NO: 20535 - RNA, 13 nt, Homo sapiens
uauuuuaggucaa

SEQ ID NO: 20536 - RNA, 23 nt, Homo sapiens
ggaacaugagccuuuguugcuau

SEQ ID NO: 20537 - RNA, 15 nt, Homo sapiens
gcauguuugugauug

SEQ ID NO: 20538 - RNA, 23 nt, Homo sapiens
agcccucuucugacacuaaaaca

SEQ ID NO: 20539 - RNA, 15 nt, Homo sapiens
uuuuaaaugcaccug

SEQ ID NO: 20540 - RNA, 17 nt, Homo sapiens
cagaucaagccugccuc

SEQ ID NO: 20541 - RNA, 14 nt, Homo sapiens
cacagaguuguuac

SEQ ID NO: 20542 - RNA, 17 nt, Homo sapiens
cauaguaccucugcuau

SEQ ID NO: 20543 - RNA, 15 nt, Homo sapiens
uucaagggaccucuc

SEQ ID NO: 20544 - RNA, 22 nt, Homo sapiens
uccugauucauauuuaauuuga

SEQ ID NO: 20545 - RNA, 18 nt, Homo sapiens
uuaggaguaccauaauuc

SEQ ID NO: 20546 - RNA, 13 nt, Homo sapiens
acuuuuauaagaa

SEQ ID NO: 20547 - RNA, 15 nt, Homo sapiens
guaugaggcauuugu

SEQ ID NO: 20548 - RNA, 17 nt, Homo sapiens
caccuccugccucaggu

SEQ ID NO: 20549 - RNA, 12 nt, Homo sapiens
uguuugugauug

SEQ ID NO: 20550 - RNA, 20 nt, Homo sapiens
agcucuaucccaaccucucc

SEQ ID NO: 20551 - RNA, 17 nt, Homo sapiens
acauaaggaaacugggu

SEQ ID NO: 20552 - RNA, 21 nt, Homo sapiens
gcccugaaagucccagaucaa

SEQ ID NO: 20553 - RNA, 13 nt, Homo sapiens
uaguuagcuuucu

SEQ ID NO: 20554 - RNA, 21 nt, Homo sapiens
guucuccagucauuauguuaa

SEQ ID NO: 20555 - RNA, 16 nt, Homo sapiens
ugcagccccugggacc

SEQ ID NO: 20556 - RNA, 12 nt, Homo sapiens
cuaugcauuuga

SEQ ID NO: 20557 - RNA, 23 nt, Homo sapiens
auucagaauuucuaaaaguuuaa

SEQ ID NO: 20558 - RNA, 17 nt, Homo sapiens
aggauuuuaugcuuuaa

SEQ ID NO: 20559 - RNA, 15 nt, Homo sapiens
uaucuucacuuuuau

SEQ ID NO: 20560 - RNA, 21 nt, Homo sapiens
cagcccucuucugacacuaaa

SEQ ID NO: 20561 - RNA, 13 nt, Homo sapiens
aagaaauauuccu

SEQ ID NO: 20562 - RNA, 19 nt, Homo sapiens
cuguuuagaugaaugucag

SEQ ID NO: 20563 - RNA, 21 nt, Homo sapiens
gcaaacugccaucauuuacuu

SEQ ID NO: 20564 - RNA, 16 nt, Homo sapiens
uucuaaaggcuaccuu

SEQ ID NO: 20565 - RNA, 20 nt, Homo sapiens
cccagaucaagccugccuca

SEQ ID NO: 20566 - RNA, 17 nt, Homo sapiens
agccagguaccuucuca

SEQ ID NO: 20567 - RNA, 13 nt, Homo sapiens
uuauaugcuauuu

SEQ ID NO: 20568 - RNA, 15 nt, Homo sapiens
uggcuuuugugcauu

SEQ ID NO: 20569 - RNA, 14 nt, Homo sapiens
aauggccagugaga

SEQ ID NO: 20570 - RNA, 22 nt, Homo sapiens
gcugaguguuucacaccuuauc

SEQ ID NO: 20571 - RNA, 17 nt, Homo sapiens
agcuuucucuaguucaa

SEQ ID NO: 20572 - RNA, 19 nt, Homo sapiens
ggaaauguaugugugucua

SEQ ID NO: 20573 - RNA, 22 nt, Homo sapiens
cuuauugguggcuguuccugaa

SEQ ID NO: 20574 - RNA, 21 nt, Homo sapiens
aaacauugguucuuguauuaa

SEQ ID NO: 20575 - RNA, 21 nt, Homo sapiens
uccuggauuccucacuuugaa

SEQ ID NO: 20576 - RNA, 17 nt, Homo sapiens
cagccucagcucucagu

SEQ ID NO: 20577 - RNA, 15 nt, Homo sapiens
aacuaaaauguucua

SEQ ID NO: 20578 - RNA, 19 nt, Homo sapiens
uuguuugcauaggugaucu

SEQ ID NO: 20579 - RNA, 19 nt, Homo sapiens
gauauucucuagucauuug

SEQ ID NO: 20580 - RNA, 22 nt, Homo sapiens
uaccucugcuauuugcuguuau

SEQ ID NO: 20581 - RNA, 22 nt, Homo sapiens
aauuaaggguaugauuaacucu

SEQ ID NO: 20582 - RNA, 19 nt, Homo sapiens
guaaauagcuaagauauaa

SEQ ID NO: 20583 - RNA, 13 nt, Homo sapiens
uagcuaagauaua

SEQ ID NO: 20584 - RNA, 17 nt, Homo sapiens
cucuaucccaaccucuc

SEQ ID NO: 20585 - RNA, 19 nt, Homo sapiens
uagaaagcugaguguuuca

SEQ ID NO: 20586 - RNA, 16 nt, Homo sapiens
agaaauuaaguaucug

SEQ ID NO: 20587 - RNA, 16 nt, Homo sapiens
uaucuagauacuguau

SEQ ID NO: 20588 - RNA, 14 nt, Homo sapiens
uuauauucauucuu

SEQ ID NO: 20589 - RNA, 17 nt, Homo sapiens
accacuuuuugcagcuu

SEQ ID NO: 20590 - RNA, 19 nt, Homo sapiens
auauuuugcuuugugauuu

SEQ ID NO: 20591 - RNA, 19 nt, Homo sapiens
uguguggucaacauuucuc

SEQ ID NO: 20592 - RNA, 23 nt, Homo sapiens
accucccauucacagauaccucu

SEQ ID NO: 20593 - RNA, 22 nt, Homo sapiens
cauagagaauauaaaaauaaag

SEQ ID NO: 20594 - RNA, 13 nt, Homo sapiens
aaccaccuuucag

SEQ ID NO: 20595 - RNA, 12 nt, Homo sapiens
uugaaaugucaa

SEQ ID NO: 20596 - RNA, 19 nt, Homo sapiens
aucugacaucucugcaauc

SEQ ID NO: 20597 - RNA, 13 nt, Homo sapiens
augaggcauuugu

SEQ ID NO: 20598 - RNA, 20 nt, Homo sapiens
uugugauacaaugcugugcc

SEQ ID NO: 20599 - RNA, 14 nt, Homo sapiens
gccuuguuuaaugu

SEQ ID NO: 20600 - RNA, 14 nt, Homo sapiens
acagaguuguuaca

SEQ ID NO: 20601 - RNA, 22 nt, Homo sapiens
ugggcaagggaccugcuucuau

SEQ ID NO: 20602 - RNA, 17 nt, Homo sapiens
gaagccucuauugccau

SEQ ID NO: 20603 - RNA, 14 nt, Homo sapiens
ucagccacugugau

SEQ ID NO: 20604 - RNA, 16 nt, Homo sapiens
agggaagggggaacau

SEQ ID NO: 20605 - RNA, 20 nt, Homo sapiens
uuaaauaaugugaaacugga

SEQ ID NO: 20606 - RNA, 14 nt, Homo sapiens
cagaccgggguucc

SEQ ID NO: 20607 - RNA, 13 nt, Homo sapiens
uugaagauucuau

SEQ ID NO: 20608 - RNA, 19 nt, Homo sapiens
cauuaucuagauacuguau

SEQ ID NO: 20609 - RNA, 19 nt, Homo sapiens
ccauuauauuuauuguuua

SEQ ID NO: 20610 - RNA, 19 nt, Homo sapiens
ucuuucaagggaccucucc

SEQ ID NO: 20611 - RNA, 23 nt, Homo sapiens
ugugaaacuggauuaaacuuaau

SEQ ID NO: 20612 - RNA, 15 nt, Homo sapiens
ugccaugagaguucu

SEQ ID NO: 20613 - RNA, 17 nt, Homo sapiens
cuguccuauuauauuca

SEQ ID NO: 20614 - RNA, 14 nt, Homo sapiens
aauuuuaguuguca

SEQ ID NO: 20615 - RNA, 17 nt, Homo sapiens
agcucucaguugcagcc

SEQ ID NO: 20616 - RNA, 18 nt, Homo sapiens
auugaaguuuuggcaauu

SEQ ID NO: 20617 - RNA, 15 nt, Homo sapiens
cccuggccuagcaua

SEQ ID NO: 20618 - RNA, 15 nt, Homo sapiens
augcuuguacauaau

SEQ ID NO: 20619 - RNA, 20 nt, Homo sapiens
aaccguuugugauugccauu

SEQ ID NO: 20620 - RNA, 17 nt, Homo sapiens
uugagcuagggggguca

SEQ ID NO: 20621 - RNA, 15 nt, Homo sapiens
gagagagcuuggaau

SEQ ID NO: 20622 - RNA, 17 nt, Homo sapiens
aggggaaggcaacauac

SEQ ID NO: 20623 - RNA, 18 nt, Homo sapiens
guaaaugggggugcauuu

SEQ ID NO: 20624 - RNA, 14 nt, Homo sapiens
guauuauaccuuuu

SEQ ID NO: 20625 - RNA, 23 nt, Homo sapiens
uccucucaaccaccuuucagaua

SEQ ID NO: 20626 - RNA, 17 nt, Homo sapiens
uucauaccuacauguau

SEQ ID NO: 20627 - RNA, 22 nt, Homo sapiens
aaagucccagaucaagccugcc

SEQ ID NO: 20628 - RNA, 16 nt, Homo sapiens
uaguaccucugcuauu

SEQ ID NO: 20629 - RNA, 14 nt, Homo sapiens
ucuuaauucuuagc

SEQ ID NO: 20630 - RNA, 15 nt, Homo sapiens
gaagauucuauguua

SEQ ID NO: 20631 - RNA, 19 nt, Homo sapiens
agaaaacaggcaaauuccu

SEQ ID NO: 20632 - RNA, 16 nt, Homo sapiens
accaggcacccccaga

SEQ ID NO: 20633 - RNA, 22 nt, Homo sapiens
gccaggaaucacuggcuguuaa

SEQ ID NO: 20634 - RNA, 16 nt, Homo sapiens
ucauauuuauagccag

SEQ ID NO: 20635 - RNA, 20 nt, Homo sapiens
cuggauugcgccuaaugugu

SEQ ID NO: 20636 - RNA, 15 nt, Homo sapiens
ucuaugacacaugca

SEQ ID NO: 20637 - RNA, 21 nt, Homo sapiens
ccaugaugcugagcccggaaa

SEQ ID NO: 20638 - RNA, 14 nt, Homo sapiens
cuaaaauguucuaa

SEQ ID NO: 20639 - RNA, 14 nt, Homo sapiens
uaaaacuaggugcu

SEQ ID NO: 20640 - RNA, 16 nt, Homo sapiens
caugaucccaccuccc

SEQ ID NO: 20641 - RNA, 15 nt, Homo sapiens
uccugagacacaugg

SEQ ID NO: 20642 - RNA, 18 nt, Homo sapiens
uacaaaauauagcuuuca

SEQ ID NO: 20643 - RNA, 13 nt, Homo sapiens
auuuaagauaugu

SEQ ID NO: 20644 - RNA, 14 nt, Homo sapiens
ugagcggaccuucc

SEQ ID NO: 20645 - RNA, 13 nt, Homo sapiens
uaaucaacugggc

SEQ ID NO: 20646 - RNA, 11 nt, Homo sapiens
augauguuuca

SEQ ID NO: 20647 - RNA, 21 nt, Homo sapiens
aggauggcaggaggcauccaa

SEQ ID NO: 20648 - RNA, 13 nt, Homo sapiens
acuuuuugcagcu

SEQ ID NO: 20649 - RNA, 23 nt, Homo sapiens
guaacuguuuagaugaaugucag

SEQ ID NO: 20650 - RNA, 14 nt, Homo sapiens
cucuggaagccucu

SEQ ID NO: 20651 - RNA, 18 nt, Homo sapiens
ccacauccugugggaccu

SEQ ID NO: 20652 - RNA, 19 nt, Homo sapiens
gcccugcccuuacaggaac

SEQ ID NO: 20653 - RNA, 21 nt, Homo sapiens
ucuggaagccucuauugccau

SEQ ID NO: 20654 - RNA, 23 nt, Homo sapiens
guaccucugcuauuugcuguuau

SEQ ID NO: 20655 - RNA, 17 nt, Homo sapiens
agccucuauugccauga

SEQ ID NO: 20656 - RNA, 18 nt, Homo sapiens
aagaacuaaaauguucua

SEQ ID NO: 20657 - RNA, 20 nt, Homo sapiens
cugccucagguguccgcuau

SEQ ID NO: 20658 - RNA, 12 nt, Homo sapiens
cuuagaacaaag

SEQ ID NO: 20659 - RNA, 18 nt, Homo sapiens
uucagcagagaaguuuuc

SEQ ID NO: 20660 - RNA, 14 nt, Homo sapiens
aucuacuugcacac

SEQ ID NO: 20661 - RNA, 21 nt, Homo sapiens
ugcaguguuucccucuguguu

SEQ ID NO: 20662 - RNA, 15 nt, Homo sapiens
cugccugcccugaaa

SEQ ID NO: 20663 - RNA, 18 nt, Homo sapiens
uaguuacuaaacauguau

SEQ ID NO: 20664 - RNA, 21 nt, Homo sapiens
uacaaaauauagcuuucauaa

SEQ ID NO: 20665 - RNA, 19 nt, Homo sapiens
cauaguaccucugcuauuu

SEQ ID NO: 20666 - RNA, 13 nt, Homo sapiens
agaucaagccugc

SEQ ID NO: 20667 - RNA, 19 nt, Homo sapiens
ccaagaaaauggccaguga

SEQ ID NO: 20668 - RNA, 21 nt, Homo sapiens
cccugccaugcucuccaaacc

SEQ ID NO: 20669 - RNA, 13 nt, Homo sapiens
gauuaaacuuaau

SEQ ID NO: 20670 - RNA, 13 nt, Homo sapiens
cuggaagccucua

SEQ ID NO: 20671 - RNA, 14 nt, Homo sapiens
uucauaacaucgaa

SEQ ID NO: 20672 - RNA, 16 nt, Homo sapiens
cagaucaagccugccu

SEQ ID NO: 20673 - RNA, 16 nt, Homo sapiens
cugaccuccuccuuca

SEQ ID NO: 20674 - RNA, 23 nt, Homo sapiens
aucauuuacuuuuaaacuuugau

SEQ ID NO: 20675 - RNA, 22 nt, Homo sapiens
aggaaacuggguuccugcaaug

SEQ ID NO: 20676 - RNA, 14 nt, Homo sapiens
accugugagaccaa

SEQ ID NO: 20677 - RNA, 21 nt, Homo sapiens
cuauuuauuuauuuauucauu

SEQ ID NO: 20678 - RNA, 19 nt, Homo sapiens
gccaugagaguucugucac

SEQ ID NO: 20679 - RNA, 15 nt, Homo sapiens
auauccuuagcccau

SEQ ID NO: 20680 - RNA, 19 nt, Homo sapiens
aggaaggaggaagcuuauu

SEQ ID NO: 20681 - RNA, 17 nt, Homo sapiens
agucuguuuuaugacuu

SEQ ID NO: 20682 - RNA, 18 nt, Homo sapiens
aucacaguuuugguugcu

SEQ ID NO: 20683 - RNA, 15 nt, Homo sapiens
agauaauacaccacu

SEQ ID NO: 20684 - RNA, 15 nt, Homo sapiens
caaugauaaugcuaa

SEQ ID NO: 20685 - RNA, 17 nt, Homo sapiens
ucaauguuuagcagauu

SEQ ID NO: 20686 - RNA, 23 nt, Homo sapiens
uggcguuguggggaugaacuuuu

SEQ ID NO: 20687 - RNA, 21 nt, Homo sapiens
guuuuacaguguuucuggcuu

SEQ ID NO: 20688 - RNA, 13 nt, Homo sapiens
uccugugggaccu

SEQ ID NO: 20689 - RNA, 19 nt, Homo sapiens
cuagaaaacaggcaaauuc

SEQ ID NO: 20690 - RNA, 19 nt, Homo sapiens
ccucagggugcacacagga

SEQ ID NO: 20691 - RNA, 14 nt, Homo sapiens
gagccuuuguugcu

SEQ ID NO: 20692 - RNA, 19 nt, Homo sapiens
gaaacuccacauccugugg

SEQ ID NO: 20693 - RNA, 15 nt, Homo sapiens
cguuugugauugcca

SEQ ID NO: 20694 - RNA, 15 nt, Homo sapiens
agauaccucucuugu

SEQ ID NO: 20695 - RNA, 14 nt, Homo sapiens
auaaucaacugggc

SEQ ID NO: 20696 - RNA, 15 nt, Homo sapiens
agcucucaguugcag

SEQ ID NO: 20697 - RNA, 23 nt, Homo sapiens
aaggaaacuggguuccugcaaug

SEQ ID NO: 20698 - RNA, 20 nt, Homo sapiens
auacuauuuaauuauuucac

SEQ ID NO: 20699 - RNA, 18 nt, Homo sapiens
uuauggcuuuugugcauu

SEQ ID NO: 20700 - RNA, 22 nt, Homo sapiens
accucuccaugaucccaccucc

SEQ ID NO: 20701 - RNA, 14 nt, Homo sapiens
acaggcaaauuccu

SEQ ID NO: 20702 - RNA, 23 nt, Homo sapiens
auaggaaauauuuuaauguuucu

SEQ ID NO: 20703 - RNA, 15 nt, Homo sapiens
gaccuucccagcuag

SEQ ID NO: 20704 - RNA, 22 nt, Homo sapiens
uauugaaaugauuucacagugu

SEQ ID NO: 20705 - RNA, 22 nt, Homo sapiens
uuguuugagaaauuaaguaucu

SEQ ID NO: 20706 - RNA, 16 nt, Homo sapiens
aauuauuucacuuuag

SEQ ID NO: 20707 - RNA, 16 nt, Homo sapiens
ucucaaccaccuuuca

SEQ ID NO: 20708 - RNA, 17 nt, Homo sapiens
cucaccucucaccuccc

SEQ ID NO: 20709 - RNA, 19 nt, Homo sapiens
auucuuuuugaaaugucaa

SEQ ID NO: 20710 - RNA, 15 nt, Homo sapiens
ggauucaauuuuaag

SEQ ID NO: 20711 - RNA, 22 nt, Homo sapiens
ucccuauuuuuuuucuguuaua

SEQ ID NO: 20712 - RNA, 13 nt, Homo sapiens
gaaaacaggcaaa

SEQ ID NO: 20713 - RNA, 20 nt, Homo sapiens
ccaguaaaugggggugcauu

SEQ ID NO: 20714 - RNA, 17 nt, Homo sapiens
gcaaauggccaaugaga

SEQ ID NO: 20715 - RNA, 15 nt, Homo sapiens
aagggaccucuccau

SEQ ID NO: 20716 - RNA, 15 nt, Homo sapiens
uuuagaugaauguca

SEQ ID NO: 20717 - RNA, 17 nt, Homo sapiens
cagccuuggauacucca

SEQ ID NO: 20718 - RNA, 13 nt, Homo sapiens
aaagauacaguua

SEQ ID NO: 20719 - RNA, 19 nt, Homo sapiens
ucuggaagccucuauugcc

SEQ ID NO: 20720 - RNA, 16 nt, Homo sapiens
gcaaauggccaaugag

SEQ ID NO: 20721 - RNA, 19 nt, Homo sapiens
augccagccacugugauag

SEQ ID NO: 20722 - RNA, 20 nt, Homo sapiens
uugaaauauaggaacuuaaa

SEQ ID NO: 20723 - RNA, 20 nt, Homo sapiens
cuucagaucucuaacuucac

SEQ ID NO: 20724 - RNA, 14 nt, Homo sapiens
ccuccugcuuccuc

SEQ ID NO: 20725 - RNA, 18 nt, Homo sapiens
ccagggcuugugugcaca

SEQ ID NO: 20726 - RNA, 14 nt, Homo sapiens
uacuauauauguga

SEQ ID NO: 20727 - RNA, 14 nt, Homo sapiens
acuaaaauguucua

SEQ ID NO: 20728 - RNA, 19 nt, Homo sapiens
caccuuaucuauguagaau

SEQ ID NO: 20729 - RNA, 15 nt, Homo sapiens
cucuccaugauccca

SEQ ID NO: 20730 - RNA, 17 nt, Homo sapiens
uacauaaugcgugcaua

SEQ ID NO: 20731 - RNA, 21 nt, Homo sapiens
uuaggaguaccauaauucugg

SEQ ID NO: 20732 - RNA, 20 nt, Homo sapiens
acuuugauuuuauaugcuau

SEQ ID NO: 20733 - RNA, 19 nt, Homo sapiens
ucccauucacagauaccuc

SEQ ID NO: 20734 - RNA, 22 nt, Homo sapiens
ugacaaggggcaguggugguuu

SEQ ID NO: 20735 - RNA, 21 nt, Homo sapiens
gucucugaagugaaacugcuu

SEQ ID NO: 20736 - RNA, 22 nt, Homo sapiens
uuuguuaguaugaggcauuugu

SEQ ID NO: 20737 - RNA, 16 nt, Homo sapiens
ccucugcuauuugcug

SEQ ID NO: 20738 - RNA, 19 nt, Homo sapiens
auaaaacuuuuccaaugac

SEQ ID NO: 20739 - RNA, 22 nt, Homo sapiens
ccaugagaguucugucacgguc

SEQ ID NO: 20740 - RNA, 16 nt, Homo sapiens
aaacaccucagcugcc

SEQ ID NO: 20741 - RNA, 19 nt, Homo sapiens
acaugagccuuuguugcua

SEQ ID NO: 20742 - RNA, 19 nt, Homo sapiens
gauugugggauacuauuua

SEQ ID NO: 20743 - RNA, 18 nt, Homo sapiens
cugccuccccagcucuau

SEQ ID NO: 20744 - RNA, 19 nt, Homo sapiens
gcauacugccuuguuuaau

SEQ ID NO: 20745 - RNA, 13 nt, Homo sapiens
gagacacaugggu

SEQ ID NO: 20746 - RNA, 22 nt, Homo sapiens
cacuaaaacaccucagcugccu

SEQ ID NO: 20747 - RNA, 20 nt, Homo sapiens
gcuguuauuuuaucugcuau

SEQ ID NO: 20748 - RNA, 14 nt, Homo sapiens
aucugcuaugcuau

SEQ ID NO: 20749 - RNA, 17 nt, Homo sapiens
uugaaaugauuucacag

SEQ ID NO: 20750 - RNA, 20 nt, Homo sapiens
uacacuguuaucuucacuuu

SEQ ID NO: 20751 - RNA, 16 nt, Homo sapiens
ccucaccucucaccuc

SEQ ID NO: 20752 - RNA, 17 nt, Homo sapiens
aaguaucccuacuguaa

SEQ ID NO: 20753 - RNA, 20 nt, Homo sapiens
cuuucagcucagcuaaugaa

SEQ ID NO: 20754 - RNA, 17 nt, Homo sapiens
cagauauucucuaguca

SEQ ID NO: 20755 - RNA, 17 nt, Homo sapiens
uccaaaguacacuguuu

SEQ ID NO: 20756 - RNA, 23 nt, Homo sapiens
uuauauuuccaagaaauauuccu

SEQ ID NO: 20757 - RNA, 16 nt, Homo sapiens
uuauuuauuuauucau

SEQ ID NO: 20758 - RNA, 21 nt, Homo sapiens
auacauaaacaagaccacguu

SEQ ID NO: 20759 - RNA, 14 nt, Homo sapiens
aagcaaauggccaa

SEQ ID NO: 20760 - RNA, 23 nt, Homo sapiens
uaccaugaugcugagcccggaaa

SEQ ID NO: 20761 - RNA, 15 nt, Homo sapiens
caaguuaguucaauc

SEQ ID NO: 20762 - RNA, 15 nt, Homo sapiens
agacacaugggugcu

SEQ ID NO: 20763 - RNA, 20 nt, Homo sapiens
accccggaagccaaaccucu

SEQ ID NO: 20764 - RNA, 17 nt, Homo sapiens
ucagcagagaaguuuuc

SEQ ID NO: 20765 - RNA, 21 nt, Homo sapiens
caucaaugauaaugcuaauuu

SEQ ID NO: 20766 - RNA, 15 nt, Homo sapiens
aucaucacccagcac

SEQ ID NO: 20767 - RNA, 23 nt, Homo sapiens
cuggaagccucuauugccaugag

SEQ ID NO: 20768 - RNA, 15 nt, Homo sapiens
ucauaagaauucugu

SEQ ID NO: 20769 - RNA, 13 nt, Homo sapiens
uccucacuuugaa

SEQ ID NO: 20770 - RNA, 15 nt, Homo sapiens
ucuaucccaaccucu

SEQ ID NO: 20771 - RNA, 18 nt, Homo sapiens
cuguuaucuucacuuuua

SEQ ID NO: 20772 - RNA, 15 nt, Homo sapiens
aguaugugcauuuaa

SEQ ID NO: 20773 - RNA, 20 nt, Homo sapiens
uauggcuuuugugcauuauc

SEQ ID NO: 20774 - RNA, 17 nt, Homo sapiens
uaauuauuucacuuuag

SEQ ID NO: 20775 - RNA, 14 nt, Homo sapiens
uuuuaaacuuugau

SEQ ID NO: 20776 - RNA, 14 nt, Homo sapiens
cuguucuuucuggc

SEQ ID NO: 20777 - RNA, 22 nt, Homo sapiens
auguuugccgcuuaagcuuuca

SEQ ID NO: 20778 - RNA, 19 nt, Homo sapiens
acucuggucaagaagcauc

SEQ ID NO: 20779 - RNA, 21 nt, Homo sapiens
uuccugcaaugaagucucuga

SEQ ID NO: 20780 - RNA, 21 nt, Homo sapiens
agcagauuuaagauauguaac

SEQ ID NO: 20781 - RNA, 18 nt, Homo sapiens
guagcucucugaccuccu

SEQ ID NO: 20782 - RNA, 17 nt, Homo sapiens
acuaaacauguauguaa

SEQ ID NO: 20783 - RNA, 15 nt, Homo sapiens
ugagaucaaugugac

SEQ ID NO: 20784 - RNA, 17 nt, Homo sapiens
augcuaauuuuauuaua

SEQ ID NO: 20785 - RNA, 13 nt, Homo sapiens
guuuaauguuaau

SEQ ID NO: 20786 - RNA, 20 nt, Homo sapiens
acacauuuuuuaaaugcacc

SEQ ID NO: 20787 - RNA, 16 nt, Homo sapiens
aggcaggggaauguau

SEQ ID NO: 20788 - RNA, 23 nt, Homo sapiens
cucugaccuccuccuucauggca

SEQ ID NO: 20789 - RNA, 21 nt, Homo sapiens
cugcacacuguccuauuauau

SEQ ID NO: 20790 - RNA, 13 nt, Homo sapiens
caagggaccucuc

SEQ ID NO: 20791 - RNA, 15 nt, Homo sapiens
uucaaauguucucca

SEQ ID NO: 20792 - RNA, 11 nt, Homo sapiens
gggaccucucc

SEQ ID NO: 20793 - RNA, 20 nt, Homo sapiens
uauguuagagaauuuccuua

SEQ ID NO: 20794 - RNA, 16 nt, Homo sapiens
acaccucagcugccuc

SEQ ID NO: 20795 - RNA, 22 nt, Homo sapiens
aauaaauucccuggccuuucau

SEQ ID NO: 20796 - RNA, 14 nt, Homo sapiens
auuugaagauuuaa

SEQ ID NO: 20797 - RNA, 16 nt, Homo sapiens
augggggugcauuuga

SEQ ID NO: 20798 - RNA, 16 nt, Homo sapiens
cauccugugggaccug

SEQ ID NO: 20799 - RNA, 22 nt, Homo sapiens
ugcugaaccguuugugauugcc

SEQ ID NO: 20800 - RNA, 23 nt, Homo sapiens
cucccauucacagauaccucucu

SEQ ID NO: 20801 - RNA, 16 nt, Homo sapiens
ucucuuguagcucucu

SEQ ID NO: 20802 - RNA, 19 nt, Homo sapiens
cuagcccuuacguccuucc

SEQ ID NO: 20803 - RNA, 11 nt, Homo sapiens
caaauguucuc

SEQ ID NO: 20804 - RNA, 15 nt, Homo sapiens
uaugugcacaucugu

SEQ ID NO: 20805 - RNA, 22 nt, Homo sapiens
acggucacuuuacuguccccau

SEQ ID NO: 20806 - RNA, 16 nt, Homo sapiens
ugagccuuuguugcua

SEQ ID NO: 20807 - RNA, 22 nt, Homo sapiens
caacauacacaccccggacucc

SEQ ID NO: 20808 - RNA, 20 nt, Homo sapiens
aaacuuuuccaaugacauuu

SEQ ID NO: 20809 - RNA, 10 nt, Homo sapiens
cauccaaagg

SEQ ID NO: 20810 - RNA, 22 nt, Homo sapiens
auuuaauuacuucuuaguaugu

SEQ ID NO: 20811 - RNA, 16 nt, Homo sapiens
uuaacaaaauuugaau

SEQ ID NO: 20812 - RNA, 20 nt, Homo sapiens
agacugaguacguugugcau

SEQ ID NO: 20813 - RNA, 17 nt, Homo sapiens
gcuccugagacacaugg

SEQ ID NO: 20814 - RNA, 19 nt, Homo sapiens
gaaaauaguggugugauuu

SEQ ID NO: 20815 - RNA, 23 nt, Homo sapiens
ugcauaccacuuuuguucuuggu

SEQ ID NO: 20816 - RNA, 17 nt, Homo sapiens
cucuaccugcacacugu

SEQ ID NO: 20817 - RNA, 22 nt, Homo sapiens
uaaacauugguucuuguauuaa

SEQ ID NO: 20818 - RNA, 19 nt, Homo sapiens
cauucuccuuguguuacua

SEQ ID NO: 20819 - RNA, 23 nt, Homo sapiens
cauucacagauaccucucuugua

SEQ ID NO: 20820 - RNA, 14 nt, Homo sapiens
ccuacugugucuca

SEQ ID NO: 20821 - RNA, 13 nt, Homo sapiens
auucuuuuaguuu

SEQ ID NO: 20822 - RNA, 19 nt, Homo sapiens
ucuuuuuccagguuccuga

SEQ ID NO: 20823 - RNA, 20 nt, Homo sapiens
aaucuaaauggaaccacucu

SEQ ID NO: 20824 - RNA, 17 nt, Homo sapiens
ugcaugaaguaauaugc

SEQ ID NO: 20825 - RNA, 17 nt, Homo sapiens
ccccaaguuaguucaau

SEQ ID NO: 20826 - RNA, 20 nt, Homo sapiens
gagcggaccuucccagcuag

SEQ ID NO: 20827 - RNA, 21 nt, Homo sapiens
auguagaauauauuuccuuau

SEQ ID NO: 20828 - RNA, 21 nt, Homo sapiens
gcaguguuucccucuguguua

SEQ ID NO: 20829 - RNA, 19 nt, Homo sapiens
aaacuggguuccugcaaug

SEQ ID NO: 20830 - RNA, 22 nt, Homo sapiens
ucucaauguuuagcagauuuaa

SEQ ID NO: 20831 - RNA, 13 nt, Homo sapiens
cuacaauuguaaa

SEQ ID NO: 20832 - RNA, 17 nt, Homo sapiens
acugccaucauuuacuu

SEQ ID NO: 20833 - RNA, 17 nt, Homo sapiens
ccuagcacacacuuuug

SEQ ID NO: 20834 - RNA, 21 nt, Homo sapiens
cucuggaagccucuauugcca

SEQ ID NO: 20835 - RNA, 15 nt, Homo sapiens
ucaggugugcccuga

SEQ ID NO: 20836 - RNA, 15 nt, Homo sapiens
agccucuauugccau

SEQ ID NO: 20837 - RNA, 17 nt, Homo sapiens
ucccaccucccauucac

SEQ ID NO: 20838 - RNA, 14 nt, Homo sapiens
cagaaauguguuau

SEQ ID NO: 20839 - RNA, 16 nt, Homo sapiens
agccucuauugccaug

SEQ ID NO: 20840 - RNA, 14 nt, Homo sapiens
uuugugauugccau

SEQ ID NO: 20841 - RNA, 15 nt, Homo sapiens
uagacauucuuuauc

SEQ ID NO: 20842 - RNA, 15 nt, Homo sapiens
ggaccucuccaugau

SEQ ID NO: 20843 - RNA, 19 nt, Homo sapiens
cagaaaugccuuacccuca

SEQ ID NO: 20844 - RNA, 15 nt, Homo sapiens
ugcccuuacaggaac

SEQ ID NO: 20845 - RNA, 20 nt, Homo sapiens
uggauuaaacuuaaucuaaa

SEQ ID NO: 20846 - RNA, 18 nt, Homo sapiens
cugggcaagggaccugcu

SEQ ID NO: 20847 - RNA, 13 nt, Homo sapiens
acagauaccucuc

SEQ ID NO: 20848 - RNA, 14 nt, Homo sapiens
uaccugcacacugu

SEQ ID NO: 20849 - RNA, 13 nt, Homo sapiens
ugcaaggucauuu

SEQ ID NO: 20850 - RNA, 14 nt, Homo sapiens
uaaggaaacugggu

SEQ ID NO: 20851 - RNA, 14 nt, Homo sapiens
augacaaagacuga

SEQ ID NO: 20852 - RNA, 15 nt, Homo sapiens
gauuuuaugcuuuaa

SEQ ID NO: 20853 - RNA, 13 nt, Homo sapiens
cugaacacuccaa

SEQ ID NO: 20854 - RNA, 16 nt, Homo sapiens
caaugaagucucugaa

SEQ ID NO: 20855 - RNA, 23 nt, Homo sapiens
cuccuucauggcaggcaucgcca

SEQ ID NO: 20856 - RNA, 20 nt, Homo sapiens
uacaguuacucagaauucuc

SEQ ID NO: 20857 - RNA, 19 nt, Homo sapiens
ucuuaguaugugcauuuaa

SEQ ID NO: 20858 - RNA, 14 nt, Homo sapiens
ugcuaucaauccaa

SEQ ID NO: 20859 - RNA, 21 nt, Homo sapiens
caugaucccaccucccauuca

SEQ ID NO: 20860 - RNA, 15 nt, Homo sapiens
gcccggaaacuccac

SEQ ID NO: 20861 - RNA, 12 nt, Homo sapiens
aaggaaacuggg

SEQ ID NO: 20862 - RNA, 16 nt, Homo sapiens
aaaauggccagugaga

SEQ ID NO: 20863 - RNA, 22 nt, Homo sapiens
ugacugcuaguuuauauagaaa

SEQ ID NO: 20864 - RNA, 12 nt, Homo sapiens
gguaugauuaac

SEQ ID NO: 20865 - RNA, 18 nt, Homo sapiens
agaauauaaaaauaaagc

SEQ ID NO: 20866 - RNA, 19 nt, Homo sapiens
aaauaaaauuuuuauguaa

SEQ ID NO: 20867 - RNA, 16 nt, Homo sapiens
uucacagauaccucuc

SEQ ID NO: 20868 - RNA, 13 nt, Homo sapiens
uggccagugagau

SEQ ID NO: 20869 - RNA, 13 nt, Homo sapiens
acuuugaccucug

SEQ ID NO: 20870 - RNA, 16 nt, Homo sapiens
ggcaagggaccugcuu

SEQ ID NO: 20871 - RNA, 23 nt, Homo sapiens
cucccuauuuuuuuucuguuaua

SEQ ID NO: 20872 - RNA, 13 nt, Homo sapiens
uuugguugcuuua

SEQ ID NO: 20873 - RNA, 18 nt, Homo sapiens
uguuaucuucacuuuuau

SEQ ID NO: 20874 - RNA, 21 nt, Homo sapiens
uuuucaauaaaacuuuuccaa

SEQ ID NO: 20875 - RNA, 11 nt, Homo sapiens
cggaagccaaa

SEQ ID NO: 20876 - RNA, 12 nt, Homo sapiens
cuccgcauccuc

SEQ ID NO: 20877 - RNA, 14 nt, Homo sapiens
aguaccucugcuau

SEQ ID NO: 20878 - RNA, 15 nt, Homo sapiens
uuguagcucucugac

SEQ ID NO: 20879 - RNA, 16 nt, Homo sapiens
cuuccuauaauuuuag

SEQ ID NO: 20880 - RNA, 23 nt, Homo sapiens
aaucacuggcuguuaaucuuuca

SEQ ID NO: 20881 - RNA, 21 nt, Homo sapiens
ucucaaccaccuuucagauaa

SEQ ID NO: 20882 - RNA, 19 nt, Homo sapiens
gaauuguaggugacuauua

SEQ ID NO: 20883 - RNA, 19 nt, Homo sapiens
uaaguuucacagcacuuac

SEQ ID NO: 20884 - RNA, 16 nt, Homo sapiens
uaguaugugcauuuaa

SEQ ID NO: 20885 - RNA, 18 nt, Homo sapiens
uuucuggaggucucugaa

SEQ ID NO: 20886 - RNA, 20 nt, Homo sapiens
ucuccagucauuauguuaau

SEQ ID NO: 20887 - RNA, 22 nt, Homo sapiens
aaacauguauguaaauagcuaa

SEQ ID NO: 20888 - RNA, 18 nt, Homo sapiens
accuucucaccugugaga

SEQ ID NO: 20889 - RNA, 15 nt, Homo sapiens
cuuuaagaacuaaaa

SEQ ID NO: 20890 - RNA, 13 nt, Homo sapiens
accuucccagcua

SEQ ID NO: 20891 - RNA, 20 nt, Homo sapiens
cuuguagcucucugaccucc

SEQ ID NO: 20892 - RNA, 13 nt, Homo sapiens
agaauguuuucaa

SEQ ID NO: 20893 - RNA, 20 nt, Homo sapiens
gaaaaguuucccagucuuca

SEQ ID NO: 20894 - RNA, 11 nt, Homo sapiens
uaucugcuaug

SEQ ID NO: 20895 - RNA, 14 nt, Homo sapiens
aauauauauuuuag

SEQ ID NO: 20896 - RNA, 20 nt, Homo sapiens
ccccagauaccaugaugcug

SEQ ID NO: 20897 - RNA, 22 nt, Homo sapiens
cacaugucagccacugugauag

SEQ ID NO: 20898 - RNA, 16 nt, Homo sapiens
uuauagccagguaccu

SEQ ID NO: 20899 - RNA, 14 nt, Homo sapiens
uggcuuuugugcau

SEQ ID NO: 20900 - RNA, 21 nt, Homo sapiens
gcaaucuucucagaaggcaaa

SEQ ID NO: 20901 - RNA, 16 nt, Homo sapiens
auaauuuuagacauuc

SEQ ID NO: 20902 - RNA, 13 nt, Homo sapiens
gccucuauugcca

SEQ ID NO: 20903 - RNA, 15 nt, Homo sapiens
gauauuaacugagaa

SEQ ID NO: 20904 - RNA, 12 nt, Homo sapiens
ccggaagccaaa

SEQ ID NO: 20905 - RNA, 17 nt, Homo sapiens
gacacaugcaaggucau

SEQ ID NO: 20906 - RNA, 18 nt, Homo sapiens
acacauuuuucuuaggga

SEQ ID NO: 20907 - RNA, 17 nt, Homo sapiens
ggaauguaugugcacau

SEQ ID NO: 20908 - RNA, 11 nt, Homo sapiens
augcucuccaa

SEQ ID NO: 20909 - RNA, 21 nt, Homo sapiens
uugccaugagaguucugucac

SEQ ID NO: 20910 - RNA, 15 nt, Homo sapiens
ugauuaaauucuugc

SEQ ID NO: 20911 - RNA, 20 nt, Homo sapiens
cugccaucauuuacuuuuaa

SEQ ID NO: 20912 - RNA, 15 nt, Homo sapiens
aaagucccagaucaa

SEQ ID NO: 20913 - RNA, 22 nt, Homo sapiens
ugacuauuauauuuccaagaaa

SEQ ID NO: 20914 - RNA, 21 nt, Homo sapiens
auuaacuuuuauaaacuuuac

SEQ ID NO: 20915 - RNA, 13 nt, Homo sapiens
aacuaaaauguuc

SEQ ID NO: 20916 - RNA, 17 nt, Homo sapiens
uccuuccacuuccaaga

SEQ ID NO: 20917 - RNA, 14 nt, Homo sapiens
auuuaaguuucaca

SEQ ID NO: 20918 - RNA, 14 nt, Homo sapiens
agucuucuauuuau

SEQ ID NO: 20919 - RNA, 14 nt, Homo sapiens
aggccaccuggauu

SEQ ID NO: 20920 - RNA, 16 nt, Homo sapiens
uccuuauucagaauuu

SEQ ID NO: 20921 - RNA, 19 nt, Homo sapiens
acuccacuuggacaugggc

SEQ ID NO: 20922 - RNA, 13 nt, Homo sapiens
aaugcaccuggaa

SEQ ID NO: 20923 - RNA, 13 nt, Homo sapiens
aagugaaacugcu

SEQ ID NO: 20924 - RNA, 18 nt, Homo sapiens
uuugaagguagaauguuu

SEQ ID NO: 20925 - RNA, 15 nt, Homo sapiens
agcccggaaacucca

SEQ ID NO: 20926 - RNA, 17 nt, Homo sapiens
auaucacaugucagcca

SEQ ID NO: 20927 - RNA, 15 nt, Homo sapiens
augcaaggucauuuu

SEQ ID NO: 20928 - RNA, 15 nt, Homo sapiens
uggcaggcaucgcca

SEQ ID NO: 20929 - RNA, 17 nt, Homo sapiens
aguucaccagacucuau

SEQ ID NO: 20930 - RNA, 16 nt, Homo sapiens
guaaauagcuaagaua

SEQ ID NO: 20931 - RNA, 19 nt, Homo sapiens
uguuuccuagcacacacuu

SEQ ID NO: 20932 - RNA, 14 nt, Homo sapiens
gucauuauguuaau

SEQ ID NO: 20933 - RNA, 21 nt, Homo sapiens
uucuuaaauaauaaagaucau

SEQ ID NO: 20934 - RNA, 24 nt, Homo sapiens
ggugaucucauuuaauccucucaa

SEQ ID NO: 20935 - RNA, 14 nt, Homo sapiens
caagccugccucaa

SEQ ID NO: 20936 - RNA, 19 nt, Homo sapiens
ucagcucucaguugcagcc

SEQ ID NO: 20937 - RNA, 20 nt, Homo sapiens
gaauguuuucaaauguucuc

SEQ ID NO: 20938 - RNA, 17 nt, Homo sapiens
caaaggcuccugagaca

SEQ ID NO: 20939 - RNA, 14 nt, Homo sapiens
auggcaaacugcca

SEQ ID NO: 20940 - RNA, 19 nt, Homo sapiens
ccagcacggggcuaagcau

SEQ ID NO: 20941 - RNA, 21 nt, Homo sapiens
cucacuuugaagagugugagg

SEQ ID NO: 20942 - RNA, 20 nt, Homo sapiens
accccagacgaugucuucau

SEQ ID NO: 20943 - RNA, 17 nt, Homo sapiens
acaggcaaauuccugac

SEQ ID NO: 20944 - RNA, 15 nt, Homo sapiens
uugauguuuucacaa

SEQ ID NO: 20945 - RNA, 23 nt, Homo sapiens
auacugccuuguuuaauguuaau

SEQ ID NO: 20946 - RNA, 21 nt, Homo sapiens
uaugcuauuuauuaaguauuu

SEQ ID NO: 20947 - RNA, 23 nt, Homo sapiens
ugcaacaugccagccacugugau

SEQ ID NO: 20948 - RNA, 18 nt, Homo sapiens
uugugugcacauauccuu

SEQ ID NO: 20949 - RNA, 21 nt, Homo sapiens
uauguagaauauauuuccuua

SEQ ID NO: 20950 - RNA, 21 nt, Homo sapiens
ugaaagucccagaucaagccu

SEQ ID NO: 20951 - RNA, 22 nt, Homo sapiens
ugcauaggugaucucauuuaau

SEQ ID NO: 20952 - RNA, 19 nt, Homo sapiens
uuaaggaugcuuguacaua

SEQ ID NO: 20953 - RNA, 21 nt, Homo sapiens
gaaccguuugugauugccauu

SEQ ID NO: 20954 - RNA, 20 nt, Homo sapiens
aggcauacugccuuguuuaa

SEQ ID NO: 20955 - RNA, 14 nt, Homo sapiens
gagggcuaauaucu

SEQ ID NO: 20956 - RNA, 16 nt, Homo sapiens
ugaguacguugugcau

SEQ ID NO: 20957 - RNA, 17 nt, Homo sapiens
gaaucacuggcuguuaa

SEQ ID NO: 20958 - RNA, 14 nt, Homo sapiens
aaagcaugugagac

SEQ ID NO: 20959 - RNA, 18 nt, Homo sapiens
uuuagaagauucuauguu

SEQ ID NO: 20960 - RNA, 20 nt, Homo sapiens
auuaacuuuuauaaacuuua

SEQ ID NO: 20961 - RNA, 14 nt, Homo sapiens
accucuccaugauc

SEQ ID NO: 20962 - RNA, 19 nt, Homo sapiens
cuuguaaggcauacugccu

SEQ ID NO: 20963 - RNA, 16 nt, Homo sapiens
uuugaagagugugagg

SEQ ID NO: 20964 - RNA, 22 nt, Homo sapiens
ucagccagcccucuucugacac

SEQ ID NO: 20965 - RNA, 20 nt, Homo sapiens
gcaaucuucucagaaggcaa

SEQ ID NO: 20966 - RNA, 19 nt, Homo sapiens
cuacaauuguaaacuaguu

SEQ ID NO: 20967 - RNA, 22 nt, Homo sapiens
uaccagccuuggauacuccaug

SEQ ID NO: 20968 - RNA, 22 nt, Homo sapiens
aaauacuguuugagguuuuuaa

SEQ ID NO: 20969 - RNA, 20 nt, Homo sapiens
gugagaccaaauugagcuag

SEQ ID NO: 20970 - RNA, 18 nt, Homo sapiens
aaucacuggcuguuaauc

SEQ ID NO: 20971 - RNA, 14 nt, Homo sapiens
cauggcccugccau

SEQ ID NO: 20972 - RNA, 20 nt, Homo sapiens
aucuuucaagggaccucucc

SEQ ID NO: 20973 - RNA, 18 nt, Homo sapiens
gauugagaaggagcuccc

SEQ ID NO: 20974 - RNA, 19 nt, Homo sapiens
agcuagaaaacaggcaaau

SEQ ID NO: 20975 - RNA, 23 nt, Homo sapiens
gaccuucccagcuagaauucacu

SEQ ID NO: 20976 - RNA, 20 nt, Homo sapiens
agucuucagcagagaaguuu

SEQ ID NO: 20977 - RNA, 14 nt, Homo sapiens
ucuaugacacaugc

SEQ ID NO: 20978 - RNA, 21 nt, Homo sapiens
ggccccagauaccaugaugcu

SEQ ID NO: 20979 - RNA, 17 nt, Homo sapiens
ggagauuuacaacuggg

SEQ ID NO: 20980 - RNA, 16 nt, Homo sapiens
gaagccucuauugcca

SEQ ID NO: 20981 - RNA, 15 nt, Homo sapiens
guuuagcagauuuaa

SEQ ID NO: 20982 - RNA, 14 nt, Homo sapiens
cugccugcccugaa

SEQ ID NO: 20983 - RNA, 16 nt, Homo sapiens
uaucuauguagaauau

SEQ ID NO: 20984 - RNA, 16 nt, Homo sapiens
aacuauaaaacuaggu

SEQ ID NO: 20985 - RNA, 17 nt, Homo sapiens
uacuguccccaucauca

SEQ ID NO: 20986 - RNA, 19 nt, Homo sapiens
uucauucuuuuugaaaugu

SEQ ID NO: 20987 - RNA, 11 nt, Homo sapiens
acuuacuguac

SEQ ID NO: 20988 - RNA, 15 nt, Homo sapiens
agaauauauuuccuu

SEQ ID NO: 20989 - RNA, 21 nt, Homo sapiens
uuccuauaauuuuagacauuc

SEQ ID NO: 20990 - RNA, 16 nt, Homo sapiens
ucuggaggucucugaa

SEQ ID NO: 20991 - RNA, 20 nt, Homo sapiens
acuguuuagaugaaugucag

SEQ ID NO: 20992 - RNA, 21 nt, Homo sapiens
guucaaucuggauucauauuu

SEQ ID NO: 20993 - RNA, 18 nt, Homo sapiens
cagcuagaauucacucca

SEQ ID NO: 20994 - RNA, 21 nt, Homo sapiens
uagcauaguaccucugcuauu

SEQ ID NO: 20995 - RNA, 23 nt, Homo sapiens
ucaguuguuauuuauugaaauga

SEQ ID NO: 20996 - RNA, 19 nt, Homo sapiens
gcuauuuauuaaguauuuu

SEQ ID NO: 20997 - RNA, 19 nt, Homo sapiens
auaccucucuuguagcucu

SEQ ID NO: 20998 - RNA, 23 nt, Homo sapiens
uauuuccaagaaauauuccuuaa

SEQ ID NO: 20999 - RNA, 15 nt, Homo sapiens
aaauaccagccagua

SEQ ID NO: 21000 - RNA, 17 nt, Homo sapiens
caggauuuaaguuucac

SEQ ID NO: 21001 - RNA, 16 nt, Homo sapiens
aguaucccuacuguaa

SEQ ID NO: 21002 - RNA, 19 nt, Homo sapiens
uuggauacuccauggggug

SEQ ID NO: 21003 - RNA, 23 nt, Homo sapiens
gugaagacaaugacuuacuguac

SEQ ID NO: 21004 - RNA, 14 nt, Homo sapiens
aauacacuguuauc

SEQ ID NO: 21005 - RNA, 13 nt, Homo sapiens
gccucaccucuca

SEQ ID NO: 21006 - RNA, 13 nt, Homo sapiens
gaucauugugaag

SEQ ID NO: 21007 - RNA, 16 nt, Homo sapiens
gaggagccugcaacau

SEQ ID NO: 21008 - RNA, 12 nt, Homo sapiens
uggccuuucaua

SEQ ID NO: 21009 - RNA, 15 nt, Homo sapiens
aauguaugugcacau

SEQ ID NO: 21010 - RNA, 20 nt, Homo sapiens
cugccuuguuuaauguuaau

SEQ ID NO: 21011 - RNA, 14 nt, Homo sapiens
gcuuuugugcauua

SEQ ID NO: 21012 - RNA, 14 nt, Homo sapiens
agcagaaaugccuu

SEQ ID NO: 21013 - RNA, 19 nt, Homo sapiens
ugcagaggccaccuggauu

SEQ ID NO: 21014 - RNA, 16 nt, Homo sapiens
cuggguuccugcaaug

SEQ ID NO: 21015 - RNA, 14 nt, Homo sapiens
gcucucugaccucc

SEQ ID NO: 21016 - RNA, 14 nt, Homo sapiens
ucacagauaccucu

SEQ ID NO: 21017 - RNA, 19 nt, Homo sapiens
uaaugaaguguuuagcaua

SEQ ID NO: 21018 - RNA, 23 nt, Homo sapiens
gcccaucuuucaagggaccucuc

SEQ ID NO: 21019 - RNA, 15 nt, Homo sapiens
gaauguaugugcaca

SEQ ID NO: 21020 - RNA, 15 nt, Homo sapiens
cagacucuggucaag

SEQ ID NO: 21021 - RNA, 17 nt, Homo sapiens
ucaaucuggauucauau

SEQ ID NO: 21022 - RNA, 18 nt, Homo sapiens
cuaaacuuucacacccca

SEQ ID NO: 21023 - RNA, 17 nt, Homo sapiens
cuugugugcacauaucc

SEQ ID NO: 21024 - RNA, 16 nt, Homo sapiens
uuaugacuucauuaau

SEQ ID NO: 21025 - RNA, 12 nt, Homo sapiens
uguaucaugaca

SEQ ID NO: 21026 - RNA, 16 nt, Homo sapiens
acuuuuaaacuuugau

SEQ ID NO: 21027 - RNA, 13 nt, Homo sapiens
cuuuugugcauua

SEQ ID NO: 21028 - RNA, 16 nt, Homo sapiens
uggcuuuugugcauua

SEQ ID NO: 21029 - RNA, 13 nt, Homo sapiens
caaucuucucaga

SEQ ID NO: 21030 - RNA, 18 nt, Homo sapiens
aauuuccuuacucuugau

SEQ ID NO: 21031 - RNA, 16 nt, Homo sapiens
ucuaugacacaugcaa

SEQ ID NO: 21032 - RNA, 18 nt, Homo sapiens
cugcuauuugcuguuauu

SEQ ID NO: 21033 - RNA, 13 nt, Homo sapiens
aucccuacuguaa

SEQ ID NO: 21034 - RNA, 18 nt, Homo sapiens
aauguuuagcagauuuaa

SEQ ID NO: 21035 - RNA, 15 nt, Homo sapiens
uuccucacuuugaag

SEQ ID NO: 21036 - RNA, 20 nt, Homo sapiens
auggcaggaggcauccaaag

SEQ ID NO: 21037 - RNA, 15 nt, Homo sapiens
ucccaggaggggcuu

SEQ ID NO: 21038 - RNA, 14 nt, Homo sapiens
auuuauuuauucau

SEQ ID NO: 21039 - RNA, 22 nt, Homo sapiens
acguuucuaaaggcuaccuuug

SEQ ID NO: 21040 - RNA, 16 nt, Homo sapiens
cucuggaagccucuau

SEQ ID NO: 21041 - RNA, 17 nt, Homo sapiens
gacacuaaaacaccuca

SEQ ID NO: 21042 - RNA, 16 nt, Homo sapiens
guuuugguugcuuuaa

SEQ ID NO: 21043 - RNA, 14 nt, Homo sapiens
uccuuacucuugau

SEQ ID NO: 21044 - RNA, 14 nt, Homo sapiens
acauucuguuaauc

SEQ ID NO: 21045 - RNA, 16 nt, Homo sapiens
ucaaucaguauucaua

SEQ ID NO: 21046 - RNA, 17 nt, Homo sapiens
gcuucugggcagacucu

SEQ ID NO: 21047 - RNA, 20 nt, Homo sapiens
gagaauuuccuuacucuuga

SEQ ID NO: 21048 - RNA, 12 nt, Homo sapiens
caugcucuccaa

SEQ ID NO: 21049 - RNA, 17 nt, Homo sapiens
acauauccuuagcccau

SEQ ID NO: 21050 - RNA, 14 nt, Homo sapiens
auucucuccuguac

SEQ ID NO: 21051 - RNA, 23 nt, Homo sapiens
gagcaucacaguuuugguugcuu

SEQ ID NO: 21052 - RNA, 17 nt, Homo sapiens
agcccggaaacuccaca

SEQ ID NO: 21053 - RNA, 19 nt, Homo sapiens
caugaaguaauaugcacac

SEQ ID NO: 21054 - RNA, 21 nt, Homo sapiens
uuuuagaagauucuauguuaa

SEQ ID NO: 21055 - RNA, 15 nt, Homo sapiens
aaugauuucacagug

SEQ ID NO: 21056 - RNA, 17 nt, Homo sapiens
aagccucuauugccaug

SEQ ID NO: 21057 - RNA, 18 nt, Homo sapiens
aaaugggggugcauuuga

SEQ ID NO: 21058 - RNA, 23 nt, Homo sapiens
ugcacacauuuuuuaaaugcacc

SEQ ID NO: 21059 - RNA, 17 nt, Homo sapiens
ucuuaauucuuagcuca

SEQ ID NO: 21060 - RNA, 23 nt, Homo sapiens
uuuccacauaaggaaacuggguu

SEQ ID NO: 21061 - RNA, 23 nt, Homo sapiens
aauguuaauuaugcaguguuucc

SEQ ID NO: 21062 - RNA, 22 nt, Homo sapiens
guuuuuauggcuuuugugcauu

SEQ ID NO: 21063 - RNA, 20 nt, Homo sapiens
uagaaaacaggcaaauuccu

SEQ ID NO: 21064 - RNA, 18 nt, Homo sapiens
guauucaaacaauuugaa

SEQ ID NO: 21065 - RNA, 16 nt, Homo sapiens
aggagcucccaggagg

SEQ ID NO: 21066 - RNA, 18 nt, Homo sapiens
ucugcuaugcuauugaag

SEQ ID NO: 21067 - RNA, 19 nt, Homo sapiens
acaggaggggaaggcaaca

SEQ ID NO: 21068 - RNA, 18 nt, Homo sapiens
guuaaguaucagcuacaa

SEQ ID NO: 21069 - RNA, 14 nt, Homo sapiens
caccugugagacca

SEQ ID NO: 21070 - RNA, 15 nt, Homo sapiens
auuuuauuaugcaug

SEQ ID NO: 21071 - RNA, 15 nt, Homo sapiens
cuagaauucacucca

SEQ ID NO: 21072 - RNA, 20 nt, Homo sapiens
cugagcccuacugugucuca

SEQ ID NO: 21073 - RNA, 13 nt, Homo sapiens
ugagacacauggg

SEQ ID NO: 21074 - RNA, 20 nt, Homo sapiens
gaaccguuugugauugccau

SEQ ID NO: 21075 - RNA, 15 nt, Homo sapiens
cauuuuuuaaaugca

SEQ ID NO: 21076 - RNA, 17 nt, Homo sapiens
uaaaugggggugcauuu

SEQ ID NO: 21077 - RNA, 15 nt, Homo sapiens
cuauuauauucauuc

SEQ ID NO: 21078 - RNA, 21 nt, Homo sapiens
uagaauucacuccacuuggac

SEQ ID NO: 21079 - RNA, 22 nt, Homo sapiens
uauguuaauauuuuauguguaa

SEQ ID NO: 21080 - RNA, 14 nt, Homo sapiens
uaucccuacuguaa

SEQ ID NO: 21081 - RNA, 20 nt, Homo sapiens
acacuaaaacaccucagcug

SEQ ID NO: 21082 - RNA, 23 nt, Homo sapiens
ugugcauuaucuagauacuguau

SEQ ID NO: 21083 - RNA, 13 nt, Homo sapiens
uaagaaugaaaua

SEQ ID NO: 21084 - RNA, 21 nt, Homo sapiens
uuguuaguaugaggcauuugu

SEQ ID NO: 21085 - RNA, 16 nt, Homo sapiens
ugacuuguacucugaa

SEQ ID NO: 21086 - RNA, 17 nt, Homo sapiens
cugucacggucacuuua

SEQ ID NO: 21087 - RNA, 17 nt, Homo sapiens
cuccagccucagcucuc

SEQ ID NO: 21088 - RNA, 21 nt, Homo sapiens
ucacaguuuugguugcuuuaa

SEQ ID NO: 21089 - RNA, 12 nt, Homo sapiens
acuccacauccu

SEQ ID NO: 21090 - RNA, 22 nt, Homo sapiens
guagcucucugaccuccuccuu

SEQ ID NO: 21091 - RNA, 13 nt, Homo sapiens
gucauuuguuaau

SEQ ID NO: 21092 - RNA, 17 nt, Homo sapiens
gccucaaucaguauuca

SEQ ID NO: 21093 - RNA, 16 nt, Homo sapiens
uucacagcacuuacaa

SEQ ID NO: 21094 - RNA, 15 nt, Homo sapiens
auuccucacuuugaa

SEQ ID NO: 21095 - RNA, 24 nt, Homo sapiens
cacugcuuaacuucacauauugau

SEQ ID NO: 21096 - RNA, 16 nt, Homo sapiens
gcuagaauucacucca

SEQ ID NO: 21097 - RNA, 22 nt, Homo sapiens
uugaauuguaggugacuauuau

SEQ ID NO: 21098 - RNA, 14 nt, Homo sapiens
ucacuccacuugga

SEQ ID NO: 21099 - RNA, 12 nt, Homo sapiens
cacuuacaauuu

SEQ ID NO: 21100 - RNA, 13 nt, Homo sapiens
ggcuuuugugcau

SEQ ID NO: 21101 - RNA, 21 nt, Homo sapiens
uuguacauaaugcgugcauac

SEQ ID NO: 21102 - RNA, 17 nt, Homo sapiens
guuuagaugaaugucag

SEQ ID NO: 21103 - RNA, 16 nt, Homo sapiens
caugucagccacugug

SEQ ID NO: 21104 - RNA, 20 nt, Homo sapiens
aauaaaacuuuuccaaugac

SEQ ID NO: 21105 - RNA, 12 nt, Homo sapiens
accucuccauga

SEQ ID NO: 21106 - RNA, 17 nt, Homo sapiens
uaguuacuaaacaugua

SEQ ID NO: 21107 - RNA, 19 nt, Homo sapiens
cuuuuuccagguuccugag

SEQ ID NO: 21108 - RNA, 14 nt, Homo sapiens
aaaguaaaggcaaa

SEQ ID NO: 21109 - RNA, 20 nt, Homo sapiens
accucccaacgucccuagcc

SEQ ID NO: 21110 - RNA, 18 nt, Homo sapiens
caauuauuugaagauuua

SEQ ID NO: 21111 - RNA, 19 nt, Homo sapiens
gaaccguuugugauugcca

SEQ ID NO: 21112 - RNA, 20 nt, Homo sapiens
uagcauaguaccucugcuau

SEQ ID NO: 21113 - RNA, 17 nt, Homo sapiens
cguuugugauugccauu

SEQ ID NO: 21114 - RNA, 18 nt, Homo sapiens
cucgaggcccuagcauuu

SEQ ID NO: 21115 - RNA, 14 nt, Homo sapiens
caagcaaauggcca

SEQ ID NO: 21116 - RNA, 16 nt, Homo sapiens
cuuccacuuccaagau

SEQ ID NO: 21117 - RNA, 12 nt, Homo sapiens
cuacuugcacac

SEQ ID NO: 21118 - RNA, 17 nt, Homo sapiens
augcucuccaaaccacu

SEQ ID NO: 21119 - RNA, 17 nt, Homo sapiens
uauggcuuuugugcauu

SEQ ID NO: 21120 - RNA, 18 nt, Homo sapiens
agguuuuuaagccuuaaa

SEQ ID NO: 21121 - RNA, 22 nt, Homo sapiens
cugaaccguuugugauugccau

SEQ ID NO: 21122 - RNA, 21 nt, Homo sapiens
uuuugguugcuuuaauaucau

SEQ ID NO: 21123 - RNA, 22 nt, Homo sapiens
auuuccaagaaauauuccuuaa

SEQ ID NO: 21124 - RNA, 15 nt, Homo sapiens
auuuuaugcuuuaaa

SEQ ID NO: 21125 - RNA, 17 nt, Homo sapiens
aauguucuccagucauu

SEQ ID NO: 21126 - RNA, 21 nt, Homo sapiens
gaaaacaugcuacacacugca

SEQ ID NO: 21127 - RNA, 21 nt, Homo sapiens
accuuucagauaacuguuauu

SEQ ID NO: 21128 - RNA, 17 nt, Homo sapiens
gaagauucuauguuaau

SEQ ID NO: 21129 - RNA, 19 nt, Homo sapiens
gccuggauggcugccucac

SEQ ID NO: 21130 - RNA, 17 nt, Homo sapiens
uggcaggaggcauccaa

SEQ ID NO: 21131 - RNA, 23 nt, Homo sapiens
gaaacguauucaaacaauuugaa

SEQ ID NO: 21132 - RNA, 19 nt, Homo sapiens
uaaccaguguuguggauuu

SEQ ID NO: 21133 - RNA, 15 nt, Homo sapiens
ccugagacacauggg

SEQ ID NO: 21134 - RNA, 16 nt, Homo sapiens
ccaguguuguggauuu

SEQ ID NO: 21135 - RNA, 21 nt, Homo sapiens
ugaagcuuuaagaacuaaaau

SEQ ID NO: 21136 - RNA, 16 nt, Homo sapiens
caaugagaucauugug

SEQ ID NO: 21137 - RNA, 23 nt, Homo sapiens
aaugauuucacagugugugguca

SEQ ID NO: 21138 - RNA, 14 nt, Homo sapiens
agaaauguguuauc

SEQ ID NO: 21139 - RNA, 14 nt, Homo sapiens
cuguaucaugacaa

SEQ ID NO: 21140 - RNA, 16 nt, Homo sapiens
cauucacagauaccuc

SEQ ID NO: 21141 - RNA, 17 nt, Homo sapiens
auuuuuuuucuguuaua

SEQ ID NO: 21142 - RNA, 12 nt, Homo sapiens
ucuauguuaaua

SEQ ID NO: 21143 - RNA, 18 nt, Homo sapiens
acaugucagccacuguga

SEQ ID NO: 21144 - RNA, 18 nt, Homo sapiens
aggcacccccagaaugac

SEQ ID NO: 21145 - RNA, 17 nt, Homo sapiens
auggcaggcaucgccau

SEQ ID NO: 21146 - RNA, 16 nt, Homo sapiens
caaucaguauucauau

SEQ ID NO: 21147 - RNA, 19 nt, Homo sapiens
uaguucaaucuggauucau

SEQ ID NO: 21148 - RNA, 18 nt, Homo sapiens
cuuacucuugauuguggg

SEQ ID NO: 21149 - RNA, 17 nt, Homo sapiens
cugaccuccuccuucau

SEQ ID NO: 21150 - RNA, 13 nt, Homo sapiens
uuuuaguugucaa

SEQ ID NO: 21151 - RNA, 17 nt, Homo sapiens
ccugaaagucccagauc

SEQ ID NO: 21152 - RNA, 19 nt, Homo sapiens
auucucuccuguaccucuu

SEQ ID NO: 21153 - RNA, 15 nt, Homo sapiens
cuguucuuuccaaag

SEQ ID NO: 21154 - RNA, 21 nt, Homo sapiens
ugugucucaggugugcccuga

SEQ ID NO: 21155 - RNA, 18 nt, Homo sapiens
cugagcccggaaacucca

SEQ ID NO: 21156 - RNA, 17 nt, Homo sapiens
ucgccauucuugcugaa

SEQ ID NO: 21157 - RNA, 15 nt, Homo sapiens
ucacuggcuguuaau

SEQ ID NO: 21158 - RNA, 22 nt, Homo sapiens
ucaccaucaauuuuaguuguca

SEQ ID NO: 21159 - RNA, 18 nt, Homo sapiens
cagugaggcggauugaga

SEQ ID NO: 21160 - RNA, 18 nt, Homo sapiens
aaagcugaguguuucaca

SEQ ID NO: 21161 - RNA, 13 nt, Homo sapiens
uuauucagaauuu

SEQ ID NO: 21162 - RNA, 16 nt, Homo sapiens
aacgucccuagcccuu

SEQ ID NO: 21163 - RNA, 20 nt, Homo sapiens
acuggcuguuaaucuuucaa

SEQ ID NO: 21164 - RNA, 16 nt, Homo sapiens
auuauauauacuauau

SEQ ID NO: 21165 - RNA, 17 nt, Homo sapiens
ccuggauggcugccuca

SEQ ID NO: 21166 - RNA, 16 nt, Homo sapiens
acuguccccaucauca

SEQ ID NO: 21167 - RNA, 16 nt, Homo sapiens
aaugagaucauuguga

SEQ ID NO: 21168 - RNA, 14 nt, Homo sapiens
uuuugaaaugucaa

SEQ ID NO: 21169 - RNA, 14 nt, Homo sapiens
uacuaauagacaau

SEQ ID NO: 21170 - RNA, 15 nt, Homo sapiens
uaucagcuacaauug

SEQ ID NO: 21171 - RNA, 11 nt, Homo sapiens
caucucugcaa

SEQ ID NO: 21172 - RNA, 13 nt, Homo sapiens
accucucaccucc

SEQ ID NO: 21173 - RNA, 11 nt, Homo sapiens
uggugugauuu

SEQ ID NO: 21174 - RNA, 16 nt, Homo sapiens
uaaguaucagcuacaa

SEQ ID NO: 21175 - RNA, 13 nt, Homo sapiens
gcuaugcauuuga

SEQ ID NO: 21176 - RNA, 16 nt, Homo sapiens
uauuuuaucugcuaug

SEQ ID NO: 21177 - RNA, 12 nt, Homo sapiens
uucaaacuuuac

SEQ ID NO: 21178 - RNA, 12 nt, Homo sapiens
cgugugccugag

SEQ ID NO: 21179 - RNA, 16 nt, Homo sapiens
caugcuacacacugca

SEQ ID NO: 21180 - RNA, 23 nt, Homo sapiens
ccugaaagucccagaucaagccu

SEQ ID NO: 21181 - RNA, 20 nt, Homo sapiens
aagauagaagguuugcagau

SEQ ID NO: 21182 - RNA, 18 nt, Homo sapiens
ggugagguaccagccuug

SEQ ID NO: 21183 - RNA, 20 nt, Homo sapiens
uaaauucccuggccuuucau

SEQ ID NO: 21184 - RNA, 23 nt, Homo sapiens
aagccugccucaaucaguauuca

SEQ ID NO: 21185 - RNA, 13 nt, Homo sapiens
ccggaaacuccac

SEQ ID NO: 21186 - RNA, 20 nt, Homo sapiens
uugauaaucaacugggcuga

SEQ ID NO: 21187 - RNA, 21 nt, Homo sapiens
cuuacguccuuccacuuccaa

SEQ ID NO: 21188 - RNA, 13 nt, Homo sapiens
agccacugugaua

SEQ ID NO: 21189 - RNA, 19 nt, Homo sapiens
uccuuccacuuccaagauc

SEQ ID NO: 21190 - RNA, 13 nt, Homo sapiens
ucccuuggacauu

SEQ ID NO: 21191 - RNA, 15 nt, Homo sapiens
ugcauuuggugguuu

SEQ ID NO: 21192 - RNA, 14 nt, Homo sapiens
acaucucugcaauc

SEQ ID NO: 21193 - RNA, 20 nt, Homo sapiens
uuacguccuuccacuuccaa

SEQ ID NO: 21194 - RNA, 16 nt, Homo sapiens
acacuguuaucuucac

SEQ ID NO: 21195 - RNA, 17 nt, Homo sapiens
aauucacuccacuugga

SEQ ID NO: 21196 - RNA, 21 nt, Homo sapiens
cccagcuagaauucacuccac

SEQ ID NO: 21197 - RNA, 19 nt, Homo sapiens
uguagaauauauuuccuua

SEQ ID NO: 21198 - RNA, 22 nt, Homo sapiens
aaggcuccugagacacaugggu

SEQ ID NO: 21199 - RNA, 15 nt, Homo sapiens
auuuuaucugcuaug

SEQ ID NO: 21200 - RNA, 13 nt, Homo sapiens
aaucuggauucau

SEQ ID NO: 21201 - RNA, 17 nt, Homo sapiens
gagcgcuaccucuccag

SEQ ID NO: 21202 - RNA, 13 nt, Homo sapiens
caucacaguuuug

SEQ ID NO: 21203 - RNA, 21 nt, Homo sapiens
auuuauugaaaugauuucaca

SEQ ID NO: 21204 - RNA, 13 nt, Homo sapiens
ugcuaugcuauug

SEQ ID NO: 21205 - RNA, 18 nt, Homo sapiens
acacuguuaucuucacuu

SEQ ID NO: 21206 - RNA, 21 nt, Homo sapiens
agggaccucuccaugauccca

SEQ ID NO: 21207 - RNA, 15 nt, Homo sapiens
gaagucuucuauuua

SEQ ID NO: 21208 - RNA, 23 nt, Homo sapiens
cagggaaauguaugugugucuau

SEQ ID NO: 21209 - RNA, 18 nt, Homo sapiens
uggauuccucacuuugaa

SEQ ID NO: 21210 - RNA, 13 nt, Homo sapiens
ucuuggggaauau

SEQ ID NO: 21211 - RNA, 17 nt, Homo sapiens
gccugagcggaccuucc

SEQ ID NO: 21212 - RNA, 20 nt, Homo sapiens
guuauuuauaaucacuuuuu

SEQ ID NO: 21213 - RNA, 11 nt, Homo sapiens
cugacugcuag

SEQ ID NO: 21214 - RNA, 15 nt, Homo sapiens
uagcccuuacguccu

SEQ ID NO: 21215 - RNA, 19 nt, Homo sapiens
uccacauccugugggaccu

SEQ ID NO: 21216 - RNA, 14 nt, Homo sapiens
uuccaaugacauuu

SEQ ID NO: 21217 - RNA, 20 nt, Homo sapiens
uauuuauugauguuuucaca

SEQ ID NO: 21218 - RNA, 20 nt, Homo sapiens
ggcccugccaugcucuccaa

SEQ ID NO: 21219 - RNA, 15 nt, Homo sapiens
gauguuucauaagaa

SEQ ID NO: 21220 - RNA, 19 nt, Homo sapiens
ucuccaugaucccaccucc

SEQ ID NO: 21221 - RNA, 18 nt, Homo sapiens
ugcaugaaguaauaugca

SEQ ID NO: 21222 - RNA, 15 nt, Homo sapiens
agcaucacaguuuug

SEQ ID NO: 21223 - RNA, 21 nt, Homo sapiens
aucgucacugcuuaacuucac

SEQ ID NO: 21224 - RNA, 13 nt, Homo sapiens
uuuaugcuuuaaa

SEQ ID NO: 21225 - RNA, 16 nt, Homo sapiens
ugccagccacugugau

SEQ ID NO: 21226 - RNA, 16 nt, Homo sapiens
uuaguaugugcauuua

SEQ ID NO: 21227 - RNA, 23 nt, Homo sapiens
cauauuuaacaaaauuugaauag

SEQ ID NO: 21228 - RNA, 18 nt, Homo sapiens
accguuugugauugccau

SEQ ID NO: 21229 - RNA, 23 nt, Homo sapiens
uugagcuaggggggucagccagc

SEQ ID NO: 21230 - RNA, 22 nt, Homo sapiens
aauccaagaaaauggccaguga

SEQ ID NO: 21231 - RNA, 21 nt, Homo sapiens
gcaacaugccagccacuguga

SEQ ID NO: 21232 - RNA, 16 nt, Homo sapiens
ggaaggcaacauacac

SEQ ID NO: 21233 - RNA, 14 nt, Homo sapiens
ucugccugcccuga

SEQ ID NO: 21234 - RNA, 22 nt, Homo sapiens
caugaucccaccucccauucac

SEQ ID NO: 21235 - RNA, 19 nt, Homo sapiens
aagaaaauggccagugaga

SEQ ID NO: 21236 - RNA, 20 nt, Homo sapiens
ugauugugggauacuauuua

SEQ ID NO: 21237 - RNA, 20 nt, Homo sapiens
agggcuugugugcacauauc

SEQ ID NO: 21238 - RNA, 17 nt, Homo sapiens
aucugacaucucugcaa

SEQ ID NO: 21239 - RNA, 18 nt, Homo sapiens
aaaccacuuuuugcagcu

SEQ ID NO: 21240 - RNA, 13 nt, Homo sapiens
cuuacguccuucc

SEQ ID NO: 21241 - RNA, 14 nt, Homo sapiens
aacuaaacuuucac

SEQ ID NO: 21242 - RNA, 20 nt, Homo sapiens
aaggcuaccuuuguauucuc

SEQ ID NO: 21243 - RNA, 18 nt, Homo sapiens
aauccugauucauauuua

SEQ ID NO: 21244 - RNA, 19 nt, Homo sapiens
aguuuuggaaacguauuca

SEQ ID NO: 21245 - RNA, 19 nt, Homo sapiens
aagccucuauugccaugag

SEQ ID NO: 21246 - RNA, 13 nt, Homo sapiens
ucagccacuguga

SEQ ID NO: 21247 - RNA, 21 nt, Homo sapiens
cucaauguuuagcagauuuaa

SEQ ID NO: 21248 - RNA, 17 nt, Homo sapiens
cugggcugaacacucca

SEQ ID NO: 21249 - RNA, 16 nt, Homo sapiens
caaugacuuacuguac

SEQ ID NO: 21250 - RNA, 23 nt, Homo sapiens
agcuaggggggucagccagcccu

SEQ ID NO: 21251 - RNA, 22 nt, Homo sapiens
auggccagugagaucaauguga

SEQ ID NO: 21252 - RNA, 19 nt, Homo sapiens
cugagacacaugggugcua

SEQ ID NO: 21253 - RNA, 15 nt, Homo sapiens
cugagacacaugggu

SEQ ID NO: 21254 - RNA, 13 nt, Homo sapiens
agcagaaaugccu

SEQ ID NO: 21255 - RNA, 14 nt, Homo sapiens
gccagguaccuucu

SEQ ID NO: 21256 - RNA, 17 nt, Homo sapiens
auuuaauuugaagauag

SEQ ID NO: 21257 - RNA, 16 nt, Homo sapiens
uucucaccugugagac

SEQ ID NO: 21258 - RNA, 22 nt, Homo sapiens
uauuuauugaaaugauuucaca

SEQ ID NO: 21259 - RNA, 18 nt, Homo sapiens
aacugccaucauuuacuu

SEQ ID NO: 21260 - RNA, 21 nt, Homo sapiens
ugauggaaauacacuguuauc

SEQ ID NO: 21261 - RNA, 19 nt, Homo sapiens
gaagccucuauugccauga

SEQ ID NO: 21262 - RNA, 19 nt, Homo sapiens
acaguuuugguugcuuuaa

SEQ ID NO: 21263 - RNA, 22 nt, Homo sapiens
cagcguuucuaugacacaugca

SEQ ID NO: 21264 - RNA, 17 nt, Homo sapiens
uucagauaacuguuauu

SEQ ID NO: 21265 - RNA, 21 nt, Homo sapiens
uaaugguaguuuuacaguguu

SEQ ID NO: 21266 - RNA, 13 nt, Homo sapiens
uggccaaugagau

SEQ ID NO: 21267 - RNA, 15 nt, Homo sapiens
agccccugggaccag

SEQ ID NO: 21268 - RNA, 20 nt, Homo sapiens
uuuagcagauuuaagauaug

SEQ ID NO: 21269 - RNA, 13 nt, Homo sapiens
accuccuccuuca

SEQ ID NO: 21270 - RNA, 14 nt, Homo sapiens
ucacuggcuguuaa

SEQ ID NO: 21271 - RNA, 18 nt, Homo sapiens
auggcaggaggcauccaa

SEQ ID NO: 21272 - RNA, 16 nt, Homo sapiens
ugcuauuugcuguuau

SEQ ID NO: 21273 - RNA, 16 nt, Homo sapiens
ccucucccaacuauaa

SEQ ID NO: 21274 - RNA, 20 nt, Homo sapiens
auucauauuuauagccaggu

SEQ ID NO: 21275 - RNA, 17 nt, Homo sapiens
ucuaugagggcuaauau

SEQ ID NO: 21276 - RNA, 19 nt, Homo sapiens
cucugcuauuugcuguuau

SEQ ID NO: 21277 - RNA, 20 nt, Homo sapiens
uuugcagauauucucuaguc

SEQ ID NO: 21278 - RNA, 16 nt, Homo sapiens
cugugucucaggugug

SEQ ID NO: 21279 - RNA, 20 nt, Homo sapiens
ucacagauaccucucuugua

SEQ ID NO: 21280 - RNA, 14 nt, Homo sapiens
ggagccugcaacau

SEQ ID NO: 21281 - RNA, 13 nt, Homo sapiens
ucacuuuacuguc

SEQ ID NO: 21282 - RNA, 21 nt, Homo sapiens
aacaccaggauuuaaguuuca

SEQ ID NO: 21283 - RNA, 13 nt, Homo sapiens
uauauuuccuuau

SEQ ID NO: 21284 - RNA, 12 nt, Homo sapiens
caucuuucaagg

SEQ ID NO: 21285 - RNA, 19 nt, Homo sapiens
uaagucuguuuuaugacuu

SEQ ID NO: 21286 - RNA, 15 nt, Homo sapiens
ccaugagaguucugu

SEQ ID NO: 21287 - RNA, 13 nt, Homo sapiens
cccagauaccaug

SEQ ID NO: 21288 - RNA, 15 nt, Homo sapiens
auuuuagcuacuaua

SEQ ID NO: 21289 - RNA, 16 nt, Homo sapiens
aaacuaguuacuaaac

SEQ ID NO: 21290 - RNA, 23 nt, Homo sapiens
cuccugagacacaugggugcuau

SEQ ID NO: 21291 - RNA, 12 nt, Homo sapiens
augauuucacag

SEQ ID NO: 21292 - RNA, 15 nt, Homo sapiens
uccuggauuccucac

SEQ ID NO: 21293 - RNA, 11 nt, Homo sapiens
uaugcauuuga

SEQ ID NO: 21294 - RNA, 20 nt, Homo sapiens
gcaaaguaucccuacuguaa

SEQ ID NO: 21295 - RNA, 20 nt, Homo sapiens
ccaggcacccccagaaugac

SEQ ID NO: 21296 - RNA, 20 nt, Homo sapiens
uucagcucagcuaaugaagu

SEQ ID NO: 21297 - RNA, 16 nt, Homo sapiens
aagauucuauguuaau

SEQ ID NO: 21298 - RNA, 22 nt, Homo sapiens
cacacucucccauuauauuuau

SEQ ID NO: 21299 - RNA, 17 nt, Homo sapiens
aucucauuuaauccucu

SEQ ID NO: 21300 - RNA, 14 nt, Homo sapiens
uagaugaaugucag

SEQ ID NO: 21301 - RNA, 16 nt, Homo sapiens
auaguaccucugcuau

SEQ ID NO: 21302 - RNA, 21 nt, Homo sapiens
cauacacaccccggacuccuc

SEQ ID NO: 21303 - RNA, 14 nt, Homo sapiens
agccucagcucuca

SEQ ID NO: 21304 - RNA, 15 nt, Homo sapiens
gauauucucuaguca

SEQ ID NO: 21305 - RNA, 21 nt, Homo sapiens
cucagcuaaugaaguguuuag

SEQ ID NO: 21306 - RNA, 13 nt, Homo sapiens
aaggagauuuaca

SEQ ID NO: 21307 - RNA, 12 nt, Homo sapiens
agauaccucucu

SEQ ID NO: 21308 - RNA, 22 nt, Homo sapiens
aacuuuuauaaacuuuaccuuu

SEQ ID NO: 21309 - RNA, 14 nt, Homo sapiens
aucuucacuuuuau

SEQ ID NO: 21310 - RNA, 23 nt, Homo sapiens
uuuagcauaguaccucugcuauu

SEQ ID NO: 21311 - RNA, 20 nt, Homo sapiens
acuguccuauuauauucauu

SEQ ID NO: 21312 - RNA, 15 nt, Homo sapiens
uucuuguaaggcaua

SEQ ID NO: 21313 - RNA, 14 nt, Homo sapiens
ccucucaaccaccu

SEQ ID NO: 21314 - RNA, 20 nt, Homo sapiens
cuuacguccuuccacuucca

SEQ ID NO: 21315 - RNA, 14 nt, Homo sapiens
ccucuauugccaug

SEQ ID NO: 21316 - RNA, 22 nt, Homo sapiens
auuucugaggagccugcaacau

SEQ ID NO: 21317 - RNA, 20 nt, Homo sapiens
aacaugccagccacugugau

SEQ ID NO: 21318 - RNA, 17 nt, Homo sapiens
ccagucauuauguuaau

SEQ ID NO: 21319 - RNA, 23 nt, Homo sapiens
ggcccuggccuagcauacguaca

SEQ ID NO: 21320 - RNA, 16 nt, Homo sapiens
uuauaguaaugugacu

SEQ ID NO: 21321 - RNA, 17 nt, Homo sapiens
cacaccccagacgaugu

SEQ ID NO: 21322 - RNA, 16 nt, Homo sapiens
acauguauguaaauag

SEQ ID NO: 21323 - RNA, 16 nt, Homo sapiens
caagaccacguuucua

SEQ ID NO: 21324 - RNA, 15 nt, Homo sapiens
acaguguuucuggcu

SEQ ID NO: 21325 - RNA, 17 nt, Homo sapiens
uauacauaaacaagacc

SEQ ID NO: 21326 - RNA, 17 nt, Homo sapiens
auguuuagcagauuuaa

SEQ ID NO: 21327 - RNA, 15 nt, Homo sapiens
aauaucuuaucuucc

SEQ ID NO: 21328 - RNA, 13 nt, Homo sapiens
cugccucaccucu

SEQ ID NO: 21329 - RNA, 19 nt, Homo sapiens
cuacaaaauauagcuuuca

SEQ ID NO: 21330 - RNA, 20 nt, Homo sapiens
uguaauuugugauacaaugc

SEQ ID NO: 21331 - RNA, 23 nt, Homo sapiens
acucuauaaauaaaaccugacag

SEQ ID NO: 21332 - RNA, 20 nt, Homo sapiens
cacuugguucuuguacucua

SEQ ID NO: 21333 - RNA, 22 nt, Homo sapiens
auaaaucgcuuuugauaaucaa

SEQ ID NO: 21334 - RNA, 14 nt, Homo sapiens
ucccaacuauaaaa

SEQ ID NO: 21335 - RNA, 19 nt, Homo sapiens
uuguauucucuccuguacc

SEQ ID NO: 21336 - RNA, 12 nt, Homo sapiens
gaauuuccuuac

SEQ ID NO: 21337 - RNA, 13 nt, Homo sapiens
cuugaauuguagg

SEQ ID NO: 21338 - RNA, 22 nt, Homo sapiens
gaagcauuuuauaaaucgcuuu

SEQ ID NO: 21339 - RNA, 16 nt, Homo sapiens
cagugagaucaaugug

SEQ ID NO: 21340 - RNA, 22 nt, Homo sapiens
gacugaguacguugugcauuug

SEQ ID NO: 21341 - RNA, 19 nt, Homo sapiens
agguaccagccuuggauac

SEQ ID NO: 21342 - RNA, 17 nt, Homo sapiens
caaguuguuugagaaau

SEQ ID NO: 21343 - RNA, 22 nt, Homo sapiens
ggaaucacuggcuguuaaucuu

SEQ ID NO: 21344 - RNA, 18 nt, Homo sapiens
cauaucacaugucagcca

SEQ ID NO: 21345 - RNA, 21 nt, Homo sapiens
caucuuucaagggaccucucc

SEQ ID NO: 21346 - RNA, 17 nt, Homo sapiens
aauuauauauacuauau

SEQ ID NO: 21347 - RNA, 22 nt, Homo sapiens
acucuacaaaauauagcuuuca

SEQ ID NO: 21348 - RNA, 19 nt, Homo sapiens
cuuucagauaacuguuauu

SEQ ID NO: 21349 - RNA, 18 nt, Homo sapiens
ugagacacaugggugcua

SEQ ID NO: 21350 - RNA, 15 nt, Homo sapiens
auaguggugugauuu

SEQ ID NO: 21351 - RNA, 19 nt, Homo sapiens
aaauucccuggccuuucau

SEQ ID NO: 21352 - RNA, 21 nt, Homo sapiens
cccagggcuugugugcacaua

SEQ ID NO: 21353 - RNA, 13 nt, Homo sapiens
cccgugugccuga

SEQ ID NO: 21354 - RNA, 18 nt, Homo sapiens
auuucuaaaucuccaaaa

SEQ ID NO: 21355 - RNA, 15 nt, Homo sapiens
gaaagucccagauca

SEQ ID NO: 21356 - RNA, 14 nt, Homo sapiens
uaaugugacuugga

SEQ ID NO: 21357 - RNA, 20 nt, Homo sapiens
ggaaauauuuuaauguuucu

SEQ ID NO: 21358 - RNA, 22 nt, Homo sapiens
gaccauaaccccggaagccaaa

SEQ ID NO: 21359 - RNA, 23 nt, Homo sapiens
ugggauacuauuuaauuauuuca

SEQ ID NO: 21360 - RNA, 14 nt, Homo sapiens
cgcuuaagcuuuca

SEQ ID NO: 21361 - RNA, 18 nt, Homo sapiens
gacauuuuaugucuuucu

SEQ ID NO: 21362 - RNA, 12 nt, Homo sapiens
ucuauugccaug

SEQ ID NO: 21363 - RNA, 19 nt, Homo sapiens
uaagauauuaacugagaag

SEQ ID NO: 21364 - RNA, 14 nt, Homo sapiens
aaacauguauguaa

SEQ ID NO: 21365 - RNA, 15 nt, Homo sapiens
ccaucauuuacuuuu

SEQ ID NO: 21366 - RNA, 19 nt, Homo sapiens
ccugagcggaccuucccag

SEQ ID NO: 21367 - RNA, 19 nt, Homo sapiens
uaaaugggggugcauuuga

SEQ ID NO: 21368 - RNA, 16 nt, Homo sapiens
acuguaauuugugaua

SEQ ID NO: 21369 - RNA, 13 nt, Homo sapiens
gcuaugcuauuga

SEQ ID NO: 21370 - RNA, 16 nt, Homo sapiens
uaucaauccaagaacu

SEQ ID NO: 21371 - RNA, 16 nt, Homo sapiens
aaaauaccagccagua

SEQ ID NO: 21372 - RNA, 16 nt, Homo sapiens
agaaaauggccaguga

SEQ ID NO: 21373 - RNA, 17 nt, Homo sapiens
cuuagcccaucuuucaa

SEQ ID NO: 21374 - RNA, 18 nt, Homo sapiens
uuuaaaguaaaggcaaac

SEQ ID NO: 21375 - RNA, 17 nt, Homo sapiens
guuauuuuaucugcuau

SEQ ID NO: 21376 - RNA, 18 nt, Homo sapiens
acuguuauuuauaaucac

SEQ ID NO: 21377 - RNA, 21 nt, Homo sapiens
ucauucuuuuugaaaugucaa

SEQ ID NO: 21378 - RNA, 16 nt, Homo sapiens
cauuucucauguugaa

SEQ ID NO: 21379 - RNA, 22 nt, Homo sapiens
cuucucagaaggcaaaugacuu

SEQ ID NO: 21380 - RNA, 16 nt, Homo sapiens
ugucagccacugugau

SEQ ID NO: 21381 - RNA, 17 nt, Homo sapiens
ugcccuaaaguguauuu

SEQ ID NO: 21382 - RNA, 15 nt, Homo sapiens
augauuucacagugu

SEQ ID NO: 21383 - RNA, 16 nt, Homo sapiens
aagaacuuauuuguac

SEQ ID NO: 21384 - RNA, 18 nt, Homo sapiens
cuauaaaacuaggugcug

SEQ ID NO: 21385 - RNA, 18 nt, Homo sapiens
uaacucuaccugcacacu

SEQ ID NO: 21386 - RNA, 16 nt, Homo sapiens
ucugaccuccuccuuc

SEQ ID NO: 21387 - RNA, 21 nt, Homo sapiens
cugugucucaggugugcccug

SEQ ID NO: 21388 - RNA, 19 nt, Homo sapiens
ucucuagucauuuguuaau

SEQ ID NO: 21389 - RNA, 14 nt, Homo sapiens
uauguaaauagcua

SEQ ID NO: 21390 - RNA, 16 nt, Homo sapiens
uguaaauagcuaagau

SEQ ID NO: 21391 - RNA, 22 nt, Homo sapiens
ccuccuccuucauggcaggcau

SEQ ID NO: 21392 - RNA, 21 nt, Homo sapiens
gagcuaggggggucagccagc

SEQ ID NO: 21393 - RNA, 12 nt, Homo sapiens
ccucaccucuca

SEQ ID NO: 21394 - RNA, 14 nt, Homo sapiens
ugccugcccugaaa

SEQ ID NO: 21395 - RNA, 15 nt, Homo sapiens
gucggaaaacaugcu

SEQ ID NO: 21396 - RNA, 13 nt, Homo sapiens
auagacaauuuau

SEQ ID NO: 21397 - RNA, 18 nt, Homo sapiens
ugaguacguugugcauuu

SEQ ID NO: 21398 - RNA, 21 nt, Homo sapiens
auacuauuuaauuauuucacu

SEQ ID NO: 21399 - RNA, 16 nt, Homo sapiens
gggcaagggaccugcu

SEQ ID NO: 21400 - RNA, 23 nt, Homo sapiens
gaaauacacuguuaucuucacuu

SEQ ID NO: 21401 - RNA, 20 nt, Homo sapiens
cuuuacuguccccaucauca

SEQ ID NO: 21402 - RNA, 17 nt, Homo sapiens
ucagaucucuaacuuca

SEQ ID NO: 21403 - RNA, 21 nt, Homo sapiens
ccugagcggaccuucccagcu

SEQ ID NO: 21404 - RNA, 19 nt, Homo sapiens
uccaaaggcuccugagaca

SEQ ID NO: 21405 - RNA, 19 nt, Homo sapiens
gagcuaggggggucagcca

SEQ ID NO: 21406 - RNA, 16 nt, Homo sapiens
acaugucagccacugu

SEQ ID NO: 21407 - RNA, 22 nt, Homo sapiens
agcucuaucccaaccucuccca

SEQ ID NO: 21408 - RNA, 21 nt, Homo sapiens
aauguucuccagucauuaugu

SEQ ID NO: 21409 - RNA, 19 nt, Homo sapiens
uggacaugggccccagaua

SEQ ID NO: 21410 - RNA, 12 nt, Homo sapiens
uuaucugcuaug

SEQ ID NO: 21411 - RNA, 23 nt, Homo sapiens
aguacacuguuucaaacuuuacu

SEQ ID NO: 21412 - RNA, 19 nt, Homo sapiens
cauaaccccggaagccaaa

SEQ ID NO: 21413 - RNA, 16 nt, Homo sapiens
cauguauuuguuugca

SEQ ID NO: 21414 - RNA, 15 nt, Homo sapiens
aaggcuccugagaca

SEQ ID NO: 21415 - RNA, 16 nt, Homo sapiens
caguaguuagcuuucu

SEQ ID NO: 21416 - RNA, 22 nt, Homo sapiens
agccuuuguugcuaucaaucca

SEQ ID NO: 21417 - RNA, 15 nt, Homo sapiens
ugauuucacagugug

SEQ ID NO: 21418 - RNA, 23 nt, Homo sapiens
aucaccaucaauuuuaguuguca

SEQ ID NO: 21419 - RNA, 21 nt, Homo sapiens
ugcuguuauuuuaucugcuau

SEQ ID NO: 21420 - RNA, 18 nt, Homo sapiens
ugccaucauuuacuuuua

SEQ ID NO: 21421 - RNA, 14 nt, Homo sapiens
gaaaguuuuggaaa

SEQ ID NO: 21422 - RNA, 16 nt, Homo sapiens
cacacuguccuauuau

SEQ ID NO: 21423 - RNA, 12 nt, Homo sapiens
ugugauugccau

SEQ ID NO: 21424 - RNA, 15 nt, Homo sapiens
aaugggggugcauuu

SEQ ID NO: 21425 - RNA, 18 nt, Homo sapiens
agcucuaucccaaccucu

SEQ ID NO: 21426 - RNA, 21 nt, Homo sapiens
ccaguaaaugggggugcauuu

SEQ ID NO: 21427 - RNA, 11 nt, Homo sapiens
uuccugcaaug

SEQ ID NO: 21428 - RNA, 16 nt, Homo sapiens
uucuuguacucuacaa

SEQ ID NO: 21429 - RNA, 16 nt, Homo sapiens
aaauggccaaugagau

SEQ ID NO: 21430 - RNA, 15 nt, Homo sapiens
cauaagaauucuguu

SEQ ID NO: 21431 - RNA, 15 nt, Homo sapiens
gaugaaugucaguug

SEQ ID NO: 21432 - RNA, 15 nt, Homo sapiens
cuuuuaaacuuugau

SEQ ID NO: 21433 - RNA, 19 nt, Homo sapiens
uuucuggcuaugcauuuga

SEQ ID NO: 21434 - RNA, 18 nt, Homo sapiens
caucuuucaagggaccuc

SEQ ID NO: 21435 - RNA, 22 nt, Homo sapiens
cauuugagcucuggaagccucu

SEQ ID NO: 21436 - RNA, 11 nt, Homo sapiens
uuuuuuaaaaa

SEQ ID NO: 21437 - RNA, 13 nt, Homo sapiens
uguguaaguagau

SEQ ID NO: 21438 - RNA, 13 nt, Homo sapiens
uggcaauagucaa

SEQ ID NO: 21439 - RNA, 16 nt, Homo sapiens
ugcuucuguuuuauaa

SEQ ID NO: 21440 - RNA, 13 nt, Homo sapiens
ugcuguauuuuaa

SEQ ID NO: 21441 - RNA, 20 nt, Homo sapiens
uuuguauaaaauaauuuuua

SEQ ID NO: 21442 - RNA, 19 nt, Homo sapiens
uuugcuaagcauuccaacu

SEQ ID NO: 21443 - RNA, 23 nt, Homo sapiens
uuugcuaagcauuccaacuaucu

SEQ ID NO: 21444 - RNA, 19 nt, Homo sapiens
uuucucuaggaaauauuua

SEQ ID NO: 21445 - RNA, 23 nt, Homo sapiens
uuucaaacauauauaacaaugcu

SEQ ID NO: 21446 - RNA, 21 nt, Homo sapiens
uuggagaagaacugaaaucau

SEQ ID NO: 21447 - RNA, 13 nt, Homo sapiens
uucuaugaaauau

SEQ ID NO: 21448 - RNA, 14 nt, Homo sapiens
uuauauuugaaaua

SEQ ID NO: 21449 - RNA, 18 nt, Homo sapiens
uuacauuuguauaaaaua

SEQ ID NO: 21450 - RNA, 16 nt, Homo sapiens
uguuuuaggaauacau

SEQ ID NO: 21451 - RNA, 13 nt, Homo sapiens
uauaauuuuguga

SEQ ID NO: 21452 - RNA, 17 nt, Homo sapiens
uagucucuaucauuaaa

SEQ ID NO: 21453 - RNA, 22 nt, Homo sapiens
uagugaaacucguuaauuugua

SEQ ID NO: 21454 - RNA, 13 nt, Homo sapiens
uaucacuugucaa

SEQ ID NO: 21455 - RNA, 13 nt, Homo sapiens
uaguaauuggaaa

SEQ ID NO: 21456 - RNA, 13 nt, Homo sapiens
uaggaaauauuua

SEQ ID NO: 21457 - RNA, 17 nt, Homo sapiens
uagauguauagguugau

SEQ ID NO: 21458 - RNA, 14 nt, Homo sapiens
uaaaguucuaguga

SEQ ID NO: 21459 - RNA, 14 nt, Homo sapiens
uaaaagaaugauua

SEQ ID NO: 21460 - RNA, 15 nt, Homo sapiens
uaaugauaacuggaa

SEQ ID NO: 21461 - RNA, 16 nt, Homo sapiens
uaaggggaauugagga

SEQ ID NO: 21462 - RNA, 11 nt, Homo sapiens
uaagaaaauau

SEQ ID NO: 21463 - RNA, 16 nt, Homo sapiens
ucagaaaacaaggaug

SEQ ID NO: 21464 - RNA, 17 nt, Homo sapiens
uaugccccauucaacau

SEQ ID NO: 21465 - RNA, 13 nt, Homo sapiens
ucauuaaaguucu

SEQ ID NO: 21466 - RNA, 15 nt, Homo sapiens
ugccccggggagggg

SEQ ID NO: 21467 - RNA, 14 nt, Homo sapiens
ugcacaucaaaaua

SEQ ID NO: 21468 - RNA, 16 nt, Homo sapiens
ugcauuauauuuauua

SEQ ID NO: 21469 - RNA, 17 nt, Homo sapiens
ugcauuuaauuuauuga

SEQ ID NO: 21470 - RNA, 13 nt, Homo sapiens
ugcaaauugucac

SEQ ID NO: 21471 - RNA, 14 nt, Homo sapiens
ugcaaauugucaca

SEQ ID NO: 21472 - RNA, 18 nt, Homo sapiens
ugaucagcuuauugucua

SEQ ID NO: 21473 - RNA, 11 nt, Homo sapiens
ucgcuuccgca

SEQ ID NO: 21474 - RNA, 12 nt, Homo sapiens
ucgcuuccgcau

SEQ ID NO: 21475 - RNA, 19 nt, Homo sapiens
ucgcuuccgcauccuaguc

SEQ ID NO: 21476 - RNA, 12 nt, Homo sapiens
ucucaauauuuc

SEQ ID NO: 21477 - RNA, 13 nt, Homo sapiens
ucucaauauuuca

SEQ ID NO: 21478 - RNA, 18 nt, Homo sapiens
ucuaucauuaaaguucua

SEQ ID NO: 21479 - RNA, 19 nt, Homo sapiens
ucuaugaaauauuauguua

SEQ ID NO: 21480 - RNA, 14 nt, Homo sapiens
ucuaccaaaaaucu

SEQ ID NO: 21481 - RNA, 16 nt, Homo sapiens
ucucuaggaaauauuu

SEQ ID NO: 21482 - RNA, 13 nt, Homo sapiens
ucugaagaagaug

SEQ ID NO: 21483 - RNA, 15 nt, Homo sapiens
gaaguaaauguuguu

SEQ ID NO: 21484 - RNA, 20 nt, Homo sapiens
gaaauauuuauuuuaauaau

SEQ ID NO: 21485 - RNA, 14 nt, Homo sapiens
gaacugaaaucaua

SEQ ID NO: 21486 - RNA, 21 nt, Homo sapiens
gaucaguaugaaaaugucauu

SEQ ID NO: 21487 - RNA, 13 nt, Homo sapiens
gcgcucgcuuccg

SEQ ID NO: 21488 - RNA, 21 nt, Homo sapiens
gcauccuagucucuaucauua

SEQ ID NO: 21489 - RNA, 17 nt, Homo sapiens
gggcauggguuuuauua

SEQ ID NO: 21490 - RNA, 18 nt, Homo sapiens
gggcauggguuuuauuau

SEQ ID NO: 21491 - RNA, 23 nt, Homo sapiens
gggcgcucgcuuccgcauccuag

SEQ ID NO: 21492 - RNA, 17 nt, Homo sapiens
gugcauauuuuauuaua

SEQ ID NO: 21493 - RNA, 16 nt, Homo sapiens
guuaugauuaaguaau

SEQ ID NO: 21494 - RNA, 14 nt, Homo sapiens
gugugggcaauguu

SEQ ID NO: 21495 - RNA, 11 nt, Homo sapiens
guuauuuuuaa

SEQ ID NO: 21496 - RNA, 19 nt, Homo sapiens
guugacaugggacauuugc

SEQ ID NO: 21497 - RNA, 12 nt, Homo sapiens
gcauauuuuauu

SEQ ID NO: 21498 - RNA, 14 nt, Homo sapiens
gcauuuaauuuauu

SEQ ID NO: 21499 - RNA, 16 nt, Homo sapiens
gcaguucugaagaaga

SEQ ID NO: 21500 - RNA, 16 nt, Homo sapiens
gccaugugcuaguaau

SEQ ID NO: 21501 - RNA, 20 nt, Homo sapiens
gccucagaaaacaaggauga

SEQ ID NO: 21502 - RNA, 18 nt, Homo sapiens
gacggagccgggaaagaa

SEQ ID NO: 21503 - RNA, 22 nt, Homo sapiens
acaagacugcacaucaaaauau

SEQ ID NO: 21504 - RNA, 13 nt, Homo sapiens
aauuggagcucgu

SEQ ID NO: 21505 - RNA, 14 nt, Homo sapiens
gaauaucaguuauu

SEQ ID NO: 21506 - RNA, 16 nt, Homo sapiens
gaagcaccaaucauga

SEQ ID NO: 21507 - RNA, 14 nt, Homo sapiens
cuaagcauuccaac

SEQ ID NO: 21508 - RNA, 14 nt, Homo sapiens
cgcucgcuuccgca

SEQ ID NO: 21509 - RNA, 20 nt, Homo sapiens
cuagucucuaucauuaaagu

SEQ ID NO: 21510 - RNA, 22 nt, Homo sapiens
cugauaugggucuugauaaaug

SEQ ID NO: 21511 - RNA, 21 nt, Homo sapiens
cucuaggaaauauuuauuuua

SEQ ID NO: 21512 - RNA, 17 nt, Homo sapiens
cuucuuucaugaagggg

SEQ ID NO: 21513 - RNA, 17 nt, Homo sapiens
cuucagcgguuuauaua

SEQ ID NO: 21514 - RNA, 12 nt, Homo sapiens
cuguaagaaaau

SEQ ID NO: 21515 - RNA, 16 nt, Homo sapiens
gaaauauuuauuuuaa

SEQ ID NO: 21516 - RNA, 19 nt, Homo sapiens
guaugaaaaugucauuguu

SEQ ID NO: 21517 - RNA, 21 nt, Homo sapiens
guagaggguguguaaguagau

SEQ ID NO: 21518 - RNA, 19 nt, Homo sapiens
guauuucuaugaaauauua

SEQ ID NO: 21519 - RNA, 20 nt, Homo sapiens
guauuuuaaaagaaugauua

SEQ ID NO: 21520 - RNA, 19 nt, Homo sapiens
gggcauggguuuuauuaua

SEQ ID NO: 21521 - RNA, 24 nt, Homo sapiens
gggcgcucgcuuccgcauccuagu

SEQ ID NO: 21522 - RNA, 13 nt, Homo sapiens
ugaagaaguugau

SEQ ID NO: 21523 - RNA, 15 nt, Homo sapiens
ugaauuacauuugua

SEQ ID NO: 21524 - RNA, 22 nt, Homo sapiens
ucucuccucuccccaugauguu

SEQ ID NO: 21525 - RNA, 23 nt, Homo sapiens
ucucuccucuccccaugauguuu

SEQ ID NO: 21526 - RNA, 12 nt, Homo sapiens
ucuaaaugucaa

SEQ ID NO: 21527 - RNA, 12 nt, Homo sapiens
ugcaaauuguca

SEQ ID NO: 21528 - RNA, 21 nt, Homo sapiens
ugccucagaaaacaaggauga

SEQ ID NO: 21529 - RNA, 13 nt, Homo sapiens
ugcauuauauuua

SEQ ID NO: 21530 - RNA, 13 nt, Homo sapiens
ucgcgcgccuccg

SEQ ID NO: 21531 - RNA, 18 nt, Homo sapiens
ucgcuuccgcauccuagu

SEQ ID NO: 21532 - RNA, 20 nt, Homo sapiens
ucgcuuccgcauccuagucu

SEQ ID NO: 21533 - RNA, 13 nt, Homo sapiens
ucauggaauugga

SEQ ID NO: 21534 - RNA, 21 nt, Homo sapiens
ucauuaaauggaaguaaaugu

SEQ ID NO: 21535 - RNA, 22 nt, Homo sapiens
ucauuaaauggaaguaaauguu

SEQ ID NO: 21536 - RNA, 18 nt, Homo sapiens
ucaaucagccuaguugau

SEQ ID NO: 21537 - RNA, 14 nt, Homo sapiens
ucaaacauauauaa

SEQ ID NO: 21538 - RNA, 17 nt, Homo sapiens
ucacaggggacaggaug

SEQ ID NO: 21539 - RNA, 15 nt, Homo sapiens
uauuuuuuuuuuuaa

SEQ ID NO: 21540 - RNA, 16 nt, Homo sapiens
uauguuaaaacuggga

SEQ ID NO: 21541 - RNA, 12 nt, Homo sapiens
uaugaaauauua

SEQ ID NO: 21542 - RNA, 22 nt, Homo sapiens
uaguguuggagaagaacugaaa

SEQ ID NO: 21543 - RNA, 13 nt, Homo sapiens
uauaaaauaauuu

SEQ ID NO: 21544 - RNA, 12 nt, Homo sapiens
uauaauuuugug

SEQ ID NO: 21545 - RNA, 23 nt, Homo sapiens
uauaauuuugugaagcaaaauuu

SEQ ID NO: 21546 - RNA, 23 nt, Homo sapiens
uagucacuaguuguaauuuuuuu

SEQ ID NO: 21547 - RNA, 15 nt, Homo sapiens
uaauguuucaaacau

SEQ ID NO: 21548 - RNA, 16 nt, Homo sapiens
uaaugauaacuggaaa

SEQ ID NO: 21549 - RNA, 13 nt, Homo sapiens
uacgcgcgcuccg

SEQ ID NO: 21550 - RNA, 15 nt, Homo sapiens
gugcauauuuuauua

SEQ ID NO: 21551 - RNA, 16 nt, Homo sapiens
gugcauauuuuauuau

SEQ ID NO: 21552 - RNA, 14 nt, Homo sapiens
uaaaauaauuuuua

SEQ ID NO: 21553 - RNA, 20 nt, Homo sapiens
guuuugcaagccagauuuuc

SEQ ID NO: 21554 - RNA, 13 nt, Homo sapiens
cagcuuauugucu

SEQ ID NO: 21555 - RNA, 17 nt, Homo sapiens
caggaaccacaagacug

SEQ ID NO: 21556 - RNA, 14 nt, Homo sapiens
cauuuguauaaaau

SEQ ID NO: 21557 - RNA, 15 nt, Homo sapiens
cauuuguauaaaaua

SEQ ID NO: 21558 - RNA, 22 nt, Homo sapiens
ccacagcuguaugauucccagc

SEQ ID NO: 21559 - RNA, 14 nt, Homo sapiens
cauuauauuuauua

SEQ ID NO: 21560 - RNA, 13 nt, Homo sapiens
cauuaaaguucua

SEQ ID NO: 21561 - RNA, 11 nt, Homo sapiens
ccuaauuuguu

SEQ ID NO: 21562 - RNA, 15 nt, Homo sapiens
ccuagggugauauua

SEQ ID NO: 21563 - RNA, 12 nt, Homo sapiens
ccuuuucccaac

SEQ ID NO: 21564 - RNA, 22 nt, Homo sapiens
ccucagaaaacaaggaugaauu

SEQ ID NO: 21565 - RNA, 12 nt, Homo sapiens
ccuccagcugcc

SEQ ID NO: 21566 - RNA, 13 nt, Homo sapiens
cucuaggaaauau

SEQ ID NO: 21567 - RNA, 17 nt, Homo sapiens
cucuaggaaauauuuau

SEQ ID NO: 21568 - RNA, 21 nt, Homo sapiens
cugauaugggucuugauaaau

SEQ ID NO: 21569 - RNA, 16 nt, Homo sapiens
cuucuuucaugaaggg

SEQ ID NO: 21570 - RNA, 18 nt, Homo sapiens
cuucagcgguuuauauaa

SEQ ID NO: 21571 - RNA, 15 nt, Homo sapiens
cgcucgcuuccgcau

SEQ ID NO: 21572 - RNA, 12 nt, Homo sapiens
cgcucaucccac

SEQ ID NO: 21573 - RNA, 13 nt, Homo sapiens
cgcucaucccacc

SEQ ID NO: 21574 - RNA, 14 nt, Homo sapiens
uguauuuuaaaaga

SEQ ID NO: 21575 - RNA, 20 nt, Homo sapiens
ugucaauaaaauccauacau

SEQ ID NO: 21576 - RNA, 20 nt, Homo sapiens
uucaaauccuugaagauuua

SEQ ID NO: 21577 - RNA, 15 nt, Homo sapiens
uuauauuugaaauau

SEQ ID NO: 21578 - RNA, 16 nt, Homo sapiens
uuauauuugaaauauu

SEQ ID NO: 21579 - RNA, 24 nt, Homo sapiens
uuagcuggaaaaguauguuagugc

SEQ ID NO: 21580 - RNA, 18 nt, Homo sapiens
uuaccacuuguguuuugc

SEQ ID NO: 21581 - RNA, 14 nt, Homo sapiens
uucuaugaaauauu

SEQ ID NO: 21582 - RNA, 21 nt, Homo sapiens
uuccaagcaaguauuagaaua

SEQ ID NO: 21583 - RNA, 16 nt, Homo sapiens
accagucugacuguuu

SEQ ID NO: 21584 - RNA, 21 nt, Homo sapiens
uugaugaagaaguugauaugc

SEQ ID NO: 21585 - RNA, 12 nt, Homo sapiens
agauccuggaaa

SEQ ID NO: 21586 - RNA, 15 nt, Homo sapiens
agauaaucacaauac

SEQ ID NO: 21587 - RNA, 15 nt, Homo sapiens
agaaaauaucacuug

SEQ ID NO: 21588 - RNA, 15 nt, Homo sapiens
agaagaacugaaauc

SEQ ID NO: 21589 - RNA, 20 nt, Homo sapiens
agccagauuuuccugaaaac

SEQ ID NO: 21590 - RNA, 12 nt, Homo sapiens
uuuuuuaaaaaa

SEQ ID NO: 21591 - RNA, 21 nt, Homo sapiens
uuugcuaagcauuccaacuau

SEQ ID NO: 21592 - RNA, 16 nt, Homo sapiens
uuucuaugaaauauua

SEQ ID NO: 21593 - RNA, 19 nt, Homo sapiens
uuuauauuugaaauauuga

SEQ ID NO: 21594 - RNA, 12 nt, Homo sapiens
uuuagcuggaaa

SEQ ID NO: 21595 - RNA, 21 nt, Homo sapiens
acguauugcauuuaauuuauu

SEQ ID NO: 21596 - RNA, 14 nt, Homo sapiens
acugcauuauauuu

SEQ ID NO: 21597 - RNA, 15 nt, Homo sapiens
acugcauuauauuua

SEQ ID NO: 21598 - RNA, 13 nt, Homo sapiens
acucuuaagaaga

SEQ ID NO: 21599 - RNA, 20 nt, Homo sapiens
aucaggguuaguauugucca

SEQ ID NO: 21600 - RNA, 18 nt, Homo sapiens
auauuuuuuuuuuuaaaa

SEQ ID NO: 21601 - RNA, 22 nt, Homo sapiens
auauuuauuacuguaagaaaau

SEQ ID NO: 21602 - RNA, 11 nt, Homo sapiens
aucucaauauu

SEQ ID NO: 21603 - RNA, 12 nt, Homo sapiens
aucucaauauuu

SEQ ID NO: 21604 - RNA, 21 nt, Homo sapiens
auaugcuucuguuuuauaauu

SEQ ID NO: 21605 - RNA, 19 nt, Homo sapiens
auaaaauaauuuuuauauu

SEQ ID NO: 21606 - RNA, 22 nt, Homo sapiens
auaagcuuguauuccuuuuucu

SEQ ID NO: 21607 - RNA, 14 nt, Homo sapiens
auauauauuuuuuu

SEQ ID NO: 21608 - RNA, 13 nt, Homo sapiens
auauauuuuuuuu

SEQ ID NO: 21609 - RNA, 14 nt, Homo sapiens
caacuauauuguuu

SEQ ID NO: 21610 - RNA, 13 nt, Homo sapiens
auuacauuuguau

SEQ ID NO: 21611 - RNA, 22 nt, Homo sapiens
augcuguauuuuaaaagaauga

SEQ ID NO: 21612 - RNA, 19 nt, Homo sapiens
augcaguucugaagaagau

SEQ ID NO: 21613 - RNA, 14 nt, Homo sapiens
auggugguauguuu

SEQ ID NO: 21614 - RNA, 23 nt, Homo sapiens
cauacuucuuaggguuaugauua

SEQ ID NO: 21615 - RNA, 14 nt, Homo sapiens
cauauauaacaaug

SEQ ID NO: 21616 - RNA, 12 nt, Homo sapiens
cauuauauuuau

SEQ ID NO: 21617 - RNA, 14 nt, Homo sapiens
cauuaaaguucuag

SEQ ID NO: 21618 - RNA, 18 nt, Homo sapiens
caugugcuaguaauugga

SEQ ID NO: 21619 - RNA, 19 nt, Homo sapiens
caugugcuaguaauuggaa

SEQ ID NO: 21620 - RNA, 17 nt, Homo sapiens
auuaugaauuacauuug

SEQ ID NO: 21621 - RNA, 15 nt, Homo sapiens
auuaaaguucuagug

SEQ ID NO: 21622 - RNA, 16 nt, Homo sapiens
auuuuaaaagaaugau

SEQ ID NO: 21623 - RNA, 17 nt, Homo sapiens
auuuaccacuuguguuu

SEQ ID NO: 21624 - RNA, 12 nt, Homo sapiens
auuuauuuuaau

SEQ ID NO: 21625 - RNA, 13 nt, Homo sapiens
auuuauuuuaaua

SEQ ID NO: 21626 - RNA, 13 nt, Homo sapiens
caacuauauuguu

SEQ ID NO: 21627 - RNA, 12 nt, Homo sapiens
auuuuuauauuu

SEQ ID NO: 21628 - RNA, 15 nt, Homo sapiens
auuuuaauaauguuu

SEQ ID NO: 21629 - RNA, 20 nt, Homo sapiens
cacgcucugggucgccggca

SEQ ID NO: 21630 - RNA, 15 nt, Homo sapiens
cacugccuucucaac

SEQ ID NO: 21631 - RNA, 18 nt, Homo sapiens
aguauuucuaugaaauau

SEQ ID NO: 21632 - RNA, 14 nt, Homo sapiens
auauauuuuuuuuu

SEQ ID NO: 21633 - RNA, 15 nt, Homo sapiens
auauauuuuuuuuuu

SEQ ID NO: 21634 - RNA, 16 nt, Homo sapiens
auauauuuuuuuuuuu

SEQ ID NO: 21635 - RNA, 22 nt, Homo sapiens
auaauuuuuauauuugaaauau

SEQ ID NO: 21636 - RNA, 18 nt, Homo sapiens
auaaaauccauacauuug

SEQ ID NO: 21637 - RNA, 14 nt, Homo sapiens
aguuauuuuuaaac

SEQ ID NO: 21638 - RNA, 15 nt, Homo sapiens
aguuauuuuuaaacu

SEQ ID NO: 21639 - RNA, 15 nt, Homo sapiens
augaauuacauuugu

SEQ ID NO: 21640 - RNA, 15 nt, Homo sapiens
augaaguccaagcau

SEQ ID NO: 21641 - RNA, 17 nt, Homo sapiens
augaauuaaguuuuuuu

SEQ ID NO: 21642 - RNA, 18 nt, Homo sapiens
augaauuaaguuuuuuuu

SEQ ID NO: 21643 - RNA, 19 nt, Homo sapiens
augaauuaaguuuuuuuuu

SEQ ID NO: 21644 - RNA, 13 nt, Homo sapiens
augggacauuugc

SEQ ID NO: 21645 - RNA, 13 nt, Homo sapiens
aucuuguaaaggu

SEQ ID NO: 21646 - RNA, 14 nt, Homo sapiens
auccauacauuugu

SEQ ID NO: 21647 - RNA, 15 nt, Homo sapiens
auauugacuuuuuau

SEQ ID NO: 21648 - RNA, 21 nt, Homo sapiens
auauuucagauaaucacaaua

SEQ ID NO: 21649 - RNA, 15 nt, Homo sapiens
aaaaagaaacauuug

SEQ ID NO: 21650 - RNA, 16 nt, Homo sapiens
aaacguauugcauuua

SEQ ID NO: 21651 - RNA, 16 nt, Homo sapiens
aaagaaacauuuggua

SEQ ID NO: 21652 - RNA, 18 nt, Homo sapiens
aaauaauuuuuauauuug

SEQ ID NO: 21653 - RNA, 21 nt, Homo sapiens
aaaguaugugcauauuuuauu

SEQ ID NO: 21654 - RNA, 17 nt, Homo sapiens
aaagugugacucauuaa

SEQ ID NO: 21655 - RNA, 22 nt, Homo sapiens
aaauguugacaugggacauuug

SEQ ID NO: 21656 - RNA, 17 nt, Homo sapiens
aaacguauugcauuuaa

SEQ ID NO: 21657 - RNA, 15 nt, Homo sapiens
aacuauauuguuugc

SEQ ID NO: 21658 - RNA, 15 nt, Homo sapiens
aacuccagaaaguga

SEQ ID NO: 21659 - RNA, 20 nt, Homo sapiens
aagacugcacaucaaaauau

SEQ ID NO: 21660 - RNA, 17 nt, Homo sapiens
accaaaaaucucaauau

SEQ ID NO: 21661 - RNA, 21 nt, Homo sapiens
aauaugccccauucaacaucu

SEQ ID NO: 21662 - RNA, 19 nt, Homo sapiens
aauuuuuucucuaggaaau

SEQ ID NO: 21663 - RNA, 16 nt, Homo sapiens
acuaguuguaauuuuu

SEQ ID NO: 21664 - RNA, 17 nt, Homo sapiens
acuaguuguaauuuuuu

SEQ ID NO: 21665 - RNA, 20 nt, Homo sapiens
acguauugcauuuaauuuau

SEQ ID NO: 21666 - RNA, 14 nt, Homo sapiens
acucauuaaaugga

SEQ ID NO: 21667 - RNA, 14 nt, Homo sapiens
agaaacacaacuau

SEQ ID NO: 21668 - RNA, 12 nt, Homo sapiens
agaaacauuugg

SEQ ID NO: 21669 - RNA, 18 nt, Homo sapiens
agaaugauuaugaauuac

SEQ ID NO: 21670 - RNA, 17 nt, Homo sapiens
agcagucaggaaagaga

SEQ ID NO: 21671 - RNA, 19 nt, Homo sapiens
accauuuuugaaaccaaac

SEQ ID NO: 21672 - RNA, 20 nt, Homo sapiens
cggggaggggcgcucgcuuc

SEQ ID NO: 21673 - RNA, 17 nt, Homo sapiens
uccagcugccccgggga

SEQ ID NO: 21674 - RNA, 22 nt, Homo sapiens
gagaccaaggcccccgggccga

SEQ ID NO: 21675 - RNA, 14 nt, Homo sapiens
uaaaguaugugcau

SEQ ID NO: 21676 - RNA, 18 nt, Homo sapiens
aguaugaaaaugucauug

SEQ ID NO: 21677 - RNA, 14 nt, Homo sapiens
aaaguucuagugac

SEQ ID NO: 21678 - RNA, 19 nt, Homo sapiens
agccgggaaagaagagccg

SEQ ID NO: 21679 - RNA, 23 nt, Homo sapiens
cuaguuguaauuuuuuuguggga

SEQ ID NO: 21680 - RNA, 23 nt, Homo sapiens
aacccaaagugugacucauuaaa

SEQ ID NO: 21681 - RNA, 16 nt, Homo sapiens
aaagcuuugugcagau

SEQ ID NO: 21682 - RNA, 13 nt, Homo sapiens
ggggaggggcgcu

SEQ ID NO: 21683 - RNA, 21 nt, Homo sapiens
cuggcugcgcucggccugcuc

SEQ ID NO: 21684 - RNA, 23 nt, Homo sapiens
agcgcgcgcgcccucuggcugcu

SEQ ID NO: 21685 - RNA, 14 nt, Homo sapiens
gugugacucauuaa

SEQ ID NO: 21686 - RNA, 15 nt, Homo sapiens
cuccgcuacuuccag

SEQ ID NO: 21687 - RNA, 22 nt, Homo sapiens
ugaacugcagcgaguacuuccc

SEQ ID NO: 21688 - RNA, 22 nt, Homo sapiens
ucauuguucuugugaacccaaa

SEQ ID NO: 21689 - RNA, 21 nt, Homo sapiens
aaccagagccugaguguugcc

SEQ ID NO: 21690 - RNA, 12 nt, Homo sapiens
accucauuauca

SEQ ID NO: 21691 - RNA, 23 nt, Homo sapiens
uaaaaaaaaaacguauugcauuu

SEQ ID NO: 21692 - RNA, 17 nt, Homo sapiens
ucauuaaaguucuagug

SEQ ID NO: 21693 - RNA, 18 nt, Homo sapiens
ugaucaguaugaaaaugu

SEQ ID NO: 21694 - RNA, 23 nt, Homo sapiens
uugcauuuaauuuauugaggcuu

SEQ ID NO: 21695 - RNA, 19 nt, Homo sapiens
cgcucaucccacccgccca

SEQ ID NO: 21696 - RNA, 19 nt, Homo sapiens
ucuuacaaugcauucugag

SEQ ID NO: 21697 - RNA, 16 nt, Homo sapiens
cgugugggcaauguuc

SEQ ID NO: 21698 - RNA, 15 nt, Homo sapiens
cagcugccccgggga

SEQ ID NO: 21699 - RNA, 16 nt, Homo sapiens
caugaauaucaguuau

SEQ ID NO: 21700 - RNA, 22 nt, Homo sapiens
ucuuguaaagguccuggcaaag

SEQ ID NO: 21701 - RNA, 17 nt, Homo sapiens
caggaccaucccggccg

SEQ ID NO: 21702 - RNA, 12 nt, Homo sapiens
caucuucuuuca

SEQ ID NO: 21703 - RNA, 18 nt, Homo sapiens
agagccggagccuccagc

SEQ ID NO: 21704 - RNA, 17 nt, Homo sapiens
uauagucacuaguugua

SEQ ID NO: 21705 - RNA, 15 nt, Homo sapiens
uaaaguaugugcaua

SEQ ID NO: 21706 - RNA, 16 nt, Homo sapiens
ccgcauccuagucucu

SEQ ID NO: 21707 - RNA, 11 nt, Homo sapiens
acaaugcauuc

SEQ ID NO: 21708 - RNA, 13 nt, Homo sapiens
aucaguccaaagg

SEQ ID NO: 21709 - RNA, 15 nt, Homo sapiens
gcucgcccacuuccu

SEQ ID NO: 21710 - RNA, 16 nt, Homo sapiens
gccuccgcuacuucca

SEQ ID NO: 21711 - RNA, 22 nt, Homo sapiens
cauccuagucucuaucauuaaa

SEQ ID NO: 21712 - RNA, 23 nt, Homo sapiens
gggcgcucgcuuccgcauccuag

SEQ ID NO: 21713 - RNA, 16 nt, Homo sapiens
auucgauccccuguca

SEQ ID NO: 21714 - RNA, 17 nt, Homo sapiens
cacacugagcugagggg

SEQ ID NO: 21715 - RNA, 22 nt, Homo sapiens
aauacauaaaguaugugcauau

SEQ ID NO: 21716 - RNA, 20 nt, Homo sapiens
uacauaaaguaugugcauau

SEQ ID NO: 21717 - RNA, 15 nt, Homo sapiens
caggcggguccgggu

SEQ ID NO: 21718 - RNA, 16 nt, Homo sapiens
cucaggcuggcaccgc

SEQ ID NO: 21719 - RNA, 19 nt, Homo sapiens
uuucccuucuuacaaugca

SEQ ID NO: 21720 - RNA, 17 nt, Homo sapiens
gaauacauaaaguaugu

SEQ ID NO: 21721 - RNA, 15 nt, Homo sapiens
cuugugaacccaaag

SEQ ID NO: 21722 - RNA, 18 nt, Homo sapiens
gcccacuuccucccggcc

SEQ ID NO: 21723 - RNA, 21 nt, Homo sapiens
agagccugaguguugccuaau

SEQ ID NO: 21724 - RNA, 14 nt, Homo sapiens
cuccgcuacuucca

SEQ ID NO: 21725 - RNA, 14 nt, Homo sapiens
aaaaacguauugca

SEQ ID NO: 21726 - RNA, 16 nt, Homo sapiens
ucuaucauuaaaguuc

SEQ ID NO: 21727 - RNA, 19 nt, Homo sapiens
ggcuuuaaaacuuauccuc

SEQ ID NO: 21728 - RNA, 15 nt, Homo sapiens
gccccaauucgaucc

SEQ ID NO: 21729 - RNA, 17 nt, Homo sapiens
cggagccuccagcugcc

SEQ ID NO: 21730 - RNA, 12 nt, Homo sapiens
augcauucugag

SEQ ID NO: 21731 - RNA, 22 nt, Homo sapiens
cuaauuuguuuucccuucuuac

SEQ ID NO: 21732 - RNA, 14 nt, Homo sapiens
uggcgcuggcugcg

SEQ ID NO: 21733 - RNA, 13 nt, Homo sapiens
agccuccagcugc

SEQ ID NO: 21734 - RNA, 16 nt, Homo sapiens
aucuucuuucaugaag

SEQ ID NO: 21735 - RNA, 22 nt, Homo sapiens
auuuuuuugugggaaauccaca

SEQ ID NO: 21736 - RNA, 15 nt, Homo sapiens
agugugacucauuaa

SEQ ID NO: 21737 - RNA, 13 nt, Homo sapiens
uuccucgccacgc

SEQ ID NO: 21738 - RNA, 18 nt, Homo sapiens
ugugaacccaaaguguga

SEQ ID NO: 21739 - RNA, 18 nt, Homo sapiens
uagucucuaucauuaaag

SEQ ID NO: 21740 - RNA, 16 nt, Homo sapiens
gggugaacugcagcga

SEQ ID NO: 21741 - RNA, 20 nt, Homo sapiens
ggccugcucgcccacuuccu

SEQ ID NO: 21742 - RNA, 22 nt, Homo sapiens
auccuagucucuaucauuaaag

SEQ ID NO: 21743 - RNA, 19 nt, Homo sapiens
aacccaaagugugacucau

SEQ ID NO: 21744 - RNA, 19 nt, Homo sapiens
uggcaaagaugaucaguau

SEQ ID NO: 21745 - RNA, 17 nt, Homo sapiens
cuuccgcauccuagucu

SEQ ID NO: 21746 - RNA, 13 nt, Homo sapiens
uccgcauccuagu

SEQ ID NO: 21747 - RNA, 23 nt, Homo sapiens
auucugagguaaccucauuauca

SEQ ID NO: 21748 - RNA, 14 nt, Homo sapiens
aaaacguauugcau

SEQ ID NO: 21749 - RNA, 17 nt, Homo sapiens
guaaagcuuugugcaga

SEQ ID NO: 21750 - RNA, 14 nt, Homo sapiens
cgauccccugucac

SEQ ID NO: 21751 - RNA, 18 nt, Homo sapiens
uauccuccaugaauauca

SEQ ID NO: 21752 - RNA, 21 nt, Homo sapiens
gcucgcuuccgcauccuaguc

SEQ ID NO: 21753 - RNA, 19 nt, Homo sapiens
cccuucuuacaaugcauuc

SEQ ID NO: 21754 - RNA, 18 nt, Homo sapiens
gcuuccgcauccuagucu

SEQ ID NO: 21755 - RNA, 15 nt, Homo sapiens
cagcgaguacuuccc

SEQ ID NO: 21756 - RNA, 21 nt, Homo sapiens
ugugcggccuggucuaccugu

SEQ ID NO: 21757 - RNA, 13 nt, Homo sapiens
gagccuccagcug

SEQ ID NO: 21758 - RNA, 22 nt, Homo sapiens
uccuccaugaauaucaguuauu

SEQ ID NO: 21759 - RNA, 19 nt, Homo sapiens
augucauuguucuugugaa

SEQ ID NO: 21760 - RNA, 17 nt, Homo sapiens
gcaaagaugaucaguau

SEQ ID NO: 21761 - RNA, 12 nt, Homo sapiens
ucucuaucauua

SEQ ID NO: 21762 - RNA, 23 nt, Homo sapiens
agaagagccggagccuccagcug

SEQ ID NO: 21763 - RNA, 15 nt, Homo sapiens
auaaaguaugugcau

SEQ ID NO: 21764 - RNA, 13 nt, Homo sapiens
uggaaucuuguaa

SEQ ID NO: 21765 - RNA, 19 nt, Homo sapiens
uacauaaaguaugugcaua

SEQ ID NO: 21766 - RNA, 23 nt, Homo sapiens
aaaaugucauuguucuugugaac

SEQ ID NO: 21767 - RNA, 19 nt, Homo sapiens
caaagaugaucaguaugaa

SEQ ID NO: 21768 - RNA, 11 nt, Homo sapiens
agccggagccu

SEQ ID NO: 21769 - RNA, 20 nt, Homo sapiens
cuguaaagcuuugugcagau

SEQ ID NO: 21770 - RNA, 22 nt, Homo sapiens
agucucuaucauuaaaguucua

SEQ ID NO: 21771 - RNA, 23 nt, Homo sapiens
uaauuuuuuugugggaaauccac

SEQ ID NO: 21772 - RNA, 11 nt, Homo sapiens
caaagugugac

SEQ ID NO: 21773 - RNA, 18 nt, Homo sapiens
cugcagcgaguacuuccc

SEQ ID NO: 21774 - RNA, 20 nt, Homo sapiens
cauuguucuugugaacccaa

SEQ ID NO: 21775 - RNA, 17 nt, Homo sapiens
aaacguauugcauuuaa

SEQ ID NO: 21776 - RNA, 13 nt, Homo sapiens
uccgcuacuucca

SEQ ID NO: 21777 - RNA, 15 nt, Homo sapiens
ugaauaucaguuauu

SEQ ID NO: 21778 - RNA, 12 nt, Homo sapiens
uuaucaguccaa

SEQ ID NO: 21779 - RNA, 15 nt, Homo sapiens
cggccugcucgccca

SEQ ID NO: 21780 - RNA, 12 nt, Homo sapiens
ccgcuacuucca

SEQ ID NO: 21781 - RNA, 20 nt, Homo sapiens
aauacauaaaguaugugcau

SEQ ID NO: 21782 - RNA, 13 nt, Homo sapiens
aguaugugcauau

SEQ ID NO: 21783 - RNA, 17 nt, Homo sapiens
uaaagguccuggcaaag

SEQ ID NO: 21784 - RNA, 23 nt, Homo sapiens
agguccuggcaaagaugaucagu

SEQ ID NO: 21785 - RNA, 16 nt, Homo sapiens
uuccgcauccuagucu

SEQ ID NO: 21786 - RNA, 19 nt, Homo sapiens
aaauguuguuuuaggaaua

SEQ ID NO: 21787 - RNA, 13 nt, Homo sapiens
uaucaguccaaag

SEQ ID NO: 21788 - RNA, 17 nt, Homo sapiens
uuugaaaccaaaccaga

SEQ ID NO: 21789 - RNA, 17 nt, Homo sapiens
cgccuccgcuacuucca

SEQ ID NO: 21790 - RNA, 18 nt, Homo sapiens
ucuaucauuaaaguucua

SEQ ID NO: 21791 - RNA, 24 nt, Homo sapiens
aauacauaaaguaugugcauauuu

SEQ ID NO: 21792 - RNA, 17 nt, Homo sapiens
aucaguccaaagggcau

SEQ ID NO: 21793 - RNA, 15 nt, Homo sapiens
cggagccuccagcug

SEQ ID NO: 21794 - RNA, 23 nt, Homo sapiens
ugcauucugagguaaccucauua

SEQ ID NO: 21795 - RNA, 22 nt, Homo sapiens
ugaggcuuuaaaacuuauccuc

SEQ ID NO: 21796 - RNA, 15 nt, Homo sapiens
gcgcgcucaucccac

SEQ ID NO: 21797 - RNA, 21 nt, Homo sapiens
cauuguucuugugaacccaaa

SEQ ID NO: 21798 - RNA, 15 nt, Homo sapiens
aaaaacguauugcau

SEQ ID NO: 21799 - RNA, 18 nt, Homo sapiens
aagagccggagccuccag

SEQ ID NO: 21800 - RNA, 20 nt, Homo sapiens
agccggagccuccagcugcc

SEQ ID NO: 21801 - RNA, 11 nt, Homo sapiens
cgcuacuucca

SEQ ID NO: 21802 - RNA, 21 nt, Homo sapiens
gcuccucggacggcuccggac

SEQ ID NO: 21803 - RNA, 22 nt, Homo sapiens
gcucgcuuccgcauccuagucu

SEQ ID NO: 21804 - RNA, 21 nt, Homo sapiens
ucgauccccugucacgugugg

SEQ ID NO: 21805 - RNA, 16 nt, Homo sapiens
ccggagccuccagcug

SEQ ID NO: 21806 - RNA, 20 nt, Homo sapiens
ccgcagggugaacugcagcg

SEQ ID NO: 21807 - RNA, 13 nt, Homo sapiens
uuuauuauauaua

SEQ ID NO: 21808 - RNA, 16 nt, Homo sapiens
uaaaguaugugcauau

SEQ ID NO: 21809 - RNA, 23 nt, Homo sapiens
uccccugucacgugugggcaaug

SEQ ID NO: 21810 - RNA, 18 nt, Homo sapiens
accauuuuugaaaccaaa

SEQ ID NO: 21811 - RNA, 14 nt, Homo sapiens
aaguaugugcauau

SEQ ID NO: 21812 - RNA, 12 nt, Homo sapiens
aaagaagagccg

SEQ ID NO: 21813 - RNA, 22 nt, Homo sapiens
uaaaaaaaaaacguauugcauu

SEQ ID NO: 21814 - RNA, 16 nt, Homo sapiens
auuaaaguucuaguga

SEQ ID NO: 21815 - RNA, 23 nt, Homo sapiens
uacuucccgcuguuccucgccac

SEQ ID NO: 21816 - RNA, 11 nt, Homo sapiens
aacccaaagug

SEQ ID NO: 21817 - RNA, 16 nt, Homo sapiens
caaugcauucugaggu

SEQ ID NO: 21818 - RNA, 22 nt, Homo sapiens
aaaugucauuguucuugugaac

SEQ ID NO: 21819 - RNA, 11 nt, Homo sapiens
gcauccuaguc

SEQ ID NO: 21820 - RNA, 16 nt, Homo sapiens
auccacacugagcuga

SEQ ID NO: 21821 - RNA, 19 nt, Homo sapiens
cccucuccucucuuccucc

SEQ ID NO: 21822 - RNA, 19 nt, Homo sapiens
cggcgggagggcgcggggc

SEQ ID NO: 21823 - RNA, 15 nt, Homo sapiens
cucgcccacuuccuc

SEQ ID NO: 21824 - RNA, 21 nt, Homo sapiens
aagagccggagccuccagcug

SEQ ID NO: 21825 - RNA, 17 nt, Homo sapiens
ucauuguucuugugaac

SEQ ID NO: 21826 - RNA, 16 nt, Homo sapiens
ccauuuuugaaaccaa

SEQ ID NO: 21827 - RNA, 20 nt, Homo sapiens
ugcgcucggccugcucgccc

SEQ ID NO: 21828 - RNA, 19 nt, Homo sapiens
cauauuuuauuauagucac

SEQ ID NO: 21829 - RNA, 19 nt, Homo sapiens
aggaauacauaaaguaugu

SEQ ID NO: 21830 - RNA, 13 nt, Homo sapiens
gaccaucccggcc

SEQ ID NO: 21831 - RNA, 14 nt, Homo sapiens
ggagccuccagcug

SEQ ID NO: 21832 - RNA, 13 nt, Homo sapiens
gccccaauucgau

SEQ ID NO: 21833 - RNA, 17 nt, Homo sapiens
cccaaagugugacucau

SEQ ID NO: 21834 - RNA, 18 nt, Homo sapiens
cugucacgugugggcaau

SEQ ID NO: 21835 - RNA, 21 nt, Homo sapiens
uccaaagggcauggguuuuau

SEQ ID NO: 21836 - RNA, 15 nt, Homo sapiens
gacgcugcugccgug

SEQ ID NO: 21837 - RNA, 16 nt, Homo sapiens
ucuuccucccuggaau

SEQ ID NO: 21838 - RNA, 15 nt, Homo sapiens
cuuauccuccaugaa

SEQ ID NO: 21839 - RNA, 16 nt, Homo sapiens
uucugagguaaccuca

SEQ ID NO: 21840 - RNA, 20 nt, Homo sapiens
ugcauauuuuauuauaguca

SEQ ID NO: 21841 - RNA, 12 nt, Homo sapiens
gcauccuagucu

SEQ ID NO: 21842 - RNA, 20 nt, Homo sapiens
ggcggguccgggucgcagga

SEQ ID NO: 21843 - RNA, 13 nt, Homo sapiens
gccgacggagccg

SEQ ID NO: 21844 - RNA, 17 nt, Homo sapiens
caguaugaaaaugucau

SEQ ID NO: 21845 - RNA, 22 nt, Homo sapiens
aauguuguuuuaggaauacaua

SEQ ID NO: 21846 - RNA, 14 nt, Homo sapiens
augaucaguaugaa

SEQ ID NO: 21847 - RNA, 15 nt, Homo sapiens
agccgggaaagaaga

SEQ ID NO: 21848 - RNA, 20 nt, Homo sapiens
aacugcagcgaguacuuccc

SEQ ID NO: 21849 - RNA, 13 nt, Homo sapiens
cauuaucagucca

SEQ ID NO: 21850 - RNA, 18 nt, Homo sapiens
auucuuuacccccuggga

SEQ ID NO: 21851 - RNA, 22 nt, Homo sapiens
cucuaucauuaaaguucuagug

SEQ ID NO: 21852 - RNA, 12 nt, Homo sapiens
aaaaaaacguau

SEQ ID NO: 21853 - RNA, 19 nt, Homo sapiens
cuuuaaaacuuauccucca

SEQ ID NO: 21854 - RNA, 17 nt, Homo sapiens
uaaagcuuugugcagau

SEQ ID NO: 21855 - RNA, 13 nt, Homo sapiens
uuguucuugugaa

SEQ ID NO: 21856 - RNA, 17 nt, Homo sapiens
agagccggagccuccag

SEQ ID NO: 21857 - RNA, 19 nt, Homo sapiens
cagcgaguacuucccgcug

SEQ ID NO: 21858 - RNA, 16 nt, Homo sapiens
uuaaaguucuagugac

SEQ ID NO: 21859 - RNA, 20 nt, Homo sapiens
uuacccccugggagccccaa

SEQ ID NO: 21860 - RNA, 15 nt, Homo sapiens
ucauuaaaguucuag

SEQ ID NO: 21861 - RNA, 17 nt, Homo sapiens
auccuagucucuaucau

SEQ ID NO: 21862 - RNA, 15 nt, Homo sapiens
ccuccgcuacuucca

SEQ ID NO: 21863 - RNA, 16 nt, Homo sapiens
guaaagcuuugugcag

SEQ ID NO: 21864 - RNA, 17 nt, Homo sapiens
uuugugggaaauccaca

SEQ ID NO: 21865 - RNA, 16 nt, Homo sapiens
agucucuaucauuaaa

SEQ ID NO: 21866 - RNA, 17 nt, Homo sapiens
aaccagagccugagugu

SEQ ID NO: 21867 - RNA, 15 nt, Homo sapiens
uaaaguucuagugac

SEQ ID NO: 21868 - RNA, 16 nt, Homo sapiens
cuucuuacaaugcauu

SEQ ID NO: 21869 - RNA, 17 nt, Homo sapiens
cauccuagucucuauca

SEQ ID NO: 21870 - RNA, 13 nt, Homo sapiens
aaaguucuaguga

SEQ ID NO: 21871 - RNA, 14 nt, Homo sapiens
ucuuccucccugga

SEQ ID NO: 21872 - RNA, 22 nt, Homo sapiens
gagggcgcggggcggggagcga

SEQ ID NO: 21873 - RNA, 20 nt, Homo sapiens
aaacuuauccuccaugaaua

SEQ ID NO: 21874 - RNA, 20 nt, Homo sapiens
uguuguuuuaggaauacaua

SEQ ID NO: 21875 - RNA, 24 nt, Homo sapiens
ggcuuuaaaacuuauccuccauga

SEQ ID NO: 21876 - RNA, 19 nt, Homo sapiens
gccugcucgcccacuuccu

SEQ ID NO: 21877 - RNA, 17 nt, Homo sapiens
ugcagcgaguacuuccc

SEQ ID NO: 21878 - RNA, 22 nt, Homo sapiens
gcugccgugggccugagaccaa

SEQ ID NO: 21879 - RNA, 21 nt, Homo sapiens
cgccuccgcuacuuccagggc

SEQ ID NO: 21880 - RNA, 14 nt, Homo sapiens
aaagcuuugugcag

SEQ ID NO: 21881 - RNA, 14 nt, Homo sapiens
auuuuugaaaccaa

SEQ ID NO: 21882 - RNA, 19 nt, Homo sapiens
uacaaugcauucugaggua

SEQ ID NO: 21883 - RNA, 20 nt, Homo sapiens
uuaauuuauugaggcuuuaa

SEQ ID NO: 21884 - RNA, 14 nt, Homo sapiens
cacugagcugaggg

SEQ ID NO: 21885 - RNA, 20 nt, Homo sapiens
aaaaaacguauugcauuuaa

SEQ ID NO: 21886 - RNA, 19 nt, Homo sapiens
auauuuuauuauagucacu

SEQ ID NO: 21887 - RNA, 16 nt, Homo sapiens
ccuucuuacaaugcau

SEQ ID NO: 21888 - RNA, 18 nt, Homo sapiens
cuaucauuaaaguucuag

SEQ ID NO: 21889 - RNA, 15 nt, Homo sapiens
cuuccagggcuacgc

SEQ ID NO: 21890 - RNA, 15 nt, Homo sapiens
aaccucauuaucagu

SEQ ID NO: 21891 - RNA, 17 nt, Homo sapiens
ccauuuuugaaaccaaa

SEQ ID NO: 21892 - RNA, 15 nt, Homo sapiens
ugugggaaauccaca

SEQ ID NO: 21893 - RNA, 20 nt, Homo sapiens
cucgcuuccgcauccuaguc

SEQ ID NO: 21894 - RNA, 14 nt, Homo sapiens
agccccaauucgau

SEQ ID NO: 21895 - RNA, 15 nt, Homo sapiens
uaugaaaaugucauu

SEQ ID NO: 21896 - RNA, 13 nt, Homo sapiens
augaaaaugucau

SEQ ID NO: 21897 - RNA, 19 nt, Homo sapiens
ccuccaugaauaucaguua

SEQ ID NO: 21898 - RNA, 12 nt, Homo sapiens
uguucuugugaa

SEQ ID NO: 21899 - RNA, 14 nt, Homo sapiens
aaagguccuggcaa

SEQ ID NO: 21900 - RNA, 15 nt, Homo sapiens
cuuuaaaacuuaucc

SEQ ID NO: 21901 - RNA, 15 nt, Homo sapiens
uacauaaaguaugug

SEQ ID NO: 21902 - RNA, 18 nt, Homo sapiens
agucacuaguuguaauuu

SEQ ID NO: 21903 - RNA, 13 nt, Homo sapiens
uagucucuaucau

SEQ ID NO: 21904 - RNA, 20 nt, Homo sapiens
gcgcgccuccgcuacuucca

SEQ ID NO: 21905 - RNA, 21 nt, Homo sapiens
uguuguuuuaggaauacauaa

SEQ ID NO: 21906 - RNA, 21 nt, Homo sapiens
acuguaaagcuuugugcagau

SEQ ID NO: 21907 - RNA, 16 nt, Homo sapiens
ugugaacccaaagugu

SEQ ID NO: 21908 - RNA, 17 nt, Homo sapiens
cgugggccugagaccaa

SEQ ID NO: 21909 - RNA, 17 nt, Homo sapiens
ugcauuuaauuuauuga

SEQ ID NO: 21910 - RNA, 16 nt, Homo sapiens
ugcauauuuuauuaua

SEQ ID NO: 21911 - RNA, 21 nt, Homo sapiens
ccuggcaaagaugaucaguau

SEQ ID NO: 21912 - RNA, 23 nt, Homo sapiens
gugaacugcagcgaguacuuccc

SEQ ID NO: 21913 - RNA, 19 nt, Homo sapiens
auugaggcuuuaaaacuua

SEQ ID NO: 21914 - RNA, 19 nt, Homo sapiens
gcuuuaaaacuuauccucc

SEQ ID NO: 21915 - RNA, 21 nt, Homo sapiens
auucugagguaaccucauuau

SEQ ID NO: 21916 - RNA, 11 nt, Homo sapiens
cgcaggaccau

SEQ ID NO: 21917 - RNA, 14 nt, Homo sapiens
cucaucccacccgc

SEQ ID NO: 21918 - RNA, 17 nt, Homo sapiens
ucaguccaaagggcaug

SEQ ID NO: 21919 - RNA, 16 nt, Homo sapiens
uaaagcuuugugcaga

SEQ ID NO: 21920 - RNA, 20 nt, Homo sapiens
uuacaaugcauucugaggua

SEQ ID NO: 21921 - RNA, 16 nt, Homo sapiens
gcauccuagucucuau

SEQ ID NO: 21922 - RNA, 22 nt, Homo sapiens
ucuaucauuaaaguucuaguga

SEQ ID NO: 21923 - RNA, 22 nt, Homo sapiens
uaguuguaauuuuuuuguggga

SEQ ID NO: 21924 - RNA, 16 nt, Homo sapiens
cauaaaguaugugcau

SEQ ID NO: 21925 - RNA, 16 nt, Homo sapiens
cauuuuugaaaccaaa

SEQ ID NO: 21926 - RNA, 19 nt, Homo sapiens
gcauccuagucucuaucau

SEQ ID NO: 21927 - RNA, 23 nt, Homo sapiens
uccuggcaaagaugaucaguaug

SEQ ID NO: 21928 - RNA, 13 nt, Homo sapiens
cgcgcuccgcgca

SEQ ID NO: 21929 - RNA, 19 nt, Homo sapiens
cuuugugcagauucuuuac

SEQ ID NO: 21930 - RNA, 17 nt, Homo sapiens
cauaaaguaugugcaua

SEQ ID NO: 21931 - RNA, 12 nt, Homo sapiens
ugagguaaccuc

SEQ ID NO: 21932 - RNA, 16 nt, Homo sapiens
aguaugaaaaugucau

SEQ ID NO: 21933 - RNA, 20 nt, Homo sapiens
caguuauuuuuaaacuguaa

SEQ ID NO: 21934 - RNA, 18 nt, Homo sapiens
gaagagccggagccucca

SEQ ID NO: 21935 - RNA, 20 nt, Homo sapiens
ugcauucugagguaaccuca

SEQ ID NO: 21936 - RNA, 15 nt, Homo sapiens
gaauacauaaaguau

SEQ ID NO: 21937 - RNA, 17 nt, Homo sapiens
ucauuaucaguccaaag

SEQ ID NO: 21938 - RNA, 14 nt, Homo sapiens
uaaaguucuaguga

SEQ ID NO: 21939 - RNA, 14 nt, Homo sapiens
cuagucucuaucau

SEQ ID NO: 21940 - RNA, 23 nt, Homo sapiens
uucgcgcgccuccgcuacuucca

SEQ ID NO: 21941 - RNA, 15 nt, Homo sapiens
uccgcauccuagucu

SEQ ID NO: 21942 - RNA, 14 nt, Homo sapiens
agcugccccgggga

SEQ ID NO: 21943 - RNA, 17 nt, Homo sapiens
gguccgggucgcaggac

SEQ ID NO: 21944 - RNA, 21 nt, Homo sapiens
ggcaauguucccccucuccuc

SEQ ID NO: 21945 - RNA, 16 nt, Homo sapiens
ggcugcugguggcgcu

SEQ ID NO: 21946 - RNA, 15 nt, Homo sapiens
uaaagcuuugugcag

SEQ ID NO: 21947 - RNA, 15 nt, Homo sapiens
agccuccagcugccc

SEQ ID NO: 21948 - RNA, 20 nt, Homo sapiens
uuacaggcgugagccaccaa

SEQ ID NO: 21949 - RNA, 17 nt, Homo sapiens
uguugguacuagauacu

SEQ ID NO: 21950 - RNA, 18 nt, Homo sapiens
uguugguacuagauacug

SEQ ID NO: 21951 - RNA, 24 nt, Homo sapiens
uguugccaaggcuggagugcagug

SEQ ID NO: 21952 - RNA, 19 nt, Homo sapiens
uguuuccauagggugacac

SEQ ID NO: 21953 - RNA, 15 nt, Homo sapiens
uuaacacagugucug

SEQ ID NO: 21954 - RNA, 21 nt, Homo sapiens
uuagacccucaugcugccaau

SEQ ID NO: 21955 - RNA, 12 nt, Homo sapiens
uuccccaaccac

SEQ ID NO: 21956 - RNA, 15 nt, Homo sapiens
uugaaauagugucug

SEQ ID NO: 21957 - RNA, 16 nt, Homo sapiens
uugagcaccugcaggc

SEQ ID NO: 21958 - RNA, 21 nt, Homo sapiens
uugcuccuggcuggggccugu

SEQ ID NO: 21959 - RNA, 21 nt, Homo sapiens
uuggcccaggaguuuggccag

SEQ ID NO: 21960 - RNA, 22 nt, Homo sapiens
uuggcccaggaguuuggccaga

SEQ ID NO: 21961 - RNA, 22 nt, Homo sapiens
uugggaggcugaggcgggugga

SEQ ID NO: 21962 - RNA, 12 nt, Homo sapiens
ugcuuggcccag

SEQ ID NO: 21963 - RNA, 21 nt, Homo sapiens
uggaaaaaaaggaagaaauuc

SEQ ID NO: 21964 - RNA, 15 nt, Homo sapiens
uggaaaggcagcucu

SEQ ID NO: 21965 - RNA, 15 nt, Homo sapiens
ugcuggccaggcugg

SEQ ID NO: 21966 - RNA, 18 nt, Homo sapiens
ugcuggccaggcuggucu

SEQ ID NO: 21967 - RNA, 20 nt, Homo sapiens
ugcugggaauuacaggcgug

SEQ ID NO: 21968 - RNA, 15 nt, Homo sapiens
uggagacaccaccac

SEQ ID NO: 21969 - RNA, 16 nt, Homo sapiens
uggagacaccaccacc

SEQ ID NO: 21970 - RNA, 17 nt, Homo sapiens
uggagacaccaccaccc

SEQ ID NO: 21971 - RNA, 19 nt, Homo sapiens
uggauaugacacaucucug

SEQ ID NO: 21972 - RNA, 14 nt, Homo sapiens
uggcacuugggaca

SEQ ID NO: 21973 - RNA, 15 nt, Homo sapiens
uggccagaagucaag

SEQ ID NO: 21974 - RNA, 15 nt, Homo sapiens
uggccaggcuggucu

SEQ ID NO: 21975 - RNA, 22 nt, Homo sapiens
uggccaggcuggucucgaacug

SEQ ID NO: 21976 - RNA, 15 nt, Homo sapiens
uggcgcgcgccacca

SEQ ID NO: 21977 - RNA, 22 nt, Homo sapiens
uggcauguaugacgugacuggc

SEQ ID NO: 21978 - RNA, 21 nt, Homo sapiens
uggcccaggaguuuggccaga

SEQ ID NO: 21979 - RNA, 16 nt, Homo sapiens
uggcgcgcgccaccac

SEQ ID NO: 21980 - RNA, 18 nt, Homo sapiens
uggcgcgcgccaccacgc

SEQ ID NO: 21981 - RNA, 19 nt, Homo sapiens
uggcgcgcgccaccacgcc

SEQ ID NO: 21982 - RNA, 16 nt, Homo sapiens
uggucaacauggugaa

SEQ ID NO: 21983 - RNA, 13 nt, Homo sapiens
ugucucaguccau

SEQ ID NO: 21984 - RNA, 14 nt, Homo sapiens
ugucucaguccaug

SEQ ID NO: 21985 - RNA, 11 nt, Homo sapiens
uggguggggca

SEQ ID NO: 21986 - RNA, 14 nt, Homo sapiens
uggguggggugagg

SEQ ID NO: 21987 - RNA, 23 nt, Homo sapiens
uggucucagugucaaugcagccc

SEQ ID NO: 21988 - RNA, 18 nt, Homo sapiens
uggucuggagggaagccu

SEQ ID NO: 21989 - RNA, 15 nt, Homo sapiens
ugggcugagcaguca

SEQ ID NO: 21990 - RNA, 10 nt, Homo sapiens
ugggcagguc

SEQ ID NO: 21991 - RNA, 23 nt, Homo sapiens
uggggcagugcuuggcccaggag

SEQ ID NO: 21992 - RNA, 13 nt, Homo sapiens
uggcugggagugg

SEQ ID NO: 21993 - RNA, 18 nt, Homo sapiens
ugggagaaucacuugaac

SEQ ID NO: 21994 - RNA, 12 nt, Homo sapiens
ucuacacuccag

SEQ ID NO: 21995 - RNA, 15 nt, Homo sapiens
ucucuaacucagaaa

SEQ ID NO: 21996 - RNA, 14 nt, Homo sapiens
ucuggguucaagcg

SEQ ID NO: 21997 - RNA, 17 nt, Homo sapiens
ucuguugccaaggcugg

SEQ ID NO: 21998 - RNA, 19 nt, Homo sapiens
ucuuggugccucaguuucc

SEQ ID NO: 21999 - RNA, 17 nt, Homo sapiens
ucuaggccgggcgcggu

SEQ ID NO: 22000 - RNA, 15 nt, Homo sapiens
ucucgaacugcugga

SEQ ID NO: 22001 - RNA, 16 nt, Homo sapiens
uccugccccugagccc

SEQ ID NO: 22002 - RNA, 15 nt, Homo sapiens
uccugagaccagcca

SEQ ID NO: 22003 - RNA, 18 nt, Homo sapiens
ucccucuguugccaaggc

SEQ ID NO: 22004 - RNA, 13 nt, Homo sapiens
ucccugccuggau

SEQ ID NO: 22005 - RNA, 23 nt, Homo sapiens
ucccuggaagagaucaagccauc

SEQ ID NO: 22006 - RNA, 20 nt, Homo sapiens
uccuaauaaaaaggugacca

SEQ ID NO: 22007 - RNA, 15 nt, Homo sapiens
ugaucucagaaauug

SEQ ID NO: 22008 - RNA, 22 nt, Homo sapiens
ugauucccagccagcacagccu

SEQ ID NO: 22009 - RNA, 19 nt, Homo sapiens
ugcaagcuuuucaaaauug

SEQ ID NO: 22010 - RNA, 15 nt, Homo sapiens
ugccaaggcuggagu

SEQ ID NO: 22011 - RNA, 17 nt, Homo sapiens
ugccaugcuggccaggc

SEQ ID NO: 22012 - RNA, 16 nt, Homo sapiens
ugcccauccugccccu

SEQ ID NO: 22013 - RNA, 15 nt, Homo sapiens
ugccuguaaucacag

SEQ ID NO: 22014 - RNA, 15 nt, Homo sapiens
ugcuggauucaagug

SEQ ID NO: 22015 - RNA, 22 nt, Homo sapiens
ugcuggauucaagugauccgcc

SEQ ID NO: 22016 - RNA, 12 nt, Homo sapiens
ugcuaucgccau

SEQ ID NO: 22017 - RNA, 23 nt, Homo sapiens
ugcccugcuuuugcuaggucaca

SEQ ID NO: 22018 - RNA, 18 nt, Homo sapiens
ugccuaagugcagccccg

SEQ ID NO: 22019 - RNA, 15 nt, Homo sapiens
ugauaccucaacccc

SEQ ID NO: 22020 - RNA, 17 nt, Homo sapiens
ugaggcauuugcagcug

SEQ ID NO: 22021 - RNA, 18 nt, Homo sapiens
ugaggcauuugcagcugu

SEQ ID NO: 22022 - RNA, 13 nt, Homo sapiens
ugagaccagccaa

SEQ ID NO: 22023 - RNA, 14 nt, Homo sapiens
ugagaccagccaac

SEQ ID NO: 22024 - RNA, 14 nt, Homo sapiens
ugacuggccugcug

SEQ ID NO: 22025 - RNA, 21 nt, Homo sapiens
ugacuggccugcuggaugugg

SEQ ID NO: 22026 - RNA, 20 nt, Homo sapiens
ugacgugacuggccugcugg

SEQ ID NO: 22027 - RNA, 18 nt, Homo sapiens
ugacuauuauagaaugga

SEQ ID NO: 22028 - RNA, 19 nt, Homo sapiens
ugacuauuauagaauggaa

SEQ ID NO: 22029 - RNA, 16 nt, Homo sapiens
ugagagacagcagguc

SEQ ID NO: 22030 - RNA, 17 nt, Homo sapiens
ugagagacagcaggucu

SEQ ID NO: 22031 - RNA, 18 nt, Homo sapiens
ugagagacagcaggucuc

SEQ ID NO: 22032 - RNA, 14 nt, Homo sapiens
ugagcaccugcagg

SEQ ID NO: 22033 - RNA, 13 nt, Homo sapiens
ugaccacugcaga

SEQ ID NO: 22034 - RNA, 14 nt, Homo sapiens
ugacaagcucacag

SEQ ID NO: 22035 - RNA, 22 nt, Homo sapiens
ugacagcccaaggguggguggg

SEQ ID NO: 22036 - RNA, 23 nt, Homo sapiens
ugacagcccaagggugggugggg

SEQ ID NO: 22037 - RNA, 18 nt, Homo sapiens
ucuuuccacagaagcucc

SEQ ID NO: 22038 - RNA, 15 nt, Homo sapiens
ucauguacauccaug

SEQ ID NO: 22039 - RNA, 22 nt, Homo sapiens
ucaggcuagauguauguacuuc

SEQ ID NO: 22040 - RNA, 16 nt, Homo sapiens
ucaguccaugaagaug

SEQ ID NO: 22041 - RNA, 16 nt, Homo sapiens
ucccaaaacugauacc

SEQ ID NO: 22042 - RNA, 17 nt, Homo sapiens
uccccaaaaagaauggg

SEQ ID NO: 22043 - RNA, 18 nt, Homo sapiens
uccccaaaaagaauggga

SEQ ID NO: 22044 - RNA, 19 nt, Homo sapiens
ucccagcacuuugggaggc

SEQ ID NO: 22045 - RNA, 20 nt, Homo sapiens
ucccagcacuuugggaggcu

SEQ ID NO: 22046 - RNA, 19 nt, Homo sapiens
ucccagcuacuugggaggc

SEQ ID NO: 22047 - RNA, 20 nt, Homo sapiens
ucccagcuacuugggaggcu

SEQ ID NO: 22048 - RNA, 21 nt, Homo sapiens
ucccaggaaaauuaaggcuuc

SEQ ID NO: 22049 - RNA, 13 nt, Homo sapiens
uccacuacugcua

SEQ ID NO: 22050 - RNA, 11 nt, Homo sapiens
uauuacaucuu

SEQ ID NO: 22051 - RNA, 19 nt, Homo sapiens
uauucagccccgggagugg

SEQ ID NO: 22052 - RNA, 18 nt, Homo sapiens
uauugucuagugaaacuc

SEQ ID NO: 22053 - RNA, 19 nt, Homo sapiens
uauugucuagugaaacucg

SEQ ID NO: 22054 - RNA, 13 nt, Homo sapiens
ucagccccgggag

SEQ ID NO: 22055 - RNA, 21 nt, Homo sapiens
ucacagcuacuugggaggcug

SEQ ID NO: 22056 - RNA, 16 nt, Homo sapiens
ucacagguugaccaau

SEQ ID NO: 22057 - RNA, 11 nt, Homo sapiens
ucaaugcagcc

SEQ ID NO: 22058 - RNA, 12 nt, Homo sapiens
ucaaugcagccc

SEQ ID NO: 22059 - RNA, 12 nt, Homo sapiens
uaagugcagccc

SEQ ID NO: 22060 - RNA, 18 nt, Homo sapiens
uacaaaaauuagccgggc

SEQ ID NO: 22061 - RNA, 19 nt, Homo sapiens
uacaaaaauuagccgggca

SEQ ID NO: 22062 - RNA, 20 nt, Homo sapiens
uacaaaaauuagccgggcau

SEQ ID NO: 22063 - RNA, 21 nt, Homo sapiens
uaagagauggguuugacaagg

SEQ ID NO: 22064 - RNA, 21 nt, Homo sapiens
uaagcaaagacuaugaggaau

SEQ ID NO: 22065 - RNA, 11 nt, Homo sapiens
uaauuacuaug

SEQ ID NO: 22066 - RNA, 21 nt, Homo sapiens
uaaaauauuuuuaugugcaau

SEQ ID NO: 22067 - RNA, 20 nt, Homo sapiens
guuugccaugcuggccaggc

SEQ ID NO: 22068 - RNA, 13 nt, Homo sapiens
guuugcuaagcau

SEQ ID NO: 22069 - RNA, 15 nt, Homo sapiens
guucuaggccgggcg

SEQ ID NO: 22070 - RNA, 15 nt, Homo sapiens
guuggaggcugcaaa

SEQ ID NO: 22071 - RNA, 12 nt, Homo sapiens
uagaugcaguuc

SEQ ID NO: 22072 - RNA, 10 nt, Homo sapiens
uagccgggca

SEQ ID NO: 22073 - RNA, 13 nt, Homo sapiens
uacuucaauacuu

SEQ ID NO: 22074 - RNA, 14 nt, Homo sapiens
uagacccucaugcu

SEQ ID NO: 22075 - RNA, 18 nt, Homo sapiens
uacuccagccugggugac

SEQ ID NO: 22076 - RNA, 23 nt, Homo sapiens
uacaggcgugagccaccaaaccc

SEQ ID NO: 22077 - RNA, 16 nt, Homo sapiens
uacaguucucccaagg

SEQ ID NO: 22078 - RNA, 11 nt, Homo sapiens
uacauacugcu

SEQ ID NO: 22079 - RNA, 11 nt, Homo sapiens
uacccucuggg

SEQ ID NO: 22080 - RNA, 16 nt, Homo sapiens
guuggaaaaugugcaa

SEQ ID NO: 22081 - RNA, 13 nt, Homo sapiens
guugccaaggcug

SEQ ID NO: 22082 - RNA, 17 nt, Homo sapiens
guuccuaaccagccugg

SEQ ID NO: 22083 - RNA, 18 nt, Homo sapiens
guuccuaaccagccuggu

SEQ ID NO: 22084 - RNA, 19 nt, Homo sapiens
guuccuaaccagccugguc

SEQ ID NO: 22085 - RNA, 17 nt, Homo sapiens
gugauucccuccugcua

SEQ ID NO: 22086 - RNA, 18 nt, Homo sapiens
gugauucccuccugcuac

SEQ ID NO: 22087 - RNA, 15 nt, Homo sapiens
gugcuuggcccagga

SEQ ID NO: 22088 - RNA, 16 nt, Homo sapiens
gugcuuggcccaggag

SEQ ID NO: 22089 - RNA, 23 nt, Homo sapiens
gugcuuuaauggcaugucagaca

SEQ ID NO: 22090 - RNA, 18 nt, Homo sapiens
guggagggggcgcgugca

SEQ ID NO: 22091 - RNA, 18 nt, Homo sapiens
guggcauguaugacguga

SEQ ID NO: 22092 - RNA, 23 nt, Homo sapiens
gugcugggaauuacaggcgugag

SEQ ID NO: 22093 - RNA, 12 nt, Homo sapiens
guggccagcuug

SEQ ID NO: 22094 - RNA, 17 nt, Homo sapiens
gugucaaugcagccccc

SEQ ID NO: 22095 - RNA, 15 nt, Homo sapiens
gugucaguggaugcu

SEQ ID NO: 22096 - RNA, 21 nt, Homo sapiens
guggggcagugcuuggcccag

SEQ ID NO: 22097 - RNA, 13 nt, Homo sapiens
guggguggggcag

SEQ ID NO: 22098 - RNA, 10 nt, Homo sapiens
gugggcucug

SEQ ID NO: 22099 - RNA, 16 nt, Homo sapiens
guggggcagugcuugg

SEQ ID NO: 22100 - RNA, 18 nt, Homo sapiens
guggggcagugcuuggcc

SEQ ID NO: 22101 - RNA, 16 nt, Homo sapiens
guagauaaacucagaa

SEQ ID NO: 22102 - RNA, 17 nt, Homo sapiens
guagauaaacucagaaa

SEQ ID NO: 22103 - RNA, 16 nt, Homo sapiens
guagauaugaggcauu

SEQ ID NO: 22104 - RNA, 20 nt, Homo sapiens
guaauuggaaaggcagcucu

SEQ ID NO: 22105 - RNA, 22 nt, Homo sapiens
guacauccauggugugcuggcu

SEQ ID NO: 22106 - RNA, 21 nt, Homo sapiens
guacauuuccaaauucacaag

SEQ ID NO: 22107 - RNA, 15 nt, Homo sapiens
guacuccagccuggg

SEQ ID NO: 22108 - RNA, 16 nt, Homo sapiens
guacuccagccugggu

SEQ ID NO: 22109 - RNA, 18 nt, Homo sapiens
guauucccuuuugcugcc

SEQ ID NO: 22110 - RNA, 16 nt, Homo sapiens
gucagaagaccugguc

SEQ ID NO: 22111 - RNA, 18 nt, Homo sapiens
gucaaggcuuagacccuc

SEQ ID NO: 22112 - RNA, 19 nt, Homo sapiens
gucaaggcuuagacccuca

SEQ ID NO: 22113 - RNA, 13 nt, Homo sapiens
gugagccaccaaa

SEQ ID NO: 22114 - RNA, 22 nt, Homo sapiens
gugauccgcccaucuccgucuc

SEQ ID NO: 22115 - RNA, 16 nt, Homo sapiens
gugagacagcucugca

SEQ ID NO: 22116 - RNA, 17 nt, Homo sapiens
gugagacagcucugcau

SEQ ID NO: 22117 - RNA, 19 nt, Homo sapiens
gugauuacccucugggucu

SEQ ID NO: 22118 - RNA, 14 nt, Homo sapiens
gugacccugaugaa

SEQ ID NO: 22119 - RNA, 17 nt, Homo sapiens
gugaccugacagcccaa

SEQ ID NO: 22120 - RNA, 17 nt, Homo sapiens
gucucgaacugcuggau

SEQ ID NO: 22121 - RNA, 21 nt, Homo sapiens
gucucccucuguugccaaggc

SEQ ID NO: 22122 - RNA, 15 nt, Homo sapiens
gucucgaacugcugg

SEQ ID NO: 22123 - RNA, 16 nt, Homo sapiens
gucucgaacugcugga

SEQ ID NO: 22124 - RNA, 13 nt, Homo sapiens
gggccuggcuggg

SEQ ID NO: 22125 - RNA, 18 nt, Homo sapiens
gggcagugcuuggcccag

SEQ ID NO: 22126 - RNA, 16 nt, Homo sapiens
gggauuguaaaauggu

SEQ ID NO: 22127 - RNA, 23 nt, Homo sapiens
ggcuuagacccucaugcugccaa

SEQ ID NO: 22128 - RNA, 11 nt, Homo sapiens
gggaguggcgc

SEQ ID NO: 22129 - RNA, 12 nt, Homo sapiens
gggaguggcgcg

SEQ ID NO: 22130 - RNA, 10 nt, Homo sapiens
ggccugcugg

SEQ ID NO: 22131 - RNA, 14 nt, Homo sapiens
ggccugcuggaugu

SEQ ID NO: 22132 - RNA, 14 nt, Homo sapiens
ggcgugagccacca

SEQ ID NO: 22133 - RNA, 15 nt, Homo sapiens
ggcgugagccaccaa

SEQ ID NO: 22134 - RNA, 15 nt, Homo sapiens
ggcugaggcgggugg

SEQ ID NO: 22135 - RNA, 16 nt, Homo sapiens
ggcuauuuaaagacaa

SEQ ID NO: 22136 - RNA, 22 nt, Homo sapiens
ggcuauuuaaagacaaagacaa

SEQ ID NO: 22137 - RNA, 10 nt, Homo sapiens
ggcuagaacc

SEQ ID NO: 22138 - RNA, 18 nt, Homo sapiens
guaaaauggugugaccac

SEQ ID NO: 22139 - RNA, 20 nt, Homo sapiens
gguuucacaagugaaaaaca

SEQ ID NO: 22140 - RNA, 21 nt, Homo sapiens
gguuucacaagugaaaaacau

SEQ ID NO: 22141 - RNA, 15 nt, Homo sapiens
gguuugccaugcugg

SEQ ID NO: 22142 - RNA, 17 nt, Homo sapiens
gguggggcagugcuugg

SEQ ID NO: 22143 - RNA, 13 nt, Homo sapiens
gguggguggggca

SEQ ID NO: 22144 - RNA, 15 nt, Homo sapiens
gguucuaggccgggc

SEQ ID NO: 22145 - RNA, 16 nt, Homo sapiens
gguucuaggccgggcg

SEQ ID NO: 22146 - RNA, 17 nt, Homo sapiens
ggucucgaacugcugga

SEQ ID NO: 22147 - RNA, 18 nt, Homo sapiens
ggucucgaacugcuggau

SEQ ID NO: 22148 - RNA, 19 nt, Homo sapiens
ggucucgaacugcuggauu

SEQ ID NO: 22149 - RNA, 14 nt, Homo sapiens
ggucaacaugguga

SEQ ID NO: 22150 - RNA, 16 nt, Homo sapiens
ggggccaugaaucacc

SEQ ID NO: 22151 - RNA, 12 nt, Homo sapiens
ggggcgcgugca

SEQ ID NO: 22152 - RNA, 13 nt, Homo sapiens
gggcugaugcagu

SEQ ID NO: 22153 - RNA, 15 nt, Homo sapiens
gggcgcgugcaggca

SEQ ID NO: 22154 - RNA, 20 nt, Homo sapiens
ggggcuuuagggaccugcug

SEQ ID NO: 22155 - RNA, 16 nt, Homo sapiens
gggguggguggggcag

SEQ ID NO: 22156 - RNA, 17 nt, Homo sapiens
gggguggguggggcagu

SEQ ID NO: 22157 - RNA, 14 nt, Homo sapiens
ggguggggcagugc

SEQ ID NO: 22158 - RNA, 15 nt, Homo sapiens
ggguggggcagugcu

SEQ ID NO: 22159 - RNA, 13 nt, Homo sapiens
gcuauguuguugc

SEQ ID NO: 22160 - RNA, 13 nt, Homo sapiens
gcucccuggaaga

SEQ ID NO: 22161 - RNA, 16 nt, Homo sapiens
gcucugcauacucauu

SEQ ID NO: 22162 - RNA, 21 nt, Homo sapiens
gcucauggaauuggagcucgu

SEQ ID NO: 22163 - RNA, 22 nt, Homo sapiens
gcucauggaauuggagcucgug

SEQ ID NO: 22164 - RNA, 12 nt, Homo sapiens
gcuaucgccauc

SEQ ID NO: 22165 - RNA, 15 nt, Homo sapiens
gcucauggaauugga

SEQ ID NO: 22166 - RNA, 18 nt, Homo sapiens
gcuuccauuccaagccug

SEQ ID NO: 22167 - RNA, 14 nt, Homo sapiens
gcuugaacccagga

SEQ ID NO: 22168 - RNA, 19 nt, Homo sapiens
gcuugaggacuugggcggg

SEQ ID NO: 22169 - RNA, 13 nt, Homo sapiens
gcuuggcccagga

SEQ ID NO: 22170 - RNA, 14 nt, Homo sapiens
gcuuggcccaggag

SEQ ID NO: 22171 - RNA, 15 nt, Homo sapiens
gcuuggcccaggagu

SEQ ID NO: 22172 - RNA, 20 nt, Homo sapiens
gcuuguauuuuacuuuucca

SEQ ID NO: 22173 - RNA, 23 nt, Homo sapiens
gcuggauguggagggggcgcgug

SEQ ID NO: 22174 - RNA, 13 nt, Homo sapiens
gcuuagacccuca

SEQ ID NO: 22175 - RNA, 21 nt, Homo sapiens
gcuuagacccucaugcugcca

SEQ ID NO: 22176 - RNA, 22 nt, Homo sapiens
gcuuagacccucaugcugccaa

SEQ ID NO: 22177 - RNA, 15 nt, Homo sapiens
gcugaggcgggugga

SEQ ID NO: 22178 - RNA, 13 nt, Homo sapiens
gcuggagugcagu

SEQ ID NO: 22179 - RNA, 22 nt, Homo sapiens
gcuggauucaagugauccgccc

SEQ ID NO: 22180 - RNA, 17 nt, Homo sapiens
gcuggccaggcuggucu

SEQ ID NO: 22181 - RNA, 16 nt, Homo sapiens
ggccagaagucaaggc

SEQ ID NO: 22182 - RNA, 19 nt, Homo sapiens
ggcccaggaguuuggccag

SEQ ID NO: 22183 - RNA, 20 nt, Homo sapiens
ggcccaggaguuuggccaga

SEQ ID NO: 22184 - RNA, 12 nt, Homo sapiens
ggcgcgcaccug

SEQ ID NO: 22185 - RNA, 18 nt, Homo sapiens
ggcgcgcgccaccacgcc

SEQ ID NO: 22186 - RNA, 20 nt, Homo sapiens
ggcgcgugcaggcagcagga

SEQ ID NO: 22187 - RNA, 13 nt, Homo sapiens
ggcacuugggaca

SEQ ID NO: 22188 - RNA, 19 nt, Homo sapiens
ggcacuugggacaaaaaca

SEQ ID NO: 22189 - RNA, 21 nt, Homo sapiens
ggcacuugggacaaaaacaaa

SEQ ID NO: 22190 - RNA, 13 nt, Homo sapiens
ggcagaagcaacc

SEQ ID NO: 22191 - RNA, 14 nt, Homo sapiens
ggcagaagcaaccc

SEQ ID NO: 22192 - RNA, 20 nt, Homo sapiens
ggcaggucacacaaccuguc

SEQ ID NO: 22193 - RNA, 20 nt, Homo sapiens
ggcagugcuuggcccaggag

SEQ ID NO: 22194 - RNA, 16 nt, Homo sapiens
ggacaguuccugagac

SEQ ID NO: 22195 - RNA, 17 nt, Homo sapiens
ggacauuugcucaugga

SEQ ID NO: 22196 - RNA, 16 nt, Homo sapiens
ggacaaaaacaaacaa

SEQ ID NO: 22197 - RNA, 17 nt, Homo sapiens
ggaaugaaguacucaua

SEQ ID NO: 22198 - RNA, 21 nt, Homo sapiens
ggaauuacaggcgugagccac

SEQ ID NO: 22199 - RNA, 12 nt, Homo sapiens
ggaauugaccca

SEQ ID NO: 22200 - RNA, 15 nt, Homo sapiens
ggaauuggagcucgu

SEQ ID NO: 22201 - RNA, 16 nt, Homo sapiens
ggaauuggagcucgug

SEQ ID NO: 22202 - RNA, 20 nt, Homo sapiens
ggauucaagugauccgccca

SEQ ID NO: 22203 - RNA, 15 nt, Homo sapiens
ggaucucacaagcac

SEQ ID NO: 22204 - RNA, 12 nt, Homo sapiens
ggagcucgugga

SEQ ID NO: 22205 - RNA, 12 nt, Homo sapiens
ggagcucguggg

SEQ ID NO: 22206 - RNA, 15 nt, Homo sapiens
ggaguuuggccagaa

SEQ ID NO: 22207 - RNA, 19 nt, Homo sapiens
ggauagcugacccagcccc

SEQ ID NO: 22208 - RNA, 13 nt, Homo sapiens
ggacuugaaccca

SEQ ID NO: 22209 - RNA, 12 nt, Homo sapiens
ggagacaccacc

SEQ ID NO: 22210 - RNA, 14 nt, Homo sapiens
ggagacaccaccac

SEQ ID NO: 22211 - RNA, 16 nt, Homo sapiens
gcauuguaacuuauga

SEQ ID NO: 22212 - RNA, 15 nt, Homo sapiens
gcauuuauaaaugga

SEQ ID NO: 22213 - RNA, 14 nt, Homo sapiens
gccagaagucaagg

SEQ ID NO: 22214 - RNA, 16 nt, Homo sapiens
gcauuuucacuuuugg

SEQ ID NO: 22215 - RNA, 22 nt, Homo sapiens
gccaacugggguggguggggca

SEQ ID NO: 22216 - RNA, 23 nt, Homo sapiens
gccaacugggguggguggggcag

SEQ ID NO: 22217 - RNA, 15 nt, Homo sapiens
gccaaggcuggagug

SEQ ID NO: 22218 - RNA, 13 nt, Homo sapiens
gccaccacgccca

SEQ ID NO: 22219 - RNA, 16 nt, Homo sapiens
gccaccacgcccagcu

SEQ ID NO: 22220 - RNA, 16 nt, Homo sapiens
gcagugcuuggcccag

SEQ ID NO: 22221 - RNA, 17 nt, Homo sapiens
gcagugcuuggcccagg

SEQ ID NO: 22222 - RNA, 19 nt, Homo sapiens
gcagugcuuggcccaggag

SEQ ID NO: 22223 - RNA, 14 nt, Homo sapiens
gcagugcuuggccc

SEQ ID NO: 22224 - RNA, 17 nt, Homo sapiens
gcaggucacacaaccug

SEQ ID NO: 22225 - RNA, 19 nt, Homo sapiens
gcaggucacacaaccuguc

SEQ ID NO: 22226 - RNA, 22 nt, Homo sapiens
gcagcucuaaaugucaaucagc

SEQ ID NO: 22227 - RNA, 19 nt, Homo sapiens
gcagagguugcagugagcc

SEQ ID NO: 22228 - RNA, 21 nt, Homo sapiens
gcagagguugcagugagccga

SEQ ID NO: 22229 - RNA, 14 nt, Homo sapiens
gcccugcuuuugcu

SEQ ID NO: 22230 - RNA, 11 nt, Homo sapiens
gccccugagcc

SEQ ID NO: 22231 - RNA, 12 nt, Homo sapiens
gccccugagccc

SEQ ID NO: 22232 - RNA, 19 nt, Homo sapiens
gccccuguacuccagccug

SEQ ID NO: 22233 - RNA, 18 nt, Homo sapiens
gcccaggaguuuggccag

SEQ ID NO: 22234 - RNA, 19 nt, Homo sapiens
gcccaggaguuuggccaga

SEQ ID NO: 22235 - RNA, 12 nt, Homo sapiens
gcccauccugcc

SEQ ID NO: 22236 - RNA, 14 nt, Homo sapiens
gccaggcuggucuc

SEQ ID NO: 22237 - RNA, 16 nt, Homo sapiens
gccaugcuggccaggc

SEQ ID NO: 22238 - RNA, 16 nt, Homo sapiens
gcgcgugcaggcagca

SEQ ID NO: 22239 - RNA, 18 nt, Homo sapiens
gcgugaccugacagccca

SEQ ID NO: 22240 - RNA, 13 nt, Homo sapiens
gcgcgcgccacca

SEQ ID NO: 22241 - RNA, 22 nt, Homo sapiens
gcgggacacaggcuccaaacug

SEQ ID NO: 22242 - RNA, 16 nt, Homo sapiens
gcgcgcgccaccacgc

SEQ ID NO: 22243 - RNA, 23 nt, Homo sapiens
gcgcgcaccuguaaucccagcua

SEQ ID NO: 22244 - RNA, 12 nt, Homo sapiens
gcgcgccaccac

SEQ ID NO: 22245 - RNA, 13 nt, Homo sapiens
gcgcgccaccacg

SEQ ID NO: 22246 - RNA, 16 nt, Homo sapiens
gcgcgccaccacgccc

SEQ ID NO: 22247 - RNA, 23 nt, Homo sapiens
gccugcuggauguggagggggcg

SEQ ID NO: 22248 - RNA, 14 nt, Homo sapiens
gccucaccccuugc

SEQ ID NO: 22249 - RNA, 13 nt, Homo sapiens
gccugggugacag

SEQ ID NO: 22250 - RNA, 14 nt, Homo sapiens
gccugggugacaga

SEQ ID NO: 22251 - RNA, 13 nt, Homo sapiens
gcgacagugagac

SEQ ID NO: 22252 - RNA, 13 nt, Homo sapiens
gcgccaccacgcc

SEQ ID NO: 22253 - RNA, 15 nt, Homo sapiens
gccgggcaugguggc

SEQ ID NO: 22254 - RNA, 13 nt, Homo sapiens
gauaggccauggg

SEQ ID NO: 22255 - RNA, 15 nt, Homo sapiens
gauaugccuuuuccc

SEQ ID NO: 22256 - RNA, 16 nt, Homo sapiens
gauaugccuuuuccca

SEQ ID NO: 22257 - RNA, 18 nt, Homo sapiens
gagccccuugggcagguc

SEQ ID NO: 22258 - RNA, 20 nt, Homo sapiens
gagccccuugggcaggucac

SEQ ID NO: 22259 - RNA, 19 nt, Homo sapiens
gagcaccugcaggcgugac

SEQ ID NO: 22260 - RNA, 17 nt, Homo sapiens
gaggacuugggcgggac

SEQ ID NO: 22261 - RNA, 16 nt, Homo sapiens
gaggcauuugcagcug

SEQ ID NO: 22262 - RNA, 13 nt, Homo sapiens
gaggccuccucuc

SEQ ID NO: 22263 - RNA, 19 nt, Homo sapiens
gagcuguuuucccugaccu

SEQ ID NO: 22264 - RNA, 15 nt, Homo sapiens
gauucccagccagca

SEQ ID NO: 22265 - RNA, 18 nt, Homo sapiens
gauucccagccagcacag

SEQ ID NO: 22266 - RNA, 11 nt, Homo sapiens
gaugaagaagu

SEQ ID NO: 22267 - RNA, 18 nt, Homo sapiens
gauguagaggagaaacug

SEQ ID NO: 22268 - RNA, 19 nt, Homo sapiens
gaugggagaaucacuugaa

SEQ ID NO: 22269 - RNA, 11 nt, Homo sapiens
gcaccugcagg

SEQ ID NO: 22270 - RNA, 14 nt, Homo sapiens
gcaccugcaggcgu

SEQ ID NO: 22271 - RNA, 19 nt, Homo sapiens
gaugcaguuguugcccaca

SEQ ID NO: 22272 - RNA, 17 nt, Homo sapiens
gcaaccuccaccuucug

SEQ ID NO: 22273 - RNA, 19 nt, Homo sapiens
gcaaccuccaccuucuggg

SEQ ID NO: 22274 - RNA, 14 nt, Homo sapiens
gcacuccagccuga

SEQ ID NO: 22275 - RNA, 21 nt, Homo sapiens
gcacuuauuuauuguuguugg

SEQ ID NO: 22276 - RNA, 11 nt, Homo sapiens
gaacugcugga

SEQ ID NO: 22277 - RNA, 12 nt, Homo sapiens
gaagucaaggcu

SEQ ID NO: 22278 - RNA, 20 nt, Homo sapiens
gaagucaaggcuuagacccu

SEQ ID NO: 22279 - RNA, 23 nt, Homo sapiens
gaagucaaggcuuagacccucau

SEQ ID NO: 22280 - RNA, 18 nt, Homo sapiens
gaaguuaagcaacaucua

SEQ ID NO: 22281 - RNA, 19 nt, Homo sapiens
gaagaguggguuucacaag

SEQ ID NO: 22282 - RNA, 22 nt, Homo sapiens
gaagcuuccauuccaagccuga

SEQ ID NO: 22283 - RNA, 14 nt, Homo sapiens
gacagugagacucu

SEQ ID NO: 22284 - RNA, 23 nt, Homo sapiens
gacauguuuacaaaccucaagcc

SEQ ID NO: 22285 - RNA, 20 nt, Homo sapiens
gacaccaccacccuugccau

SEQ ID NO: 22286 - RNA, 13 nt, Homo sapiens
gacaccgaguggc

SEQ ID NO: 22287 - RNA, 11 nt, Homo sapiens
gaauugaccca

SEQ ID NO: 22288 - RNA, 16 nt, Homo sapiens
gaauuggagcucgugg

SEQ ID NO: 22289 - RNA, 14 nt, Homo sapiens
gagacaccaccacc

SEQ ID NO: 22290 - RNA, 15 nt, Homo sapiens
gagacaccaccaccc

SEQ ID NO: 22291 - RNA, 13 nt, Homo sapiens
gagacagcagguc

SEQ ID NO: 22292 - RNA, 19 nt, Homo sapiens
gagacagggaaagggucuc

SEQ ID NO: 22293 - RNA, 12 nt, Homo sapiens
gagaccagccaa

SEQ ID NO: 22294 - RNA, 16 nt, Homo sapiens
gagaccagccaaccug

SEQ ID NO: 22295 - RNA, 19 nt, Homo sapiens
gagacgggguuugccaugc

SEQ ID NO: 22296 - RNA, 21 nt, Homo sapiens
gagacgggguuugccaugcug

SEQ ID NO: 22297 - RNA, 23 nt, Homo sapiens
gagacgggguuugccaugcuggc

SEQ ID NO: 22298 - RNA, 17 nt, Homo sapiens
gacuguacccaaaugga

SEQ ID NO: 22299 - RNA, 16 nt, Homo sapiens
gagaaaauaaaagcac

SEQ ID NO: 22300 - RNA, 13 nt, Homo sapiens
gacuggccugcug

SEQ ID NO: 22301 - RNA, 16 nt, Homo sapiens
gacgugacuggccugc

SEQ ID NO: 22302 - RNA, 19 nt, Homo sapiens
gacgugacuggccugcugg

SEQ ID NO: 22303 - RNA, 12 nt, Homo sapiens
gacuaaaaaaca

SEQ ID NO: 22304 - RNA, 13 nt, Homo sapiens
gacuaaaaaacaa

SEQ ID NO: 22305 - RNA, 10 nt, Homo sapiens
gaccugcugu

SEQ ID NO: 22306 - RNA, 11 nt, Homo sapiens
gaccugcuguu

SEQ ID NO: 22307 - RNA, 20 nt, Homo sapiens
gacgggguuugccaugcugg

SEQ ID NO: 22308 - RNA, 13 nt, Homo sapiens
gacgaaccuugaa

SEQ ID NO: 22309 - RNA, 14 nt, Homo sapiens
gacgaaccuugaaa

SEQ ID NO: 22310 - RNA, 22 nt, Homo sapiens
gacauguuuacaaaccucaagc

SEQ ID NO: 22311 - RNA, 18 nt, Homo sapiens
auggagacaccaccaccc

SEQ ID NO: 22312 - RNA, 17 nt, Homo sapiens
auguucuuuggggagcc

SEQ ID NO: 22313 - RNA, 15 nt, Homo sapiens
auguguuuuucacau

SEQ ID NO: 22314 - RNA, 17 nt, Homo sapiens
auguuaaaacugggaca

SEQ ID NO: 22315 - RNA, 14 nt, Homo sapiens
augccccagggacc

SEQ ID NO: 22316 - RNA, 19 nt, Homo sapiens
augacgugacuggccugcu

SEQ ID NO: 22317 - RNA, 20 nt, Homo sapiens
augacgugacuggccugcug

SEQ ID NO: 22318 - RNA, 22 nt, Homo sapiens
augacgugacuggccugcugga

SEQ ID NO: 22319 - RNA, 13 nt, Homo sapiens
augagagacacac

SEQ ID NO: 22320 - RNA, 14 nt, Homo sapiens
augauuucauucaa

SEQ ID NO: 22321 - RNA, 16 nt, Homo sapiens
auggagacaccaccac

SEQ ID NO: 22322 - RNA, 17 nt, Homo sapiens
auggagacaccaccacc

SEQ ID NO: 22323 - RNA, 11 nt, Homo sapiens
auuagccgggc

SEQ ID NO: 22324 - RNA, 17 nt, Homo sapiens
auucacaagacccaaaa

SEQ ID NO: 22325 - RNA, 19 nt, Homo sapiens
auuugguucuaggccgggc

SEQ ID NO: 22326 - RNA, 20 nt, Homo sapiens
auuugguucuaggccgggcg

SEQ ID NO: 22327 - RNA, 17 nt, Homo sapiens
auugguugggcugagca

SEQ ID NO: 22328 - RNA, 17 nt, Homo sapiens
caacugggguggguggg

SEQ ID NO: 22329 - RNA, 22 nt, Homo sapiens
caacugggguggguggggcagu

SEQ ID NO: 22330 - RNA, 21 nt, Homo sapiens
caaucagccuaguugaucagc

SEQ ID NO: 22331 - RNA, 22 nt, Homo sapiens
caaauugucacaggacagcccu

SEQ ID NO: 22332 - RNA, 21 nt, Homo sapiens
caaagacaaauucuguuucuu

SEQ ID NO: 22333 - RNA, 15 nt, Homo sapiens
auuuuuaugugcaau

SEQ ID NO: 22334 - RNA, 14 nt, Homo sapiens
caaacccggccuga

SEQ ID NO: 22335 - RNA, 15 nt, Homo sapiens
caaacccggccugau

SEQ ID NO: 22336 - RNA, 13 nt, Homo sapiens
caaacgaaaaaca

SEQ ID NO: 22337 - RNA, 16 nt, Homo sapiens
caaaaauuagccgggc

SEQ ID NO: 22338 - RNA, 17 nt, Homo sapiens
caaaaauuagccgggca

SEQ ID NO: 22339 - RNA, 15 nt, Homo sapiens
cacagugucuggcac

SEQ ID NO: 22340 - RNA, 11 nt, Homo sapiens
caccaccaccc

SEQ ID NO: 22341 - RNA, 13 nt, Homo sapiens
caccaccacccuu

SEQ ID NO: 22342 - RNA, 15 nt, Homo sapiens
cacaugauccugcaa

SEQ ID NO: 22343 - RNA, 20 nt, Homo sapiens
cacagccucuuagaugcagu

SEQ ID NO: 22344 - RNA, 14 nt, Homo sapiens
caauuccucuggga

SEQ ID NO: 22345 - RNA, 19 nt, Homo sapiens
caauucuauuacgugcaau

SEQ ID NO: 22346 - RNA, 15 nt, Homo sapiens
caaucaucaaccccc

SEQ ID NO: 22347 - RNA, 18 nt, Homo sapiens
caaucaucaacccccaac

SEQ ID NO: 22348 - RNA, 17 nt, Homo sapiens
caccucauggaauugga

SEQ ID NO: 22349 - RNA, 14 nt, Homo sapiens
caccacgcccagcu

SEQ ID NO: 22350 - RNA, 23 nt, Homo sapiens
caccagggccuggcugggagugg

SEQ ID NO: 22351 - RNA, 14 nt, Homo sapiens
caccuucuggguuc

SEQ ID NO: 22352 - RNA, 19 nt, Homo sapiens
cacgccuguaaucccagca

SEQ ID NO: 22353 - RNA, 15 nt, Homo sapiens
cacuaaaaaggcaug

SEQ ID NO: 22354 - RNA, 18 nt, Homo sapiens
cacuaaaaaggcauguaa

SEQ ID NO: 22355 - RNA, 23 nt, Homo sapiens
auauccuaauaaaaaggugacca

SEQ ID NO: 22356 - RNA, 22 nt, Homo sapiens
auaaccaugcccaagaaugaga

SEQ ID NO: 22357 - RNA, 15 nt, Homo sapiens
auacaaucaucaacc

SEQ ID NO: 22358 - RNA, 17 nt, Homo sapiens
auacaaucaucaacccc

SEQ ID NO: 22359 - RNA, 22 nt, Homo sapiens
aguuuggccagaagucaaggcu

SEQ ID NO: 22360 - RNA, 19 nt, Homo sapiens
aguuccuaaccagccuggu

SEQ ID NO: 22361 - RNA, 18 nt, Homo sapiens
aguuccugagaccagcca

SEQ ID NO: 22362 - RNA, 15 nt, Homo sapiens
aguucugaagaagau

SEQ ID NO: 22363 - RNA, 16 nt, Homo sapiens
aguugauaugccuuuu

SEQ ID NO: 22364 - RNA, 16 nt, Homo sapiens
aguugcagugagcuga

SEQ ID NO: 22365 - RNA, 22 nt, Homo sapiens
agugcugggaauuacaggcgug

SEQ ID NO: 22366 - RNA, 14 nt, Homo sapiens
agugcuuggcccag

SEQ ID NO: 22367 - RNA, 15 nt, Homo sapiens
agugcaguggcgcaa

SEQ ID NO: 22368 - RNA, 18 nt, Homo sapiens
aguggcgcgcgccaccac

SEQ ID NO: 22369 - RNA, 20 nt, Homo sapiens
aguggcgcgcgccaccacgc

SEQ ID NO: 22370 - RNA, 14 nt, Homo sapiens
aguggguuucacaa

SEQ ID NO: 22371 - RNA, 19 nt, Homo sapiens
auccuaauaaaaaggugac

SEQ ID NO: 22372 - RNA, 18 nt, Homo sapiens
aucucacaagcacuuucc

SEQ ID NO: 22373 - RNA, 16 nt, Homo sapiens
aucucauuuccaagca

SEQ ID NO: 22374 - RNA, 17 nt, Homo sapiens
aucucauuuccaagcaa

SEQ ID NO: 22375 - RNA, 21 nt, Homo sapiens
aucuguaaaauggagacacca

SEQ ID NO: 22376 - RNA, 17 nt, Homo sapiens
augaaguacucauacau

SEQ ID NO: 22377 - RNA, 14 nt, Homo sapiens
augaaguccaagca

SEQ ID NO: 22378 - RNA, 19 nt, Homo sapiens
auauuauuuugaauccaga

SEQ ID NO: 22379 - RNA, 17 nt, Homo sapiens
auccaguuacugccggu

SEQ ID NO: 22380 - RNA, 21 nt, Homo sapiens
aucccagcuacuugggaggcu

SEQ ID NO: 22381 - RNA, 13 nt, Homo sapiens
aucacuugaaccc

SEQ ID NO: 22382 - RNA, 14 nt, Homo sapiens
aucacuugaacccg

SEQ ID NO: 22383 - RNA, 12 nt, Homo sapiens
agcuguggccag

SEQ ID NO: 22384 - RNA, 13 nt, Homo sapiens
agcuguggccagc

SEQ ID NO: 22385 - RNA, 16 nt, Homo sapiens
agcgacagugagacuc

SEQ ID NO: 22386 - RNA, 13 nt, Homo sapiens
agcgcagccaugu

SEQ ID NO: 22387 - RNA, 13 nt, Homo sapiens
aggcuccaaacug

SEQ ID NO: 22388 - RNA, 14 nt, Homo sapiens
aggcugaggcgggu

SEQ ID NO: 22389 - RNA, 17 nt, Homo sapiens
aggccugucccugcaga

SEQ ID NO: 22390 - RNA, 13 nt, Homo sapiens
aggaauugaccca

SEQ ID NO: 22391 - RNA, 23 nt, Homo sapiens
aggaguuccuaaccagccugguc

SEQ ID NO: 22392 - RNA, 15 nt, Homo sapiens
aggaguuuggccaga

SEQ ID NO: 22393 - RNA, 10 nt, Homo sapiens
aggugaccau

SEQ ID NO: 22394 - RNA, 18 nt, Homo sapiens
aggguacacugccuucuc

SEQ ID NO: 22395 - RNA, 13 nt, Homo sapiens
agggaccugcugu

SEQ ID NO: 22396 - RNA, 14 nt, Homo sapiens
agggaccugcuguu

SEQ ID NO: 22397 - RNA, 10 nt, Homo sapiens
agggcuugag

SEQ ID NO: 22398 - RNA, 12 nt, Homo sapiens
aguacagacuuu

SEQ ID NO: 22399 - RNA, 21 nt, Homo sapiens
acgugacuggccugcuggaug

SEQ ID NO: 22400 - RNA, 14 nt, Homo sapiens
acuccagccugggu

SEQ ID NO: 22401 - RNA, 23 nt, Homo sapiens
acucuauguucuaagaagugaaa

SEQ ID NO: 22402 - RNA, 20 nt, Homo sapiens
acucaucaaucaaauaagua

SEQ ID NO: 22403 - RNA, 18 nt, Homo sapiens
acucauugcaaccuccac

SEQ ID NO: 22404 - RNA, 15 nt, Homo sapiens
acuaucucauuucca

SEQ ID NO: 22405 - RNA, 17 nt, Homo sapiens
acuauuauagaauggaa

SEQ ID NO: 22406 - RNA, 13 nt, Homo sapiens
acugacaacuuga

SEQ ID NO: 22407 - RNA, 13 nt, Homo sapiens
acuggccugcugg

SEQ ID NO: 22408 - RNA, 14 nt, Homo sapiens
acuggccugcugga

SEQ ID NO: 22409 - RNA, 14 nt, Homo sapiens
acggggugaaaccc

SEQ ID NO: 22410 - RNA, 18 nt, Homo sapiens
acgugacuggccugcugg

SEQ ID NO: 22411 - RNA, 12 nt, Homo sapiens
accuguccccga

SEQ ID NO: 22412 - RNA, 13 nt, Homo sapiens
accuguccccgaa

SEQ ID NO: 22413 - RNA, 23 nt, Homo sapiens
uuggcccaggaguuuggccagaa

SEQ ID NO: 22414 - RNA, 19 nt, Homo sapiens
uugggaggcugaggcgggu

SEQ ID NO: 22415 - RNA, 14 nt, Homo sapiens
acccucaugcugcc

SEQ ID NO: 22416 - RNA, 22 nt, Homo sapiens
uugcuccuggcuggggccuguu

SEQ ID NO: 22417 - RNA, 10 nt, Homo sapiens
accugcaggc

SEQ ID NO: 22418 - RNA, 24 nt, Homo sapiens
accugcuguuuccuagcgcagcca

SEQ ID NO: 22419 - RNA, 12 nt, Homo sapiens
accugagcccca

SEQ ID NO: 22420 - RNA, 17 nt, Homo sapiens
accugacagcccaaggg

SEQ ID NO: 22421 - RNA, 23 nt, Homo sapiens
agcaccugcaggcgugaccugac

SEQ ID NO: 22422 - RNA, 16 nt, Homo sapiens
agccagacaucaacag

SEQ ID NO: 22423 - RNA, 18 nt, Homo sapiens
agcccacuggcucccugg

SEQ ID NO: 22424 - RNA, 16 nt, Homo sapiens
agcacuuugggaggcu

SEQ ID NO: 22425 - RNA, 20 nt, Homo sapiens
agcagaacagugauuaccag

SEQ ID NO: 22426 - RNA, 21 nt, Homo sapiens
agcagcuuauucacaagaccc

SEQ ID NO: 22427 - RNA, 19 nt, Homo sapiens
agcaggauagagugggaca

SEQ ID NO: 22428 - RNA, 21 nt, Homo sapiens
agauuucuuuccauugugggc

SEQ ID NO: 22429 - RNA, 21 nt, Homo sapiens
agcaaguauuagaauaccaca

SEQ ID NO: 22430 - RNA, 13 nt, Homo sapiens
agcaccugcaggc

SEQ ID NO: 22431 - RNA, 20 nt, Homo sapiens
agccugaaagaggaaugaag

SEQ ID NO: 22432 - RNA, 11 nt, Homo sapiens
agccugaccac

SEQ ID NO: 22433 - RNA, 17 nt, Homo sapiens
agccccgggaguggcgc

SEQ ID NO: 22434 - RNA, 19 nt, Homo sapiens
agccccgggaguggcgcgc

SEQ ID NO: 22435 - RNA, 17 nt, Homo sapiens
agccccuugggcagguc

SEQ ID NO: 22436 - RNA, 23 nt, Homo sapiens
agccagccuugcuccuggcuggg

SEQ ID NO: 22437 - RNA, 13 nt, Homo sapiens
agccaggcggcug

SEQ ID NO: 22438 - RNA, 15 nt, Homo sapiens
agccggagccccuug

SEQ ID NO: 22439 - RNA, 14 nt, Homo sapiens
acuugggaggcuga

SEQ ID NO: 22440 - RNA, 19 nt, Homo sapiens
acugggguggguggggcag

SEQ ID NO: 22441 - RNA, 23 nt, Homo sapiens
acuggcucccuggaagagaucaa

SEQ ID NO: 22442 - RNA, 22 nt, Homo sapiens
acuguacccaaauggaaaguaa

SEQ ID NO: 22443 - RNA, 13 nt, Homo sapiens
agauaugaggcau

SEQ ID NO: 22444 - RNA, 15 nt, Homo sapiens
agauaugaggcauuu

SEQ ID NO: 22445 - RNA, 16 nt, Homo sapiens
agagacagaaagcaga

SEQ ID NO: 22446 - RNA, 22 nt, Homo sapiens
agacgggguuugccaugcuggc

SEQ ID NO: 22447 - RNA, 19 nt, Homo sapiens
agaggguguguaaguagau

SEQ ID NO: 22448 - RNA, 21 nt, Homo sapiens
agacaugagagacagcagguc

SEQ ID NO: 22449 - RNA, 20 nt, Homo sapiens
agaccagccaaccugggggc

SEQ ID NO: 22450 - RNA, 17 nt, Homo sapiens
agaaguuaagcaacauc

SEQ ID NO: 22451 - RNA, 19 nt, Homo sapiens
agacgggguuugccaugcu

SEQ ID NO: 22452 - RNA, 11 nt, Homo sapiens
agacaccacca

SEQ ID NO: 22453 - RNA, 12 nt, Homo sapiens
agacaccaccac

SEQ ID NO: 22454 - RNA, 13 nt, Homo sapiens
agacaccaccacc

SEQ ID NO: 22455 - RNA, 14 nt, Homo sapiens
agacaccaccaccc

SEQ ID NO: 22456 - RNA, 16 nt, Homo sapiens
acacugaagaagcacc

SEQ ID NO: 22457 - RNA, 18 nt, Homo sapiens
acagcccaagggugggug

SEQ ID NO: 22458 - RNA, 23 nt, Homo sapiens
acaggaaguagaggaggccacgu

SEQ ID NO: 22459 - RNA, 13 nt, Homo sapiens
acagaagcuccag

SEQ ID NO: 22460 - RNA, 17 nt, Homo sapiens
acagcuacuugggaggc

SEQ ID NO: 22461 - RNA, 14 nt, Homo sapiens
acagugucuggcac

SEQ ID NO: 22462 - RNA, 17 nt, Homo sapiens
acaggacagcccuucuu

SEQ ID NO: 22463 - RNA, 21 nt, Homo sapiens
acaggacagcccuucuuucca

SEQ ID NO: 22464 - RNA, 13 nt, Homo sapiens
acaggggagaacc

SEQ ID NO: 22465 - RNA, 16 nt, Homo sapiens
acaguauggcagcuuu

SEQ ID NO: 22466 - RNA, 17 nt, Homo sapiens
acccacaagaaaugaaa

SEQ ID NO: 22467 - RNA, 19 nt, Homo sapiens
acccauauuuguacaccaa

SEQ ID NO: 22468 - RNA, 11 nt, Homo sapiens
accagggagcc

SEQ ID NO: 22469 - RNA, 12 nt, Homo sapiens
accagggagccc

SEQ ID NO: 22470 - RNA, 17 nt, Homo sapiens
accacccuugccaugga

SEQ ID NO: 22471 - RNA, 20 nt, Homo sapiens
uuagacccucaugcugccaa

SEQ ID NO: 22472 - RNA, 15 nt, Homo sapiens
uuccugagaccagcc

SEQ ID NO: 22473 - RNA, 21 nt, Homo sapiens
uuccugagaccagccaaccug

SEQ ID NO: 22474 - RNA, 12 nt, Homo sapiens
ugucaaugcagc

SEQ ID NO: 22475 - RNA, 14 nt, Homo sapiens
ugucaaugcagccc

SEQ ID NO: 22476 - RNA, 21 nt, Homo sapiens
ugguuauuuagggaacugcuu

SEQ ID NO: 22477 - RNA, 20 nt, Homo sapiens
uggucucgaacugcuggauu

SEQ ID NO: 22478 - RNA, 12 nt, Homo sapiens
uggguggggcag

SEQ ID NO: 22479 - RNA, 20 nt, Homo sapiens
uggggcagugcuuggcccag

SEQ ID NO: 22480 - RNA, 17 nt, Homo sapiens
ugugauuacccucuggg

SEQ ID NO: 22481 - RNA, 17 nt, Homo sapiens
uguuuccauagggugac

SEQ ID NO: 22482 - RNA, 18 nt, Homo sapiens
uguuuccauagggugaca

SEQ ID NO: 22483 - RNA, 16 nt, Homo sapiens
uguguuuugcaagcca

SEQ ID NO: 22484 - RNA, 11 nt, Homo sapiens
ugggcagguca

SEQ ID NO: 22485 - RNA, 12 nt, Homo sapiens
ugggcaggucac

SEQ ID NO: 22486 - RNA, 17 nt, Homo sapiens
ugggacaguuccugaga

SEQ ID NO: 22487 - RNA, 24 nt, Homo sapiens
ugggacaguuccugagaccagcca

SEQ ID NO: 22488 - RNA, 19 nt, Homo sapiens
ugggagaaucacuugaacc

SEQ ID NO: 22489 - RNA, 20 nt, Homo sapiens
ugggagaaucacuugaaccc

SEQ ID NO: 22490 - RNA, 20 nt, Homo sapiens
uggcccaggaguuuggccag

SEQ ID NO: 22491 - RNA, 11 nt, Homo sapiens
uggccugcugg

SEQ ID NO: 22492 - RNA, 12 nt, Homo sapiens
uggccugcugga

SEQ ID NO: 22493 - RNA, 17 nt, Homo sapiens
uggagugcaguggcgca

SEQ ID NO: 22494 - RNA, 17 nt, Homo sapiens
uggcgcgcgccaccacg

SEQ ID NO: 22495 - RNA, 17 nt, Homo sapiens
uggaauuggagcucgug

SEQ ID NO: 22496 - RNA, 11 nt, Homo sapiens
uggagacacca

SEQ ID NO: 22497 - RNA, 12 nt, Homo sapiens
uggagacaccac

SEQ ID NO: 22498 - RNA, 14 nt, Homo sapiens
uggagacaccacca

SEQ ID NO: 22499 - RNA, 16 nt, Homo sapiens
uggagugcaguggcgc

SEQ ID NO: 22500 - RNA, 12 nt, Homo sapiens
ugcuggagcucu

SEQ ID NO: 22501 - RNA, 23 nt, Homo sapiens
ugcuggauguggagggggcgcgu

SEQ ID NO: 22502 - RNA, 12 nt, Homo sapiens
ugcuggccaggc

SEQ ID NO: 22503 - RNA, 13 nt, Homo sapiens
ugcuuggcccagg

SEQ ID NO: 22504 - RNA, 14 nt, Homo sapiens
ugcuuggcccagga

SEQ ID NO: 22505 - RNA, 18 nt, Homo sapiens
cgcgccaccacgcccagc

SEQ ID NO: 22506 - RNA, 11 nt, Homo sapiens
cgcgugcaggc

SEQ ID NO: 22507 - RNA, 12 nt, Homo sapiens
cgcgugcaggca

SEQ ID NO: 22508 - RNA, 14 nt, Homo sapiens
cgcgugcaggcagc

SEQ ID NO: 22509 - RNA, 20 nt, Homo sapiens
cgagaaccuaaguuucaguu

SEQ ID NO: 22510 - RNA, 21 nt, Homo sapiens
cgaagucuuccauagagacuu

SEQ ID NO: 22511 - RNA, 22 nt, Homo sapiens
cgacagugagacucugucucag

SEQ ID NO: 22512 - RNA, 23 nt, Homo sapiens
cgacaguuuuccuucucaucugu

SEQ ID NO: 22513 - RNA, 21 nt, Homo sapiens
cgcccagcuaauuuguguauu

SEQ ID NO: 22514 - RNA, 14 nt, Homo sapiens
cgcgccaccacgcc

SEQ ID NO: 22515 - RNA, 18 nt, Homo sapiens
cgcgcgccaccacgccca

SEQ ID NO: 22516 - RNA, 13 nt, Homo sapiens
cgugagccaccaa

SEQ ID NO: 22517 - RNA, 17 nt, Homo sapiens
cgugcaggcagcaggau

SEQ ID NO: 22518 - RNA, 16 nt, Homo sapiens
cgugggacagucaccu

SEQ ID NO: 22519 - RNA, 19 nt, Homo sapiens
cgucucccaaagugcuggg

SEQ ID NO: 22520 - RNA, 19 nt, Homo sapiens
cgugacuggccugcuggau

SEQ ID NO: 22521 - RNA, 18 nt, Homo sapiens
cgucucccaaagugcugg

SEQ ID NO: 22522 - RNA, 13 nt, Homo sapiens
cgcgcgccaccac

SEQ ID NO: 22523 - RNA, 22 nt, Homo sapiens
cgggacacaggcuccaaacugg

SEQ ID NO: 22524 - RNA, 20 nt, Homo sapiens
cgggaggcagagguugcagu

SEQ ID NO: 22525 - RNA, 15 nt, Homo sapiens
cgggaguggcgcgcg

SEQ ID NO: 22526 - RNA, 19 nt, Homo sapiens
cgggaguggcgcgcgccac

SEQ ID NO: 22527 - RNA, 20 nt, Homo sapiens
cgggaguggcgcgcgccacc

SEQ ID NO: 22528 - RNA, 13 nt, Homo sapiens
cgggcaugguggc

SEQ ID NO: 22529 - RNA, 18 nt, Homo sapiens
cuaggccgggcgcggugg

SEQ ID NO: 22530 - RNA, 20 nt, Homo sapiens
cuacuugggaggcugagaug

SEQ ID NO: 22531 - RNA, 12 nt, Homo sapiens
cuaggccgggcg

SEQ ID NO: 22532 - RNA, 17 nt, Homo sapiens
cuacacuccagugagac

SEQ ID NO: 22533 - RNA, 24 nt, Homo sapiens
cuacucuguuccuucacauccugu

SEQ ID NO: 22534 - RNA, 19 nt, Homo sapiens
cucagugucaaugcagccc

SEQ ID NO: 22535 - RNA, 18 nt, Homo sapiens
cucauugcaaccuccacc

SEQ ID NO: 22536 - RNA, 15 nt, Homo sapiens
cucauuuccaagcaa

SEQ ID NO: 22537 - RNA, 17 nt, Homo sapiens
cuccaaaaucggaucug

SEQ ID NO: 22538 - RNA, 15 nt, Homo sapiens
cuccaaacuggagcu

SEQ ID NO: 22539 - RNA, 15 nt, Homo sapiens
cucagaaacaucagu

SEQ ID NO: 22540 - RNA, 15 nt, Homo sapiens
cucacaagcacuuuc

SEQ ID NO: 22541 - RNA, 16 nt, Homo sapiens
cucacaagcacuuucc

SEQ ID NO: 22542 - RNA, 18 nt, Homo sapiens
cuauuacgugcaauacuu

SEQ ID NO: 22543 - RNA, 16 nt, Homo sapiens
cuugcuccuggcuggg

SEQ ID NO: 22544 - RNA, 23 nt, Homo sapiens
cuucccuuuuacauacugcuguc

SEQ ID NO: 22545 - RNA, 21 nt, Homo sapiens
cuuggcccaggaguuuggcca

SEQ ID NO: 22546 - RNA, 14 nt, Homo sapiens
gaaagaggaaugaa

SEQ ID NO: 22547 - RNA, 13 nt, Homo sapiens
gaaaaugugcaau

SEQ ID NO: 22548 - RNA, 22 nt, Homo sapiens
cuuuuuagagaaauuugccaau

SEQ ID NO: 22549 - RNA, 22 nt, Homo sapiens
cuuucacauuggcuauuuaaag

SEQ ID NO: 22550 - RNA, 15 nt, Homo sapiens
cuuuagggaccugcu

SEQ ID NO: 22551 - RNA, 21 nt, Homo sapiens
cuguccccgaaacuaccagcc

SEQ ID NO: 22552 - RNA, 15 nt, Homo sapiens
cuggucucgaacugc

SEQ ID NO: 22553 - RNA, 20 nt, Homo sapiens
cuggucucgaacugcuggau

SEQ ID NO: 22554 - RNA, 22 nt, Homo sapiens
cuggacuuuccagagaccagua

SEQ ID NO: 22555 - RNA, 18 nt, Homo sapiens
cuggagugcaguggcgca

SEQ ID NO: 22556 - RNA, 19 nt, Homo sapiens
cuggagugcaguggcgcaa

SEQ ID NO: 22557 - RNA, 20 nt, Homo sapiens
cuggauguggagggggcgcg

SEQ ID NO: 22558 - RNA, 22 nt, Homo sapiens
cuggauguggagggggcgcgug

SEQ ID NO: 22559 - RNA, 22 nt, Homo sapiens
cuggauucaagugauccgccca

SEQ ID NO: 22560 - RNA, 18 nt, Homo sapiens
cugggguggguggggcag

SEQ ID NO: 22561 - RNA, 11 nt, Homo sapiens
cugcaaccugu

SEQ ID NO: 22562 - RNA, 22 nt, Homo sapiens
cugcaggcgugaccugacagcc

SEQ ID NO: 22563 - RNA, 18 nt, Homo sapiens
cugacagcccaagggugg

SEQ ID NO: 22564 - RNA, 13 nt, Homo sapiens
cugaagaagcacc

SEQ ID NO: 22565 - RNA, 14 nt, Homo sapiens
cugaagaagcacca

SEQ ID NO: 22566 - RNA, 21 nt, Homo sapiens
cugaagaguggguuucacaag

SEQ ID NO: 22567 - RNA, 18 nt, Homo sapiens
cugagaccagccaaccug

SEQ ID NO: 22568 - RNA, 19 nt, Homo sapiens
cugagaccagccaaccugg

SEQ ID NO: 22569 - RNA, 23 nt, Homo sapiens
cugagaccagccaaccugggggc

SEQ ID NO: 22570 - RNA, 13 nt, Homo sapiens
cugagaccagcca

SEQ ID NO: 22571 - RNA, 23 nt, Homo sapiens
cugauauauguguuuuucacauu

SEQ ID NO: 22572 - RNA, 22 nt, Homo sapiens
cuggaaaccacauggcuucacc

SEQ ID NO: 22573 - RNA, 20 nt, Homo sapiens
cugcuguuuccuagcgcagc

SEQ ID NO: 22574 - RNA, 21 nt, Homo sapiens
cugcuggauguggagggggcg

SEQ ID NO: 22575 - RNA, 23 nt, Homo sapiens
cucuggcgacaguuuuccuucuc

SEQ ID NO: 22576 - RNA, 13 nt, Homo sapiens
cucugggucucag

SEQ ID NO: 22577 - RNA, 13 nt, Homo sapiens
cucgaacugcugg

SEQ ID NO: 22578 - RNA, 14 nt, Homo sapiens
cucgaacugcugga

SEQ ID NO: 22579 - RNA, 15 nt, Homo sapiens
cucgaacugcuggau

SEQ ID NO: 22580 - RNA, 16 nt, Homo sapiens
cucccaaagugcuggg

SEQ ID NO: 22581 - RNA, 15 nt, Homo sapiens
cuccagugagacagc

SEQ ID NO: 22582 - RNA, 12 nt, Homo sapiens
cuccaccuucug

SEQ ID NO: 22583 - RNA, 14 nt, Homo sapiens
cuccaccuucuggg

SEQ ID NO: 22584 - RNA, 16 nt, Homo sapiens
cuccagccugagcgac

SEQ ID NO: 22585 - RNA, 11 nt, Homo sapiens
cuccagccugg

SEQ ID NO: 22586 - RNA, 15 nt, Homo sapiens
cuccugcuacucugu

SEQ ID NO: 22587 - RNA, 20 nt, Homo sapiens
cuccugccuaagugcagccc

SEQ ID NO: 22588 - RNA, 21 nt, Homo sapiens
cuccugccuaagugcagcccc

SEQ ID NO: 22589 - RNA, 21 nt, Homo sapiens
ccucauggaauuggagcucgu

SEQ ID NO: 22590 - RNA, 12 nt, Homo sapiens
ccucaugcugcc

SEQ ID NO: 22591 - RNA, 17 nt, Homo sapiens
ccucuguugccaaggcu

SEQ ID NO: 22592 - RNA, 21 nt, Homo sapiens
ccugacagcccaagggugggu

SEQ ID NO: 22593 - RNA, 14 nt, Homo sapiens
ccugagaccagcca

SEQ ID NO: 22594 - RNA, 17 nt, Homo sapiens
ccugagaccagccaacc

SEQ ID NO: 22595 - RNA, 8 nt, Homo sapiens
ccugagcc

SEQ ID NO: 22596 - RNA, 9 nt, Homo sapiens
ccugagccc

SEQ ID NO: 22597 - RNA, 10 nt, Homo sapiens
ccugagcccc

SEQ ID NO: 22598 - RNA, 14 nt, Homo sapiens
ccucaccccuugcc

SEQ ID NO: 22599 - RNA, 15 nt, Homo sapiens
ccugcaggcgugacc

SEQ ID NO: 22600 - RNA, 15 nt, Homo sapiens
ccuucuggguucaag

SEQ ID NO: 22601 - RNA, 19 nt, Homo sapiens
ccugugaaauaguucaaag

SEQ ID NO: 22602 - RNA, 11 nt, Homo sapiens
ccugccuggau

SEQ ID NO: 22603 - RNA, 21 nt, Homo sapiens
ccugcuguuuccuagcgcagc

SEQ ID NO: 22604 - RNA, 22 nt, Homo sapiens
ccugcuguuuccuagcgcagcc

SEQ ID NO: 22605 - RNA, 16 nt, Homo sapiens
ccuggucaacauggug

SEQ ID NO: 22606 - RNA, 15 nt, Homo sapiens
ccuauauccugugac

SEQ ID NO: 22607 - RNA, 18 nt, Homo sapiens
ccuaauaaaaaggugacc

SEQ ID NO: 22608 - RNA, 19 nt, Homo sapiens
ccuaauaaaaaggugacca

SEQ ID NO: 22609 - RNA, 14 nt, Homo sapiens
ccuaagugcagccc

SEQ ID NO: 22610 - RNA, 14 nt, Homo sapiens
ccuaaccagccugg

SEQ ID NO: 22611 - RNA, 19 nt, Homo sapiens
ccgucucccaaagugcugg

SEQ ID NO: 22612 - RNA, 22 nt, Homo sapiens
ccgggaguggcgcgcgccacca

SEQ ID NO: 22613 - RNA, 18 nt, Homo sapiens
ccgggcgcgguggcucac

SEQ ID NO: 22614 - RNA, 16 nt, Homo sapiens
ccgggcguggugguga

SEQ ID NO: 22615 - RNA, 19 nt, Homo sapiens
ccgggcaugguggcgcgca

SEQ ID NO: 22616 - RNA, 11 nt, Homo sapiens
ccagagaccag

SEQ ID NO: 22617 - RNA, 16 nt, Homo sapiens
ccacuuauaggaauug

SEQ ID NO: 22618 - RNA, 16 nt, Homo sapiens
ccagcccuacaccauu

SEQ ID NO: 22619 - RNA, 21 nt, Homo sapiens
ccaggaguuuggccagaaguc

SEQ ID NO: 22620 - RNA, 15 nt, Homo sapiens
cccagcacuuuggga

SEQ ID NO: 22621 - RNA, 20 nt, Homo sapiens
cccagcacuuugggaggcug

SEQ ID NO: 22622 - RNA, 15 nt, Homo sapiens
cccagccccuugaga

SEQ ID NO: 22623 - RNA, 20 nt, Homo sapiens
cccagcuacuugggaggcug

SEQ ID NO: 22624 - RNA, 22 nt, Homo sapiens
cccagcuacuugggaggcugag

SEQ ID NO: 22625 - RNA, 13 nt, Homo sapiens
cccaagaaugaga

SEQ ID NO: 22626 - RNA, 16 nt, Homo sapiens
cccaaggguggguggg

SEQ ID NO: 22627 - RNA, 17 nt, Homo sapiens
cccaagggugggugggg

SEQ ID NO: 22628 - RNA, 21 nt, Homo sapiens
cccaaggguggguggggugag

SEQ ID NO: 22629 - RNA, 18 nt, Homo sapiens
ccauuccaagccugacca

SEQ ID NO: 22630 - RNA, 20 nt, Homo sapiens
ccaugauguuuagaaacaca

SEQ ID NO: 22631 - RNA, 17 nt, Homo sapiens
ccaugcuggccaggcug

SEQ ID NO: 22632 - RNA, 15 nt, Homo sapiens
ccauggagguuaagc

SEQ ID NO: 22633 - RNA, 12 nt, Homo sapiens
cccucugggucu

SEQ ID NO: 22634 - RNA, 12 nt, Homo sapiens
cccucaugcugc

SEQ ID NO: 22635 - RNA, 13 nt, Homo sapiens
cccucaugcugcc

SEQ ID NO: 22636 - RNA, 15 nt, Homo sapiens
cccucaugcugccaa

SEQ ID NO: 22637 - RNA, 14 nt, Homo sapiens
ccccgggaguggcg

SEQ ID NO: 22638 - RNA, 16 nt, Homo sapiens
cccgaaacuaccagcc

SEQ ID NO: 22639 - RNA, 14 nt, Homo sapiens
cccgggaguggcgc

SEQ ID NO: 22640 - RNA, 15 nt, Homo sapiens
cccgggaguggcgcg

SEQ ID NO: 22641 - RNA, 23 nt, Homo sapiens
cccgggaguggcgcgcgccacca

SEQ ID NO: 22642 - RNA, 10 nt, Homo sapiens
cauguuucuu

SEQ ID NO: 22643 - RNA, 19 nt, Homo sapiens
cauguaugacgugacuggc

SEQ ID NO: 22644 - RNA, 18 nt, Homo sapiens
cauggaauuggagcucgu

SEQ ID NO: 22645 - RNA, 14 nt, Homo sapiens
cauuugcucaugga

SEQ ID NO: 22646 - RNA, 15 nt, Homo sapiens
ccaccaaacccggcc

SEQ ID NO: 22647 - RNA, 19 nt, Homo sapiens
ccacaccagggccuggcug

SEQ ID NO: 22648 - RNA, 17 nt, Homo sapiens
ccaccaaacccggccug

SEQ ID NO: 22649 - RNA, 13 nt, Homo sapiens
ccaaagugcuggg

SEQ ID NO: 22650 - RNA, 14 nt, Homo sapiens
ccaaggcuggagug

SEQ ID NO: 22651 - RNA, 13 nt, Homo sapiens
caugcuggccagg

SEQ ID NO: 22652 - RNA, 17 nt, Homo sapiens
caugcuggccaggcugg

SEQ ID NO: 22653 - RNA, 21 nt, Homo sapiens
caugcuggccaggcuggucuc

SEQ ID NO: 22654 - RNA, 14 nt, Homo sapiens
caugggcacugugg

SEQ ID NO: 22655 - RNA, 21 nt, Homo sapiens
caugauguuuagaaacacaac

SEQ ID NO: 22656 - RNA, 19 nt, Homo sapiens
cauccugccccugagccca

SEQ ID NO: 22657 - RNA, 19 nt, Homo sapiens
caugagagacagcaggucu

SEQ ID NO: 22658 - RNA, 18 nt, Homo sapiens
caucuuggucacauacaa

SEQ ID NO: 22659 - RNA, 18 nt, Homo sapiens
cauccauggugugcuggc

SEQ ID NO: 22660 - RNA, 18 nt, Homo sapiens
cauagcaucucaggagau

SEQ ID NO: 22661 - RNA, 12 nt, Homo sapiens
cauagggugaca

SEQ ID NO: 22662 - RNA, 14 nt, Homo sapiens
cauagggugacaca

SEQ ID NO: 22663 - RNA, 13 nt, Homo sapiens
cagugucuggcac

SEQ ID NO: 22664 - RNA, 19 nt, Homo sapiens
caguuccugagaccagcca

SEQ ID NO: 22665 - RNA, 15 nt, Homo sapiens
caguucugaagaaga

SEQ ID NO: 22666 - RNA, 16 nt, Homo sapiens
caggaguuuggccaga

SEQ ID NO: 22667 - RNA, 12 nt, Homo sapiens
caggcagcagga

SEQ ID NO: 22668 - RNA, 17 nt, Homo sapiens
caggcgugagccaccaa

SEQ ID NO: 22669 - RNA, 22 nt, Homo sapiens
caggcgugagccaccaaacccg

SEQ ID NO: 22670 - RNA, 23 nt, Homo sapiens
caggcgugagccaccaaacccgg

SEQ ID NO: 22671 - RNA, 22 nt, Homo sapiens
caggcgugaccugacagcccaa

SEQ ID NO: 22672 - RNA, 15 nt, Homo sapiens
caggcgugagccacc

SEQ ID NO: 22673 - RNA, 15 nt, Homo sapiens
cagucaccucaugga

SEQ ID NO: 22674 - RNA, 17 nt, Homo sapiens
caggaguuuggccagaa

SEQ ID NO: 22675 - RNA, 20 nt, Homo sapiens
cagugagacucugucucagu

SEQ ID NO: 22676 - RNA, 18 nt, Homo sapiens
cagugcuuggcccaggag

SEQ ID NO: 22677 - RNA, 15 nt, Homo sapiens
caggcuccaaacugg

SEQ ID NO: 22678 - RNA, 18 nt, Homo sapiens
caggcuccaaacuggagc

SEQ ID NO: 22679 - RNA, 23 nt, Homo sapiens
caggcuggucucgaacugcugga

SEQ ID NO: 22680 - RNA, 24 nt, Homo sapiens
caggcuggucucgaacugcuggau

SEQ ID NO: 22681 - RNA, 15 nt, Homo sapiens
cagggccuggcuggg

SEQ ID NO: 22682 - RNA, 20 nt, Homo sapiens
cagggccuggcugggagugg

SEQ ID NO: 22683 - RNA, 15 nt, Homo sapiens
cagccugggugacag

SEQ ID NO: 22684 - RNA, 16 nt, Homo sapiens
cagccugggugacaga

SEQ ID NO: 22685 - RNA, 22 nt, Homo sapiens
cagccuggucaacauggugaaa

SEQ ID NO: 22686 - RNA, 18 nt, Homo sapiens
cagccaggcggcuggaau

SEQ ID NO: 22687 - RNA, 21 nt, Homo sapiens
cagccaggcggcuggaauuga

SEQ ID NO: 22688 - RNA, 22 nt, Homo sapiens
cagccaggcggcuggaauugaa

SEQ ID NO: 22689 - RNA, 15 nt, Homo sapiens
cagcccaaggguggg

SEQ ID NO: 22690 - RNA, 15 nt, Homo sapiens
cagccccgggagugg

SEQ ID NO: 22691 - RNA, 12 nt, Homo sapiens
cagagguugcag

SEQ ID NO: 22692 - RNA, 23 nt, Homo sapiens
cagagacgggguuugccaugcug

SEQ ID NO: 22693 - RNA, 13 nt, Homo sapiens
cagaagucaaggc

SEQ ID NO: 22694 - RNA, 23 nt, Homo sapiens
cagaagucaaggcuuagacccuc

SEQ ID NO: 22695 - RNA, 21 nt, Homo sapiens
cacuuuaacacagugucuggc

SEQ ID NO: 22696 - RNA, 19 nt, Homo sapiens
cagaaauuuaauucauguu

SEQ ID NO: 22697 - RNA, 14 nt, Homo sapiens
cacuuaaaaauggu

SEQ ID NO: 22698 - RNA, 20 nt, Homo sapiens
guuuggccagaagucaaggc

SEQ ID NO: 22699 - RNA, 21 nt, Homo sapiens
guuuggccagaagucaaggcu

SEQ ID NO: 22700 - RNA, 16 nt, Homo sapiens
guuuccauagggugac

SEQ ID NO: 22701 - RNA, 17 nt, Homo sapiens
guuuccauagggugaca

SEQ ID NO: 22702 - RNA, 18 nt, Homo sapiens
guuuccauagggugacac

SEQ ID NO: 22703 - RNA, 15 nt, Homo sapiens
guugacaacugugac

SEQ ID NO: 22704 - RNA, 22 nt, Homo sapiens
guugagcuguuuucccugaccu

SEQ ID NO: 22705 - RNA, 16 nt, Homo sapiens
guugccaaggcuggag

SEQ ID NO: 22706 - RNA, 12 nt, Homo sapiens
uaaaagcacuua

SEQ ID NO: 22707 - RNA, 17 nt, Homo sapiens
guuauaaucuuucacag

SEQ ID NO: 22708 - RNA, 14 nt, Homo sapiens
guugccaaggcugg

SEQ ID NO: 22709 - RNA, 16 nt, Homo sapiens
guuccuaaccagccug

SEQ ID NO: 22710 - RNA, 13 nt, Homo sapiens
gugccucaccccu

SEQ ID NO: 22711 - RNA, 20 nt, Homo sapiens
gugcugggaauuacaggcgu

SEQ ID NO: 22712 - RNA, 24 nt, Homo sapiens
gugcugggaauuacaggcgugagc

SEQ ID NO: 22713 - RNA, 12 nt, Homo sapiens
gugcuuggccca

SEQ ID NO: 22714 - RNA, 21 nt, Homo sapiens
guggagggggcgcgugcaggc

SEQ ID NO: 22715 - RNA, 13 nt, Homo sapiens
guggcgcgcgcca

SEQ ID NO: 22716 - RNA, 16 nt, Homo sapiens
guggcgcgcgccacca

SEQ ID NO: 22717 - RNA, 16 nt, Homo sapiens
gugucaaugcagcccc

SEQ ID NO: 22718 - RNA, 16 nt, Homo sapiens
gugucaguggaugcug

SEQ ID NO: 22719 - RNA, 18 nt, Homo sapiens
gugacuggccugcuggau

SEQ ID NO: 22720 - RNA, 11 nt, Homo sapiens
gugggcucugg

SEQ ID NO: 22721 - RNA, 13 nt, Homo sapiens
guggggcagugcu

SEQ ID NO: 22722 - RNA, 20 nt, Homo sapiens
guggggcagugcuuggccca

SEQ ID NO: 22723 - RNA, 23 nt, Homo sapiens
guggggcagugcuuggcccagga

SEQ ID NO: 22724 - RNA, 14 nt, Homo sapiens
guggguagacacac

SEQ ID NO: 22725 - RNA, 13 nt, Homo sapiens
guaugauucccag

SEQ ID NO: 22726 - RNA, 18 nt, Homo sapiens
gucucgaacugcuggauu

SEQ ID NO: 22727 - RNA, 23 nt, Homo sapiens
gugaacaaauuuacagagacaga

SEQ ID NO: 22728 - RNA, 24 nt, Homo sapiens
gugaacaaauuuacagagacagaa

SEQ ID NO: 22729 - RNA, 15 nt, Homo sapiens
gucugacuguuucca

SEQ ID NO: 22730 - RNA, 18 nt, Homo sapiens
gucucccaaagugcuggg

SEQ ID NO: 22731 - RNA, 19 nt, Homo sapiens
uacuccagccugggugaca

SEQ ID NO: 22732 - RNA, 15 nt, Homo sapiens
uacaucuuucacauu

SEQ ID NO: 22733 - RNA, 22 nt, Homo sapiens
uaccagggacugaggggagggg

SEQ ID NO: 22734 - RNA, 13 nt, Homo sapiens
uagcuuuacuguu

SEQ ID NO: 22735 - RNA, 14 nt, Homo sapiens
uagcuuuacuguuu

SEQ ID NO: 22736 - RNA, 13 nt, Homo sapiens
uagacccucaugc

SEQ ID NO: 22737 - RNA, 17 nt, Homo sapiens
uagacccucaugcugcc

SEQ ID NO: 22738 - RNA, 11 nt, Homo sapiens
uaagugcagcc

SEQ ID NO: 22739 - RNA, 13 nt, Homo sapiens
uaagugcagcccc

SEQ ID NO: 22740 - RNA, 12 nt, Homo sapiens
uacauucugcuu

SEQ ID NO: 22741 - RNA, 12 nt, Homo sapiens
uacauacugcug

SEQ ID NO: 22742 - RNA, 13 nt, Homo sapiens
uacauacugcugu

SEQ ID NO: 22743 - RNA, 9 nt, Homo sapiens
uaugugcaa

SEQ ID NO: 22744 - RNA, 23 nt, Homo sapiens
ucaaggcuuagacccucaugcug

SEQ ID NO: 22745 - RNA, 12 nt, Homo sapiens
uauuacaucuuu

SEQ ID NO: 22746 - RNA, 13 nt, Homo sapiens
ucacaagcacuuu

SEQ ID NO: 22747 - RNA, 14 nt, Homo sapiens
ucacaagcacuuuc

SEQ ID NO: 22748 - RNA, 13 nt, Homo sapiens
ucaaugcagcccc

SEQ ID NO: 22749 - RNA, 17 nt, Homo sapiens
ucccaaaacugauaccc

SEQ ID NO: 22750 - RNA, 13 nt, Homo sapiens
ucccaaagugcug

SEQ ID NO: 22751 - RNA, 11 nt, Homo sapiens
ucauuucaaaa

SEQ ID NO: 22752 - RNA, 12 nt, Homo sapiens
uccacuacugcu

SEQ ID NO: 22753 - RNA, 18 nt, Homo sapiens
ucaguccucuuucaaagg

SEQ ID NO: 22754 - RNA, 13 nt, Homo sapiens
ucagaagaaauuc

SEQ ID NO: 22755 - RNA, 16 nt, Homo sapiens
uccugagaccagccaa

SEQ ID NO: 22756 - RNA, 18 nt, Homo sapiens
uccugagaccagccaacc

SEQ ID NO: 22757 - RNA, 14 nt, Homo sapiens
ucgaacugcuggau

SEQ ID NO: 22758 - RNA, 12 nt, Homo sapiens
ugccaugcuggc

SEQ ID NO: 22759 - RNA, 16 nt, Homo sapiens
ugccccugcacuccag

SEQ ID NO: 22760 - RNA, 13 nt, Homo sapiens
ugcccaagaauga

SEQ ID NO: 22761 - RNA, 15 nt, Homo sapiens
ugcccaagaaugaga

SEQ ID NO: 22762 - RNA, 22 nt, Homo sapiens
ugcccaagaaugagaagaauga

SEQ ID NO: 22763 - RNA, 16 nt, Homo sapiens
ugccuaagugcagccc

SEQ ID NO: 22764 - RNA, 19 nt, Homo sapiens
ugccuaagugcagccccgu

SEQ ID NO: 22765 - RNA, 11 nt, Homo sapiens
ugccuggaucu

SEQ ID NO: 22766 - RNA, 17 nt, Homo sapiens
ugcaaccuccaccuucu

SEQ ID NO: 22767 - RNA, 13 nt, Homo sapiens
ugcagugagccga

SEQ ID NO: 22768 - RNA, 14 nt, Homo sapiens
ucucuaacucagaa

SEQ ID NO: 22769 - RNA, 15 nt, Homo sapiens
ucucuuuauucagcc

SEQ ID NO: 22770 - RNA, 19 nt, Homo sapiens
ucucuuuuuagagaaauuu

SEQ ID NO: 22771 - RNA, 20 nt, Homo sapiens
ucucuuuuuagagaaauuug

SEQ ID NO: 22772 - RNA, 19 nt, Homo sapiens
ugaaaaaguucugcagaua

SEQ ID NO: 22773 - RNA, 17 nt, Homo sapiens
ugacagcccaagggugg

SEQ ID NO: 22774 - RNA, 18 nt, Homo sapiens
ugacagcccaaggguggg

SEQ ID NO: 22775 - RNA, 16 nt, Homo sapiens
ugaacccgggaggcag

SEQ ID NO: 22776 - RNA, 12 nt, Homo sapiens
ugagcaccugca

SEQ ID NO: 22777 - RNA, 17 nt, Homo sapiens
ugacuggccugcuggau

SEQ ID NO: 22778 - RNA, 15 nt, Homo sapiens
ugaccacugcagaag

SEQ ID NO: 22779 - RNA, 17 nt, Homo sapiens
gggcagugcuuggccca

SEQ ID NO: 22780 - RNA, 19 nt, Homo sapiens
gggcagugcuuggcccagg

SEQ ID NO: 22781 - RNA, 20 nt, Homo sapiens
gggcuuuagggaccugcugu

SEQ ID NO: 22782 - RNA, 21 nt, Homo sapiens
gggcuuuagggaccugcuguu

SEQ ID NO: 22783 - RNA, 14 nt, Homo sapiens
gggaccugcuguuu

SEQ ID NO: 22784 - RNA, 18 nt, Homo sapiens
gggaguggcgcgcgccac

SEQ ID NO: 22785 - RNA, 17 nt, Homo sapiens
gggccuggcugggagug

SEQ ID NO: 22786 - RNA, 19 nt, Homo sapiens
gguauuuuaaucaccaagg

SEQ ID NO: 22787 - RNA, 15 nt, Homo sapiens
ggucaacauggugaa

SEQ ID NO: 22788 - RNA, 16 nt, Homo sapiens
ggucucgaacugcugg

SEQ ID NO: 22789 - RNA, 19 nt, Homo sapiens
gggguggguggggcagugc

SEQ ID NO: 22790 - RNA, 19 nt, Homo sapiens
gggguuugccaugcuggcc

SEQ ID NO: 22791 - RNA, 13 nt, Homo sapiens
gggugagggcuug

SEQ ID NO: 22792 - RNA, 13 nt, Homo sapiens
ggguggggcagug

SEQ ID NO: 22793 - RNA, 16 nt, Homo sapiens
ggguuugccaugcugg

SEQ ID NO: 22794 - RNA, 15 nt, Homo sapiens
guauuuucagcagag

SEQ ID NO: 22795 - RNA, 23 nt, Homo sapiens
gucaggaguuccuaaccagccug

SEQ ID NO: 22796 - RNA, 16 nt, Homo sapiens
guccacugguucuucu

SEQ ID NO: 22797 - RNA, 15 nt, Homo sapiens
guagauaugaggcau

SEQ ID NO: 22798 - RNA, 16 nt, Homo sapiens
guauccuucagccuga

SEQ ID NO: 22799 - RNA, 17 nt, Homo sapiens
guauccuucagccugaa

SEQ ID NO: 22800 - RNA, 13 nt, Homo sapiens
guacuccagccug

SEQ ID NO: 22801 - RNA, 22 nt, Homo sapiens
guaccuaacgaaguauccuuca

SEQ ID NO: 22802 - RNA, 21 nt, Homo sapiens
guacauccauggugugcuggc

SEQ ID NO: 22803 - RNA, 22 nt, Homo sapiens
guacauuuccaaauucacaagu

SEQ ID NO: 22804 - RNA, 17 nt, Homo sapiens
gguucuaggccgggcgc

SEQ ID NO: 22805 - RNA, 14 nt, Homo sapiens
ggugagggcuugag

SEQ ID NO: 22806 - RNA, 13 nt, Homo sapiens
gggaguggcgcgc

SEQ ID NO: 22807 - RNA, 16 nt, Homo sapiens
gggaguggcgcgcgcc

SEQ ID NO: 22808 - RNA, 17 nt, Homo sapiens
gggaguggcgcgcgcca

SEQ ID NO: 22809 - RNA, 21 nt, Homo sapiens
ggcuggucucgaacugcugga

SEQ ID NO: 22810 - RNA, 20 nt, Homo sapiens
gggacacaggcuccaaacug

SEQ ID NO: 22811 - RNA, 17 nt, Homo sapiens
ggcuccaaacuggagcu

SEQ ID NO: 22812 - RNA, 23 nt, Homo sapiens
ggcucugggauagcugacccagc

SEQ ID NO: 22813 - RNA, 13 nt, Homo sapiens
ggcugagcaguca

SEQ ID NO: 22814 - RNA, 12 nt, Homo sapiens
ggcuggagugca

SEQ ID NO: 22815 - RNA, 20 nt, Homo sapiens
ggcuuagacccucaugcugc

SEQ ID NO: 22816 - RNA, 21 nt, Homo sapiens
ggcuuagacccucaugcugcc

SEQ ID NO: 22817 - RNA, 22 nt, Homo sapiens
ggcucacgccuguaaucccagc

SEQ ID NO: 22818 - RNA, 11 nt, Homo sapiens
ggccugcugga

SEQ ID NO: 22819 - RNA, 15 nt, Homo sapiens
ggccugcuggaugug

SEQ ID NO: 22820 - RNA, 14 nt, Homo sapiens
ggcgcgcgccacca

SEQ ID NO: 22821 - RNA, 20 nt, Homo sapiens
ggcgcgcgccaccacgccca

SEQ ID NO: 22822 - RNA, 17 nt, Homo sapiens
ggcgcgcgccaccacgc

SEQ ID NO: 22823 - RNA, 15 nt, Homo sapiens
ggccgggcgcggugg

SEQ ID NO: 22824 - RNA, 22 nt, Homo sapiens
ggcauguaugacgugacuggcc

SEQ ID NO: 22825 - RNA, 15 nt, Homo sapiens
ggcagugcuuggccc

SEQ ID NO: 22826 - RNA, 18 nt, Homo sapiens
ggcagugcuuggcccagg

SEQ ID NO: 22827 - RNA, 19 nt, Homo sapiens
ggcagugcuuggcccagga

SEQ ID NO: 22828 - RNA, 14 nt, Homo sapiens
ggcgcgguggcuca

SEQ ID NO: 22829 - RNA, 21 nt, Homo sapiens
ggaguuccuaaccagccuggu

SEQ ID NO: 22830 - RNA, 22 nt, Homo sapiens
ggcagcaggauagagugggaca

SEQ ID NO: 22831 - RNA, 20 nt, Homo sapiens
ggcacuugggacaaaaacaa

SEQ ID NO: 22832 - RNA, 21 nt, Homo sapiens
ggcagagguugcagugagccg

SEQ ID NO: 22833 - RNA, 15 nt, Homo sapiens
ggcagcaggauagag

SEQ ID NO: 22834 - RNA, 14 nt, Homo sapiens
gcgugagccaccaa

SEQ ID NO: 22835 - RNA, 22 nt, Homo sapiens
gcgugagccaccaaacccggcc

SEQ ID NO: 22836 - RNA, 19 nt, Homo sapiens
gcgugcaggcagcaggaua

SEQ ID NO: 22837 - RNA, 14 nt, Homo sapiens
gcgcgcgccaccac

SEQ ID NO: 22838 - RNA, 13 nt, Homo sapiens
gcgcgugcaggca

SEQ ID NO: 22839 - RNA, 16 nt, Homo sapiens
gcgggacacaggcucc

SEQ ID NO: 22840 - RNA, 22 nt, Homo sapiens
gcgcgcaccuguaaucccagcu

SEQ ID NO: 22841 - RNA, 15 nt, Homo sapiens
gcgcgcgccaccacg

SEQ ID NO: 22842 - RNA, 20 nt, Homo sapiens
gcucauggaauuggagcucg

SEQ ID NO: 22843 - RNA, 14 nt, Homo sapiens
gcucauggaauugg

SEQ ID NO: 22844 - RNA, 14 nt, Homo sapiens
ggaauuggagcucg

SEQ ID NO: 22845 - RNA, 16 nt, Homo sapiens
gcuuuagggaccugcu

SEQ ID NO: 22846 - RNA, 22 nt, Homo sapiens
gcuugaaauagugucugaugaa

SEQ ID NO: 22847 - RNA, 12 nt, Homo sapiens
gcuuagacccuc

SEQ ID NO: 22848 - RNA, 15 nt, Homo sapiens
gcuuagacccucaug

SEQ ID NO: 22849 - RNA, 20 nt, Homo sapiens
gcuuagacccucaugcugcc

SEQ ID NO: 22850 - RNA, 18 nt, Homo sapiens
gcuggucucgaacugcug

SEQ ID NO: 22851 - RNA, 19 nt, Homo sapiens
gcuggucucgaacugcugg

SEQ ID NO: 22852 - RNA, 14 nt, Homo sapiens
gcugggaguggcau

SEQ ID NO: 22853 - RNA, 16 nt, Homo sapiens
gcugggaguggcaugu

SEQ ID NO: 22854 - RNA, 21 nt, Homo sapiens
gcuguauuuuaaaagaaugau

SEQ ID NO: 22855 - RNA, 14 nt, Homo sapiens
gcuggccaggcugg

SEQ ID NO: 22856 - RNA, 16 nt, Homo sapiens
ggacauuugcucaugg

SEQ ID NO: 22857 - RNA, 18 nt, Homo sapiens
ggaauuggagcucguggg

SEQ ID NO: 22858 - RNA, 17 nt, Homo sapiens
ggacagucaccucaugg

SEQ ID NO: 22859 - RNA, 18 nt, Homo sapiens
ggacagucaccucaugga

SEQ ID NO: 22860 - RNA, 10 nt, Homo sapiens
ggaccugcug

SEQ ID NO: 22861 - RNA, 11 nt, Homo sapiens
ggaccugcugu

SEQ ID NO: 22862 - RNA, 14 nt, Homo sapiens
ggacgaaccuugaa

SEQ ID NO: 22863 - RNA, 10 nt, Homo sapiens
ggagaagaac

SEQ ID NO: 22864 - RNA, 11 nt, Homo sapiens
ggagaagaacu

SEQ ID NO: 22865 - RNA, 11 nt, Homo sapiens
ggagacaccac

SEQ ID NO: 22866 - RNA, 13 nt, Homo sapiens
ggagacaccacca

SEQ ID NO: 22867 - RNA, 15 nt, Homo sapiens
ggagacaccaccacc

SEQ ID NO: 22868 - RNA, 16 nt, Homo sapiens
ggagacaccaccaccc

SEQ ID NO: 22869 - RNA, 14 nt, Homo sapiens
ggaguuuggccaga

SEQ ID NO: 22870 - RNA, 16 nt, Homo sapiens
ggaggcugaggcgggu

SEQ ID NO: 22871 - RNA, 17 nt, Homo sapiens
cuugcuccuggcugggg

SEQ ID NO: 22872 - RNA, 12 nt, Homo sapiens
cuuggucucagu

SEQ ID NO: 22873 - RNA, 12 nt, Homo sapiens
cuuggcccagga

SEQ ID NO: 22874 - RNA, 22 nt, Homo sapiens
cuuggcccaggaguuuggccag

SEQ ID NO: 22875 - RNA, 23 nt, Homo sapiens
cuuggcccaggaguuuggccaga

SEQ ID NO: 22876 - RNA, 19 nt, Homo sapiens
cuuuaaguguaacuggcag

SEQ ID NO: 22877 - RNA, 20 nt, Homo sapiens
cuuuaaguguaacuggcagu

SEQ ID NO: 22878 - RNA, 16 nt, Homo sapiens
cuuuagggaccugcug

SEQ ID NO: 22879 - RNA, 20 nt, Homo sapiens
cuguccccgaaacuaccagc

SEQ ID NO: 22880 - RNA, 19 nt, Homo sapiens
cuuacuaguuucccuugca

SEQ ID NO: 22881 - RNA, 16 nt, Homo sapiens
cuguugccaaggcugg

SEQ ID NO: 22882 - RNA, 21 nt, Homo sapiens
cuguugccaaggcuggagugc

SEQ ID NO: 22883 - RNA, 21 nt, Homo sapiens
cuguaaaauggagacaccacc

SEQ ID NO: 22884 - RNA, 14 nt, Homo sapiens
cuggucucgaacug

SEQ ID NO: 22885 - RNA, 18 nt, Homo sapiens
cuggucucgaacugcugg

SEQ ID NO: 22886 - RNA, 19 nt, Homo sapiens
cuggucucgaacugcugga

SEQ ID NO: 22887 - RNA, 16 nt, Homo sapiens
cuucaugcauuugcac

SEQ ID NO: 22888 - RNA, 14 nt, Homo sapiens
cuugaugaagaagu

SEQ ID NO: 22889 - RNA, 20 nt, Homo sapiens
cucgaacugcuggauucaag

SEQ ID NO: 22890 - RNA, 12 nt, Homo sapiens
cuccagccuggg

SEQ ID NO: 22891 - RNA, 10 nt, Homo sapiens
cugagcaguc

SEQ ID NO: 22892 - RNA, 14 nt, Homo sapiens
cugagaccagccaa

SEQ ID NO: 22893 - RNA, 15 nt, Homo sapiens
cugagaccagccaac

SEQ ID NO: 22894 - RNA, 20 nt, Homo sapiens
cugagaccagccaaccuggg

SEQ ID NO: 22895 - RNA, 12 nt, Homo sapiens
cugaggcgggug

SEQ ID NO: 22896 - RNA, 13 nt, Homo sapiens
cugaggcgggugg

SEQ ID NO: 22897 - RNA, 21 nt, Homo sapiens
cugcagacaugagagacagca

SEQ ID NO: 22898 - RNA, 21 nt, Homo sapiens
cuggaaaccacauggcuucac

SEQ ID NO: 22899 - RNA, 11 nt, Homo sapiens
cuggaaacuuc

SEQ ID NO: 22900 - RNA, 16 nt, Homo sapiens
cuggccaacgggguga

SEQ ID NO: 22901 - RNA, 20 nt, Homo sapiens
cugcuggauguggagggggc

SEQ ID NO: 22902 - RNA, 18 nt, Homo sapiens
cugccucuaaaaggccug

SEQ ID NO: 22903 - RNA, 18 nt, Homo sapiens
cugccuaagugcagcccc

SEQ ID NO: 22904 - RNA, 14 nt, Homo sapiens
cuggccugcuggau

SEQ ID NO: 22905 - RNA, 16 nt, Homo sapiens
cuggccugcuggaugu

SEQ ID NO: 22906 - RNA, 18 nt, Homo sapiens
cuggccaggcuggucucg

SEQ ID NO: 22907 - RNA, 12 nt, Homo sapiens
cuggccugcugg

SEQ ID NO: 22908 - RNA, 13 nt, Homo sapiens
cuggccugcugga

SEQ ID NO: 22909 - RNA, 13 nt, Homo sapiens
cuggccaggcugg

SEQ ID NO: 22910 - RNA, 20 nt, Homo sapiens
cugggaauuacaggcgugag

SEQ ID NO: 22911 - RNA, 20 nt, Homo sapiens
cuggggcucugggauagcug

SEQ ID NO: 22912 - RNA, 14 nt, Homo sapiens
cuaguuucccuugc

SEQ ID NO: 22913 - RNA, 19 nt, Homo sapiens
cuagggugauauuaaccag

SEQ ID NO: 22914 - RNA, 23 nt, Homo sapiens
cuaguaauuggaaaggcagcucu

SEQ ID NO: 22915 - RNA, 20 nt, Homo sapiens
cucagugucaaugcagcccc

SEQ ID NO: 22916 - RNA, 17 nt, Homo sapiens
cuauguggcuguaucuu

SEQ ID NO: 22917 - RNA, 14 nt, Homo sapiens
cuccaaacuggagc

SEQ ID NO: 22918 - RNA, 16 nt, Homo sapiens
cuccaccuucuggguu

SEQ ID NO: 22919 - RNA, 20 nt, Homo sapiens
cucaugggggugacaagcuu

SEQ ID NO: 22920 - RNA, 19 nt, Homo sapiens
cucauugcaaccuccaccu

SEQ ID NO: 22921 - RNA, 19 nt, Homo sapiens
cucauggaauuggagcucg

SEQ ID NO: 22922 - RNA, 20 nt, Homo sapiens
cucauggaauuggagcucgu

SEQ ID NO: 22923 - RNA, 22 nt, Homo sapiens
cgggaguggcgcgcgccaccac

SEQ ID NO: 22924 - RNA, 23 nt, Homo sapiens
cgggguuugccaugcuggccagg

SEQ ID NO: 22925 - RNA, 19 nt, Homo sapiens
cgggguuugccaugcuggc

SEQ ID NO: 22926 - RNA, 16 nt, Homo sapiens
cgugacuggccugcug

SEQ ID NO: 22927 - RNA, 17 nt, Homo sapiens
cgugacuggccugcugg

SEQ ID NO: 22928 - RNA, 16 nt, Homo sapiens
cgugaccugacagccc

SEQ ID NO: 22929 - RNA, 17 nt, Homo sapiens
cgugaccugacagccca

SEQ ID NO: 22930 - RNA, 14 nt, Homo sapiens
cgugagccaccaaa

SEQ ID NO: 22931 - RNA, 15 nt, Homo sapiens
cgugagccaccaaac

SEQ ID NO: 22932 - RNA, 16 nt, Homo sapiens
cgugagccaccaaacc

SEQ ID NO: 22933 - RNA, 17 nt, Homo sapiens
cgugagccaccaaaccc

SEQ ID NO: 22934 - RNA, 21 nt, Homo sapiens
cgugagccaccaaacccggcc

SEQ ID NO: 22935 - RNA, 12 nt, Homo sapiens
cgugagccacca

SEQ ID NO: 22936 - RNA, 15 nt, Homo sapiens
cgcgccaccacgccc

SEQ ID NO: 22937 - RNA, 11 nt, Homo sapiens
cgggcauggug

SEQ ID NO: 22938 - RNA, 17 nt, Homo sapiens
cgcgcgccaccacgccc

SEQ ID NO: 22939 - RNA, 20 nt, Homo sapiens
cgcgcgccaccacgcccagc

SEQ ID NO: 22940 - RNA, 12 nt, Homo sapiens
cgcgccaccacg

SEQ ID NO: 22941 - RNA, 20 nt, Homo sapiens
gaagaguggguuucacaagu

SEQ ID NO: 22942 - RNA, 21 nt, Homo sapiens
gaagaguggguuucacaagug

SEQ ID NO: 22943 - RNA, 16 nt, Homo sapiens
gaauugacccacaaga

SEQ ID NO: 22944 - RNA, 11 nt, Homo sapiens
gaaugaaugaa

SEQ ID NO: 22945 - RNA, 16 nt, Homo sapiens
gaaucacuugaacccg

SEQ ID NO: 22946 - RNA, 17 nt, Homo sapiens
gaaucacuugaacccgg

SEQ ID NO: 22947 - RNA, 17 nt, Homo sapiens
gaauuggagcucguggg

SEQ ID NO: 22948 - RNA, 16 nt, Homo sapiens
gacaacauuaaaacaa

SEQ ID NO: 22949 - RNA, 15 nt, Homo sapiens
gacccucaugcugcc

SEQ ID NO: 22950 - RNA, 16 nt, Homo sapiens
gacccucaugcugcca

SEQ ID NO: 22951 - RNA, 16 nt, Homo sapiens
gaccagccaaccuggg

SEQ ID NO: 22952 - RNA, 19 nt, Homo sapiens
gaccagccaaccugggggc

SEQ ID NO: 22953 - RNA, 11 nt, Homo sapiens
gacaccaccac

SEQ ID NO: 22954 - RNA, 13 nt, Homo sapiens
gacaccaccaccc

SEQ ID NO: 22955 - RNA, 12 nt, Homo sapiens
gacaccaccacc

SEQ ID NO: 22956 - RNA, 20 nt, Homo sapiens
gacaguuccugagaccagcc

SEQ ID NO: 22957 - RNA, 13 nt, Homo sapiens
aauuagccgggca

SEQ ID NO: 22958 - RNA, 15 nt, Homo sapiens
aauuuugugaagcaa

SEQ ID NO: 22959 - RNA, 15 nt, Homo sapiens
aaugaaugaaugaau

SEQ ID NO: 22960 - RNA, 12 nt, Homo sapiens
aauuagccgggc

SEQ ID NO: 22961 - RNA, 15 nt, Homo sapiens
acacacugaagaagc

SEQ ID NO: 22962 - RNA, 14 nt, Homo sapiens
acacagugucuggc

SEQ ID NO: 22963 - RNA, 19 nt, Homo sapiens
acaccagggccuggcuggg

SEQ ID NO: 22964 - RNA, 23 nt, Homo sapiens
acaccaauauucauagcagcuua

SEQ ID NO: 22965 - RNA, 23 nt, Homo sapiens
gaacccauauuuguacaccaaua

SEQ ID NO: 22966 - RNA, 13 nt, Homo sapiens
gacgugacuggcc

SEQ ID NO: 22967 - RNA, 12 nt, Homo sapiens
gacgaaccuuga

SEQ ID NO: 22968 - RNA, 17 nt, Homo sapiens
gagaaaauaaaagcacu

SEQ ID NO: 22969 - RNA, 16 nt, Homo sapiens
gacuguacccaaaugg

SEQ ID NO: 22970 - RNA, 14 nt, Homo sapiens
gacuugggcgggac

SEQ ID NO: 22971 - RNA, 14 nt, Homo sapiens
gacuggccugcugg

SEQ ID NO: 22972 - RNA, 15 nt, Homo sapiens
gacuggccugcugga

SEQ ID NO: 22973 - RNA, 20 nt, Homo sapiens
gacgugacuggccugcugga

SEQ ID NO: 22974 - RNA, 20 nt, Homo sapiens
gacccucaugcugccaauau

SEQ ID NO: 22975 - RNA, 14 nt, Homo sapiens
gacuaaaaaacaaa

SEQ ID NO: 22976 - RNA, 10 nt, Homo sapiens
gagacaccac

SEQ ID NO: 22977 - RNA, 11 nt, Homo sapiens
gagacaccacc

SEQ ID NO: 22978 - RNA, 12 nt, Homo sapiens
gagacaccacca

SEQ ID NO: 22979 - RNA, 13 nt, Homo sapiens
gagacaccaccac

SEQ ID NO: 22980 - RNA, 13 nt, Homo sapiens
gagaccagccaac

SEQ ID NO: 22981 - RNA, 12 nt, Homo sapiens
gagcaccugcag

SEQ ID NO: 22982 - RNA, 16 nt, Homo sapiens
gagcaccugcaggcgu

SEQ ID NO: 22983 - RNA, 20 nt, Homo sapiens
gagcaccugcaggcgugacc

SEQ ID NO: 22984 - RNA, 14 nt, Homo sapiens
gagacagcaggucu

SEQ ID NO: 22985 - RNA, 15 nt, Homo sapiens
gagacagcaggucuc

SEQ ID NO: 22986 - RNA, 14 nt, Homo sapiens
gauuacccucuggg

SEQ ID NO: 22987 - RNA, 18 nt, Homo sapiens
gauuacccucugggucuc

SEQ ID NO: 22988 - RNA, 19 nt, Homo sapiens
gauucaagugauccgccca

SEQ ID NO: 22989 - RNA, 12 nt, Homo sapiens
gaugaagaaguu

SEQ ID NO: 22990 - RNA, 19 nt, Homo sapiens
gauaagcuauguuguugca

SEQ ID NO: 22991 - RNA, 21 nt, Homo sapiens
gaguggcauguaugacgugac

SEQ ID NO: 22992 - RNA, 14 nt, Homo sapiens
gaguggcgcgcgcc

SEQ ID NO: 22993 - RNA, 18 nt, Homo sapiens
gaggacuugggcgggaca

SEQ ID NO: 22994 - RNA, 19 nt, Homo sapiens
gaggagaaacuggaacucu

SEQ ID NO: 22995 - RNA, 18 nt, Homo sapiens
gaggcagagguugcagug

SEQ ID NO: 22996 - RNA, 12 nt, Homo sapiens
gaggcugagaug

SEQ ID NO: 22997 - RNA, 20 nt, Homo sapiens
gagcugauaucaugccccug

SEQ ID NO: 22998 - RNA, 22 nt, Homo sapiens
gagccaccaaacccggccugau

SEQ ID NO: 22999 - RNA, 19 nt, Homo sapiens
gagccccuugggcagguca

SEQ ID NO: 23000 - RNA, 22 nt, Homo sapiens
gccugcuggauguggagggggc

SEQ ID NO: 23001 - RNA, 15 nt, Homo sapiens
gccucaccccuugcc

SEQ ID NO: 23002 - RNA, 15 nt, Homo sapiens
gccgggcgcgguggc

SEQ ID NO: 23003 - RNA, 12 nt, Homo sapiens
gccugggugaca

SEQ ID NO: 23004 - RNA, 18 nt, Homo sapiens
gccuggugcuuccaaaua

SEQ ID NO: 23005 - RNA, 16 nt, Homo sapiens
gccuguaaucccagca

SEQ ID NO: 23006 - RNA, 22 nt, Homo sapiens
gcccaacuguuauagguuguug

SEQ ID NO: 23007 - RNA, 23 nt, Homo sapiens
gcccaacuguuauagguuguugg

SEQ ID NO: 23008 - RNA, 22 nt, Homo sapiens
gcccacaccagggccuggcugg

SEQ ID NO: 23009 - RNA, 17 nt, Homo sapiens
gcccaggaguuuggcca

SEQ ID NO: 23010 - RNA, 22 nt, Homo sapiens
gcccauccugccccugagccca

SEQ ID NO: 23011 - RNA, 16 nt, Homo sapiens
gcccaucuccgucucc

SEQ ID NO: 23012 - RNA, 18 nt, Homo sapiens
gccccgugggguuccucc

SEQ ID NO: 23013 - RNA, 19 nt, Homo sapiens
gccccgggaguggcgcgcg

SEQ ID NO: 23014 - RNA, 20 nt, Homo sapiens
gccccuguacuccagccugg

SEQ ID NO: 23015 - RNA, 13 nt, Homo sapiens
gcccuucauguac

SEQ ID NO: 23016 - RNA, 19 nt, Homo sapiens
gccgagauugugccccugc

SEQ ID NO: 23017 - RNA, 23 nt, Homo sapiens
gccggagccccuugggcagguca

SEQ ID NO: 23018 - RNA, 18 nt, Homo sapiens
gcagugcuuggcccagga

SEQ ID NO: 23019 - RNA, 19 nt, Homo sapiens
gcaugguggcgcgcaccug

SEQ ID NO: 23020 - RNA, 21 nt, Homo sapiens
gcaugguggcgcgcaccugua

SEQ ID NO: 23021 - RNA, 15 nt, Homo sapiens
gcagugcuuggccca

SEQ ID NO: 23022 - RNA, 12 nt, Homo sapiens
gcaggcagcagg

SEQ ID NO: 23023 - RNA, 15 nt, Homo sapiens
gcaggcgugaccuga

SEQ ID NO: 23024 - RNA, 19 nt, Homo sapiens
gcagucagaagaccugguc

SEQ ID NO: 23025 - RNA, 12 nt, Homo sapiens
gcagugagccga

SEQ ID NO: 23026 - RNA, 13 nt, Homo sapiens
gcagugcuuggcc

SEQ ID NO: 23027 - RNA, 15 nt, Homo sapiens
gcauuguaacuuaug

SEQ ID NO: 23028 - RNA, 21 nt, Homo sapiens
gccaacugggguggguggggc

SEQ ID NO: 23029 - RNA, 13 nt, Homo sapiens
gccaaggcuggag

SEQ ID NO: 23030 - RNA, 16 nt, Homo sapiens
gccaccaaacccggcc

SEQ ID NO: 23031 - RNA, 15 nt, Homo sapiens
gccaccacgcccagc

SEQ ID NO: 23032 - RNA, 16 nt, Homo sapiens
gccaacuaggcagcca

SEQ ID NO: 23033 - RNA, 17 nt, Homo sapiens
gccaugcuggccaggcu

SEQ ID NO: 23034 - RNA, 21 nt, Homo sapiens
gccaugcuggccaggcugguc

SEQ ID NO: 23035 - RNA, 23 nt, Homo sapiens
gccaugcuggccaggcuggucuc

SEQ ID NO: 23036 - RNA, 15 nt, Homo sapiens
gccauggagguuaag

SEQ ID NO: 23037 - RNA, 20 nt, Homo sapiens
gccaugugauuacccucugg

SEQ ID NO: 23038 - RNA, 12 nt, Homo sapiens
gccaggcggcug

SEQ ID NO: 23039 - RNA, 23 nt, Homo sapiens
gcagcucuaaaugucaaucagcc

SEQ ID NO: 23040 - RNA, 19 nt, Homo sapiens
gcaggcgugaccugacagc

SEQ ID NO: 23041 - RNA, 20 nt, Homo sapiens
gcaggcgugaccugacagcc

SEQ ID NO: 23042 - RNA, 13 nt, Homo sapiens
gcagggacuugaa

SEQ ID NO: 23043 - RNA, 14 nt, Homo sapiens
gcagggacuugaac

SEQ ID NO: 23044 - RNA, 15 nt, Homo sapiens
gcagggacuugaacc

SEQ ID NO: 23045 - RNA, 16 nt, Homo sapiens
gcagggacuugaaccc

SEQ ID NO: 23046 - RNA, 17 nt, Homo sapiens
gcagggacuugaaccca

SEQ ID NO: 23047 - RNA, 20 nt, Homo sapiens
gcacuuauuuauuguuguug

SEQ ID NO: 23048 - RNA, 20 nt, Homo sapiens
gcacuuucccucuuggugcc

SEQ ID NO: 23049 - RNA, 21 nt, Homo sapiens
gcacuuucccucuuggugccu

SEQ ID NO: 23050 - RNA, 22 nt, Homo sapiens
gcacuuucccucuuggugccuc

SEQ ID NO: 23051 - RNA, 20 nt, Homo sapiens
gcagagacgggguuugccau

SEQ ID NO: 23052 - RNA, 22 nt, Homo sapiens
gcagccaugugauuacccucug

SEQ ID NO: 23053 - RNA, 17 nt, Homo sapiens
gcaccuguaaucccagc

SEQ ID NO: 23054 - RNA, 12 nt, Homo sapiens
gcaccugcaggc

SEQ ID NO: 23055 - RNA, 15 nt, Homo sapiens
gcaccugcaggcgug

SEQ ID NO: 23056 - RNA, 15 nt, Homo sapiens
gcaaccuccaccuuc

SEQ ID NO: 23057 - RNA, 18 nt, Homo sapiens
gcaaccuccaccuucugg

SEQ ID NO: 23058 - RNA, 22 nt, Homo sapiens
gcaaccuccaccuucuggguuc

SEQ ID NO: 23059 - RNA, 16 nt, Homo sapiens
gcaaccuuuggaugca

SEQ ID NO: 23060 - RNA, 16 nt, Homo sapiens
agccaccaaacccggc

SEQ ID NO: 23061 - RNA, 17 nt, Homo sapiens
agccagcacagccucuu

SEQ ID NO: 23062 - RNA, 14 nt, Homo sapiens
agccaggcggcugg

SEQ ID NO: 23063 - RNA, 19 nt, Homo sapiens
agccaucggagcugcuaga

SEQ ID NO: 23064 - RNA, 15 nt, Homo sapiens
agcacuuugggaggc

SEQ ID NO: 23065 - RNA, 17 nt, Homo sapiens
agcagggacuugaaccc

SEQ ID NO: 23066 - RNA, 18 nt, Homo sapiens
agcagggacuugaaccca

SEQ ID NO: 23067 - RNA, 17 nt, Homo sapiens
agcccacuggcucccug

SEQ ID NO: 23068 - RNA, 18 nt, Homo sapiens
agccccgggaguggcgcg

SEQ ID NO: 23069 - RNA, 19 nt, Homo sapiens
agccccuugggcaggucac

SEQ ID NO: 23070 - RNA, 23 nt, Homo sapiens
agacgggguuugccaugcuggcc

SEQ ID NO: 23071 - RNA, 22 nt, Homo sapiens
agagacgggguuugccaugcug

SEQ ID NO: 23072 - RNA, 12 nt, Homo sapiens
agacagcagguc

SEQ ID NO: 23073 - RNA, 14 nt, Homo sapiens
agacagcaggucuc

SEQ ID NO: 23074 - RNA, 15 nt, Homo sapiens
agacccucaugcugc

SEQ ID NO: 23075 - RNA, 16 nt, Homo sapiens
agacccucaugcugcc

SEQ ID NO: 23076 - RNA, 14 nt, Homo sapiens
agauaugaggcauu

SEQ ID NO: 23077 - RNA, 21 nt, Homo sapiens
agcaacccaaauguucaucaa

SEQ ID NO: 23078 - RNA, 18 nt, Homo sapiens
agcuguuuucccugaccu

SEQ ID NO: 23079 - RNA, 15 nt, Homo sapiens
agcuuauucacaaga

SEQ ID NO: 23080 - RNA, 20 nt, Homo sapiens
agcuaaguugcaccaacuuu

SEQ ID NO: 23081 - RNA, 21 nt, Homo sapiens
aggcuggagugcaguggcgca

SEQ ID NO: 23082 - RNA, 17 nt, Homo sapiens
aggcagaagcaacccaa

SEQ ID NO: 23083 - RNA, 21 nt, Homo sapiens
aggcagagguugcagugagcc

SEQ ID NO: 23084 - RNA, 16 nt, Homo sapiens
aggcauuugcagcugu

SEQ ID NO: 23085 - RNA, 19 nt, Homo sapiens
agccugaaagaggaaugaa

SEQ ID NO: 23086 - RNA, 22 nt, Homo sapiens
aggacuugggcgggacacaggc

SEQ ID NO: 23087 - RNA, 22 nt, Homo sapiens
aggaguuccuaaccagccuggu

SEQ ID NO: 23088 - RNA, 16 nt, Homo sapiens
aggaguuuggccagaa

SEQ ID NO: 23089 - RNA, 16 nt, Homo sapiens
agaagaugguaccacc

SEQ ID NO: 23090 - RNA, 17 nt, Homo sapiens
agaagaugguaccacca

SEQ ID NO: 23091 - RNA, 20 nt, Homo sapiens
acuugaaugugucaggugac

SEQ ID NO: 23092 - RNA, 12 nt, Homo sapiens
acuuuccagaga

SEQ ID NO: 23093 - RNA, 15 nt, Homo sapiens
acuuugggaggcuga

SEQ ID NO: 23094 - RNA, 21 nt, Homo sapiens
acucaucaaucaaauaaguau

SEQ ID NO: 23095 - RNA, 19 nt, Homo sapiens
acucauugcaaccuccacc

SEQ ID NO: 23096 - RNA, 21 nt, Homo sapiens
acuccugguuccuaggugagc

SEQ ID NO: 23097 - RNA, 20 nt, Homo sapiens
acucuacagccaggcggcug

SEQ ID NO: 23098 - RNA, 16 nt, Homo sapiens
acugcauacaaucuga

SEQ ID NO: 23099 - RNA, 16 nt, Homo sapiens
acuggccugcuggaug

SEQ ID NO: 23100 - RNA, 23 nt, Homo sapiens
acugggguggguggggcagugcu

SEQ ID NO: 23101 - RNA, 18 nt, Homo sapiens
acuagauacugaauguaa

SEQ ID NO: 23102 - RNA, 19 nt, Homo sapiens
acuagauacugaauguaaa

SEQ ID NO: 23103 - RNA, 19 nt, Homo sapiens
acgugacuggccugcugga

SEQ ID NO: 23104 - RNA, 20 nt, Homo sapiens
acgugacuggccugcuggau

SEQ ID NO: 23105 - RNA, 14 nt, Homo sapiens
acgugacuggccug

SEQ ID NO: 23106 - RNA, 23 nt, Homo sapiens
acgggguuugccaugcuggccag

SEQ ID NO: 23107 - RNA, 16 nt, Homo sapiens
accuccaccuucuggg

SEQ ID NO: 23108 - RNA, 11 nt, Homo sapiens
acccgggaggc

SEQ ID NO: 23109 - RNA, 12 nt, Homo sapiens
acccgggaggca

SEQ ID NO: 23110 - RNA, 14 nt, Homo sapiens
accuguccccgaaa

SEQ ID NO: 23111 - RNA, 20 nt, Homo sapiens
accaaggcugauuaaaccaa

SEQ ID NO: 23112 - RNA, 11 nt, Homo sapiens
accugagcccc

SEQ ID NO: 23113 - RNA, 11 nt, Homo sapiens
accugcaggcg

SEQ ID NO: 23114 - RNA, 23 nt, Homo sapiens
accugcuguuuccuagcgcagcc

SEQ ID NO: 23115 - RNA, 18 nt, Homo sapiens
acaaaaauuagccgggca

SEQ ID NO: 23116 - RNA, 16 nt, Homo sapiens
aauuuugugaagcaaa

SEQ ID NO: 23117 - RNA, 21 nt, Homo sapiens
aauugaauucccugccuggau

SEQ ID NO: 23118 - RNA, 14 nt, Homo sapiens
aaugaaugaaugaa

SEQ ID NO: 23119 - RNA, 18 nt, Homo sapiens
aauccagaaauaaugaaa

SEQ ID NO: 23120 - RNA, 10 nt, Homo sapiens
aaugugcaau

SEQ ID NO: 23121 - RNA, 19 nt, Homo sapiens
aauuagccgggcauggugg

SEQ ID NO: 23122 - RNA, 16 nt, Homo sapiens
aagugaaaaacaucca

SEQ ID NO: 23123 - RNA, 11 nt, Homo sapiens
aaguucugcag

SEQ ID NO: 23124 - RNA, 17 nt, Homo sapiens
aauaaaaaggugaccau

SEQ ID NO: 23125 - RNA, 16 nt, Homo sapiens
aauaaaaaggugacca

SEQ ID NO: 23126 - RNA, 15 nt, Homo sapiens
accagggccuggcug

SEQ ID NO: 23127 - RNA, 18 nt, Homo sapiens
acauccagauagguuacc

SEQ ID NO: 23128 - RNA, 11 nt, Homo sapiens
acaggcgugag

SEQ ID NO: 23129 - RNA, 19 nt, Homo sapiens
acagugauuaccagggacu

SEQ ID NO: 23130 - RNA, 14 nt, Homo sapiens
acacuuauaaguga

SEQ ID NO: 23131 - RNA, 15 nt, Homo sapiens
acacuuauaagugaa

SEQ ID NO: 23132 - RNA, 20 nt, Homo sapiens
acaaccuaaauuugguucua

SEQ ID NO: 23133 - RNA, 22 nt, Homo sapiens
acaagaaaugaaagcagggacu

SEQ ID NO: 23134 - RNA, 23 nt, Homo sapiens
acaagaaaugaaagcagggacuu

SEQ ID NO: 23135 - RNA, 19 nt, Homo sapiens
acaaaaauuagccgggcau

SEQ ID NO: 23136 - RNA, 12 nt, Homo sapiens
acaccaccaccc

SEQ ID NO: 23137 - RNA, 16 nt, Homo sapiens
acagcccaaggguggg

SEQ ID NO: 23138 - RNA, 18 nt, Homo sapiens
acagcuacuugggaggcu

SEQ ID NO: 23139 - RNA, 12 nt, Homo sapiens
acaggaaccaca

SEQ ID NO: 23140 - RNA, 19 nt, Homo sapiens
acaggaaguagaggaggcc

SEQ ID NO: 23141 - RNA, 22 nt, Homo sapiens
acaggaaguagaggaggccacg

SEQ ID NO: 23142 - RNA, 17 nt, Homo sapiens
aagacccaaaaggcaga

SEQ ID NO: 23143 - RNA, 22 nt, Homo sapiens
aacugggguggguggggcagug

SEQ ID NO: 23144 - RNA, 19 nt, Homo sapiens
aacugacucuuaagaagac

SEQ ID NO: 23145 - RNA, 11 nt, Homo sapiens
aaggugaccau

SEQ ID NO: 23146 - RNA, 17 nt, Homo sapiens
aaguauccuucagccug

SEQ ID NO: 23147 - RNA, 16 nt, Homo sapiens
aagugaaauaagccag

SEQ ID NO: 23148 - RNA, 15 nt, Homo sapiens
aaggcuggagugcag

SEQ ID NO: 23149 - RNA, 22 nt, Homo sapiens
aagcuuccauuccaagccugac

SEQ ID NO: 23150 - RNA, 13 nt, Homo sapiens
aagcaacccaaau

SEQ ID NO: 23151 - RNA, 22 nt, Homo sapiens
aagccagauuuuccugaaaacc

SEQ ID NO: 23152 - RNA, 20 nt, Homo sapiens
aagccaucggagcugcuaga

SEQ ID NO: 23153 - RNA, 20 nt, Homo sapiens
aacugacucuuaagaagacu

SEQ ID NO: 23154 - RNA, 15 nt, Homo sapiens
aacucagaaacauca

SEQ ID NO: 23155 - RNA, 11 nt, Homo sapiens
aaccugagccc

SEQ ID NO: 23156 - RNA, 15 nt, Homo sapiens
aaccugucccagcga

SEQ ID NO: 23157 - RNA, 13 nt, Homo sapiens
aacccggccugau

SEQ ID NO: 23158 - RNA, 18 nt, Homo sapiens
aaggccugucccugcaga

SEQ ID NO: 23159 - RNA, 22 nt, Homo sapiens
aaggcuuagacccucaugcugc

SEQ ID NO: 23160 - RNA, 23 nt, Homo sapiens
aaggcuuagacccucaugcugcc

SEQ ID NO: 23161 - RNA, 23 nt, Homo sapiens
aaacauccagauacacccaaagu

SEQ ID NO: 23162 - RNA, 12 nt, Homo sapiens
aaaagaaagaaa

SEQ ID NO: 23163 - RNA, 14 nt, Homo sapiens
aaaaguagaauaaa

SEQ ID NO: 23164 - RNA, 17 nt, Homo sapiens
aaagucagugcccaacu

SEQ ID NO: 23165 - RNA, 19 nt, Homo sapiens
aaagucagugcccaacugu

SEQ ID NO: 23166 - RNA, 22 nt, Homo sapiens
aacauuugguaaggggaauuga

SEQ ID NO: 23167 - RNA, 21 nt, Homo sapiens
aaauguucaucaaugaaugaa

SEQ ID NO: 23168 - RNA, 13 nt, Homo sapiens
aaacccggccuga

SEQ ID NO: 23169 - RNA, 12 nt, Homo sapiens
aaaaggaagaaa

SEQ ID NO: 23170 - RNA, 13 nt, Homo sapiens
aucaaugaaugaa

SEQ ID NO: 23171 - RNA, 14 nt, Homo sapiens
aucaaugaaugaau

SEQ ID NO: 23172 - RNA, 17 nt, Homo sapiens
aucaggcuggccaacgg

SEQ ID NO: 23173 - RNA, 20 nt, Homo sapiens
aucccagcuacuugggaggc

SEQ ID NO: 23174 - RNA, 20 nt, Homo sapiens
auccuaauaaaaaggugacc

SEQ ID NO: 23175 - RNA, 21 nt, Homo sapiens
auccuaauaaaaaggugacca

SEQ ID NO: 23176 - RNA, 22 nt, Homo sapiens
auccuaauaaaaaggugaccau

SEQ ID NO: 23177 - RNA, 17 nt, Homo sapiens
aucucacaagcacuuuc

SEQ ID NO: 23178 - RNA, 19 nt, Homo sapiens
aucucacaagcacuuuccc

SEQ ID NO: 23179 - RNA, 24 nt, Homo sapiens
aucucaggagauuucaugccuggu

SEQ ID NO: 23180 - RNA, 21 nt, Homo sapiens
auguggagggggcgcgugcag

SEQ ID NO: 23181 - RNA, 23 nt, Homo sapiens
auguggagggggcgcgugcaggc

SEQ ID NO: 23182 - RNA, 19 nt, Homo sapiens
augucauuugcuggagcuc

SEQ ID NO: 23183 - RNA, 14 nt, Homo sapiens
auggagacaccacc

SEQ ID NO: 23184 - RNA, 15 nt, Homo sapiens
auggagacaccacca

SEQ ID NO: 23185 - RNA, 12 nt, Homo sapiens
auggagacacca

SEQ ID NO: 23186 - RNA, 13 nt, Homo sapiens
auggagacaccac

SEQ ID NO: 23187 - RNA, 16 nt, Homo sapiens
augaaguacucauaca

SEQ ID NO: 23188 - RNA, 18 nt, Homo sapiens
aucuguaaaauggagaca

SEQ ID NO: 23189 - RNA, 15 nt, Homo sapiens
aucuuguuuuuccac

SEQ ID NO: 23190 - RNA, 11 nt, Homo sapiens
aucuuucacau

SEQ ID NO: 23191 - RNA, 14 nt, Homo sapiens
augacgugacuggc

SEQ ID NO: 23192 - RNA, 15 nt, Homo sapiens
augcuggccaggcug

SEQ ID NO: 23193 - RNA, 16 nt, Homo sapiens
auaaaaaggugaccau

SEQ ID NO: 23194 - RNA, 18 nt, Homo sapiens
auacaaaaauuagccggg

SEQ ID NO: 23195 - RNA, 20 nt, Homo sapiens
auacaaaaauuagccgggca

SEQ ID NO: 23196 - RNA, 16 nt, Homo sapiens
auacaaucaucaaccc

SEQ ID NO: 23197 - RNA, 14 nt, Homo sapiens
agucagaagaccug

SEQ ID NO: 23198 - RNA, 15 nt, Homo sapiens
agucagaagaccugg

SEQ ID NO: 23199 - RNA, 13 nt, Homo sapiens
agugcaguggcgc

SEQ ID NO: 23200 - RNA, 14 nt, Homo sapiens
agugcaguggcgca

SEQ ID NO: 23201 - RNA, 15 nt, Homo sapiens
agugcuuggcccagg

SEQ ID NO: 23202 - RNA, 19 nt, Homo sapiens
agugcuuggcccaggaguu

SEQ ID NO: 23203 - RNA, 19 nt, Homo sapiens
aguggcauguaugacguga

SEQ ID NO: 23204 - RNA, 19 nt, Homo sapiens
aguggcgcgcgccaccacg

SEQ ID NO: 23205 - RNA, 18 nt, Homo sapiens
agguauuuuaaucaccaa

SEQ ID NO: 23206 - RNA, 19 nt, Homo sapiens
agguauuuuaaucaccaag

SEQ ID NO: 23207 - RNA, 9 nt, Homo sapiens
aggugacca

SEQ ID NO: 23208 - RNA, 22 nt, Homo sapiens
agugacauguuuacaaaccuca

SEQ ID NO: 23209 - RNA, 23 nt, Homo sapiens
agugacauguuuacaaaccucaa

SEQ ID NO: 23210 - RNA, 17 nt, Homo sapiens
aggguggguggggugag

SEQ ID NO: 23211 - RNA, 17 nt, Homo sapiens
aggguacacugccuucu

SEQ ID NO: 23212 - RNA, 11 nt, Homo sapiens
agggaccugcu

SEQ ID NO: 23213 - RNA, 17 nt, Homo sapiens
aggcuggucucgaacug

SEQ ID NO: 23214 - RNA, 21 nt, Homo sapiens
aggcuuagacccucaugcugc

SEQ ID NO: 23215 - RNA, 15 nt, Homo sapiens
agggacuugaaccca

SEQ ID NO: 23216 - RNA, 22 nt, Homo sapiens
cacugguucuucuuggucucag

SEQ ID NO: 23217 - RNA, 21 nt, Homo sapiens
cacugaagaagcaccaaucau

SEQ ID NO: 23218 - RNA, 12 nt, Homo sapiens
cacugcauacaa

SEQ ID NO: 23219 - RNA, 23 nt, Homo sapiens
cagacaugagagacagcaggucu

SEQ ID NO: 23220 - RNA, 14 nt, Homo sapiens
cagaagucaaggcu

SEQ ID NO: 23221 - RNA, 14 nt, Homo sapiens
cagccaggcggcug

SEQ ID NO: 23222 - RNA, 15 nt, Homo sapiens
cagccaggcggcugg

SEQ ID NO: 23223 - RNA, 22 nt, Homo sapiens
cagcaggauagagugggacagu

SEQ ID NO: 23224 - RNA, 18 nt, Homo sapiens
cagccugaaagaggaaug

SEQ ID NO: 23225 - RNA, 13 nt, Homo sapiens
cagccugggugac

SEQ ID NO: 23226 - RNA, 14 nt, Homo sapiens
cagccugggugaca

SEQ ID NO: 23227 - RNA, 14 nt, Homo sapiens
caccugcaggcgug

SEQ ID NO: 23228 - RNA, 18 nt, Homo sapiens
cacccuugccauggaggu

SEQ ID NO: 23229 - RNA, 10 nt, Homo sapiens
caccaccacc

SEQ ID NO: 23230 - RNA, 19 nt, Homo sapiens
caccacccuugccauggag

SEQ ID NO: 23231 - RNA, 17 nt, Homo sapiens
caccagggccuggcugg

SEQ ID NO: 23232 - RNA, 16 nt, Homo sapiens
caccucauggaauugg

SEQ ID NO: 23233 - RNA, 14 nt, Homo sapiens
cacacugaagaagc

SEQ ID NO: 23234 - RNA, 17 nt, Homo sapiens
cacaaccacucauucaa

SEQ ID NO: 23235 - RNA, 21 nt, Homo sapiens
cacaacuauauuaucaugcaa

SEQ ID NO: 23236 - RNA, 16 nt, Homo sapiens
cacaagacugcacauc

SEQ ID NO: 23237 - RNA, 14 nt, Homo sapiens
cacaugauccugca

SEQ ID NO: 23238 - RNA, 13 nt, Homo sapiens
cacagugucuggc

SEQ ID NO: 23239 - RNA, 20 nt, Homo sapiens
cacaggcuccaaacuggagc

SEQ ID NO: 23240 - RNA, 16 nt, Homo sapiens
auuuuaaucaccaagg

SEQ ID NO: 23241 - RNA, 13 nt, Homo sapiens
auuuucaccuguu

SEQ ID NO: 23242 - RNA, 14 nt, Homo sapiens
caaacgaaaaacau

SEQ ID NO: 23243 - RNA, 14 nt, Homo sapiens
caaaugcuguauuc

SEQ ID NO: 23244 - RNA, 18 nt, Homo sapiens
caacuggggugggugggg

SEQ ID NO: 23245 - RNA, 15 nt, Homo sapiens
caagacccaaaaggc

SEQ ID NO: 23246 - RNA, 17 nt, Homo sapiens
caagacugcacaucaaa

SEQ ID NO: 23247 - RNA, 17 nt, Homo sapiens
caagccaucggagcugc

SEQ ID NO: 23248 - RNA, 15 nt, Homo sapiens
caagcucacagaccu

SEQ ID NO: 23249 - RNA, 21 nt, Homo sapiens
caaggcuggagugcaguggcg

SEQ ID NO: 23250 - RNA, 22 nt, Homo sapiens
caaggcuggagugcaguggcgc

SEQ ID NO: 23251 - RNA, 16 nt, Homo sapiens
caaggcuuagacccuc

SEQ ID NO: 23252 - RNA, 13 nt, Homo sapiens
caaucaucaaccc

SEQ ID NO: 23253 - RNA, 14 nt, Homo sapiens
caaucaucaacccc

SEQ ID NO: 23254 - RNA, 11 nt, Homo sapiens
auuugguucua

SEQ ID NO: 23255 - RNA, 14 nt, Homo sapiens
auucugcaagcuuu

SEQ ID NO: 23256 - RNA, 16 nt, Homo sapiens
auugagcaccugcagg

SEQ ID NO: 23257 - RNA, 20 nt, Homo sapiens
auugagcaccugcaggcgug

SEQ ID NO: 23258 - RNA, 17 nt, Homo sapiens
auugcuaucgccaucac

SEQ ID NO: 23259 - RNA, 18 nt, Homo sapiens
auuggagcucgugggaca

SEQ ID NO: 23260 - RNA, 16 nt, Homo sapiens
auguugacaugggaca

SEQ ID NO: 23261 - RNA, 16 nt, Homo sapiens
auuacuguaagaaaau

SEQ ID NO: 23262 - RNA, 12 nt, Homo sapiens
auuagccgggca

SEQ ID NO: 23263 - RNA, 21 nt, Homo sapiens
auucagccccgggaguggcgc

SEQ ID NO: 23264 - RNA, 22 nt, Homo sapiens
auucagccccgggaguggcgcg

SEQ ID NO: 23265 - RNA, 11 nt, Homo sapiens
cauguuuucuu

SEQ ID NO: 23266 - RNA, 15 nt, Homo sapiens
cauggaucugguagg

SEQ ID NO: 23267 - RNA, 20 nt, Homo sapiens
cauggaauuggagcucgugg

SEQ ID NO: 23268 - RNA, 15 nt, Homo sapiens
cauggugugcuggcu

SEQ ID NO: 23269 - RNA, 19 nt, Homo sapiens
caugcugccaauauccuaa

SEQ ID NO: 23270 - RNA, 22 nt, Homo sapiens
cauccugccccugagcccaugg

SEQ ID NO: 23271 - RNA, 16 nt, Homo sapiens
caugaaguccaagcau

SEQ ID NO: 23272 - RNA, 17 nt, Homo sapiens
caugaaguccaagcauu

SEQ ID NO: 23273 - RNA, 13 nt, Homo sapiens
cauagggugacac

SEQ ID NO: 23274 - RNA, 20 nt, Homo sapiens
caguuccugagaccagccaa

SEQ ID NO: 23275 - RNA, 21 nt, Homo sapiens
caguuccugagaccagccaac

SEQ ID NO: 23276 - RNA, 21 nt, Homo sapiens
caucaaggguacacugccuuc

SEQ ID NO: 23277 - RNA, 17 nt, Homo sapiens
cagggaaagggucuccc

SEQ ID NO: 23278 - RNA, 12 nt, Homo sapiens
cagugagccgag

SEQ ID NO: 23279 - RNA, 15 nt, Homo sapiens
cagugagccgagauu

SEQ ID NO: 23280 - RNA, 16 nt, Homo sapiens
cagugagccgagauug

SEQ ID NO: 23281 - RNA, 19 nt, Homo sapiens
cagugauuaccagggacug

SEQ ID NO: 23282 - RNA, 14 nt, Homo sapiens
cagugcuuggccca

SEQ ID NO: 23283 - RNA, 16 nt, Homo sapiens
cagugcuuggcccagg

SEQ ID NO: 23284 - RNA, 17 nt, Homo sapiens
cagugcuuggcccagga

SEQ ID NO: 23285 - RNA, 17 nt, Homo sapiens
cagugucaaugcagccc

SEQ ID NO: 23286 - RNA, 18 nt, Homo sapiens
caggcgugaccugacagc

SEQ ID NO: 23287 - RNA, 21 nt, Homo sapiens
caggcgugaccugacagccca

SEQ ID NO: 23288 - RNA, 16 nt, Homo sapiens
caggcgugagccacca

SEQ ID NO: 23289 - RNA, 13 nt, Homo sapiens
ccaagccugacca

SEQ ID NO: 23290 - RNA, 19 nt, Homo sapiens
cauuugcuggagcucugcc

SEQ ID NO: 23291 - RNA, 20 nt, Homo sapiens
ccaaauucacaaguuguguu

SEQ ID NO: 23292 - RNA, 15 nt, Homo sapiens
cauugcaaccuccac

SEQ ID NO: 23293 - RNA, 14 nt, Homo sapiens
ccacuacugcuacc

SEQ ID NO: 23294 - RNA, 10 nt, Homo sapiens
ccagagacca

SEQ ID NO: 23295 - RNA, 14 nt, Homo sapiens
ccagaagucaaggc

SEQ ID NO: 23296 - RNA, 21 nt, Homo sapiens
ccacaccagggccuggcuggg

SEQ ID NO: 23297 - RNA, 10 nt, Homo sapiens
ccacagcugu

SEQ ID NO: 23298 - RNA, 14 nt, Homo sapiens
ccacaggaaccaca

SEQ ID NO: 23299 - RNA, 14 nt, Homo sapiens
ccaccaaacccggc

SEQ ID NO: 23300 - RNA, 14 nt, Homo sapiens
ccaccacgcccagc

SEQ ID NO: 23301 - RNA, 19 nt, Homo sapiens
ccaggaguuuggccagaag

SEQ ID NO: 23302 - RNA, 16 nt, Homo sapiens
ccaggaaaaucugcac

SEQ ID NO: 23303 - RNA, 16 nt, Homo sapiens
ccaggaguuuggccag

SEQ ID NO: 23304 - RNA, 19 nt, Homo sapiens
ccagggccuggcugggagu

SEQ ID NO: 23305 - RNA, 22 nt, Homo sapiens
ccagggccuggcugggaguggc

SEQ ID NO: 23306 - RNA, 16 nt, Homo sapiens
ccaaguuuauauacaa

SEQ ID NO: 23307 - RNA, 17 nt, Homo sapiens
ccagcccuacaccauuc

SEQ ID NO: 23308 - RNA, 14 nt, Homo sapiens
cccaagaaugagaa

SEQ ID NO: 23309 - RNA, 22 nt, Homo sapiens
cccagcacuuugggaggcugag

SEQ ID NO: 23310 - RNA, 15 nt, Homo sapiens
cccagcuacuuggga

SEQ ID NO: 23311 - RNA, 15 nt, Homo sapiens
ccauagggugacaca

SEQ ID NO: 23312 - RNA, 13 nt, Homo sapiens
ccauagggugaca

SEQ ID NO: 23313 - RNA, 14 nt, Homo sapiens
ccauagggugacac

SEQ ID NO: 23314 - RNA, 18 nt, Homo sapiens
cccugccuggaucucaca

SEQ ID NO: 23315 - RNA, 18 nt, Homo sapiens
ccgggaguggcgcgcgcc

SEQ ID NO: 23316 - RNA, 21 nt, Homo sapiens
ccgggaguggcgcgcgccacc

SEQ ID NO: 23317 - RNA, 23 nt, Homo sapiens
ccgggaguggcgcgcgccaccac

SEQ ID NO: 23318 - RNA, 22 nt, Homo sapiens
ccggagccccuugggcagguca

SEQ ID NO: 23319 - RNA, 16 nt, Homo sapiens
ccgcccaucuccgucu

SEQ ID NO: 23320 - RNA, 11 nt, Homo sapiens
cccucuggguc

SEQ ID NO: 23321 - RNA, 20 nt, Homo sapiens
cccacaccagggccuggcug

SEQ ID NO: 23322 - RNA, 14 nt, Homo sapiens
cccucaugcugcca

SEQ ID NO: 23323 - RNA, 16 nt, Homo sapiens
cccucaugcugccaau

SEQ ID NO: 23324 - RNA, 20 nt, Homo sapiens
ccccgggaguggcgcgcgcc

SEQ ID NO: 23325 - RNA, 11 nt, Homo sapiens
cccggccugau

SEQ ID NO: 23326 - RNA, 13 nt, Homo sapiens
cccgggaggcaga

SEQ ID NO: 23327 - RNA, 12 nt, Homo sapiens
cccgggaguggc

SEQ ID NO: 23328 - RNA, 13 nt, Homo sapiens
cccgggaguggcg

SEQ ID NO: 23329 - RNA, 14 nt, Homo sapiens
cccaggaguuuggc

SEQ ID NO: 23330 - RNA, 17 nt, Homo sapiens
cccgaaacuaccagccc

SEQ ID NO: 23331 - RNA, 16 nt, Homo sapiens
ccugccccugagccca

SEQ ID NO: 23332 - RNA, 12 nt, Homo sapiens
ccugagaccagc

SEQ ID NO: 23333 - RNA, 13 nt, Homo sapiens
ccugagaccagcc

SEQ ID NO: 23334 - RNA, 11 nt, Homo sapiens
ccugagcccca

SEQ ID NO: 23335 - RNA, 21 nt, Homo sapiens
ccugcacuccagccugagcga

SEQ ID NO: 23336 - RNA, 14 nt, Homo sapiens
ccugcaggcgugac

SEQ ID NO: 23337 - RNA, 18 nt, Homo sapiens
ccucuguugccaaggcug

SEQ ID NO: 23338 - RNA, 12 nt, Homo sapiens
ccucuuucaaag

SEQ ID NO: 23339 - RNA, 13 nt, Homo sapiens
ccucuuucaaagg

SEQ ID NO: 23340 - RNA, 16 nt, Homo sapiens
ccuacaugagguacug

SEQ ID NO: 23341 - RNA, 13 nt, Homo sapiens
ccuagcgcagcca

SEQ ID NO: 23342 - RNA, 20 nt, Homo sapiens
ccucauggaauuggagcucg

SEQ ID NO: 23343 - RNA, 17 nt, Homo sapiens
ccuaauaaaaaggugac

SEQ ID NO: 23344 - RNA, 21 nt, Homo sapiens
cgauucucuuuauucagcccc

SEQ ID NO: 23345 - RNA, 19 nt, Homo sapiens
cgcaccuguaaucccagcu

SEQ ID NO: 23346 - RNA, 20 nt, Homo sapiens
cgcaccuguaaucccagcua

SEQ ID NO: 23347 - RNA, 15 nt, Homo sapiens
cgcagccaugugauu

SEQ ID NO: 23348 - RNA, 14 nt, Homo sapiens
cgccaccacgccca

SEQ ID NO: 23349 - RNA, 16 nt, Homo sapiens
ccuucuggguucaagc

SEQ ID NO: 23350 - RNA, 19 nt, Homo sapiens
ccuggucaacauggugaaa

SEQ ID NO: 23351 - RNA, 13 nt, Homo sapiens
agauaaacaguag

SEQ ID NO: 23352 - RNA, 19 nt, Homo sapiens
guugaaaaaguucugcaga

SEQ ID NO: 23353 - RNA, 14 nt, Homo sapiens
acugcauacaaucu

SEQ ID NO: 23354 - RNA, 15 nt, Homo sapiens
auuguaacuuaugaa

SEQ ID NO: 23355 - RNA, 14 nt, Homo sapiens
caccuguaauccca

SEQ ID NO: 23356 - RNA, 21 nt, Homo sapiens
aggaauauuugcaagacauag

SEQ ID NO: 23357 - RNA, 16 nt, Homo sapiens
caccaaacccggccug

SEQ ID NO: 23358 - RNA, 23 nt, Homo sapiens
caagccagccuugcuccuggcug

SEQ ID NO: 23359 - RNA, 20 nt, Homo sapiens
gcugucuauguggcuguauc

SEQ ID NO: 23360 - RNA, 10 nt, Homo sapiens
aaaauaugcc

SEQ ID NO: 23361 - RNA, 22 nt, Homo sapiens
uucucuucacagucacauucca

SEQ ID NO: 23362 - RNA, 21 nt, Homo sapiens
uaagguauauaaauuuuccca

SEQ ID NO: 23363 - RNA, 22 nt, Homo sapiens
ugcagcccccauuguggucaca

SEQ ID NO: 23364 - RNA, 15 nt, Homo sapiens
ugacugucucacuua

SEQ ID NO: 23365 - RNA, 16 nt, Homo sapiens
uccuucucaucuguga

SEQ ID NO: 23366 - RNA, 12 nt, Homo sapiens
aaguuuaugcau

SEQ ID NO: 23367 - RNA, 22 nt, Homo sapiens
caguaacggaacaguauccagu

SEQ ID NO: 23368 - RNA, 21 nt, Homo sapiens
ccaggagauggaaguugcagu

SEQ ID NO: 23369 - RNA, 18 nt, Homo sapiens
acaauuauaucaguccuc

SEQ ID NO: 23370 - RNA, 19 nt, Homo sapiens
agguauuuauugagcaccu

SEQ ID NO: 23371 - RNA, 17 nt, Homo sapiens
aaaguucugcagauaaa

SEQ ID NO: 23372 - RNA, 12 nt, Homo sapiens
auagcaagugaa

SEQ ID NO: 23373 - RNA, 12 nt, Homo sapiens
auagaauuaaca

SEQ ID NO: 23374 - RNA, 14 nt, Homo sapiens
uauuuuuaugugca

SEQ ID NO: 23375 - RNA, 14 nt, Homo sapiens
uuuaugauuccacc

SEQ ID NO: 23376 - RNA, 18 nt, Homo sapiens
auggcuaguaucaaaaga

SEQ ID NO: 23377 - RNA, 13 nt, Homo sapiens
acaucuuucacau

SEQ ID NO: 23378 - RNA, 16 nt, Homo sapiens
caccagggccuggcug

SEQ ID NO: 23379 - RNA, 15 nt, Homo sapiens
aagagaucaagccau

SEQ ID NO: 23380 - RNA, 14 nt, Homo sapiens
ucaguccucuuuca

SEQ ID NO: 23381 - RNA, 16 nt, Homo sapiens
uguguggcauuuucac

SEQ ID NO: 23382 - RNA, 21 nt, Homo sapiens
aucauuucaaaacucauuucc

SEQ ID NO: 23383 - RNA, 19 nt, Homo sapiens
aacaucaguuacucugaag

SEQ ID NO: 23384 - RNA, 18 nt, Homo sapiens
guauuuauugagcaccug

SEQ ID NO: 23385 - RNA, 17 nt, Homo sapiens
auagaauuaacacauga

SEQ ID NO: 23386 - RNA, 15 nt, Homo sapiens
agguuaagcacuuua

SEQ ID NO: 23387 - RNA, 14 nt, Homo sapiens
ccaaguuuauauac

SEQ ID NO: 23388 - RNA, 15 nt, Homo sapiens
agacucugucucagu

SEQ ID NO: 23389 - RNA, 17 nt, Homo sapiens
aauauuuuuaugugcaa

SEQ ID NO: 23390 - RNA, 12 nt, Homo sapiens
acuuugugaaaa

SEQ ID NO: 23391 - RNA, 15 nt, Homo sapiens
cugcaagcuuuucaa

SEQ ID NO: 23392 - RNA, 13 nt, Homo sapiens
aaguacagacuuu

SEQ ID NO: 23393 - RNA, 16 nt, Homo sapiens
cuaaccagccugguca

SEQ ID NO: 23394 - RNA, 21 nt, Homo sapiens
caguaauuuuaaguaauuuca

SEQ ID NO: 23395 - RNA, 13 nt, Homo sapiens
augacacaucucu

SEQ ID NO: 23396 - RNA, 17 nt, Homo sapiens
uucugcaagcuuuucaa

SEQ ID NO: 23397 - RNA, 13 nt, Homo sapiens
auuaucaugcaaa

SEQ ID NO: 23398 - RNA, 13 nt, Homo sapiens
gacagaaagcaga

SEQ ID NO: 23399 - RNA, 14 nt, Homo sapiens
ugaccugacagccc

SEQ ID NO: 23400 - RNA, 23 nt, Homo sapiens
acaccgaguggcccuucauguac

SEQ ID NO: 23401 - RNA, 16 nt, Homo sapiens
caggcuccaaacugga

SEQ ID NO: 23402 - RNA, 15 nt, Homo sapiens
ccucuguugccaagg

SEQ ID NO: 23403 - RNA, 21 nt, Homo sapiens
uuuuuaaacaaaaaaagcauu

SEQ ID NO: 23404 - RNA, 17 nt, Homo sapiens
acccaaauguucaucaa

SEQ ID NO: 23405 - RNA, 12 nt, Homo sapiens
gaagucuuccau

SEQ ID NO: 23406 - RNA, 21 nt, Homo sapiens
ccuuauuguaccucucuuaua

SEQ ID NO: 23407 - RNA, 12 nt, Homo sapiens
aaaaaaagccaa

SEQ ID NO: 23408 - RNA, 23 nt, Homo sapiens
ugaaaaaguauaaauaaaaugag

SEQ ID NO: 23409 - RNA, 23 nt, Homo sapiens
aaacauuuaaauuauacaaucau

SEQ ID NO: 23410 - RNA, 15 nt, Homo sapiens
acuugaugauacaau

SEQ ID NO: 23411 - RNA, 14 nt, Homo sapiens
auagcaucucagga

SEQ ID NO: 23412 - RNA, 17 nt, Homo sapiens
aaaguguaaguucacaa

SEQ ID NO: 23413 - RNA, 17 nt, Homo sapiens
aaaauuaucaauaucua

SEQ ID NO: 23414 - RNA, 17 nt, Homo sapiens
auuacaggcgugagcca

SEQ ID NO: 23415 - RNA, 17 nt, Homo sapiens
caaauguucaucaauga

SEQ ID NO: 23416 - RNA, 20 nt, Homo sapiens
gagcuguuuucccugaccuc

SEQ ID NO: 23417 - RNA, 14 nt, Homo sapiens
gagaaaagacauaa

SEQ ID NO: 23418 - RNA, 15 nt, Homo sapiens
augacacaucucuga

SEQ ID NO: 23419 - RNA, 14 nt, Homo sapiens
gaagaaauucugca

SEQ ID NO: 23420 - RNA, 12 nt, Homo sapiens
cacaagcacuuu

SEQ ID NO: 23421 - RNA, 13 nt, Homo sapiens
ugcauuugcacua

SEQ ID NO: 23422 - RNA, 19 nt, Homo sapiens
cacuaaaaaggcauguaau

SEQ ID NO: 23423 - RNA, 15 nt, Homo sapiens
uuuauugcugaauga

SEQ ID NO: 23424 - RNA, 15 nt, Homo sapiens
auaugacacaucucu

SEQ ID NO: 23425 - RNA, 12 nt, Homo sapiens
gcuuccuaacug

SEQ ID NO: 23426 - RNA, 20 nt, Homo sapiens
ucaaaacuucagacauagaa

SEQ ID NO: 23427 - RNA, 20 nt, Homo sapiens
cacuuauaggaauugaccca

SEQ ID NO: 23428 - RNA, 18 nt, Homo sapiens
cuauauuaucaugcaaau

SEQ ID NO: 23429 - RNA, 17 nt, Homo sapiens
gggcuuuagggaccugc

SEQ ID NO: 23430 - RNA, 15 nt, Homo sapiens
cuguacuuuuuccag

SEQ ID NO: 23431 - RNA, 16 nt, Homo sapiens
ucugcaagcuuuucaa

SEQ ID NO: 23432 - RNA, 21 nt, Homo sapiens
aucaauucuauuacgugcaau

SEQ ID NO: 23433 - RNA, 18 nt, Homo sapiens
cuuuaacacagugucugg

SEQ ID NO: 23434 - RNA, 18 nt, Homo sapiens
acaaggcuuuaucucagg

SEQ ID NO: 23435 - RNA, 17 nt, Homo sapiens
cacuuuaacacaguguc

SEQ ID NO: 23436 - RNA, 13 nt, Homo sapiens
ucuucacagucac

SEQ ID NO: 23437 - RNA, 18 nt, Homo sapiens
uaugacgugacuggccug

SEQ ID NO: 23438 - RNA, 13 nt, Homo sapiens
cagcuaaguugca

SEQ ID NO: 23439 - RNA, 18 nt, Homo sapiens
gauggaaguugcagugag

SEQ ID NO: 23440 - RNA, 22 nt, Homo sapiens
auacaauuauuuuuacaguucu

SEQ ID NO: 23441 - RNA, 15 nt, Homo sapiens
agcagggacuugaac

SEQ ID NO: 23442 - RNA, 15 nt, Homo sapiens
uuuaugcuaagugaa

SEQ ID NO: 23443 - RNA, 23 nt, Homo sapiens
agagcccuucaugcauuugcacu

SEQ ID NO: 23444 - RNA, 14 nt, Homo sapiens
aagccagacaucaa

SEQ ID NO: 23445 - RNA, 14 nt, Homo sapiens
ugccuguaaucaca

SEQ ID NO: 23446 - RNA, 21 nt, Homo sapiens
caaucugagccagugcuuuaa

SEQ ID NO: 23447 - RNA, 15 nt, Homo sapiens
guaaacaaaggaauu

SEQ ID NO: 23448 - RNA, 19 nt, Homo sapiens
auuuuuacaguucucccaa

SEQ ID NO: 23449 - RNA, 18 nt, Homo sapiens
agccaaguuuauauacaa

SEQ ID NO: 23450 - RNA, 15 nt, Homo sapiens
aucagcauuuuacua

SEQ ID NO: 23451 - RNA, 16 nt, Homo sapiens
ucuccgucucccaaag

SEQ ID NO: 23452 - RNA, 18 nt, Homo sapiens
agguacugagagugaaca

SEQ ID NO: 23453 - RNA, 14 nt, Homo sapiens
acccaaaaggcaga

SEQ ID NO: 23454 - RNA, 13 nt, Homo sapiens
ccuuaaacucagg

SEQ ID NO: 23455 - RNA, 18 nt, Homo sapiens
acuuaugaaccuuuacau

SEQ ID NO: 23456 - RNA, 20 nt, Homo sapiens
cuggagugcaguggcgcaau

SEQ ID NO: 23457 - RNA, 16 nt, Homo sapiens
aggcuuuaucucaggg

SEQ ID NO: 23458 - RNA, 16 nt, Homo sapiens
cuauuacgugcaauac

SEQ ID NO: 23459 - RNA, 24 nt, Homo sapiens
gccggagccccuugggcaggucac

SEQ ID NO: 23460 - RNA, 20 nt, Homo sapiens
guaaucccagcuacuuggga

SEQ ID NO: 23461 - RNA, 14 nt, Homo sapiens
uaugugauguggca

SEQ ID NO: 23462 - RNA, 19 nt, Homo sapiens
uuauuuagggaacugcuug

SEQ ID NO: 23463 - RNA, 18 nt, Homo sapiens
auuuaaaaaaaaaccuga

SEQ ID NO: 23464 - RNA, 21 nt, Homo sapiens
uguaaugaaaaugaauaucua

SEQ ID NO: 23465 - RNA, 16 nt, Homo sapiens
gaaucccuuaaacuca

SEQ ID NO: 23466 - RNA, 16 nt, Homo sapiens
gagauuucaugccugg

SEQ ID NO: 23467 - RNA, 17 nt, Homo sapiens
uaaaaaggcauguaauu

SEQ ID NO: 23468 - RNA, 23 nt, Homo sapiens
aaggaagaaauuccaggaaaauc

SEQ ID NO: 23469 - RNA, 21 nt, Homo sapiens
uuguguaaugaaaaugaauau

SEQ ID NO: 23470 - RNA, 21 nt, Homo sapiens
cuugagaaaccuuauuguacc

SEQ ID NO: 23471 - RNA, 21 nt, Homo sapiens
agggucucccucuguugccaa

SEQ ID NO: 23472 - RNA, 15 nt, Homo sapiens
aaccuuuacauccag

SEQ ID NO: 23473 - RNA, 17 nt, Homo sapiens
agaggagaaacuggaac

SEQ ID NO: 23474 - RNA, 20 nt, Homo sapiens
cagcauuuuacuacuuuaaa

SEQ ID NO: 23475 - RNA, 13 nt, Homo sapiens
uccuggacaguuu

SEQ ID NO: 23476 - RNA, 19 nt, Homo sapiens
cugccuugguauagcauau

SEQ ID NO: 23477 - RNA, 23 nt, Homo sapiens
ugagaugggagaaucacuugaac

SEQ ID NO: 23478 - RNA, 23 nt, Homo sapiens
auucccuuuugcugccucuaaaa

SEQ ID NO: 23479 - RNA, 13 nt, Homo sapiens
aucauguauuuau

SEQ ID NO: 23480 - RNA, 16 nt, Homo sapiens
uauucccuuuugcugc

SEQ ID NO: 23481 - RNA, 20 nt, Homo sapiens
cgucucuacuaaaaauacaa

SEQ ID NO: 23482 - RNA, 22 nt, Homo sapiens
cauuucaaaagguauuuauuga

SEQ ID NO: 23483 - RNA, 16 nt, Homo sapiens
uaaaguacagacuuuu

SEQ ID NO: 23484 - RNA, 22 nt, Homo sapiens
acaguauggcagcuuuccucaa

SEQ ID NO: 23485 - RNA, 15 nt, Homo sapiens
aagugauacuaucca

SEQ ID NO: 23486 - RNA, 18 nt, Homo sapiens
agcaagacucugucucaa

SEQ ID NO: 23487 - RNA, 13 nt, Homo sapiens
caugaaagcguaa

SEQ ID NO: 23488 - RNA, 12 nt, Homo sapiens
accagggacuga

SEQ ID NO: 23489 - RNA, 15 nt, Homo sapiens
gggucucaguguccu

SEQ ID NO: 23490 - RNA, 20 nt, Homo sapiens
cuuuccagagaccaguauuc

SEQ ID NO: 23491 - RNA, 17 nt, Homo sapiens
uguauuuuauuacaucu

SEQ ID NO: 23492 - RNA, 19 nt, Homo sapiens
accuacaugagguacugag

SEQ ID NO: 23493 - RNA, 16 nt, Homo sapiens
agaaucacuugaaccc

SEQ ID NO: 23494 - RNA, 9 nt, Homo sapiens
cgugcaaua

SEQ ID NO: 23495 - RNA, 19 nt, Homo sapiens
uggaaauaaaagauuguau

SEQ ID NO: 23496 - RNA, 16 nt, Homo sapiens
gaaaauaaaagcacuu

SEQ ID NO: 23497 - RNA, 15 nt, Homo sapiens
accuguaaucccagc

SEQ ID NO: 23498 - RNA, 15 nt, Homo sapiens
cuagauacugaaugu

SEQ ID NO: 23499 - RNA, 21 nt, Homo sapiens
cuaagaagugaaaaucuacac

SEQ ID NO: 23500 - RNA, 14 nt, Homo sapiens
agagaaauuugcca

SEQ ID NO: 23501 - RNA, 13 nt, Homo sapiens
cagcuuauucaca

SEQ ID NO: 23502 - RNA, 14 nt, Homo sapiens
gggucucagugucc

SEQ ID NO: 23503 - RNA, 11 nt, Homo sapiens
aaaagccaaaa

SEQ ID NO: 23504 - RNA, 13 nt, Homo sapiens
uaauuucaugaaa

SEQ ID NO: 23505 - RNA, 20 nt, Homo sapiens
gcuacucuguuccuucacau

SEQ ID NO: 23506 - RNA, 14 nt, Homo sapiens
uuuaaguaauuuca

SEQ ID NO: 23507 - RNA, 21 nt, Homo sapiens
ucugauuuuccuggacaguuu

SEQ ID NO: 23508 - RNA, 18 nt, Homo sapiens
ucaguccaugaagaugua

SEQ ID NO: 23509 - RNA, 15 nt, Homo sapiens
gacuuaaaaucuaau

SEQ ID NO: 23510 - RNA, 20 nt, Homo sapiens
aguuuucugcuuuaauuuca

SEQ ID NO: 23511 - RNA, 21 nt, Homo sapiens
auugaaaggcauucucugaag

SEQ ID NO: 23512 - RNA, 22 nt, Homo sapiens
gagaaaccuuauuguaccucuc

SEQ ID NO: 23513 - RNA, 13 nt, Homo sapiens
aaucugcacugug

SEQ ID NO: 23514 - RNA, 19 nt, Homo sapiens
gagaaaauaaaagcacuua

SEQ ID NO: 23515 - RNA, 13 nt, Homo sapiens
caaaucucuauua

SEQ ID NO: 23516 - RNA, 19 nt, Homo sapiens
gacauaagcaaagacuaug

SEQ ID NO: 23517 - RNA, 12 nt, Homo sapiens
ucuuggugccuc

SEQ ID NO: 23518 - RNA, 13 nt, Homo sapiens
ucuugaaagcugu

SEQ ID NO: 23519 - RNA, 18 nt, Homo sapiens
cagugucuggcacuuggg

SEQ ID NO: 23520 - RNA, 19 nt, Homo sapiens
ccugcaggcgugaccugac

SEQ ID NO: 23521 - RNA, 21 nt, Homo sapiens
agaaugauuuuacggagauau

SEQ ID NO: 23522 - RNA, 17 nt, Homo sapiens
aaacccggccugauuaa

SEQ ID NO: 23523 - RNA, 22 nt, Homo sapiens
aucuuguuuuuccacuacugcu

SEQ ID NO: 23524 - RNA, 11 nt, Homo sapiens
acagcucugca

SEQ ID NO: 23525 - RNA, 15 nt, Homo sapiens
ccuuuacauccagau

SEQ ID NO: 23526 - RNA, 13 nt, Homo sapiens
uacauuuccaaau

SEQ ID NO: 23527 - RNA, 23 nt, Homo sapiens
aaauucgcugcaaccuguugaua

SEQ ID NO: 23528 - RNA, 21 nt, Homo sapiens
ccugucccugcagacaugaga

SEQ ID NO: 23529 - RNA, 13 nt, Homo sapiens
gauaaacucagaa

SEQ ID NO: 23530 - RNA, 13 nt, Homo sapiens
aauuccucuggga

SEQ ID NO: 23531 - RNA, 16 nt, Homo sapiens
ccugugacugucucac

SEQ ID NO: 23532 - RNA, 21 nt, Homo sapiens
uuauaagugaagugauacuau

SEQ ID NO: 23533 - RNA, 18 nt, Homo sapiens
guuugaaaauaugccugc

SEQ ID NO: 23534 - RNA, 18 nt, Homo sapiens
gccauaauuacuauguca

SEQ ID NO: 23535 - RNA, 22 nt, Homo sapiens
aaauauuuuuaugugcaauaaa

SEQ ID NO: 23536 - RNA, 23 nt, Homo sapiens
auaauuccuauauccugugacug

SEQ ID NO: 23537 - RNA, 16 nt, Homo sapiens
aucucacaagcacuuu

SEQ ID NO: 23538 - RNA, 23 nt, Homo sapiens
uuaaaauauuuuuaugugcaaua

SEQ ID NO: 23539 - RNA, 17 nt, Homo sapiens
cauuuccaaauucacaa

SEQ ID NO: 23540 - RNA, 15 nt, Homo sapiens
cgugagccaccaaac

SEQ ID NO: 23541 - RNA, 16 nt, Homo sapiens
auacuguauuuuuacc

SEQ ID NO: 23542 - RNA, 19 nt, Homo sapiens
augauuccaccuacaugag

SEQ ID NO: 23543 - RNA, 23 nt, Homo sapiens
uaugcaaccuuuggaugcacuuu

SEQ ID NO: 23544 - RNA, 20 nt, Homo sapiens
gccauaauuacuaugucauu

SEQ ID NO: 23545 - RNA, 16 nt, Homo sapiens
cuuauaggaauugacc

SEQ ID NO: 23546 - RNA, 20 nt, Homo sapiens
uucugucuggacuuuccaga

SEQ ID NO: 23547 - RNA, 22 nt, Homo sapiens
gccuggaucucacaagcacuuu

SEQ ID NO: 23548 - RNA, 13 nt, Homo sapiens
aaugaauggcuaa

SEQ ID NO: 23549 - RNA, 22 nt, Homo sapiens
auguucacuuauugacuauuau

SEQ ID NO: 23550 - RNA, 12 nt, Homo sapiens
uuacgugcaaua

SEQ ID NO: 23551 - RNA, 16 nt, Homo sapiens
guaaaauggagacacc

SEQ ID NO: 23552 - RNA, 18 nt, Homo sapiens
cuuggucacauacaauua

SEQ ID NO: 23553 - RNA, 14 nt, Homo sapiens
cuuaaacacuaaaa

SEQ ID NO: 23554 - RNA, 20 nt, Homo sapiens
aguucugucuggacuuucca

SEQ ID NO: 23555 - RNA, 20 nt, Homo sapiens
augagaaucagaucauuuca

SEQ ID NO: 23556 - RNA, 13 nt, Homo sapiens
aauugacacuuaa

SEQ ID NO: 23557 - RNA, 21 nt, Homo sapiens
accagcccuacaccauuccuu

SEQ ID NO: 23558 - RNA, 18 nt, Homo sapiens
gguauauaaauuuuccca

SEQ ID NO: 23559 - RNA, 18 nt, Homo sapiens
auucccuuuugcugccuc

SEQ ID NO: 23560 - RNA, 20 nt, Homo sapiens
ggcgacaguuuuccuucuca

SEQ ID NO: 23561 - RNA, 13 nt, Homo sapiens
gcgugcaggcagc

SEQ ID NO: 23562 - RNA, 17 nt, Homo sapiens
ugaguggaugauguuuc

SEQ ID NO: 23563 - RNA, 20 nt, Homo sapiens
cagagcaagacucugucuca

SEQ ID NO: 23564 - RNA, 16 nt, Homo sapiens
aguuaagcaacaucua

SEQ ID NO: 23565 - RNA, 19 nt, Homo sapiens
acagugagacucugucuca

SEQ ID NO: 23566 - RNA, 14 nt, Homo sapiens
aaaaugagcaaaag

SEQ ID NO: 23567 - RNA, 22 nt, Homo sapiens
gagcaagacucugucucaaaaa

SEQ ID NO: 23568 - RNA, 15 nt, Homo sapiens
cacgcccagcuaauu

SEQ ID NO: 23569 - RNA, 22 nt, Homo sapiens
cuuagacccucaugcugccaau

SEQ ID NO: 23570 - RNA, 18 nt, Homo sapiens
agcaacccaaauguucau

SEQ ID NO: 23571 - RNA, 18 nt, Homo sapiens
uuguagccacuucacuuu

SEQ ID NO: 23572 - RNA, 19 nt, Homo sapiens
cagagacgggguuugccau

SEQ ID NO: 23573 - RNA, 21 nt, Homo sapiens
gacacaggcuccaaacuggag

SEQ ID NO: 23574 - RNA, 17 nt, Homo sapiens
cucuggcgacaguuuuc

SEQ ID NO: 23575 - RNA, 18 nt, Homo sapiens
uaaguugcaccaacuuug

SEQ ID NO: 23576 - RNA, 12 nt, Homo sapiens
ugacaacuguga

SEQ ID NO: 23577 - RNA, 15 nt, Homo sapiens
aaugguuccauucuc

SEQ ID NO: 23578 - RNA, 19 nt, Homo sapiens
auuuguuaaaauuaucaau

SEQ ID NO: 23579 - RNA, 12 nt, Homo sapiens
cucugauaccuc

SEQ ID NO: 23580 - RNA, 15 nt, Homo sapiens
aaccucauuccccaa

SEQ ID NO: 23581 - RNA, 19 nt, Homo sapiens
uaagugaaauaagccagac

SEQ ID NO: 23582 - RNA, 17 nt, Homo sapiens
ucacauuccaagccuca

SEQ ID NO: 23583 - RNA, 18 nt, Homo sapiens
cugccaauauccuaauaa

SEQ ID NO: 23584 - RNA, 16 nt, Homo sapiens
ugcuaucgccaucaca

SEQ ID NO: 23585 - RNA, 16 nt, Homo sapiens
agugucugaugaaugu

SEQ ID NO: 23586 - RNA, 19 nt, Homo sapiens
aaccuccaccuucuggguu

SEQ ID NO: 23587 - RNA, 22 nt, Homo sapiens
uaguguuggaaaaugugcaaua

SEQ ID NO: 23588 - RNA, 18 nt, Homo sapiens
acugaauguaaacaaagg

SEQ ID NO: 23589 - RNA, 19 nt, Homo sapiens
auccugcaauuccacuuau

SEQ ID NO: 23590 - RNA, 22 nt, Homo sapiens
agcacuuucccucuuggugccu

SEQ ID NO: 23591 - RNA, 14 nt, Homo sapiens
uugaaugugucagg

SEQ ID NO: 23592 - RNA, 20 nt, Homo sapiens
aaaacucauuuccuauguaa

SEQ ID NO: 23593 - RNA, 15 nt, Homo sapiens
agcaugggaagugac

SEQ ID NO: 23594 - RNA, 14 nt, Homo sapiens
cuguaaucacagcu

SEQ ID NO: 23595 - RNA, 17 nt, Homo sapiens
uggguuguguguuuauu

SEQ ID NO: 23596 - RNA, 15 nt, Homo sapiens
uauuacgugcaauac

SEQ ID NO: 23597 - RNA, 19 nt, Homo sapiens
uucaaaaucaaauuccaga

SEQ ID NO: 23598 - RNA, 14 nt, Homo sapiens
ccacccuugccaug

SEQ ID NO: 23599 - RNA, 18 nt, Homo sapiens
gcccaucuccgucuccca

SEQ ID NO: 23600 - RNA, 18 nt, Homo sapiens
gaauauuuauuaccucug

SEQ ID NO: 23601 - RNA, 22 nt, Homo sapiens
aauaguguuggaaaaugugcaa

SEQ ID NO: 23602 - RNA, 15 nt, Homo sapiens
uccuauguaacugca

SEQ ID NO: 23603 - RNA, 14 nt, Homo sapiens
uauauccugugacu

SEQ ID NO: 23604 - RNA, 18 nt, Homo sapiens
aagguauuuauugagcac

SEQ ID NO: 23605 - RNA, 14 nt, Homo sapiens
ugacuggccugcug

SEQ ID NO: 23606 - RNA, 16 nt, Homo sapiens
ucucuuauagaauauu

SEQ ID NO: 23607 - RNA, 17 nt, Homo sapiens
cuuguuagcaaaaugga

SEQ ID NO: 23608 - RNA, 17 nt, Homo sapiens
uaucuuguuuuuccacu

SEQ ID NO: 23609 - RNA, 15 nt, Homo sapiens
uacucauacauguua

SEQ ID NO: 23610 - RNA, 17 nt, Homo sapiens
cuucucuucacagucac

SEQ ID NO: 23611 - RNA, 13 nt, Homo sapiens
gaaaaacauuuca

SEQ ID NO: 23612 - RNA, 21 nt, Homo sapiens
uauuuauaauuccuauauccu

SEQ ID NO: 23613 - RNA, 18 nt, Homo sapiens
acaucaguuacucugaag

SEQ ID NO: 23614 - RNA, 21 nt, Homo sapiens
gagaugggagaaucacuugaa

SEQ ID NO: 23615 - RNA, 21 nt, Homo sapiens
auucuucuuugguggagauaa

SEQ ID NO: 23616 - RNA, 15 nt, Homo sapiens
auacuauccaguuac

SEQ ID NO: 23617 - RNA, 14 nt, Homo sapiens
gcagaagacaguau

SEQ ID NO: 23618 - RNA, 20 nt, Homo sapiens
gugaaauaaaaguagaauaa

SEQ ID NO: 23619 - RNA, 15 nt, Homo sapiens
uaaucccagcacuuu

SEQ ID NO: 23620 - RNA, 21 nt, Homo sapiens
gugauuacccucugggucuca

SEQ ID NO: 23621 - RNA, 20 nt, Homo sapiens
caacuauauuaucaugcaaa

SEQ ID NO: 23622 - RNA, 23 nt, Homo sapiens
auaauagguuugugacuuuccua

SEQ ID NO: 23623 - RNA, 14 nt, Homo sapiens
ccaauuuacuuugu

SEQ ID NO: 23624 - RNA, 14 nt, Homo sapiens
ugcagaagacagua

SEQ ID NO: 23625 - RNA, 20 nt, Homo sapiens
uuucacuuuuggcuuguaaa

SEQ ID NO: 23626 - RNA, 16 nt, Homo sapiens
aaagcagaacagugau

SEQ ID NO: 23627 - RNA, 13 nt, Homo sapiens
cuugaugauacaa

SEQ ID NO: 23628 - RNA, 13 nt, Homo sapiens
uccaaauucacaa

SEQ ID NO: 23629 - RNA, 12 nt, Homo sapiens
ccugugacuguc

SEQ ID NO: 23630 - RNA, 14 nt, Homo sapiens
uaaaaucuaauuca

SEQ ID NO: 23631 - RNA, 21 nt, Homo sapiens
cuucuuggucucagugucaau

SEQ ID NO: 23632 - RNA, 21 nt, Homo sapiens
agaguucugucuggacuuucc

SEQ ID NO: 23633 - RNA, 16 nt, Homo sapiens
aggagauuucaugccu

SEQ ID NO: 23634 - RNA, 22 nt, Homo sapiens
aaaauauuuuuaugugcaauaa

SEQ ID NO: 23635 - RNA, 21 nt, Homo sapiens
ccucaguuuccugaccuauga

SEQ ID NO: 23636 - RNA, 14 nt, Homo sapiens
uaaauguaucuuau

SEQ ID NO: 23637 - RNA, 23 nt, Homo sapiens
aauauuguugacaacugugacug

SEQ ID NO: 23638 - RNA, 18 nt, Homo sapiens
aguugauuuuacaauuga

SEQ ID NO: 23639 - RNA, 13 nt, Homo sapiens
augauccugcaau

SEQ ID NO: 23640 - RNA, 16 nt, Homo sapiens
acuggcaguuuuccau

SEQ ID NO: 23641 - RNA, 20 nt, Homo sapiens
auuuauuuuuuuacuuccuc

SEQ ID NO: 23642 - RNA, 12 nt, Homo sapiens
auugagcaccug

SEQ ID NO: 23643 - RNA, 18 nt, Homo sapiens
ucacuuuuuuucuuuucu

SEQ ID NO: 23644 - RNA, 15 nt, Homo sapiens
auuuaaagacaaaga

SEQ ID NO: 23645 - RNA, 15 nt, Homo sapiens
gagugcaguggcgca

SEQ ID NO: 23646 - RNA, 21 nt, Homo sapiens
uaaaauauuuuuaugugcaau

SEQ ID NO: 23647 - RNA, 15 nt, Homo sapiens
cuaugugauuacaag

SEQ ID NO: 23648 - RNA, 12 nt, Homo sapiens
cagaacagugau

SEQ ID NO: 23649 - RNA, 12 nt, Homo sapiens
acagaacuugaa

SEQ ID NO: 23650 - RNA, 23 nt, Homo sapiens
ucacuuuuuuucuuuucucugcc

SEQ ID NO: 23651 - RNA, 18 nt, Homo sapiens
uccaagccucauguccac

SEQ ID NO: 23652 - RNA, 15 nt, Homo sapiens
cucaguguccucauc

SEQ ID NO: 23653 - RNA, 17 nt, Homo sapiens
uuuaucuugucucuggg

SEQ ID NO: 23654 - RNA, 22 nt, Homo sapiens
aagucuuccauagagacuuugu

SEQ ID NO: 23655 - RNA, 17 nt, Homo sapiens
gagacgggguuugccau

SEQ ID NO: 23656 - RNA, 21 nt, Homo sapiens
gaggcauuugcagcugugcca

SEQ ID NO: 23657 - RNA, 18 nt, Homo sapiens
auuguugacaacugugac

SEQ ID NO: 23658 - RNA, 12 nt, Homo sapiens
aacugugacugu

SEQ ID NO: 23659 - RNA, 22 nt, Homo sapiens
auaauuccuauauccugugacu

SEQ ID NO: 23660 - RNA, 14 nt, Homo sapiens
caucuuggucacau

SEQ ID NO: 23661 - RNA, 12 nt, Homo sapiens
caucuuucacau

SEQ ID NO: 23662 - RNA, 21 nt, Homo sapiens
acaauuauuuuuacaguucuc

SEQ ID NO: 23663 - RNA, 11 nt, Homo sapiens
augcuggccag

SEQ ID NO: 23664 - RNA, 16 nt, Homo sapiens
cugucuggacuuucca

SEQ ID NO: 23665 - RNA, 20 nt, Homo sapiens
uuagacccucaugcugccaa

SEQ ID NO: 23666 - RNA, 15 nt, Homo sapiens
cacuugaugauacaa

SEQ ID NO: 23667 - RNA, 15 nt, Homo sapiens
aaugauuucauucaa

SEQ ID NO: 23668 - RNA, 21 nt, Homo sapiens
uugguacuagauacugaaugu

SEQ ID NO: 23669 - RNA, 17 nt, Homo sapiens
gguggcucacgccugua

SEQ ID NO: 23670 - RNA, 16 nt, Homo sapiens
uagaauuaacacauga

SEQ ID NO: 23671 - RNA, 20 nt, Homo sapiens
cgguuugaaaauaugccugc

SEQ ID NO: 23672 - RNA, 18 nt, Homo sapiens
cauaagcaaagacuauga

SEQ ID NO: 23673 - RNA, 21 nt, Homo sapiens
ugugacuuaaugccacuaaau

SEQ ID NO: 23674 - RNA, 15 nt, Homo sapiens
aacauagcaucucag

SEQ ID NO: 23675 - RNA, 23 nt, Homo sapiens
uagaguucugucuggacuuucca

SEQ ID NO: 23676 - RNA, 15 nt, Homo sapiens
ggaaaaugugcaaua

SEQ ID NO: 23677 - RNA, 16 nt, Homo sapiens
aauugacccacaagaa

SEQ ID NO: 23678 - RNA, 23 nt, Homo sapiens
ucacaggaaguagaggaggccac

SEQ ID NO: 23679 - RNA, 16 nt, Homo sapiens
ccuuauuguaccucuc

SEQ ID NO: 23680 - RNA, 23 nt, Homo sapiens
uuacuauuuauugcugaaugacu

SEQ ID NO: 23681 - RNA, 20 nt, Homo sapiens
aagauuguauagugcauguu

SEQ ID NO: 23682 - RNA, 14 nt, Homo sapiens
aucaguuacucuga

SEQ ID NO: 23683 - RNA, 17 nt, Homo sapiens
auuaccucugauaccuc

SEQ ID NO: 23684 - RNA, 24 nt, Homo sapiens
aaugauuuuacggagauaucccag

SEQ ID NO: 23685 - RNA, 12 nt, Homo sapiens
gugucaggugac

SEQ ID NO: 23686 - RNA, 15 nt, Homo sapiens
agaagacaacauuaa

SEQ ID NO: 23687 - RNA, 18 nt, Homo sapiens
uauuuaaagacaaagaca

SEQ ID NO: 23688 - RNA, 15 nt, Homo sapiens
cuugggcaggucaca

SEQ ID NO: 23689 - RNA, 13 nt, Homo sapiens
aggaauauuugca

SEQ ID NO: 23690 - RNA, 15 nt, Homo sapiens
uuggaaaaugugcaa

SEQ ID NO: 23691 - RNA, 13 nt, Homo sapiens
uuacaucuuucac

SEQ ID NO: 23692 - RNA, 20 nt, Homo sapiens
agagacgggguuugccaugc

SEQ ID NO: 23693 - RNA, 16 nt, Homo sapiens
gaaaggcauucucuga

SEQ ID NO: 23694 - RNA, 16 nt, Homo sapiens
aaugguuccauucucu

SEQ ID NO: 23695 - RNA, 16 nt, Homo sapiens
uggaaaaugugcaaua

SEQ ID NO: 23696 - RNA, 16 nt, Homo sapiens
cauuuccaaauucaca

SEQ ID NO: 23697 - RNA, 19 nt, Homo sapiens
uaaaaggccugucccugca

SEQ ID NO: 23698 - RNA, 20 nt, Homo sapiens
ugcuacaaauacucuuagga

SEQ ID NO: 23699 - RNA, 21 nt, Homo sapiens
uaacugcauugagaacugcau

SEQ ID NO: 23700 - RNA, 17 nt, Homo sapiens
ugaaaggcauucucuga

SEQ ID NO: 23701 - RNA, 17 nt, Homo sapiens
auaugccugcaaucuga

SEQ ID NO: 23702 - RNA, 16 nt, Homo sapiens
uaacugacaacuugaa

SEQ ID NO: 23703 - RNA, 23 nt, Homo sapiens
agaaauuccaggaaaaucugcac

SEQ ID NO: 23704 - RNA, 19 nt, Homo sapiens
cagccugggugacagagca

SEQ ID NO: 23705 - RNA, 22 nt, Homo sapiens
aucaauucuauuacgugcaaua

SEQ ID NO: 23706 - RNA, 19 nt, Homo sapiens
agagcaagacucugucuca

SEQ ID NO: 23707 - RNA, 16 nt, Homo sapiens
uacauucugcuuucau

SEQ ID NO: 23708 - RNA, 15 nt, Homo sapiens
aaacauguucacuua

SEQ ID NO: 23709 - RNA, 19 nt, Homo sapiens
aucuccgucucccaaagug

SEQ ID NO: 23710 - RNA, 20 nt, Homo sapiens
uuacugagcuucucugugaa

SEQ ID NO: 23711 - RNA, 16 nt, Homo sapiens
cagacaucaacagaua

SEQ ID NO: 23712 - RNA, 12 nt, Homo sapiens
ucccuuuuacau

SEQ ID NO: 23713 - RNA, 16 nt, Homo sapiens
ucucuaacucagaaac

SEQ ID NO: 23714 - RNA, 13 nt, Homo sapiens
auauauuuuuaga

SEQ ID NO: 23715 - RNA, 17 nt, Homo sapiens
accuuuggaugcacuuu

SEQ ID NO: 23716 - RNA, 20 nt, Homo sapiens
ccuggaucucacaagcacuu

SEQ ID NO: 23717 - RNA, 14 nt, Homo sapiens
cacccuugccaugg

SEQ ID NO: 23718 - RNA, 17 nt, Homo sapiens
uguagauaaacucagaa

SEQ ID NO: 23719 - RNA, 21 nt, Homo sapiens
aagggucucccucuguugcca

SEQ ID NO: 23720 - RNA, 22 nt, Homo sapiens
ggaaaaugugcaauaugugaug

SEQ ID NO: 23721 - RNA, 20 nt, Homo sapiens
guacuccagccugggugaca

SEQ ID NO: 23722 - RNA, 12 nt, Homo sapiens
aaauagugucug

SEQ ID NO: 23723 - RNA, 22 nt, Homo sapiens
ggcagcaggauagagugggaca

SEQ ID NO: 23724 - RNA, 11 nt, Homo sapiens
aggcauucucu

SEQ ID NO: 23725 - RNA, 19 nt, Homo sapiens
cuggaucucacaagcacuu

SEQ ID NO: 23726 - RNA, 23 nt, Homo sapiens
aguuuuccuucucaucugugauu

SEQ ID NO: 23727 - RNA, 21 nt, Homo sapiens
uucuucuuggucucaguguca

SEQ ID NO: 23728 - RNA, 15 nt, Homo sapiens
caucuguaaaaugga

SEQ ID NO: 23729 - RNA, 16 nt, Homo sapiens
uuaugcuaagugaaau

SEQ ID NO: 23730 - RNA, 15 nt, Homo sapiens
uggaaaaugugcaau

SEQ ID NO: 23731 - RNA, 21 nt, Homo sapiens
uauuuacugagcuucucugug

SEQ ID NO: 23732 - RNA, 21 nt, Homo sapiens
gaccacgcuuucuagcuguug

SEQ ID NO: 23733 - RNA, 11 nt, Homo sapiens
uuuaugugcaa

SEQ ID NO: 23734 - RNA, 22 nt, Homo sapiens
uguaaguuuaugcauacaguaa

SEQ ID NO: 23735 - RNA, 13 nt, Homo sapiens
agaaucacuugaa

SEQ ID NO: 23736 - RNA, 13 nt, Homo sapiens
ucaaauuccagaa

SEQ ID NO: 23737 - RNA, 16 nt, Homo sapiens
uggcacuugggacaaa

SEQ ID NO: 23738 - RNA, 16 nt, Homo sapiens
augaauaaaguguaag

SEQ ID NO: 23739 - RNA, 21 nt, Homo sapiens
gaacugcuggauucaagugau

SEQ ID NO: 23740 - RNA, 15 nt, Homo sapiens
gcaaugugacuuaau

SEQ ID NO: 23741 - RNA, 20 nt, Homo sapiens
gaaguugcagugagcugaua

SEQ ID NO: 23742 - RNA, 22 nt, Homo sapiens
gugugaccacugcagaagacag

SEQ ID NO: 23743 - RNA, 22 nt, Homo sapiens
agcaagaucccauggguugugu

SEQ ID NO: 23744 - RNA, 20 nt, Homo sapiens
agagcaagacucugucucaa

SEQ ID NO: 23745 - RNA, 24 nt, Homo sapiens
uuucaaaaucaaauuccagaauga

SEQ ID NO: 23746 - RNA, 16 nt, Homo sapiens
auuuuaaguaauuuca

SEQ ID NO: 23747 - RNA, 23 nt, Homo sapiens
gaggauguguggcauuuucacuu

SEQ ID NO: 23748 - RNA, 13 nt, Homo sapiens
acaacugugacug

SEQ ID NO: 23749 - RNA, 19 nt, Homo sapiens
gaagaaauuccaggaaaau

SEQ ID NO: 23750 - RNA, 18 nt, Homo sapiens
ugggucucaguguccuca

SEQ ID NO: 23751 - RNA, 13 nt, Homo sapiens
agauuaugaucuc

SEQ ID NO: 23752 - RNA, 15 nt, Homo sapiens
ucaucaaugaaugaa

SEQ ID NO: 23753 - RNA, 16 nt, Homo sapiens
uucaaaauuggacuua

SEQ ID NO: 23754 - RNA, 15 nt, Homo sapiens
ucuuggucacauaca

SEQ ID NO: 23755 - RNA, 15 nt, Homo sapiens
aggcauucucugaag

SEQ ID NO: 23756 - RNA, 12 nt, Homo sapiens
uggucucagugu

SEQ ID NO: 23757 - RNA, 13 nt, Homo sapiens
uuuauugccauga

SEQ ID NO: 23758 - RNA, 15 nt, Homo sapiens
cugguaacauagguu

SEQ ID NO: 23759 - RNA, 10 nt, Homo sapiens
caguaacuga

SEQ ID NO: 23760 - RNA, 16 nt, Homo sapiens
uuguaccgcaauguga

SEQ ID NO: 23761 - RNA, 14 nt, Homo sapiens
aaugaaguacucau

SEQ ID NO: 23762 - RNA, 17 nt, Homo sapiens
acuuaaaaucuaauuca

SEQ ID NO: 23763 - RNA, 14 nt, Homo sapiens
gcaggcgugaccug

SEQ ID NO: 23764 - RNA, 15 nt, Homo sapiens
ucaucaaucaaauaa

SEQ ID NO: 23765 - RNA, 13 nt, Homo sapiens
uuuauuaccucug

SEQ ID NO: 23766 - RNA, 15 nt, Homo sapiens
guugacaacugugac

SEQ ID NO: 23767 - RNA, 20 nt, Homo sapiens
cgcgcaccuguaaucccagc

SEQ ID NO: 23768 - RNA, 14 nt, Homo sapiens
gagaaguuaagcaa

SEQ ID NO: 23769 - RNA, 14 nt, Homo sapiens
uuaacacagugucu

SEQ ID NO: 23770 - RNA, 16 nt, Homo sapiens
acuaaaaauacaaaaa

SEQ ID NO: 23771 - RNA, 23 nt, Homo sapiens
augcuuguauuuuacuuuuccau

SEQ ID NO: 23772 - RNA, 15 nt, Homo sapiens
cuuaacucauugcaa

SEQ ID NO: 23773 - RNA, 12 nt, Homo sapiens
cugauaccucaa

SEQ ID NO: 23774 - RNA, 15 nt, Homo sapiens
uuaggcuauucacaa

SEQ ID NO: 23775 - RNA, 16 nt, Homo sapiens
uuuaaucaccaaggcu

SEQ ID NO: 23776 - RNA, 11 nt, Homo sapiens
cucaugcugcc

SEQ ID NO: 23777 - RNA, 21 nt, Homo sapiens
cuguaaucccagcuacuuggg

SEQ ID NO: 23778 - RNA, 20 nt, Homo sapiens
gcuaaguugcaccaacuuug

SEQ ID NO: 23779 - RNA, 20 nt, Homo sapiens
uaaauguaucuuauucacau

SEQ ID NO: 23780 - RNA, 13 nt, Homo sapiens
uccuucagccuga

SEQ ID NO: 23781 - RNA, 22 nt, Homo sapiens
cugcauacucauuaggauggcu

SEQ ID NO: 23782 - RNA, 12 nt, Homo sapiens
gaaaaugugcaa

SEQ ID NO: 23783 - RNA, 15 nt, Homo sapiens
uguuuuuaaacugga

SEQ ID NO: 23784 - RNA, 21 nt, Homo sapiens
gccuggaucucacaagcacuu

SEQ ID NO: 23785 - RNA, 23 nt, Homo sapiens
aucuuguuuuuccacuacugcua

SEQ ID NO: 23786 - RNA, 19 nt, Homo sapiens
cccuuugaugauuaauuca

SEQ ID NO: 23787 - RNA, 12 nt, Homo sapiens
acuagucuuaua

SEQ ID NO: 23788 - RNA, 19 nt, Homo sapiens
caaucuuaacucauugcaa

SEQ ID NO: 23789 - RNA, 18 nt, Homo sapiens
caagugaaaaacauccag

SEQ ID NO: 23790 - RNA, 19 nt, Homo sapiens
caggauagagugggacagu

SEQ ID NO: 23791 - RNA, 18 nt, Homo sapiens
gagccaccaaacccggcc

SEQ ID NO: 23792 - RNA, 17 nt, Homo sapiens
uaguuuaugauuccacc

SEQ ID NO: 23793 - RNA, 17 nt, Homo sapiens
gaaauagugucugauga

SEQ ID NO: 23794 - RNA, 14 nt, Homo sapiens
gguacauauuucuu

SEQ ID NO: 23795 - RNA, 14 nt, Homo sapiens
gauuucaugccugg

SEQ ID NO: 23796 - RNA, 15 nt, Homo sapiens
aagugcugggaauua

SEQ ID NO: 23797 - RNA, 20 nt, Homo sapiens
uugacuauuauagaauggaa

SEQ ID NO: 23798 - RNA, 20 nt, Homo sapiens
gaggcagagguugcagugag

SEQ ID NO: 23799 - RNA, 17 nt, Homo sapiens
uccuguacuuuuuccag

SEQ ID NO: 23800 - RNA, 15 nt, Homo sapiens
ugcagcugugccaua

SEQ ID NO: 23801 - RNA, 22 nt, Homo sapiens
augaaaacauagcaucucagga

SEQ ID NO: 23802 - RNA, 22 nt, Homo sapiens
gcuugaaauagugucugaugaa

SEQ ID NO: 23803 - RNA, 20 nt, Homo sapiens
gccauggagguuaagcacuu

SEQ ID NO: 23804 - RNA, 21 nt, Homo sapiens
ugaaauaagccagacaucaac

SEQ ID NO: 23805 - RNA, 22 nt, Homo sapiens
gaccuuuguagccacuucacuu

SEQ ID NO: 23806 - RNA, 17 nt, Homo sapiens
caaggcuggagugcagu

SEQ ID NO: 23807 - RNA, 21 nt, Homo sapiens
uaguguuggaaaaugugcaau

SEQ ID NO: 23808 - RNA, 13 nt, Homo sapiens
auguuaugcauaa

SEQ ID NO: 23809 - RNA, 14 nt, Homo sapiens
auuuauugagcacc

SEQ ID NO: 23810 - RNA, 20 nt, Homo sapiens
cucuaacucagaaacaucag

SEQ ID NO: 23811 - RNA, 12 nt, Homo sapiens
ccaacuaggcag

SEQ ID NO: 23812 - RNA, 17 nt, Homo sapiens
aauggaaaguaacucau

SEQ ID NO: 23813 - RNA, 19 nt, Homo sapiens
ugcuggccaggcuggucuc

SEQ ID NO: 23814 - RNA, 20 nt, Homo sapiens
aaccuccaccuucuggguuc

SEQ ID NO: 23815 - RNA, 14 nt, Homo sapiens
aaucccagcacuuu

SEQ ID NO: 23816 - RNA, 12 nt, Homo sapiens
uacaucuuucac

SEQ ID NO: 23817 - RNA, 17 nt, Homo sapiens
ccuuuuacauacugcug

SEQ ID NO: 23818 - RNA, 15 nt, Homo sapiens
ucccugcagacauga

SEQ ID NO: 23819 - RNA, 17 nt, Homo sapiens
caacuauauuaucaugc

SEQ ID NO: 23820 - RNA, 15 nt, Homo sapiens
cuucauguacaucca

SEQ ID NO: 23821 - RNA, 11 nt, Homo sapiens
aaugugcaaua

SEQ ID NO: 23822 - RNA, 15 nt, Homo sapiens
gguggcgcgcaccug

SEQ ID NO: 23823 - RNA, 14 nt, Homo sapiens
auggagugacuuag

SEQ ID NO: 23824 - RNA, 21 nt, Homo sapiens
gcuuauucacaagacccaaaa

SEQ ID NO: 23825 - RNA, 14 nt, Homo sapiens
gugaaauaagccag

SEQ ID NO: 23826 - RNA, 14 nt, Homo sapiens
auccugcaauucca

SEQ ID NO: 23827 - RNA, 20 nt, Homo sapiens
gugucuggcacuugggacaa

SEQ ID NO: 23828 - RNA, 20 nt, Homo sapiens
aagaccuggucgucgucuug

SEQ ID NO: 23829 - RNA, 14 nt, Homo sapiens
uaacugcauugaga

SEQ ID NO: 23830 - RNA, 14 nt, Homo sapiens
auauaauaugcaca

SEQ ID NO: 23831 - RNA, 20 nt, Homo sapiens
uccuagcgcagccaugugau

SEQ ID NO: 23832 - RNA, 23 nt, Homo sapiens
gaaauuugccaauuuacuuuguu

SEQ ID NO: 23833 - RNA, 20 nt, Homo sapiens
uugaaauagugucugaugaa

SEQ ID NO: 23834 - RNA, 12 nt, Homo sapiens
agcgacagugag

SEQ ID NO: 23835 - RNA, 20 nt, Homo sapiens
gcuguuuccauagggugaca

SEQ ID NO: 23836 - RNA, 17 nt, Homo sapiens
uauuugcaagacauaga

SEQ ID NO: 23837 - RNA, 16 nt, Homo sapiens
ucaugcaaaugcugua

SEQ ID NO: 23838 - RNA, 17 nt, Homo sapiens
aauugaaaggcauucuc

SEQ ID NO: 23839 - RNA, 20 nt, Homo sapiens
ccaaaguaucaggacgagaa

SEQ ID NO: 23840 - RNA, 21 nt, Homo sapiens
ugucucggagggauuccccua

SEQ ID NO: 23841 - RNA, 16 nt, Homo sapiens
ccacgcccagcuaauu

SEQ ID NO: 23842 - RNA, 16 nt, Homo sapiens
uucacaagacccaaaa

SEQ ID NO: 23843 - RNA, 11 nt, Homo sapiens
aggcauguaau

SEQ ID NO: 23844 - RNA, 15 nt, Homo sapiens
uccgaagucuuccau

SEQ ID NO: 23845 - RNA, 13 nt, Homo sapiens
ccucuguugccaa

SEQ ID NO: 23846 - RNA, 22 nt, Homo sapiens
uuacuauuuauugcugaaugac

SEQ ID NO: 23847 - RNA, 21 nt, Homo sapiens
agcaagugaauuuuucucuaa

SEQ ID NO: 23848 - RNA, 23 nt, Homo sapiens
auggaaguugcagugagcugaua

SEQ ID NO: 23849 - RNA, 13 nt, Homo sapiens
uaacacagugucu

SEQ ID NO: 23850 - RNA, 21 nt, Homo sapiens
ugaaaaucuacacuccaguga

SEQ ID NO: 23851 - RNA, 19 nt, Homo sapiens
uagcgcagccaugugauua

SEQ ID NO: 23852 - RNA, 14 nt, Homo sapiens
guaccucucuuaua

SEQ ID NO: 23853 - RNA, 15 nt, Homo sapiens
cuaaauuugguucua

SEQ ID NO: 23854 - RNA, 12 nt, Homo sapiens
ugacacaucucu

SEQ ID NO: 23855 - RNA, 13 nt, Homo sapiens
uuuaugcauacag

SEQ ID NO: 23856 - RNA, 11 nt, Homo sapiens
ucacauuugcg

SEQ ID NO: 23857 - RNA, 22 nt, Homo sapiens
gagacagaaagcagaacaguga

SEQ ID NO: 23858 - RNA, 21 nt, Homo sapiens
ggagcuugaaauagugucuga

SEQ ID NO: 23859 - RNA, 17 nt, Homo sapiens
aucaaauuccagaauga

SEQ ID NO: 23860 - RNA, 22 nt, Homo sapiens
caaauaaguauuuauaauagca

SEQ ID NO: 23861 - RNA, 18 nt, Homo sapiens
uucacuugaugauacaau

SEQ ID NO: 23862 - RNA, 23 nt, Homo sapiens
uaacucagaaacaucaguuacuc

SEQ ID NO: 23863 - RNA, 15 nt, Homo sapiens
agaauucuuacaugu

SEQ ID NO: 23864 - RNA, 22 nt, Homo sapiens
caggauagagugggacaguucc

SEQ ID NO: 23865 - RNA, 15 nt, Homo sapiens
agagaaaagacauaa

SEQ ID NO: 23866 - RNA, 23 nt, Homo sapiens
uccuagcgcagccaugugauuac

SEQ ID NO: 23867 - RNA, 20 nt, Homo sapiens
uaagcaaaaugugauaugua

SEQ ID NO: 23868 - RNA, 17 nt, Homo sapiens
ucugucuggacuuucca

SEQ ID NO: 23869 - RNA, 15 nt, Homo sapiens
agacaucaacagaua

SEQ ID NO: 23870 - RNA, 13 nt, Homo sapiens
cuuugaagucuga

SEQ ID NO: 23871 - RNA, 21 nt, Homo sapiens
gcagugagcugauaucaugcc

SEQ ID NO: 23872 - RNA, 11 nt, Homo sapiens
acaucuuucac

SEQ ID NO: 23873 - RNA, 16 nt, Homo sapiens
acagagaaaagacaua

SEQ ID NO: 23874 - RNA, 20 nt, Homo sapiens
gaaaccuuauuguaccucuc

SEQ ID NO: 23875 - RNA, 16 nt, Homo sapiens
ucccaaagugcuggga

SEQ ID NO: 23876 - RNA, 22 nt, Homo sapiens
agcauauguuuuuguaaguuua

SEQ ID NO: 23877 - RNA, 14 nt, Homo sapiens
ugaaugugucaggu

SEQ ID NO: 23878 - RNA, 17 nt, Homo sapiens
uugaaauuaaccauaga

SEQ ID NO: 23879 - RNA, 23 nt, Homo sapiens
auuucaaaacucauuuccuaugu

SEQ ID NO: 23880 - RNA, 13 nt, Homo sapiens
uagcaucucagga

SEQ ID NO: 23881 - RNA, 10 nt, Homo sapiens
uaugugcaau

SEQ ID NO: 23882 - RNA, 17 nt, Homo sapiens
gaauuuauucaauuccu

SEQ ID NO: 23883 - RNA, 20 nt, Homo sapiens
agugaaaaucuacacuccag

SEQ ID NO: 23884 - RNA, 14 nt, Homo sapiens
aaaccaaggcuaga

SEQ ID NO: 23885 - RNA, 20 nt, Homo sapiens
uucaccuuccagugucucgg

SEQ ID NO: 23886 - RNA, 15 nt, Homo sapiens
aaggcuuuaucucag

SEQ ID NO: 23887 - RNA, 15 nt, Homo sapiens
gaaaaugugcaauau

SEQ ID NO: 23888 - RNA, 15 nt, Homo sapiens
cauccagauagguua

SEQ ID NO: 23889 - RNA, 13 nt, Homo sapiens
aauaaaagcacuu

SEQ ID NO: 23890 - RNA, 21 nt, Homo sapiens
auagcagcuuauucacaagac

SEQ ID NO: 23891 - RNA, 23 nt, Homo sapiens
cagaagaaauucugcaagcuuuu

SEQ ID NO: 23892 - RNA, 22 nt, Homo sapiens
aaagggucucccucuguugcca

SEQ ID NO: 23893 - RNA, 16 nt, Homo sapiens
guauuuuacuuuucca

SEQ ID NO: 23894 - RNA, 15 nt, Homo sapiens
aaauaaaagcacuua

SEQ ID NO: 23895 - RNA, 15 nt, Homo sapiens
aggcuccaaacugga

SEQ ID NO: 23896 - RNA, 17 nt, Homo sapiens
ucauguacauccauggu

SEQ ID NO: 23897 - RNA, 19 nt, Homo sapiens
aauauaauaugcacacagu

SEQ ID NO: 23898 - RNA, 15 nt, Homo sapiens
ggaggcugaggcaag

SEQ ID NO: 23899 - RNA, 20 nt, Homo sapiens
uaguuucccuugcaugguuu

SEQ ID NO: 23900 - RNA, 22 nt, Homo sapiens
caaauucgcugcaaccuguuga

SEQ ID NO: 23901 - RNA, 15 nt, Homo sapiens
aaauauaauaugcac

SEQ ID NO: 23902 - RNA, 19 nt, Homo sapiens
cugcuggauucaagugauc

SEQ ID NO: 23903 - RNA, 17 nt, Homo sapiens
caagugaaaaacaucca

SEQ ID NO: 23904 - RNA, 14 nt, Homo sapiens
agcaaaaugugaua

SEQ ID NO: 23905 - RNA, 16 nt, Homo sapiens
uagauaaacucagaaa

SEQ ID NO: 23906 - RNA, 18 nt, Homo sapiens
gugagacagcucugcaua

SEQ ID NO: 23907 - RNA, 14 nt, Homo sapiens
uugaaauagugucu

SEQ ID NO: 23908 - RNA, 14 nt, Homo sapiens
aagacaaauucugu

SEQ ID NO: 23909 - RNA, 18 nt, Homo sapiens
acacuaaaaaggcaugua

SEQ ID NO: 23910 - RNA, 15 nt, Homo sapiens
uaugcuaagugaaau

SEQ ID NO: 23911 - RNA, 20 nt, Homo sapiens
gugaaauaagccagacauca

SEQ ID NO: 23912 - RNA, 17 nt, Homo sapiens
gugagacagcucugcau

SEQ ID NO: 23913 - RNA, 16 nt, Homo sapiens
aacagaagcuuccauu

SEQ ID NO: 23914 - RNA, 15 nt, Homo sapiens
gcgugagccaccaaa

SEQ ID NO: 23915 - RNA, 19 nt, Homo sapiens
uauaucaguccucuuucaa

SEQ ID NO: 23916 - RNA, 18 nt, Homo sapiens
acuaaauugacacuuaaa

SEQ ID NO: 23917 - RNA, 17 nt, Homo sapiens
ugggaauuuucuuccaa

SEQ ID NO: 23918 - RNA, 12 nt, Homo sapiens
uagcaucucagg

SEQ ID NO: 23919 - RNA, 20 nt, Homo sapiens
caaaacugauacccuuugaa

SEQ ID NO: 23920 - RNA, 22 nt, Homo sapiens
cuggagcuugaaauagugucug

SEQ ID NO: 23921 - RNA, 15 nt, Homo sapiens
uugcaagacauagaa

SEQ ID NO: 23922 - RNA, 21 nt, Homo sapiens
uaaacaguagugauaguugua

SEQ ID NO: 23923 - RNA, 19 nt, Homo sapiens
caaacgaaaaacauuucaa

SEQ ID NO: 23924 - RNA, 14 nt, Homo sapiens
ugcauacaguaauu

SEQ ID NO: 23925 - RNA, 16 nt, Homo sapiens
agggauuccccuaacc

SEQ ID NO: 23926 - RNA, 18 nt, Homo sapiens
uauuguugacaacuguga

SEQ ID NO: 23927 - RNA, 11 nt, Homo sapiens
augugcaauau

SEQ ID NO: 23928 - RNA, 16 nt, Homo sapiens
ccuucauguacaucca

SEQ ID NO: 23929 - RNA, 15 nt, Homo sapiens
cuauauccugugacu

SEQ ID NO: 23930 - RNA, 18 nt, Homo sapiens
acuuaaaaucuaauucaa

SEQ ID NO: 23931 - RNA, 21 nt, Homo sapiens
accuguugauagcaagugaau

SEQ ID NO: 23932 - RNA, 16 nt, Homo sapiens
gccuaucagcauuuua

SEQ ID NO: 23933 - RNA, 13 nt, Homo sapiens
ugacccacaagaa

SEQ ID NO: 23934 - RNA, 20 nt, Homo sapiens
caaaugagccggagccccuu

SEQ ID NO: 23935 - RNA, 11 nt, Homo sapiens
uuaaucaccaa

SEQ ID NO: 23936 - RNA, 14 nt, Homo sapiens
cuuauugacuauua

SEQ ID NO: 23937 - RNA, 20 nt, Homo sapiens
ucuggacuuuccagagacca

SEQ ID NO: 23938 - RNA, 15 nt, Homo sapiens
aagauuaugaucuca

SEQ ID NO: 23939 - RNA, 23 nt, Homo sapiens
auaguguuggaaaaugugcaaua

SEQ ID NO: 23940 - RNA, 14 nt, Homo sapiens
ccaaggcuggagug

SEQ ID NO: 23941 - RNA, 14 nt, Homo sapiens
uuaguguacaugaa

SEQ ID NO: 23942 - RNA, 17 nt, Homo sapiens
aaauauaauaugcacac

SEQ ID NO: 23943 - RNA, 18 nt, Homo sapiens
guaaguuuaugcauacag

SEQ ID NO: 23944 - RNA, 15 nt, Homo sapiens
ugugauuacaaggcu

SEQ ID NO: 23945 - RNA, 19 nt, Homo sapiens
agagacagcaggucucaug

SEQ ID NO: 23946 - RNA, 20 nt, Homo sapiens
aaacuuuaugcuaagugaaa

SEQ ID NO: 23947 - RNA, 18 nt, Homo sapiens
aaauauuuuuaugugcaa

SEQ ID NO: 23948 - RNA, 13 nt, Homo sapiens
cccuuuuacauac

SEQ ID NO: 23949 - RNA, 21 nt, Homo sapiens
uggcuaagcaaaaugugauau

SEQ ID NO: 23950 - RNA, 22 nt, Homo sapiens
uucugcagauaaacaguaguga

SEQ ID NO: 23951 - RNA, 17 nt, Homo sapiens
uggcgcgcgccaccacg

SEQ ID NO: 23952 - RNA, 23 nt, Homo sapiens
auuuuuccccaaaaagaauggga

SEQ ID NO: 23953 - RNA, 17 nt, Homo sapiens
ccucccuucucuucaca

SEQ ID NO: 23954 - RNA, 20 nt, Homo sapiens
cauuaaauauaauaugcaca

SEQ ID NO: 23955 - RNA, 12 nt, Homo sapiens
aaguacucauac

SEQ ID NO: 23956 - RNA, 16 nt, Homo sapiens
auacuauccaguuacu

SEQ ID NO: 23957 - RNA, 17 nt, Homo sapiens
gagguacugagagugaa

SEQ ID NO: 23958 - RNA, 21 nt, Homo sapiens
agaaaccuuauuguaccucuc

SEQ ID NO: 23959 - RNA, 13 nt, Homo sapiens
cgaagucuuccau

SEQ ID NO: 23960 - RNA, 13 nt, Homo sapiens
gcuuuaauuucau

SEQ ID NO: 23961 - RNA, 23 nt, Homo sapiens
auguuucgugaaguauacuguau

SEQ ID NO: 23962 - RNA, 21 nt, Homo sapiens
gaacucaaggaaaucuguguc

SEQ ID NO: 23963 - RNA, 20 nt, Homo sapiens
ggccuccucucucaguuuuu

SEQ ID NO: 23964 - RNA, 15 nt, Homo sapiens
uauguucuaagaagu

SEQ ID NO: 23965 - RNA, 17 nt, Homo sapiens
uaaaguacagacuuuuu

SEQ ID NO: 23966 - RNA, 19 nt, Homo sapiens
caaccugggggcuuuaggg

SEQ ID NO: 23967 - RNA, 15 nt, Homo sapiens
auucugcaagcuuuu

SEQ ID NO: 23968 - RNA, 22 nt, Homo sapiens
aagcuuccauuccaagccugac

SEQ ID NO: 23969 - RNA, 18 nt, Homo sapiens
auuagaggucuccaaaau

SEQ ID NO: 23970 - RNA, 14 nt, Homo sapiens
augaaugaauggcu

SEQ ID NO: 23971 - RNA, 15 nt, Homo sapiens
uugcaccaacuuuga

SEQ ID NO: 23972 - RNA, 16 nt, Homo sapiens
gagacucugucucagu

SEQ ID NO: 23973 - RNA, 16 nt, Homo sapiens
cgcaaugugacuuaau

SEQ ID NO: 23974 - RNA, 22 nt, Homo sapiens
cuuuaauuucaugaaaagauua

SEQ ID NO: 23975 - RNA, 20 nt, Homo sapiens
augaacacuuauaagugaag

SEQ ID NO: 23976 - RNA, 17 nt, Homo sapiens
aauucuuacauguuuuc

SEQ ID NO: 23977 - RNA, 15 nt, Homo sapiens
aagcagaacagugau

SEQ ID NO: 23978 - RNA, 13 nt, Homo sapiens
cauagagacuuug

SEQ ID NO: 23979 - RNA, 21 nt, Homo sapiens
aaaauuagccgggcauggugg

SEQ ID NO: 23980 - RNA, 17 nt, Homo sapiens
caaagcugaauacauuc

SEQ ID NO: 23981 - RNA, 20 nt, Homo sapiens
gauacaaugaacacuuauaa

SEQ ID NO: 23982 - RNA, 12 nt, Homo sapiens
uaaaagcacuua

SEQ ID NO: 23983 - RNA, 21 nt, Homo sapiens
agaauuuauucaauuccucug

SEQ ID NO: 23984 - RNA, 17 nt, Homo sapiens
aacuggaaauaaaagau

SEQ ID NO: 23985 - RNA, 13 nt, Homo sapiens
uggcacugcauac

SEQ ID NO: 23986 - RNA, 23 nt, Homo sapiens
ugaaauaagccagacaucaacag

SEQ ID NO: 23987 - RNA, 19 nt, Homo sapiens
gaagaguggguuucacaag

SEQ ID NO: 23988 - RNA, 16 nt, Homo sapiens
cauaauuacuauguca

SEQ ID NO: 23989 - RNA, 21 nt, Homo sapiens
ucuagcaaauguuaugcauaa

SEQ ID NO: 23990 - RNA, 23 nt, Homo sapiens
uguauuuuauuacaucuuucaca

SEQ ID NO: 23991 - RNA, 21 nt, Homo sapiens
ugugguccgaagucuuccaua

SEQ ID NO: 23992 - RNA, 16 nt, Homo sapiens
ugccccagggaccuuu

SEQ ID NO: 23993 - RNA, 20 nt, Homo sapiens
augguggcgcgcaccuguaa

SEQ ID NO: 23994 - RNA, 16 nt, Homo sapiens
cagagaaaagacauaa

SEQ ID NO: 23995 - RNA, 23 nt, Homo sapiens
agacaccaccacccuugccaugg

SEQ ID NO: 23996 - RNA, 18 nt, Homo sapiens
gacaaagacaaauucugu

SEQ ID NO: 23997 - RNA, 12 nt, Homo sapiens
auauuagcuuua

SEQ ID NO: 23998 - RNA, 19 nt, Homo sapiens
cuucuuggucucaguguca

SEQ ID NO: 23999 - RNA, 23 nt, Homo sapiens
cacuccagccugagcgacaguga

SEQ ID NO: 24000 - RNA, 22 nt, Homo sapiens
accagccuggucaacaugguga

SEQ ID NO: 24001 - RNA, 21 nt, Homo sapiens
cuuugcuuuaaguguaacugg

SEQ ID NO: 24002 - RNA, 14 nt, Homo sapiens
agaacuugaaugug

SEQ ID NO: 24003 - RNA, 19 nt, Homo sapiens
uggagcuugaaauaguguc

SEQ ID NO: 24004 - RNA, 19 nt, Homo sapiens
gcuguuuuuauauauguga

SEQ ID NO: 24005 - RNA, 22 nt, Homo sapiens
gaaagaaaaucaggcuggccaa

SEQ ID NO: 24006 - RNA, 13 nt, Homo sapiens
gggaguggcgcgc

SEQ ID NO: 24007 - RNA, 13 nt, Homo sapiens
uacauacugcugu

SEQ ID NO: 24008 - RNA, 22 nt, Homo sapiens
augaaaagauuaugaucucaga

SEQ ID NO: 24009 - RNA, 18 nt, Homo sapiens
ucuaacucagaaacauca

SEQ ID NO: 24010 - RNA, 16 nt, Homo sapiens
ucugcuuuaauuucau

SEQ ID NO: 24011 - RNA, 17 nt, Homo sapiens
uuauuuuuuuacuuccu

SEQ ID NO: 24012 - RNA, 13 nt, Homo sapiens
augauuucauuca

SEQ ID NO: 24013 - RNA, 18 nt, Homo sapiens
caaccuccaccuucuggg

SEQ ID NO: 24014 - RNA, 15 nt, Homo sapiens
agacgggguuugcca

SEQ ID NO: 24015 - RNA, 18 nt, Homo sapiens
aggcauguaauugcuugu

SEQ ID NO: 24016 - RNA, 21 nt, Homo sapiens
caauucuauuacgugcaauac

SEQ ID NO: 24017 - RNA, 23 nt, Homo sapiens
agccaaccugggggcuuuaggga

SEQ ID NO: 24018 - RNA, 22 nt, Homo sapiens
gaaguacucauacauguuacaa

SEQ ID NO: 24019 - RNA, 18 nt, Homo sapiens
aggugagcaggugaugcc

SEQ ID NO: 24020 - RNA, 16 nt, Homo sapiens
ugugucaguggaugcu

SEQ ID NO: 24021 - RNA, 13 nt, Homo sapiens
aucuauuuauuaa

SEQ ID NO: 24022 - RNA, 21 nt, Homo sapiens
auugcuuguuagcaaaaugga

SEQ ID NO: 24023 - RNA, 17 nt, Homo sapiens
uuacaaaccucaagcca

SEQ ID NO: 24024 - RNA, 19 nt, Homo sapiens
caagacucugucucaaaaa

SEQ ID NO: 24025 - RNA, 16 nt, Homo sapiens
guaccgcaaugugacu

SEQ ID NO: 24026 - RNA, 23 nt, Homo sapiens
uccucuuucaaagguagccauca

SEQ ID NO: 24027 - RNA, 15 nt, Homo sapiens
ucacagguugaccaa

SEQ ID NO: 24028 - RNA, 21 nt, Homo sapiens
gagccaccaaacccggccuga

SEQ ID NO: 24029 - RNA, 23 nt, Homo sapiens
aaacugauacccuuugaaaaagu

SEQ ID NO: 24030 - RNA, 12 nt, Homo sapiens
auuuucuuccaa

SEQ ID NO: 24031 - RNA, 23 nt, Homo sapiens
aauaaaagauuguauagugcaug

SEQ ID NO: 24032 - RNA, 15 nt, Homo sapiens
aaauggagugacuua

SEQ ID NO: 24033 - RNA, 19 nt, Homo sapiens
agaauauuuauuaccucug

SEQ ID NO: 24034 - RNA, 20 nt, Homo sapiens
uagaauauuuauuaccucug

SEQ ID NO: 24035 - RNA, 18 nt, Homo sapiens
augcuuguauuuuacuuu

SEQ ID NO: 24036 - RNA, 21 nt, Homo sapiens
agcccccauuguggucacagg

SEQ ID NO: 24037 - RNA, 21 nt, Homo sapiens
uuucaccuguuuuuaagcugu

SEQ ID NO: 24038 - RNA, 17 nt, Homo sapiens
gguccgaagucuuccau

SEQ ID NO: 24039 - RNA, 11 nt, Homo sapiens
cccuugccaug

SEQ ID NO: 24040 - RNA, 23 nt, Homo sapiens
aagucuuccauagagacuuugug

SEQ ID NO: 24041 - RNA, 19 nt, Homo sapiens
aaaacuuuaugcuaaguga

SEQ ID NO: 24042 - RNA, 20 nt, Homo sapiens
uccguggcacugcauacaau

SEQ ID NO: 24043 - RNA, 20 nt, Homo sapiens
ccucauuccccaaccacuuc

SEQ ID NO: 24044 - RNA, 23 nt, Homo sapiens
uauaagugaagugauacuaucca

SEQ ID NO: 24045 - RNA, 19 nt, Homo sapiens
gaaguacucauacauguua

SEQ ID NO: 24046 - RNA, 12 nt, Homo sapiens
caaacagaacua

SEQ ID NO: 24047 - RNA, 13 nt, Homo sapiens
agcaaaaugugau

SEQ ID NO: 24048 - RNA, 13 nt, Homo sapiens
uguuuuuaagcug

SEQ ID NO: 24049 - RNA, 24 nt, Homo sapiens
aucuuguuuuuccacuacugcuac

SEQ ID NO: 24050 - RNA, 22 nt, Homo sapiens
agagcccuucaugcauuugcac

SEQ ID NO: 24051 - RNA, 21 nt, Homo sapiens
aagcaaagacuaugaggaaua

SEQ ID NO: 24052 - RNA, 21 nt, Homo sapiens
cacauuccaagccucaugucc

SEQ ID NO: 24053 - RNA, 15 nt, Homo sapiens
uaaugaaaaugaaua

SEQ ID NO: 24054 - RNA, 18 nt, Homo sapiens
cuucucuucacagucaca

SEQ ID NO: 24055 - RNA, 19 nt, Homo sapiens
uguuggaaaaugugcaaua

SEQ ID NO: 24056 - RNA, 15 nt, Homo sapiens
gauuacccucugggu

SEQ ID NO: 24057 - RNA, 14 nt, Homo sapiens
ccuuauuguaccuc

SEQ ID NO: 24058 - RNA, 19 nt, Homo sapiens
cagugagccgagauugugc

SEQ ID NO: 24059 - RNA, 22 nt, Homo sapiens
ugcagauaaacaguagugauag

SEQ ID NO: 24060 - RNA, 22 nt, Homo sapiens
acacaugauccugcaauuccac

SEQ ID NO: 24061 - RNA, 14 nt, Homo sapiens
agaaucacuugaac

SEQ ID NO: 24062 - RNA, 19 nt, Homo sapiens
aauuauuuuuacaguucuc

SEQ ID NO: 24063 - RNA, 22 nt, Homo sapiens
uaauggaauauguaaauagaaa

SEQ ID NO: 24064 - RNA, 20 nt, Homo sapiens
gaaauuuaauucauguuucu

SEQ ID NO: 24065 - RNA, 17 nt, Homo sapiens
uaugauuccaccuacau

SEQ ID NO: 24066 - RNA, 14 nt, Homo sapiens
agccacuucacuuu

SEQ ID NO: 24067 - RNA, 13 nt, Homo sapiens
cuuaugaaccuuu

SEQ ID NO: 24068 - RNA, 16 nt, Homo sapiens
aagaaugacuaugcaa

SEQ ID NO: 24069 - RNA, 12 nt, Homo sapiens
cacuucacuuuu

SEQ ID NO: 24070 - RNA, 10 nt, Homo sapiens
augugcaaua

SEQ ID NO: 24071 - RNA, 19 nt, Homo sapiens
auacaauuauuuuuacagu

SEQ ID NO: 24072 - RNA, 16 nt, Homo sapiens
gcgcagccaugugauu

SEQ ID NO: 24073 - RNA, 15 nt, Homo sapiens
caaaaucaaauucca

SEQ ID NO: 24074 - RNA, 20 nt, Homo sapiens
ucugggcuuggggcuuccua

SEQ ID NO: 24075 - RNA, 14 nt, Homo sapiens
uaguguacaugaaa

SEQ ID NO: 24076 - RNA, 18 nt, Homo sapiens
aaccuuauuguaccucuc

SEQ ID NO: 24077 - RNA, 20 nt, Homo sapiens
uccagccugagcgacaguga

SEQ ID NO: 24078 - RNA, 14 nt, Homo sapiens
ucauacauguuaca

SEQ ID NO: 24079 - RNA, 16 nt, Homo sapiens
ccucucuuauagaaua

SEQ ID NO: 24080 - RNA, 20 nt, Homo sapiens
cucuacuaaaaauacaaaaa

SEQ ID NO: 24081 - RNA, 17 nt, Homo sapiens
aaucuucagaccuagaa

SEQ ID NO: 24082 - RNA, 16 nt, Homo sapiens
gacaacugugacugua

SEQ ID NO: 24083 - RNA, 19 nt, Homo sapiens
ucacaaccacucauucaaa

SEQ ID NO: 24084 - RNA, 22 nt, Homo sapiens
ugacaacugugacuguacccaa

SEQ ID NO: 24085 - RNA, 16 nt, Homo sapiens
cacagaggaucugcuu

SEQ ID NO: 24086 - RNA, 22 nt, Homo sapiens
guuaagcacuuuaacacagugu

SEQ ID NO: 24087 - RNA, 17 nt, Homo sapiens
agaaucagaucauuuca

SEQ ID NO: 24088 - RNA, 19 nt, Homo sapiens
acaaauuuacagagacaga

SEQ ID NO: 24089 - RNA, 22 nt, Homo sapiens
aauauuguugacaacugugacu

SEQ ID NO: 24090 - RNA, 19 nt, Homo sapiens
uucgugaaguauacuguau

SEQ ID NO: 24091 - RNA, 13 nt, Homo sapiens
uugaaaaaguaua

SEQ ID NO: 24092 - RNA, 23 nt, Homo sapiens
aaccaaauuuguauuuaagguau

SEQ ID NO: 24093 - RNA, 19 nt, Homo sapiens
ccuuuggaugcacuuuaua

SEQ ID NO: 24094 - RNA, 15 nt, Homo sapiens
agcccauggcacucu

SEQ ID NO: 24095 - RNA, 17 nt, Homo sapiens
augaaguacucauacau

SEQ ID NO: 24096 - RNA, 18 nt, Homo sapiens
uuauaauuccuauauccu

SEQ ID NO: 24097 - RNA, 13 nt, Homo sapiens
aacacagugucug

SEQ ID NO: 24098 - RNA, 11 nt, Homo sapiens
uaugugcaaua

SEQ ID NO: 24099 - RNA, 17 nt, Homo sapiens
aaauagugucugaugaa

SEQ ID NO: 24100 - RNA, 16 nt, Homo sapiens
aaguugcaccaacuuu

SEQ ID NO: 24101 - RNA, 22 nt, Homo sapiens
aauuccuauauccugugacugu

SEQ ID NO: 24102 - RNA, 16 nt, Homo sapiens
gcaaauguuaugcaua

SEQ ID NO: 24103 - RNA, 14 nt, Homo sapiens
uuccacuacugcua

SEQ ID NO: 24104 - RNA, 13 nt, Homo sapiens
acauagcaucuca

SEQ ID NO: 24105 - RNA, 14 nt, Homo sapiens
ugagaagaaugacu

SEQ ID NO: 24106 - RNA, 13 nt, Homo sapiens
uucugcaagcuuu

SEQ ID NO: 24107 - RNA, 20 nt, Homo sapiens
gccuguaaucccagcacuuu

SEQ ID NO: 24108 - RNA, 20 nt, Homo sapiens
gugcugggaauuacaggcgu

SEQ ID NO: 24109 - RNA, 16 nt, Homo sapiens
uacauuuccaaauuca

SEQ ID NO: 24110 - RNA, 16 nt, Homo sapiens
guagccacuucacuuu

SEQ ID NO: 24111 - RNA, 17 nt, Homo sapiens
uuuaaugggcacagggu

SEQ ID NO: 24112 - RNA, 19 nt, Homo sapiens
aauaauacaccagagauaa

SEQ ID NO: 24113 - RNA, 17 nt, Homo sapiens
gcauuguaacuuaugaa

SEQ ID NO: 24114 - RNA, 16 nt, Homo sapiens
uuccguggcacugcau

SEQ ID NO: 24115 - RNA, 17 nt, Homo sapiens
ugcuggauucaagugau

SEQ ID NO: 24116 - RNA, 19 nt, Homo sapiens
accuguuuuuaagcuguuu

SEQ ID NO: 24117 - RNA, 15 nt, Homo sapiens
cucuggcgacaguuu

SEQ ID NO: 24118 - RNA, 18 nt, Homo sapiens
ccaaggcuggagugcagu

SEQ ID NO: 24119 - RNA, 20 nt, Homo sapiens
gacauagaauuaacacauga

SEQ ID NO: 24120 - RNA, 22 nt, Homo sapiens
agcagagacgggguuugccaug

SEQ ID NO: 24121 - RNA, 22 nt, Homo sapiens
gauagagugggacaguuccuga

SEQ ID NO: 24122 - RNA, 14 nt, Homo sapiens
accaguauucccuu

SEQ ID NO: 24123 - RNA, 20 nt, Homo sapiens
agcccuucaugcauuugcac

SEQ ID NO: 24124 - RNA, 12 nt, Homo sapiens
caggaaaauuaa

SEQ ID NO: 24125 - RNA, 14 nt, Homo sapiens
aacauguucacuua

SEQ ID NO: 24126 - RNA, 15 nt, Homo sapiens
gagguuaagcacuuu

SEQ ID NO: 24127 - RNA, 20 nt, Homo sapiens
uaaauggacaaaugcuuaug

SEQ ID NO: 24128 - RNA, 20 nt, Homo sapiens
cucaguguccucaucuguaa

SEQ ID NO: 24129 - RNA, 21 nt, Homo sapiens
ugcaagacauagaauaguguu

SEQ ID NO: 24130 - RNA, 19 nt, Homo sapiens
guuuuccuucucaucugug

SEQ ID NO: 24131 - RNA, 16 nt, Homo sapiens
aucaaccaaauggagu

SEQ ID NO: 24132 - RNA, 21 nt, Homo sapiens
auauuugaauuuuaaaucuaa

SEQ ID NO: 24133 - RNA, 22 nt, Homo sapiens
gccaugugauuacccucugggu

SEQ ID NO: 24134 - RNA, 17 nt, Homo sapiens
ugacaacugugacugua

SEQ ID NO: 24135 - RNA, 22 nt, Homo sapiens
gucucaguguccucaucuguaa

SEQ ID NO: 24136 - RNA, 21 nt, Homo sapiens
auaccucaacccccauuucua

SEQ ID NO: 24137 - RNA, 18 nt, Homo sapiens
auuagccgggcauggugg

SEQ ID NO: 24138 - RNA, 15 nt, Homo sapiens
aaccaugcccaagaa

SEQ ID NO: 24139 - RNA, 19 nt, Homo sapiens
gcaacccaaauguucauca

SEQ ID NO: 24140 - RNA, 15 nt, Homo sapiens
uugacaacugugacu

SEQ ID NO: 24141 - RNA, 23 nt, Homo sapiens
aaagucagugcccaacuguuaua

SEQ ID NO: 24142 - RNA, 16 nt, Homo sapiens
uguaucuuauucacau

SEQ ID NO: 24143 - RNA, 16 nt, Homo sapiens
agcccauggcacucua

SEQ ID NO: 24144 - RNA, 13 nt, Homo sapiens
cucaucugugauu

SEQ ID NO: 24145 - RNA, 21 nt, Homo sapiens
guuuucccugaccucccucua

SEQ ID NO: 24146 - RNA, 18 nt, Homo sapiens
aauauuugcaagacauag

SEQ ID NO: 24147 - RNA, 20 nt, Homo sapiens
uugacacuuaaaaaugguuu

SEQ ID NO: 24148 - RNA, 19 nt, Homo sapiens
aucaugcaaaugcuguauu

SEQ ID NO: 24149 - RNA, 23 nt, Homo sapiens
ucucuuuuuagagaaauuugcca

SEQ ID NO: 24150 - RNA, 24 nt, Homo sapiens
ggacuugggcgggacacaggcucc

SEQ ID NO: 24151 - RNA, 17 nt, Homo sapiens
auccaaagcugaauaca

SEQ ID NO: 24152 - RNA, 22 nt, Homo sapiens
uacaauuauuuuuacaguucuc

SEQ ID NO: 24153 - RNA, 13 nt, Homo sapiens
auaaaagcacuua

SEQ ID NO: 24154 - RNA, 15 nt, Homo sapiens
uuuuaaguaauuuca

SEQ ID NO: 24155 - RNA, 17 nt, Homo sapiens
agugcccaacuguuaua

SEQ ID NO: 24156 - RNA, 23 nt, Homo sapiens
caaacaaacgaaaaacauuucaa

SEQ ID NO: 24157 - RNA, 18 nt, Homo sapiens
ugucuucauagcagauuu

SEQ ID NO: 24158 - RNA, 22 nt, Homo sapiens
agcuuuucaaaauuggacuuaa

SEQ ID NO: 24159 - RNA, 19 nt, Homo sapiens
aauagaaggauguacauuu

SEQ ID NO: 24160 - RNA, 19 nt, Homo sapiens
cauggcacucuauguucua

SEQ ID NO: 24161 - RNA, 19 nt, Homo sapiens
ugagagacagcaggucuca

SEQ ID NO: 24162 - RNA, 21 nt, Homo sapiens
cuuaguguacaugaaagcgua

SEQ ID NO: 24163 - RNA, 20 nt, Homo sapiens
uaaucccagcuacuugggag

SEQ ID NO: 24164 - RNA, 14 nt, Homo sapiens
ggccaacuaggcag

SEQ ID NO: 24165 - RNA, 16 nt, Homo sapiens
agaauucuuacauguu

SEQ ID NO: 24166 - RNA, 16 nt, Homo sapiens
uucagccugaaagagg

SEQ ID NO: 24167 - RNA, 23 nt, Homo sapiens
aucacuugaacccgggaggcaga

SEQ ID NO: 24168 - RNA, 19 nt, Homo sapiens
aaguugcaccaacuuugaa

SEQ ID NO: 24169 - RNA, 19 nt, Homo sapiens
gguaucaaccaaauggagu

SEQ ID NO: 24170 - RNA, 20 nt, Homo sapiens
ucucaggggccaacuaggca

SEQ ID NO: 24171 - RNA, 15 nt, Homo sapiens
uucuauuuauuuacu

SEQ ID NO: 24172 - RNA, 15 nt, Homo sapiens
agaauuaacacauga

SEQ ID NO: 24173 - RNA, 16 nt, Homo sapiens
uuccuauguaacugca

SEQ ID NO: 24174 - RNA, 13 nt, Homo sapiens
ccugcaauuccac

SEQ ID NO: 24175 - RNA, 11 nt, Homo sapiens
augugcaauaa

SEQ ID NO: 24176 - RNA, 21 nt, Homo sapiens
aauuuuucucuaacucagaaa

SEQ ID NO: 24177 - RNA, 12 nt, Homo sapiens
gccaauuuacuu

SEQ ID NO: 24178 - RNA, 15 nt, Homo sapiens
guggcauuuucacuu

SEQ ID NO: 24179 - RNA, 13 nt, Homo sapiens
uaagcaacaucua

SEQ ID NO: 24180 - RNA, 17 nt, Homo sapiens
aaggcuuuaucucaggg

SEQ ID NO: 24181 - RNA, 21 nt, Homo sapiens
auagugucugaugaauguuaa

SEQ ID NO: 24182 - RNA, 19 nt, Homo sapiens
aggcaaggcuaugugauua

SEQ ID NO: 24183 - RNA, 17 nt, Homo sapiens
auuguugacaacuguga

SEQ ID NO: 24184 - RNA, 23 nt, Homo sapiens
ugagaaaccuuauuguaccucuc

SEQ ID NO: 24185 - RNA, 20 nt, Homo sapiens
acgugacuggccugcuggau

SEQ ID NO: 24186 - RNA, 13 nt, Homo sapiens
ugcagacaugaga

SEQ ID NO: 24187 - RNA, 23 nt, Homo sapiens
gccagugcuuuaauggcauguca

SEQ ID NO: 24188 - RNA, 17 nt, Homo sapiens
auggagguuaagcacuu

SEQ ID NO: 24189 - RNA, 16 nt, Homo sapiens
uaagcaaagacuauga

SEQ ID NO: 24190 - RNA, 15 nt, Homo sapiens
auguuucgcugauau

SEQ ID NO: 24191 - RNA, 18 nt, Homo sapiens
uggaucucacaagcacuu

SEQ ID NO: 24192 - RNA, 21 nt, Homo sapiens
acgccuguaaucccagcacuu

SEQ ID NO: 24193 - RNA, 14 nt, Homo sapiens
aacuggcaguuuuc

SEQ ID NO: 24194 - RNA, 21 nt, Homo sapiens
uacauauuucuuugccuuuau

SEQ ID NO: 24195 - RNA, 17 nt, Homo sapiens
uuccucaaaacuucaga

SEQ ID NO: 24196 - RNA, 20 nt, Homo sapiens
cagugagcugauaucaugcc

SEQ ID NO: 24197 - RNA, 19 nt, Homo sapiens
ccaaguuuauauacaauua

SEQ ID NO: 24198 - RNA, 18 nt, Homo sapiens
uuuuaugaaacauuacag

SEQ ID NO: 24199 - RNA, 23 nt, Homo sapiens
acuccagccugagcgacagugag

SEQ ID NO: 24200 - RNA, 14 nt, Homo sapiens
uauguggcuguauc

SEQ ID NO: 24201 - RNA, 14 nt, Homo sapiens
ggcauucucugaag

SEQ ID NO: 24202 - RNA, 18 nt, Homo sapiens
ccugaugaaaacauagca

SEQ ID NO: 24203 - RNA, 12 nt, Homo sapiens
cauguacaucca

SEQ ID NO: 24204 - RNA, 12 nt, Homo sapiens
acucauugcaac

SEQ ID NO: 24205 - RNA, 15 nt, Homo sapiens
gaauuaacacaugau

SEQ ID NO: 24206 - RNA, 20 nt, Homo sapiens
gagauggaaguugcagugag

SEQ ID NO: 24207 - RNA, 17 nt, Homo sapiens
aacuggcaguuuuccau

SEQ ID NO: 24208 - RNA, 16 nt, Homo sapiens
uuguuuuuaaacugga

SEQ ID NO: 24209 - RNA, 14 nt, Homo sapiens
gauagagugggaca

SEQ ID NO: 24210 - RNA, 14 nt, Homo sapiens
guggcgacucuaua

SEQ ID NO: 24211 - RNA, 14 nt, Homo sapiens
uccacuacugcuac

SEQ ID NO: 24212 - RNA, 23 nt, Homo sapiens
ucacauuggcuauuuaaagacaa

SEQ ID NO: 24213 - RNA, 22 nt, Homo sapiens
cugaggcaagagaauugcuuga

SEQ ID NO: 24214 - RNA, 15 nt, Homo sapiens
aguguaaguucacaa

SEQ ID NO: 24215 - RNA, 19 nt, Homo sapiens
acaaggcuuuaucucaggg

SEQ ID NO: 24216 - RNA, 20 nt, Homo sapiens
aaggcuuagacccucaugcu

SEQ ID NO: 24217 - RNA, 17 nt, Homo sapiens
ugauuacaaggcuuuau

SEQ ID NO: 24218 - RNA, 15 nt, Homo sapiens
uagaauuaauggaau

SEQ ID NO: 24219 - RNA, 22 nt, Homo sapiens
uucugugggagaauucuuacau

SEQ ID NO: 24220 - RNA, 13 nt, Homo sapiens
aauuuucuuccaa

SEQ ID NO: 24221 - RNA, 20 nt, Homo sapiens
acuaauagaauuaauggaau

SEQ ID NO: 24222 - RNA, 15 nt, Homo sapiens
agugagcugauauca

SEQ ID NO: 24223 - RNA, 12 nt, Homo sapiens
gaaaauaugccu

SEQ ID NO: 24224 - RNA, 13 nt, Homo sapiens
ugugacuuuccua

SEQ ID NO: 24225 - RNA, 17 nt, Homo sapiens
uagugucugaugaaugu

SEQ ID NO: 24226 - RNA, 20 nt, Homo sapiens
cuuguugagauccccguguu

SEQ ID NO: 24227 - RNA, 14 nt, Homo sapiens
acuaaaaaggcaug

SEQ ID NO: 24228 - RNA, 18 nt, Homo sapiens
guaucaaccaaauggagu

SEQ ID NO: 24229 - RNA, 14 nt, Homo sapiens
uggucacauacaau

SEQ ID NO: 24230 - RNA, 15 nt, Homo sapiens
ccuuuuuguuauuag

SEQ ID NO: 24231 - RNA, 23 nt, Homo sapiens
gaauaguguuggaaaaugugcaa

SEQ ID NO: 24232 - RNA, 19 nt, Homo sapiens
gagcauuuauaaauggaca

SEQ ID NO: 24233 - RNA, 19 nt, Homo sapiens
aaguuuaugcauacaguaa

SEQ ID NO: 24234 - RNA, 15 nt, Homo sapiens
cuggggccuguugaa

SEQ ID NO: 24235 - RNA, 23 nt, Homo sapiens
aucaauucuauuacgugcaauac

SEQ ID NO: 24236 - RNA, 14 nt, Homo sapiens
uauagacucuagga

SEQ ID NO: 24237 - RNA, 14 nt, Homo sapiens
auuucacuugauga

SEQ ID NO: 24238 - RNA, 11 nt, Homo sapiens
aaaagcacuua

SEQ ID NO: 24239 - RNA, 16 nt, Homo sapiens
guaaucccagcacuuu

SEQ ID NO: 24240 - RNA, 20 nt, Homo sapiens
aauuuaucuugucucugggc

SEQ ID NO: 24241 - RNA, 13 nt, Homo sapiens
gacaacugugacu

SEQ ID NO: 24242 - RNA, 14 nt, Homo sapiens
cuguuccuucacau

SEQ ID NO: 24243 - RNA, 19 nt, Homo sapiens
accaccacccuugccaugg

SEQ ID NO: 24244 - RNA, 15 nt, Homo sapiens
caguauccaguacuc

SEQ ID NO: 24245 - RNA, 16 nt, Homo sapiens
aggugacccugaugaa

SEQ ID NO: 24246 - RNA, 15 nt, Homo sapiens
agcaucucaggagau

SEQ ID NO: 24247 - RNA, 16 nt, Homo sapiens
ugcaccaacuuugaag

SEQ ID NO: 24248 - RNA, 23 nt, Homo sapiens
uaucucaggggccaacuaggcag

SEQ ID NO: 24249 - RNA, 19 nt, Homo sapiens
guuauuuagggaacugcuu

SEQ ID NO: 24250 - RNA, 15 nt, Homo sapiens
gacccaaaaggcaga

SEQ ID NO: 24251 - RNA, 23 nt, Homo sapiens
ucagaaauuuaauucauguuucu

SEQ ID NO: 24252 - RNA, 15 nt, Homo sapiens
uuuaauggcauguca

SEQ ID NO: 24253 - RNA, 14 nt, Homo sapiens
cagucacauuccaa

SEQ ID NO: 24254 - RNA, 21 nt, Homo sapiens
agacccucaugcugccaauau

SEQ ID NO: 24255 - RNA, 23 nt, Homo sapiens
ugauccugcaauuccacuuauag

SEQ ID NO: 24256 - RNA, 14 nt, Homo sapiens
uucccaaaacugau

SEQ ID NO: 24257 - RNA, 12 nt, Homo sapiens
uacauacugcug

SEQ ID NO: 24258 - RNA, 14 nt, Homo sapiens
uaauuacuauguca

SEQ ID NO: 24259 - RNA, 19 nt, Homo sapiens
aaauaguuuaugauuccac

SEQ ID NO: 24260 - RNA, 11 nt, Homo sapiens
caagaaugaga

SEQ ID NO: 24261 - RNA, 20 nt, Homo sapiens
auaauaugcacacagugcuu

SEQ ID NO: 24262 - RNA, 23 nt, Homo sapiens
guaaaauugaaaggcauucucug

SEQ ID NO: 24263 - RNA, 22 nt, Homo sapiens
aauucgcugcaaccuguugaua

SEQ ID NO: 24264 - RNA, 15 nt, Homo sapiens
cuauuacgugcaaua

SEQ ID NO: 24265 - RNA, 22 nt, Homo sapiens
aaaggccugucccugcagacau

SEQ ID NO: 24266 - RNA, 13 nt, Homo sapiens
uggccugcuggau

SEQ ID NO: 24267 - RNA, 20 nt, Homo sapiens
ucuuuuuuuuaauaaaccau

SEQ ID NO: 24268 - RNA, 17 nt, Homo sapiens
aaagcauuguaacuuau

SEQ ID NO: 24269 - RNA, 18 nt, Homo sapiens
aagcaacccaaauguuca

SEQ ID NO: 24270 - RNA, 15 nt, Homo sapiens
auuuuuaugugcaau

SEQ ID NO: 24271 - RNA, 22 nt, Homo sapiens
ccuggacaguuuucugcuuuaa

SEQ ID NO: 24272 - RNA, 24 nt, Homo sapiens
augcaaccuuuggaugcacuuuau

SEQ ID NO: 24273 - RNA, 17 nt, Homo sapiens
ugaaaaucuacacucca

SEQ ID NO: 24274 - RNA, 13 nt, Homo sapiens
uuuaugugcaaua

SEQ ID NO: 24275 - RNA, 21 nt, Homo sapiens
uccuguacuuuuuccagacac

SEQ ID NO: 24276 - RNA, 13 nt, Homo sapiens
augauacaaugaa

SEQ ID NO: 24277 - RNA, 19 nt, Homo sapiens
gccauaauuacuaugucau

SEQ ID NO: 24278 - RNA, 16 nt, Homo sapiens
guggcauuuucacuuu

SEQ ID NO: 24279 - RNA, 21 nt, Homo sapiens
ccaaaagguauuuuaaucacc

SEQ ID NO: 24280 - RNA, 14 nt, Homo sapiens
ucuauguggcugua

SEQ ID NO: 24281 - RNA, 15 nt, Homo sapiens
gucucaguccaugaa

SEQ ID NO: 24282 - RNA, 18 nt, Homo sapiens
ugcauugagaacugcaua

SEQ ID NO: 24283 - RNA, 13 nt, Homo sapiens
agguuaagcacuu

SEQ ID NO: 24284 - RNA, 18 nt, Homo sapiens
acuugaugauacaaugaa

SEQ ID NO: 24285 - RNA, 23 nt, Homo sapiens
uccaagccugaccacgcuuucua

SEQ ID NO: 24286 - RNA, 18 nt, Homo sapiens
gaaaagauuaugaucuca

SEQ ID NO: 24287 - RNA, 21 nt, Homo sapiens
augaaaacauagcaucucagg

SEQ ID NO: 24288 - RNA, 16 nt, Homo sapiens
acuauccaguuacugc

SEQ ID NO: 24289 - RNA, 9 nt, Homo sapiens
ugugcaaua

SEQ ID NO: 24290 - RNA, 16 nt, Homo sapiens
cuaaaguaucuguauu

SEQ ID NO: 24291 - RNA, 21 nt, Homo sapiens
aaccucauuccccaaccacuu

SEQ ID NO: 24292 - RNA, 16 nt, Homo sapiens
aagcagaacagugauu

SEQ ID NO: 24293 - RNA, 15 nt, Homo sapiens
cuugggcgggacaca

SEQ ID NO: 24294 - RNA, 17 nt, Homo sapiens
uagaauauuuauuaccu

SEQ ID NO: 24295 - RNA, 16 nt, Homo sapiens
ugaaacauuacaguua

SEQ ID NO: 24296 - RNA, 14 nt, Homo sapiens
aguggcauguauga

SEQ ID NO: 24297 - RNA, 14 nt, Homo sapiens
uggaaaaugugcaa

SEQ ID NO: 24298 - RNA, 21 nt, Homo sapiens
cuggauguggagggggcgcgu

SEQ ID NO: 24299 - RNA, 16 nt, Homo sapiens
acuuuuguguaaugaa

SEQ ID NO: 24300 - RNA, 14 nt, Homo sapiens
acuaauuaggcaag

SEQ ID NO: 24301 - RNA, 12 nt, Homo sapiens
cucauucaaaag

SEQ ID NO: 24302 - RNA, 13 nt, Homo sapiens
aucaaaagaaaga

SEQ ID NO: 24303 - RNA, 13 nt, Homo sapiens
ggaugauguuucg

SEQ ID NO: 24304 - RNA, 17 nt, Homo sapiens
uacugcuaccacaacua

SEQ ID NO: 24305 - RNA, 21 nt, Homo sapiens
cuugaaauagugucugaugaa

SEQ ID NO: 24306 - RNA, 21 nt, Homo sapiens
cauuucuauuuauuuacugag

SEQ ID NO: 24307 - RNA, 22 nt, Homo sapiens
acccucugggucucaguguccu

SEQ ID NO: 24308 - RNA, 17 nt, Homo sapiens
aaagcagggacuugaac

SEQ ID NO: 24309 - RNA, 16 nt, Homo sapiens
gccuugguauagcaua

SEQ ID NO: 24310 - RNA, 14 nt, Homo sapiens
caguccucuuucaa

SEQ ID NO: 24311 - RNA, 17 nt, Homo sapiens
caaguuguguuugauau

SEQ ID NO: 24312 - RNA, 12 nt, Homo sapiens
uuauaaucuuuu

SEQ ID NO: 24313 - RNA, 23 nt, Homo sapiens
cuuguuuuuccacuacugcuacc

SEQ ID NO: 24314 - RNA, 20 nt, Homo sapiens
acagcuacuugggaggcuga

SEQ ID NO: 24315 - RNA, 11 nt, Homo sapiens
uuaugugcaau

SEQ ID NO: 24316 - RNA, 17 nt, Homo sapiens
uguggcauuuucacuuu

SEQ ID NO: 24317 - RNA, 15 nt, Homo sapiens
agugacauguuuaca

SEQ ID NO: 24318 - RNA, 14 nt, Homo sapiens
aguugauuuuacaa

SEQ ID NO: 24319 - RNA, 22 nt, Homo sapiens
agcuugaaauagugucugauga

SEQ ID NO: 24320 - RNA, 22 nt, Homo sapiens
cucugaagaguggguuucacaa

SEQ ID NO: 24321 - RNA, 22 nt, Homo sapiens
auaacuaggcguggacuuacua

SEQ ID NO: 24322 - RNA, 17 nt, Homo sapiens
augugauauguaccuaa

SEQ ID NO: 24323 - RNA, 13 nt, Homo sapiens
uccacuacugcua

SEQ ID NO: 24324 - RNA, 21 nt, Homo sapiens
gagauugugccccugcacucc

SEQ ID NO: 24325 - RNA, 16 nt, Homo sapiens
agaguggguuucacaa

SEQ ID NO: 24326 - RNA, 17 nt, Homo sapiens
uuugcagcugugccaua

SEQ ID NO: 24327 - RNA, 20 nt, Homo sapiens
aaauauuuuuaugugcaaua

SEQ ID NO: 24328 - RNA, 19 nt, Homo sapiens
gaagcaacccaaauguuca

SEQ ID NO: 24329 - RNA, 16 nt, Homo sapiens
ggcauuuucacuuuug

SEQ ID NO: 24330 - RNA, 18 nt, Homo sapiens
uguuacugccuaucagca

SEQ ID NO: 24331 - RNA, 20 nt, Homo sapiens
uuaaaaucuaauucaaacua

SEQ ID NO: 24332 - RNA, 17 nt, Homo sapiens
gagauggguuugacaag

SEQ ID NO: 24333 - RNA, 13 nt, Homo sapiens
ccaagccugacca

SEQ ID NO: 24334 - RNA, 19 nt, Homo sapiens
ggcuaagcaaaaugugaua

SEQ ID NO: 24335 - RNA, 19 nt, Homo sapiens
gucacagaggaucugcuug

SEQ ID NO: 24336 - RNA, 13 nt, Homo sapiens
cuuuaucucaggg

SEQ ID NO: 24337 - RNA, 16 nt, Homo sapiens
uauuacgugcaauacu

SEQ ID NO: 24338 - RNA, 17 nt, Homo sapiens
aucuacacuccagugag

SEQ ID NO: 24339 - RNA, 21 nt, Homo sapiens
guauauaaauuuucccaaaac

SEQ ID NO: 24340 - RNA, 14 nt, Homo sapiens
gcaccaacuuugaa

SEQ ID NO: 24341 - RNA, 19 nt, Homo sapiens
uugaugauuaauucaccuu

SEQ ID NO: 24342 - RNA, 22 nt, Homo sapiens
ugcuggcuuaaaauguaauuaa

SEQ ID NO: 24343 - RNA, 22 nt, Homo sapiens
ggaauauuugcaagacauagaa

SEQ ID NO: 24344 - RNA, 17 nt, Homo sapiens
uagagaaauuugccaau

SEQ ID NO: 24345 - RNA, 15 nt, Homo sapiens
ucacuuaauccuuug

SEQ ID NO: 24346 - RNA, 18 nt, Homo sapiens
caacagaagcuuccauuc

SEQ ID NO: 24347 - RNA, 22 nt, Homo sapiens
auuacaaggcuuuaucucaggg

SEQ ID NO: 24348 - RNA, 15 nt, Homo sapiens
uauuuuuaugugcaa

SEQ ID NO: 24349 - RNA, 20 nt, Homo sapiens
cugucuggacuuuccagaga

SEQ ID NO: 24350 - RNA, 14 nt, Homo sapiens
ucaugcauuugcac

SEQ ID NO: 24351 - RNA, 12 nt, Homo sapiens
ugcaagacauag

SEQ ID NO: 24352 - RNA, 22 nt, Homo sapiens
auguugaaaaaguucugcagau

SEQ ID NO: 24353 - RNA, 14 nt, Homo sapiens
agacagaaagcaga

SEQ ID NO: 24354 - RNA, 16 nt, Homo sapiens
uauugagcaccugcag

SEQ ID NO: 24355 - RNA, 15 nt, Homo sapiens
uuccauuccaagccu

SEQ ID NO: 24356 - RNA, 20 nt, Homo sapiens
aagcaacaucuagcaaaugu

SEQ ID NO: 24357 - RNA, 16 nt, Homo sapiens
accuaaauuugguucu

SEQ ID NO: 24358 - RNA, 19 nt, Homo sapiens
cugcaaucugagccagugc

SEQ ID NO: 24359 - RNA, 17 nt, Homo sapiens
gccagacaucaacagau

SEQ ID NO: 24360 - RNA, 18 nt, Homo sapiens
ugaaagcagggacuugaa

SEQ ID NO: 24361 - RNA, 19 nt, Homo sapiens
uacauuuccaaauucacaa

SEQ ID NO: 24362 - RNA, 17 nt, Homo sapiens
uaacuuaugaaccuuua

SEQ ID NO: 24363 - RNA, 15 nt, Homo sapiens
caaucuuaacucauu

SEQ ID NO: 24364 - RNA, 14 nt, Homo sapiens
aaacauagcaucuc

SEQ ID NO: 24365 - RNA, 14 nt, Homo sapiens
ccucuguugccaag

SEQ ID NO: 24366 - RNA, 22 nt, Homo sapiens
aagucagugcccaacuguuaua

SEQ ID NO: 24367 - RNA, 16 nt, Homo sapiens
uuaugcauaaagucag

SEQ ID NO: 24368 - RNA, 15 nt, Homo sapiens
uuuagggaccugcug

SEQ ID NO: 24369 - RNA, 18 nt, Homo sapiens
cugaaagaggaaugaagu

SEQ ID NO: 24370 - RNA, 17 nt, Homo sapiens
uuuauuauuuucaccug

SEQ ID NO: 24371 - RNA, 13 nt, Homo sapiens
cuaugugauuaca

SEQ ID NO: 24372 - RNA, 13 nt, Homo sapiens
auuauuuuuacag

SEQ ID NO: 24373 - RNA, 19 nt, Homo sapiens
aaucaccaaggcugauuaa

SEQ ID NO: 24374 - RNA, 17 nt, Homo sapiens
caagugauccgcccauc

SEQ ID NO: 24375 - RNA, 21 nt, Homo sapiens
aauuacaggcgugagccacca

SEQ ID NO: 24376 - RNA, 19 nt, Homo sapiens
gcuuguuagcaaaauggau

SEQ ID NO: 24377 - RNA, 23 nt, Homo sapiens
acuaauuaggcaaggcuauguga

SEQ ID NO: 24378 - RNA, 20 nt, Homo sapiens
acauagaauuaacacaugau

SEQ ID NO: 24379 - RNA, 12 nt, Homo sapiens
gauagcaaguga

SEQ ID NO: 24380 - RNA, 13 nt, Homo sapiens
acagaacuaugga

SEQ ID NO: 24381 - RNA, 12 nt, Homo sapiens
aaguauccuuca

SEQ ID NO: 24382 - RNA, 15 nt, Homo sapiens
augguuccauucucu

SEQ ID NO: 24383 - RNA, 18 nt, Homo sapiens
auuuuauuacaucuuuca

SEQ ID NO: 24384 - RNA, 17 nt, Homo sapiens
aaaucaaauuccagaau

SEQ ID NO: 24385 - RNA, 18 nt, Homo sapiens
cucugucucaguccauga

SEQ ID NO: 24386 - RNA, 20 nt, Homo sapiens
caaccaaauggagugacuua

SEQ ID NO: 24387 - RNA, 21 nt, Homo sapiens
gugguuauuuagggaacugcu

SEQ ID NO: 24388 - RNA, 13 nt, Homo sapiens
uccugugacuguc

SEQ ID NO: 24389 - RNA, 22 nt, Homo sapiens
gaccuggucgucgucuugacuu

SEQ ID NO: 24390 - RNA, 14 nt, Homo sapiens
auauccugugacug

SEQ ID NO: 24391 - RNA, 13 nt, Homo sapiens
cagggacuugaac

SEQ ID NO: 24392 - RNA, 13 nt, Homo sapiens
ggcgacaguuuuc

SEQ ID NO: 24393 - RNA, 21 nt, Homo sapiens
aauggcuaagcaaaaugugau

SEQ ID NO: 24394 - RNA, 13 nt, Homo sapiens
uauuuuaaucacc

SEQ ID NO: 24395 - RNA, 23 nt, Homo sapiens
ugaaaaucuacacuccagugaga

SEQ ID NO: 24396 - RNA, 20 nt, Homo sapiens
acauuguuugucugucuuca

SEQ ID NO: 24397 - RNA, 18 nt, Homo sapiens
auuuauugagcaccugca

SEQ ID NO: 24398 - RNA, 15 nt, Homo sapiens
uuuccacuacugcua

SEQ ID NO: 24399 - RNA, 22 nt, Homo sapiens
cuguacuccagccugggugaca

SEQ ID NO: 24400 - RNA, 15 nt, Homo sapiens
agugaaaaacaucca

SEQ ID NO: 24401 - RNA, 16 nt, Homo sapiens
cuuaaagaauuuucaa

SEQ ID NO: 24402 - RNA, 22 nt, Homo sapiens
agaaauuccaggaaaaucugca

SEQ ID NO: 24403 - RNA, 18 nt, Homo sapiens
ucaucuuggucacauaca

SEQ ID NO: 24404 - RNA, 16 nt, Homo sapiens
uuuuacauacugcugu

SEQ ID NO: 24405 - RNA, 19 nt, Homo sapiens
ccuggucaacauggugaaa

SEQ ID NO: 24406 - RNA, 22 nt, Homo sapiens
ccuggcugggaguggcauguau

SEQ ID NO: 24407 - RNA, 17 nt, Homo sapiens
aguuuauauacaauuau

SEQ ID NO: 24408 - RNA, 15 nt, Homo sapiens
acgaaaaacauuuca

SEQ ID NO: 24409 - RNA, 13 nt, Homo sapiens
ccugcagacauga

SEQ ID NO: 24410 - RNA, 19 nt, Homo sapiens
cauuugcuggagcucugcc

SEQ ID NO: 24411 - RNA, 19 nt, Homo sapiens
gaggcggguggaucacuug

SEQ ID NO: 24412 - RNA, 13 nt, Homo sapiens
agauguagaggag

SEQ ID NO: 24413 - RNA, 21 nt, Homo sapiens
ccacaacuauauuaucaugca

SEQ ID NO: 24414 - RNA, 16 nt, Homo sapiens
ggacacaggcuccaaa

SEQ ID NO: 24415 - RNA, 15 nt, Homo sapiens
gcuuaaaauguaauu

SEQ ID NO: 24416 - RNA, 21 nt, Homo sapiens
aauuuucaaaaucaaauucca

SEQ ID NO: 24417 - RNA, 20 nt, Homo sapiens
uuugaugauuaauucaccuu

SEQ ID NO: 24418 - RNA, 18 nt, Homo sapiens
cuggcuuaaaauguaauu

SEQ ID NO: 24419 - RNA, 21 nt, Homo sapiens
gacagaaagcagaacagugau

SEQ ID NO: 24420 - RNA, 17 nt, Homo sapiens
auucugcaagcuuuuca

SEQ ID NO: 24421 - RNA, 20 nt, Homo sapiens
aguguuggaaaaugugcaau

SEQ ID NO: 24422 - RNA, 22 nt, Homo sapiens
guuaccaguaacggaacaguau

SEQ ID NO: 24423 - RNA, 20 nt, Homo sapiens
accacugcagaagacaguau

SEQ ID NO: 24424 - RNA, 18 nt, Homo sapiens
auuacaggcgugagccac

SEQ ID NO: 24425 - RNA, 18 nt, Homo sapiens
uguuggaaaaugugcaau

SEQ ID NO: 24426 - RNA, 22 nt, Homo sapiens
cugccuaagugcagccccgugg

SEQ ID NO: 24427 - RNA, 14 nt, Homo sapiens
ugagaacugcauau

SEQ ID NO: 24428 - RNA, 20 nt, Homo sapiens
guucuucuuggucucagugu

SEQ ID NO: 24429 - RNA, 11 nt, Homo sapiens
uuuacuuuguu

SEQ ID NO: 24430 - RNA, 16 nt, Homo sapiens
ggagaaucacuugaac

SEQ ID NO: 24431 - RNA, 17 nt, Homo sapiens
aauauuuauuaccucug

SEQ ID NO: 24432 - RNA, 15 nt, Homo sapiens
cuuuuauugccauga

SEQ ID NO: 24433 - RNA, 17 nt, Homo sapiens
gcagaagcaacccaaau

SEQ ID NO: 24434 - RNA, 14 nt, Homo sapiens
ggcuggagugcagu

SEQ ID NO: 24435 - RNA, 12 nt, Homo sapiens
accacauggcuu

SEQ ID NO: 24436 - RNA, 17 nt, Homo sapiens
aaagcuaaaguaucugu

SEQ ID NO: 24437 - RNA, 12 nt, Homo sapiens
acaacugugacu

SEQ ID NO: 24438 - RNA, 19 nt, Homo sapiens
ggacuugggcgggacacag

SEQ ID NO: 24439 - RNA, 12 nt, Homo sapiens
aauucauguuuc

SEQ ID NO: 24440 - RNA, 15 nt, Homo sapiens
uugaacccaggagau

SEQ ID NO: 24441 - RNA, 20 nt, Homo sapiens
ccucaucuguaaaauggaga

SEQ ID NO: 24442 - RNA, 17 nt, Homo sapiens
guaaaguacagacuuuu

SEQ ID NO: 24443 - RNA, 15 nt, Homo sapiens
uuaaagaauuuucaa

SEQ ID NO: 24444 - RNA, 13 nt, Homo sapiens
cauacauguuaca

SEQ ID NO: 24445 - RNA, 16 nt, Homo sapiens
gugacuuaguguacau

SEQ ID NO: 24446 - RNA, 22 nt, Homo sapiens
ugagacagcucugcauacucau

SEQ ID NO: 24447 - RNA, 14 nt, Homo sapiens
cuaugugauuacaa

SEQ ID NO: 24448 - RNA, 16 nt, Homo sapiens
auaguguuggaaaaug

SEQ ID NO: 24449 - RNA, 17 nt, Homo sapiens
caguggcgcaaucuuaa

SEQ ID NO: 24450 - RNA, 23 nt, Homo sapiens
acaccauuccuucugcccugcuu

SEQ ID NO: 24451 - RNA, 13 nt, Homo sapiens
uagggaccugcug

SEQ ID NO: 24452 - RNA, 22 nt, Homo sapiens
aauagaaggauguacauuucca

SEQ ID NO: 24453 - RNA, 22 nt, Homo sapiens
uugggaggcugaggcaagagaa

SEQ ID NO: 24454 - RNA, 19 nt, Homo sapiens
auauuuuuaugugcaauaa

SEQ ID NO: 24455 - RNA, 11 nt, Homo sapiens
acuuuuuccag

SEQ ID NO: 24456 - RNA, 20 nt, Homo sapiens
agcuacuugggaggcugaga

SEQ ID NO: 24457 - RNA, 18 nt, Homo sapiens
cacaggcuccaaacugga

SEQ ID NO: 24458 - RNA, 21 nt, Homo sapiens
cucugcccauccugccccuga

SEQ ID NO: 24459 - RNA, 19 nt, Homo sapiens
uucucuggcgacaguuuuc

SEQ ID NO: 24460 - RNA, 23 nt, Homo sapiens
acagaagagugacauguuuacaa

SEQ ID NO: 24461 - RNA, 23 nt, Homo sapiens
uuaaguguaacuggcaguuuucc

SEQ ID NO: 24462 - RNA, 20 nt, Homo sapiens
gccuguugaagaugcuugua

SEQ ID NO: 24463 - RNA, 17 nt, Homo sapiens
auuguaacuuaugaacc

SEQ ID NO: 24464 - RNA, 15 nt, Homo sapiens
cuuaugaaacuaaga

SEQ ID NO: 24465 - RNA, 16 nt, Homo sapiens
ugauucccuccugcua

SEQ ID NO: 24466 - RNA, 15 nt, Homo sapiens
ccuaaccucauuccc

SEQ ID NO: 24467 - RNA, 22 nt, Homo sapiens
aagauguagaggagaaacugga

SEQ ID NO: 24468 - RNA, 12 nt, Homo sapiens
aaauuggacuua

SEQ ID NO: 24469 - RNA, 13 nt, Homo sapiens
cugauuaaaccaa

SEQ ID NO: 24470 - RNA, 14 nt, Homo sapiens
agcagggacuugaa

SEQ ID NO: 24471 - RNA, 13 nt, Homo sapiens
uaauuucagaaga

SEQ ID NO: 24472 - RNA, 20 nt, Homo sapiens
caccagagauaauaugagaa

SEQ ID NO: 24473 - RNA, 13 nt, Homo sapiens
aaucugagccagu

SEQ ID NO: 24474 - RNA, 15 nt, Homo sapiens
aaaaugugcaauaug

SEQ ID NO: 24475 - RNA, 18 nt, Homo sapiens
caguuccugagaccagcc

SEQ ID NO: 24476 - RNA, 14 nt, Homo sapiens
acuuuaacacagug

SEQ ID NO: 24477 - RNA, 19 nt, Homo sapiens
uuaucaugcaaaugcugua

SEQ ID NO: 24478 - RNA, 18 nt, Homo sapiens
ugggagaaucacuugaac

SEQ ID NO: 24479 - RNA, 12 nt, Homo sapiens
caaauuccagaa

SEQ ID NO: 24480 - RNA, 18 nt, Homo sapiens
auaaacaguagugauagu

SEQ ID NO: 24481 - RNA, 21 nt, Homo sapiens
cagaacuugaaugugucaggu

SEQ ID NO: 24482 - RNA, 15 nt, Homo sapiens
ugcagauaaacagua

SEQ ID NO: 24483 - RNA, 17 nt, Homo sapiens
accuuauuguaccucuc

SEQ ID NO: 24484 - RNA, 17 nt, Homo sapiens
uucaaaauuggacuuaa

SEQ ID NO: 24485 - RNA, 20 nt, Homo sapiens
agugaacaaauuuacagaga

SEQ ID NO: 24486 - RNA, 14 nt, Homo sapiens
gaaagggucucccu

SEQ ID NO: 24487 - RNA, 12 nt, Homo sapiens
caguaacugaca

SEQ ID NO: 24488 - RNA, 14 nt, Homo sapiens
auuacaucuuucac

SEQ ID NO: 24489 - RNA, 13 nt, Homo sapiens
guaaaauugaaag

SEQ ID NO: 24490 - RNA, 14 nt, Homo sapiens
cacaaaauugggaa

SEQ ID NO: 24491 - RNA, 14 nt, Homo sapiens
ggacuugggcggga

SEQ ID NO: 24492 - RNA, 20 nt, Homo sapiens
gaaaacauagcaucucagga

SEQ ID NO: 24493 - RNA, 13 nt, Homo sapiens
gaauuaauggaau

SEQ ID NO: 24494 - RNA, 19 nt, Homo sapiens
augguuccauucucucucc

SEQ ID NO: 24495 - RNA, 17 nt, Homo sapiens
aacauagcaucucagga

SEQ ID NO: 24496 - RNA, 18 nt, Homo sapiens
ugacuuaguguacaugaa

SEQ ID NO: 24497 - RNA, 16 nt, Homo sapiens
ucuauuacgugcaaua

SEQ ID NO: 24498 - RNA, 18 nt, Homo sapiens
auaaaguguaaguucaca

SEQ ID NO: 24499 - RNA, 16 nt, Homo sapiens
auucccuccugcuacu

SEQ ID NO: 24500 - RNA, 20 nt, Homo sapiens
aauauuuauuaccucugaua

SEQ ID NO: 24501 - RNA, 16 nt, Homo sapiens
aaauggaaaguaacuc

SEQ ID NO: 24502 - RNA, 18 nt, Homo sapiens
gcccuucauguacaucca

SEQ ID NO: 24503 - RNA, 20 nt, Homo sapiens
gccaaggcuggagugcagug

SEQ ID NO: 24504 - RNA, 21 nt, Homo sapiens
gcuacucuguuccuucacauc

SEQ ID NO: 24505 - RNA, 11 nt, Homo sapiens
ucucagugucc

SEQ ID NO: 24506 - RNA, 17 nt, Homo sapiens
aguacucauacauguua

SEQ ID NO: 24507 - RNA, 21 nt, Homo sapiens
agaggaaugaaguacucauac

SEQ ID NO: 24508 - RNA, 23 nt, Homo sapiens
aaaaggccugucccugcagacau

SEQ ID NO: 24509 - RNA, 14 nt, Homo sapiens
aauugacacuuaaa

SEQ ID NO: 24510 - RNA, 12 nt, Homo sapiens
aggcauguaauu

SEQ ID NO: 24511 - RNA, 20 nt, Homo sapiens
cgaguggcccuucauguaca

SEQ ID NO: 24512 - RNA, 13 nt, Homo sapiens
aagaaauucugca

SEQ ID NO: 24513 - RNA, 20 nt, Homo sapiens
aaaugggcuacuuuguccuu

SEQ ID NO: 24514 - RNA, 15 nt, Homo sapiens
acaucaacagauaaa

SEQ ID NO: 24515 - RNA, 19 nt, Homo sapiens
aaauugaaaggcauucucu

SEQ ID NO: 24516 - RNA, 20 nt, Homo sapiens
aggccgggcgcgguggcuca

SEQ ID NO: 24517 - RNA, 17 nt, Homo sapiens
cugaagggcaucaugca

SEQ ID NO: 24518 - RNA, 13 nt, Homo sapiens
ucaguuacucuga

SEQ ID NO: 24519 - RNA, 11 nt, Homo sapiens
acauacugcug

SEQ ID NO: 24520 - RNA, 14 nt, Homo sapiens
acaucuuucacauu

SEQ ID NO: 24521 - RNA, 23 nt, Homo sapiens
cuugccauggagguuaagcacuu

SEQ ID NO: 24522 - RNA, 15 nt, Homo sapiens
auuugcaagacauag

SEQ ID NO: 24523 - RNA, 17 nt, Homo sapiens
aaauaagccagacauca

SEQ ID NO: 24524 - RNA, 19 nt, Homo sapiens
ucccucuaauuuaucuugu

SEQ ID NO: 24525 - RNA, 17 nt, Homo sapiens
aaagacuaugaggaaua

SEQ ID NO: 24526 - RNA, 15 nt, Homo sapiens
cagaaauuguaucuu

SEQ ID NO: 24527 - RNA, 14 nt, Homo sapiens
aauauuguugacaa

SEQ ID NO: 24528 - RNA, 20 nt, Homo sapiens
uuugcugccucuaaaaggcc

SEQ ID NO: 24529 - RNA, 23 nt, Homo sapiens
uaaaauauuuuuaugugcaauaa

SEQ ID NO: 24530 - RNA, 14 nt, Homo sapiens
uuguaaaauggugu

SEQ ID NO: 24531 - RNA, 17 nt, Homo sapiens
gagggggcgcgugcagg

SEQ ID NO: 24532 - RNA, 20 nt, Homo sapiens
ugaggacuugggcgggacac

SEQ ID NO: 24533 - RNA, 17 nt, Homo sapiens
acacaggcuccaaacug

SEQ ID NO: 24534 - RNA, 21 nt, Homo sapiens
uuaucaugcaaaugcuguauu

SEQ ID NO: 24535 - RNA, 18 nt, Homo sapiens
uuacagagaaaagacaua

SEQ ID NO: 24536 - RNA, 13 nt, Homo sapiens
cacugcauacaau

SEQ ID NO: 24537 - RNA, 19 nt, Homo sapiens
gagaacugcauauguuucg

SEQ ID NO: 24538 - RNA, 17 nt, Homo sapiens
auuuauuuuuuuacuuc

SEQ ID NO: 24539 - RNA, 19 nt, Homo sapiens
guuuucugcuuuaauuuca

SEQ ID NO: 24540 - RNA, 10 nt, Homo sapiens
augacuaugc

SEQ ID NO: 24541 - RNA, 15 nt, Homo sapiens
uaucuuaguugguau

SEQ ID NO: 24542 - RNA, 20 nt, Homo sapiens
auauaauaugcacacagugc

SEQ ID NO: 24543 - RNA, 22 nt, Homo sapiens
ugugauauguaccuaacgaagu

SEQ ID NO: 24544 - RNA, 18 nt, Homo sapiens
gaguuaggcuauucacaa

SEQ ID NO: 24545 - RNA, 20 nt, Homo sapiens
gcuggucucgaacugcugga

SEQ ID NO: 24546 - RNA, 20 nt, Homo sapiens
gaaaaucuacacuccaguga

SEQ ID NO: 24547 - RNA, 18 nt, Homo sapiens
gaaagcagggacuugaac

SEQ ID NO: 24548 - RNA, 23 nt, Homo sapiens
gagaaaccagggagccccuuuga

SEQ ID NO: 24549 - RNA, 13 nt, Homo sapiens
uuuacuuccucag

SEQ ID NO: 24550 - RNA, 15 nt, Homo sapiens
guuuuuaagcuguuu

SEQ ID NO: 24551 - RNA, 19 nt, Homo sapiens
ucccagcgagggacaccga

SEQ ID NO: 24552 - RNA, 16 nt, Homo sapiens
uagagugggacaguuc

SEQ ID NO: 24553 - RNA, 14 nt, Homo sapiens
ccucaugcugccaa

SEQ ID NO: 24554 - RNA, 16 nt, Homo sapiens
cacagucacauuccaa

SEQ ID NO: 24555 - RNA, 23 nt, Homo sapiens
aaugugucaggugacccugauga

SEQ ID NO: 24556 - RNA, 16 nt, Homo sapiens
uucacuuauugacuau

SEQ ID NO: 24557 - RNA, 18 nt, Homo sapiens
agcaggauagagugggac

SEQ ID NO: 24558 - RNA, 16 nt, Homo sapiens
gcuuuaauuucaugaa

SEQ ID NO: 24559 - RNA, 21 nt, Homo sapiens
caucacagcugaacuuguuga

SEQ ID NO: 24560 - RNA, 23 nt, Homo sapiens
cuccuggcuggggccuguugaag

SEQ ID NO: 24561 - RNA, 16 nt, Homo sapiens
uaggaacgguaaauuu

SEQ ID NO: 24562 - RNA, 23 nt, Homo sapiens
uacauuguuugucugucuucaua

SEQ ID NO: 24563 - RNA, 18 nt, Homo sapiens
ccaaaaucggaucugggg

SEQ ID NO: 24564 - RNA, 15 nt, Homo sapiens
uaauucaaacuaaua

SEQ ID NO: 24565 - RNA, 16 nt, Homo sapiens
ccaaauuuguauuuaa

SEQ ID NO: 24566 - RNA, 23 nt, Homo sapiens
ugucuuacagagaaaagacauaa

SEQ ID NO: 24567 - RNA, 23 nt, Homo sapiens
uaguguuggaaaaugugcaauau

SEQ ID NO: 24568 - RNA, 16 nt, Homo sapiens
aacccggccugauuaa

SEQ ID NO: 24569 - RNA, 20 nt, Homo sapiens
cucaggggccaacuaggcag

SEQ ID NO: 24570 - RNA, 20 nt, Homo sapiens
agaaaccuuauuguaccucu

SEQ ID NO: 24571 - RNA, 19 nt, Homo sapiens
guaauuuuaaguaauuuca

SEQ ID NO: 24572 - RNA, 23 nt, Homo sapiens
gauuucaugccuggugcuuccaa

SEQ ID NO: 24573 - RNA, 14 nt, Homo sapiens
uauuacgugcaaua

SEQ ID NO: 24574 - RNA, 12 nt, Homo sapiens
cacuugaacccg

SEQ ID NO: 24575 - RNA, 21 nt, Homo sapiens
uguuuucugacuaauuaggca

SEQ ID NO: 24576 - RNA, 19 nt, Homo sapiens
aaugacuaaaaaacaaaga

SEQ ID NO: 24577 - RNA, 18 nt, Homo sapiens
augaaaagauuaugaucu

SEQ ID NO: 24578 - RNA, 13 nt, Homo sapiens
uuugcaagacaua

SEQ ID NO: 24579 - RNA, 21 nt, Homo sapiens
uuauagaauauuuauuaccuc

SEQ ID NO: 24580 - RNA, 23 nt, Homo sapiens
aauauguaaauagaaacguguau

SEQ ID NO: 24581 - RNA, 23 nt, Homo sapiens
uaaugaaaaugaauaucuauuaa

SEQ ID NO: 24582 - RNA, 16 nt, Homo sapiens
gaagucuuccauagag

SEQ ID NO: 24583 - RNA, 21 nt, Homo sapiens
uggacaguuuucugcuuuaau

SEQ ID NO: 24584 - RNA, 21 nt, Homo sapiens
caauagaaggauguacauuuc

SEQ ID NO: 24585 - RNA, 15 nt, Homo sapiens
uagaagcaucacagg

SEQ ID NO: 24586 - RNA, 18 nt, Homo sapiens
ugagacagcucugcauac

SEQ ID NO: 24587 - RNA, 17 nt, Homo sapiens
uguagccacuucacuuu

SEQ ID NO: 24588 - RNA, 17 nt, Homo sapiens
cuaaaucaauucuauua

SEQ ID NO: 24589 - RNA, 18 nt, Homo sapiens
auaucuaauauauaugaa

SEQ ID NO: 24590 - RNA, 13 nt, Homo sapiens
agaauggaacuca

SEQ ID NO: 24591 - RNA, 22 nt, Homo sapiens
cugcaagcuuuucaaaauugga

SEQ ID NO: 24592 - RNA, 16 nt, Homo sapiens
auacauucugcuuuca

SEQ ID NO: 24593 - RNA, 20 nt, Homo sapiens
uacaaggcuuuaucucaggg

SEQ ID NO: 24594 - RNA, 13 nt, Homo sapiens
cacuggcucccug

SEQ ID NO: 24595 - RNA, 14 nt, Homo sapiens
gaaauagugucuga

SEQ ID NO: 24596 - RNA, 16 nt, Homo sapiens
caaauguuaugcauaa

SEQ ID NO: 24597 - RNA, 20 nt, Homo sapiens
ggaauauuugcaagacauag

SEQ ID NO: 24598 - RNA, 19 nt, Homo sapiens
uuccuucucaucugugauu

SEQ ID NO: 24599 - RNA, 21 nt, Homo sapiens
auucgcugcaaccuguugaua

SEQ ID NO: 24600 - RNA, 23 nt, Homo sapiens
uauaaauuuucccaaaacugaua

SEQ ID NO: 24601 - RNA, 20 nt, Homo sapiens
ggcuggagugcaguggcgca

SEQ ID NO: 24602 - RNA, 16 nt, Homo sapiens
uuguuggauaaaucag

SEQ ID NO: 24603 - RNA, 18 nt, Homo sapiens
auuuuaaguaauuucaga

SEQ ID NO: 24604 - RNA, 20 nt, Homo sapiens
aggagauggaaguugcagug

SEQ ID NO: 24605 - RNA, 21 nt, Homo sapiens
guuucgugaaguauacuguau

SEQ ID NO: 24606 - RNA, 17 nt, Homo sapiens
aaugaaugaauggcuaa

SEQ ID NO: 24607 - RNA, 23 nt, Homo sapiens
agacauagaauuaacacaugauc

SEQ ID NO: 24608 - RNA, 15 nt, Homo sapiens
cagaaauuuaauuca

SEQ ID NO: 24609 - RNA, 17 nt, Homo sapiens
uaccucugauaccucaa

SEQ ID NO: 24610 - RNA, 13 nt, Homo sapiens
cugaauacauucu

SEQ ID NO: 24611 - RNA, 15 nt, Homo sapiens
auaguuguaccgcaa

SEQ ID NO: 24612 - RNA, 19 nt, Homo sapiens
ugucuggcacuugggacaa

SEQ ID NO: 24613 - RNA, 16 nt, Homo sapiens
uguacaccaauauuca

SEQ ID NO: 24614 - RNA, 14 nt, Homo sapiens
auuugcaagacaua

SEQ ID NO: 24615 - RNA, 14 nt, Homo sapiens
uuauuguaccucuc

SEQ ID NO: 24616 - RNA, 14 nt, Homo sapiens
aaauaaaagcacuu

SEQ ID NO: 24617 - RNA, 19 nt, Homo sapiens
accagagauaauaugagaa

SEQ ID NO: 24618 - RNA, 20 nt, Homo sapiens
aggcggguggaucacuugag

SEQ ID NO: 24619 - RNA, 17 nt, Homo sapiens
agauagguuaccaguaa

SEQ ID NO: 24620 - RNA, 18 nt, Homo sapiens
gcccccauuguggucaca

SEQ ID NO: 24621 - RNA, 20 nt, Homo sapiens
ccuccaccuucuggguucaa

SEQ ID NO: 24622 - RNA, 16 nt, Homo sapiens
auucucucuccuguac

SEQ ID NO: 24623 - RNA, 18 nt, Homo sapiens
agcaaauguuaugcauaa

SEQ ID NO: 24624 - RNA, 12 nt, Homo sapiens
cacagugucugg

SEQ ID NO: 24625 - RNA, 14 nt, Homo sapiens
agcuguuuccauag

SEQ ID NO: 24626 - RNA, 16 nt, Homo sapiens
uauuacaucuuucaca

SEQ ID NO: 24627 - RNA, 17 nt, Homo sapiens
auggcagcuuuccucaa

SEQ ID NO: 24628 - RNA, 20 nt, Homo sapiens
aucaugccccuguacuccag

SEQ ID NO: 24629 - RNA, 17 nt, Homo sapiens
aaacauagcaucucagg

SEQ ID NO: 24630 - RNA, 19 nt, Homo sapiens
ugacacuagcuaauaucaa

SEQ ID NO: 24631 - RNA, 17 nt, Homo sapiens
gaacugcauauguuucg

SEQ ID NO: 24632 - RNA, 15 nt, Homo sapiens
uaaacaguagugaua

SEQ ID NO: 24633 - RNA, 15 nt, Homo sapiens
cccauuucuauuuau

SEQ ID NO: 24634 - RNA, 13 nt, Homo sapiens
accaaauuuguau

SEQ ID NO: 24635 - RNA, 23 nt, Homo sapiens
aguguccucaucuguaaaaugga

SEQ ID NO: 24636 - RNA, 14 nt, Homo sapiens
aucuuacugaaggu

SEQ ID NO: 24637 - RNA, 21 nt, Homo sapiens
uaaaauggagacaccaccacc

SEQ ID NO: 24638 - RNA, 22 nt, Homo sapiens
uuuccuagcgcagccaugugau

SEQ ID NO: 24639 - RNA, 22 nt, Homo sapiens
ugagaugggagaaucacuugaa

SEQ ID NO: 24640 - RNA, 21 nt, Homo sapiens
aaacuaccagcccuacaccau

SEQ ID NO: 24641 - RNA, 14 nt, Homo sapiens
cuuauuguaccucu

SEQ ID NO: 24642 - RNA, 13 nt, Homo sapiens
uauuuauuuacug

SEQ ID NO: 24643 - RNA, 21 nt, Homo sapiens
agacaccaccacccuugccau

SEQ ID NO: 24644 - RNA, 14 nt, Homo sapiens
aaaaugaauaucua

SEQ ID NO: 24645 - RNA, 19 nt, Homo sapiens
gcauguaugacgugacugg

SEQ ID NO: 24646 - RNA, 23 nt, Homo sapiens
cuacucuguuccuucacauccug

SEQ ID NO: 24647 - RNA, 21 nt, Homo sapiens
uucaugaaaagauuaugaucu

SEQ ID NO: 24648 - RNA, 21 nt, Homo sapiens
ucaauuuaaaaaaaaaccuga

SEQ ID NO: 24649 - RNA, 14 nt, Homo sapiens
acagucacauucca

SEQ ID NO: 24650 - RNA, 16 nt, Homo sapiens
auaaacucagaaauuu

SEQ ID NO: 24651 - RNA, 18 nt, Homo sapiens
ugguccgaagucuuccau

SEQ ID NO: 24652 - RNA, 21 nt, Homo sapiens
gacaccaccacccuugccaug

SEQ ID NO: 24653 - RNA, 13 nt, Homo sapiens
augcauacaguaa

SEQ ID NO: 24654 - RNA, 15 nt, Homo sapiens
uaucaauaucuaaua

SEQ ID NO: 24655 - RNA, 16 nt, Homo sapiens
cacugugggcuuuuau

SEQ ID NO: 24656 - RNA, 21 nt, Homo sapiens
uccuagcgcagccaugugauu

SEQ ID NO: 24657 - RNA, 17 nt, Homo sapiens
uaaacaaaggaauuaug

SEQ ID NO: 24658 - RNA, 11 nt, Homo sapiens
uaaaagcacuu

SEQ ID NO: 24659 - RNA, 18 nt, Homo sapiens
uuguacaccaauauucau

SEQ ID NO: 24660 - RNA, 18 nt, Homo sapiens
uaaauaguuuaugauucc

SEQ ID NO: 24661 - RNA, 17 nt, Homo sapiens
gaaaauaaaagcacuua

SEQ ID NO: 24662 - RNA, 17 nt, Homo sapiens
uucuauuacgugcaaua

SEQ ID NO: 24663 - RNA, 15 nt, Homo sapiens
uuauuaccucugaua

SEQ ID NO: 24664 - RNA, 19 nt, Homo sapiens
acacuaaaaaggcauguaa

SEQ ID NO: 24665 - RNA, 15 nt, Homo sapiens
gccacuucacuuuuu

SEQ ID NO: 24666 - RNA, 15 nt, Homo sapiens
aucucacaagcacuu

SEQ ID NO: 24667 - RNA, 23 nt, Homo sapiens
cuaucagcauuuuacuacuuuaa

SEQ ID NO: 24668 - RNA, 20 nt, Homo sapiens
cugcagaagacaguauggca

SEQ ID NO: 24669 - RNA, 16 nt, Homo sapiens
cagcccaagggugggu

SEQ ID NO: 24670 - RNA, 16 nt, Homo sapiens
uuggaugcacuuuaua

SEQ ID NO: 24671 - RNA, 15 nt, Homo sapiens
agcagaacagugauu

SEQ ID NO: 24672 - RNA, 18 nt, Homo sapiens
caggauagagugggacag

SEQ ID NO: 24673 - RNA, 19 nt, Homo sapiens
cuguuuccauagggugaca

SEQ ID NO: 24674 - RNA, 19 nt, Homo sapiens
gaaaaaguucugcagauaa

SEQ ID NO: 24675 - RNA, 19 nt, Homo sapiens
uaguuguaccgcaauguga

SEQ ID NO: 24676 - RNA, 17 nt, Homo sapiens
uccaaauauuguugaca

SEQ ID NO: 24677 - RNA, 20 nt, Homo sapiens
cagagaaaauaaaagcacuu

SEQ ID NO: 24678 - RNA, 18 nt, Homo sapiens
uacucuguuccuucacau

SEQ ID NO: 24679 - RNA, 14 nt, Homo sapiens
cucacaagcacuuu

SEQ ID NO: 24680 - RNA, 21 nt, Homo sapiens
gaauauuuauuaccucugaua

SEQ ID NO: 24681 - RNA, 21 nt, Homo sapiens
uuuacauacugcugucuaugu

SEQ ID NO: 24682 - RNA, 20 nt, Homo sapiens
aagcagaacagugauuacca

SEQ ID NO: 24683 - RNA, 22 nt, Homo sapiens
gagacaccaccacccuugccau

SEQ ID NO: 24684 - RNA, 19 nt, Homo sapiens
uuccagagaccaguauucc

SEQ ID NO: 24685 - RNA, 14 nt, Homo sapiens
uaugcauacaguaa

SEQ ID NO: 24686 - RNA, 12 nt, Homo sapiens
uuucugcuuuaa

SEQ ID NO: 24687 - RNA, 12 nt, Homo sapiens
aauuuacuuugu

SEQ ID NO: 24688 - RNA, 12 nt, Homo sapiens
auuaauucaccu

SEQ ID NO: 24689 - RNA, 13 nt, Homo sapiens
cucaucaaucaaa

SEQ ID NO: 24690 - RNA, 12 nt, Homo sapiens
cggaacaguauc

SEQ ID NO: 24691 - RNA, 16 nt, Homo sapiens
auaauacuagucuuau

SEQ ID NO: 24692 - RNA, 18 nt, Homo sapiens
ugauuccaccuacaugag

SEQ ID NO: 24693 - RNA, 21 nt, Homo sapiens
uauucacaaccacucauucaa

SEQ ID NO: 24694 - RNA, 14 nt, Homo sapiens
uacaucuuucacau

SEQ ID NO: 24695 - RNA, 16 nt, Homo sapiens
caaauauuguugacaa

SEQ ID NO: 24696 - RNA, 17 nt, Homo sapiens
uacaauugaaaugacua

SEQ ID NO: 24697 - RNA, 19 nt, Homo sapiens
auuguugacaacugugacu

SEQ ID NO: 24698 - RNA, 12 nt, Homo sapiens
gcagaacaguga

SEQ ID NO: 24699 - RNA, 21 nt, Homo sapiens
uuaaacucagggagcauuuau

SEQ ID NO: 24700 - RNA, 15 nt, Homo sapiens
ucugcuuuaauuuca

SEQ ID NO: 24701 - RNA, 15 nt, Homo sapiens
auguguuuuucacau

SEQ ID NO: 24702 - RNA, 17 nt, Homo sapiens
ccuggacaguuuucugc

SEQ ID NO: 24703 - RNA, 18 nt, Homo sapiens
gagaagaaugacuaugca

SEQ ID NO: 24704 - RNA, 15 nt, Homo sapiens
uccuuaucacugaca

SEQ ID NO: 24705 - RNA, 19 nt, Homo sapiens
uaguguuggaaaaugugca

SEQ ID NO: 24706 - RNA, 12 nt, Homo sapiens
gggcgcgguggc

SEQ ID NO: 24707 - RNA, 15 nt, Homo sapiens
caaccacucauucaa

SEQ ID NO: 24708 - RNA, 17 nt, Homo sapiens
aguaacggaacaguauc

SEQ ID NO: 24709 - RNA, 18 nt, Homo sapiens
gagaaucagaucauuuca

SEQ ID NO: 24710 - RNA, 19 nt, Homo sapiens
ugcuuguuagcaaaaugga

SEQ ID NO: 24711 - RNA, 14 nt, Homo sapiens
aucaccaaggcuga

SEQ ID NO: 24712 - RNA, 20 nt, Homo sapiens
agacaccaccacccuugcca

SEQ ID NO: 24713 - RNA, 15 nt, Homo sapiens
gacaguuuucugcuu

SEQ ID NO: 24714 - RNA, 17 nt, Homo sapiens
cugggucucaguguccu

SEQ ID NO: 24715 - RNA, 14 nt, Homo sapiens
uguaauugcuuguu

SEQ ID NO: 24716 - RNA, 22 nt, Homo sapiens
cuuuuggcuuguaaaguacaga

SEQ ID NO: 24717 - RNA, 19 nt, Homo sapiens
gguauuuauugagcaccug

SEQ ID NO: 24718 - RNA, 14 nt, Homo sapiens
cgcagccaugugau

SEQ ID NO: 24719 - RNA, 17 nt, Homo sapiens
cuggcacuugggacaaa

SEQ ID NO: 24720 - RNA, 20 nt, Homo sapiens
cuggaucucacaagcacuuu

SEQ ID NO: 24721 - RNA, 17 nt, Homo sapiens
auucacaagacccaaaa

SEQ ID NO: 24722 - RNA, 14 nt, Homo sapiens
auuuauuaccucug

SEQ ID NO: 24723 - RNA, 14 nt, Homo sapiens
ggcacuugggacaa

SEQ ID NO: 24724 - RNA, 18 nt, Homo sapiens
uuuguuauuuuuccccaa

SEQ ID NO: 24725 - RNA, 16 nt, Homo sapiens
cacugcagaagacagu

SEQ ID NO: 24726 - RNA, 16 nt, Homo sapiens
acagugucuggcacuu

SEQ ID NO: 24727 - RNA, 15 nt, Homo sapiens
aauucugcaagcuuu

SEQ ID NO: 24728 - RNA, 16 nt, Homo sapiens
cuuuuacauacugcug

SEQ ID NO: 24729 - RNA, 20 nt, Homo sapiens
auuuuguguucaguacaauu

SEQ ID NO: 24730 - RNA, 18 nt, Homo sapiens
cucugggucucagugucc

SEQ ID NO: 24731 - RNA, 23 nt, Homo sapiens
gaauucuuacauguuuucuuugc

SEQ ID NO: 24732 - RNA, 17 nt, Homo sapiens
gccugcuggauguggag

SEQ ID NO: 24733 - RNA, 21 nt, Homo sapiens
aacacuaaaaaggcauguaau

SEQ ID NO: 24734 - RNA, 23 nt, Homo sapiens
cuguaaucccagcacuuugggag

SEQ ID NO: 24735 - RNA, 21 nt, Homo sapiens
gauaccucaacccccauuucu

SEQ ID NO: 24736 - RNA, 14 nt, Homo sapiens
agacagaacuugaa

SEQ ID NO: 24737 - RNA, 13 nt, Homo sapiens
ugcugggaauuac

SEQ ID NO: 24738 - RNA, 17 nt, Homo sapiens
uagagacuuugugaaaa

SEQ ID NO: 24739 - RNA, 18 nt, Homo sapiens
uguaaugaaaaugaauau

SEQ ID NO: 24740 - RNA, 15 nt, Homo sapiens
ucccagcuacuuggg

SEQ ID NO: 24741 - RNA, 15 nt, Homo sapiens
acaguuccugagacc

SEQ ID NO: 24742 - RNA, 16 nt, Homo sapiens
gaauuaacacaugauc

SEQ ID NO: 24743 - RNA, 11 nt, Homo sapiens
cuuuucucugc

SEQ ID NO: 24744 - RNA, 22 nt, Homo sapiens
agaccuggucgucgucuugacu

SEQ ID NO: 24745 - RNA, 20 nt, Homo sapiens
aggaaauauucuguaaucuu

SEQ ID NO: 24746 - RNA, 20 nt, Homo sapiens
gaacugcuggauucaaguga

SEQ ID NO: 24747 - RNA, 15 nt, Homo sapiens
gacuaauuaggcaag

SEQ ID NO: 24748 - RNA, 16 nt, Homo sapiens
gaggagaaacuggaac

SEQ ID NO: 24749 - RNA, 17 nt, Homo sapiens
gcacuuuaacacagugu

SEQ ID NO: 24750 - RNA, 21 nt, Homo sapiens
uuguguguuuauuucacuuga

SEQ ID NO: 24751 - RNA, 11 nt, Homo sapiens
ccugugacugu

SEQ ID NO: 24752 - RNA, 21 nt, Homo sapiens
ucuuaaacacuaaaaaggcau

SEQ ID NO: 24753 - RNA, 18 nt, Homo sapiens
cuaaaaaggcauguaauu

SEQ ID NO: 24754 - RNA, 18 nt, Homo sapiens
cagccaggcggcuggaau

SEQ ID NO: 24755 - RNA, 16 nt, Homo sapiens
auggcuaguaucaaaa

SEQ ID NO: 24756 - RNA, 15 nt, Homo sapiens
cuuugaagucugauu

SEQ ID NO: 24757 - RNA, 14 nt, Homo sapiens
cagaacuugaaugu

SEQ ID NO: 24758 - RNA, 16 nt, Homo sapiens
cugacuaauuaggcaa

SEQ ID NO: 24759 - RNA, 16 nt, Homo sapiens
uuauuuuuacaguucu

SEQ ID NO: 24760 - RNA, 18 nt, Homo sapiens
ccacugcagaagacagua

SEQ ID NO: 24761 - RNA, 22 nt, Homo sapiens
uucucugccuugguauagcaua

SEQ ID NO: 24762 - RNA, 18 nt, Homo sapiens
gaggcugaggcgggugga

SEQ ID NO: 24763 - RNA, 15 nt, Homo sapiens
uauuucacuugauga

SEQ ID NO: 24764 - RNA, 13 nt, Homo sapiens
guuuucugacuaa

SEQ ID NO: 24765 - RNA, 15 nt, Homo sapiens
ugaauaaaguguaag

SEQ ID NO: 24766 - RNA, 20 nt, Homo sapiens
aguaauuuuaaguaauuuca

SEQ ID NO: 24767 - RNA, 16 nt, Homo sapiens
uggcugggaguggcau

SEQ ID NO: 24768 - RNA, 17 nt, Homo sapiens
gaaucagaucauuucaa

SEQ ID NO: 24769 - RNA, 21 nt, Homo sapiens
aagcacuuuaacacagugucu

SEQ ID NO: 24770 - RNA, 21 nt, Homo sapiens
caagguucuucccuuuuacau

SEQ ID NO: 24771 - RNA, 15 nt, Homo sapiens
acagucacauuccaa

SEQ ID NO: 24772 - RNA, 15 nt, Homo sapiens
auaagcuguuuuuau

SEQ ID NO: 24773 - RNA, 16 nt, Homo sapiens
agaagaaugacuaugc

SEQ ID NO: 24774 - RNA, 23 nt, Homo sapiens
ucuucccuuuuacauacugcugu

SEQ ID NO: 24775 - RNA, 13 nt, Homo sapiens
gugcaauauguga

SEQ ID NO: 24776 - RNA, 17 nt, Homo sapiens
auuuccaaauucacaag

SEQ ID NO: 24777 - RNA, 19 nt, Homo sapiens
gacuaugaggaauauuugc

SEQ ID NO: 24778 - RNA, 12 nt, Homo sapiens
aaaugugcaaua

SEQ ID NO: 24779 - RNA, 18 nt, Homo sapiens
ucaggaguuccuaaccag

SEQ ID NO: 24780 - RNA, 16 nt, Homo sapiens
agauccccguguuacu

SEQ ID NO: 24781 - RNA, 21 nt, Homo sapiens
cccccauuguggucacaggaa

SEQ ID NO: 24782 - RNA, 19 nt, Homo sapiens
aauauuuuuaugugcaaua

SEQ ID NO: 24783 - RNA, 23 nt, Homo sapiens
agauuaagagauggguuugacaa

SEQ ID NO: 24784 - RNA, 17 nt, Homo sapiens
ugaggaauauuugcaag

SEQ ID NO: 24785 - RNA, 16 nt, Homo sapiens
aauguucaucaaugaa

SEQ ID NO: 24786 - RNA, 23 nt, Homo sapiens
cuauuauagaauggaacucaagg

SEQ ID NO: 24787 - RNA, 13 nt, Homo sapiens
ucaccaaggcuga

SEQ ID NO: 24788 - RNA, 14 nt, Homo sapiens
cucuucacagucac

SEQ ID NO: 24789 - RNA, 15 nt, Homo sapiens
ggcugggaguggcau

SEQ ID NO: 24790 - RNA, 14 nt, Homo sapiens
uccuuccuuaucac

SEQ ID NO: 24791 - RNA, 13 nt, Homo sapiens
caaccaaauggag

SEQ ID NO: 24792 - RNA, 19 nt, Homo sapiens
ugaaaagauuaugaucuca

SEQ ID NO: 24793 - RNA, 19 nt, Homo sapiens
gcaaccuuuggaugcacuu

SEQ ID NO: 24794 - RNA, 14 nt, Homo sapiens
gaauuuucuuccaa

SEQ ID NO: 24795 - RNA, 21 nt, Homo sapiens
guaaguuuaugcauacaguaa

SEQ ID NO: 24796 - RNA, 21 nt, Homo sapiens
caccaaacccggccugauuaa

SEQ ID NO: 24797 - RNA, 15 nt, Homo sapiens
uuccuauguaacugc

SEQ ID NO: 24798 - RNA, 19 nt, Homo sapiens
auguuucgcugauauaugu

SEQ ID NO: 24799 - RNA, 20 nt, Homo sapiens
ugccaaggcuggagugcagu

SEQ ID NO: 24800 - RNA, 17 nt, Homo sapiens
uauagaauggaacucaa

SEQ ID NO: 24801 - RNA, 16 nt, Homo sapiens
uuaugaaccuuuacau

SEQ ID NO: 24802 - RNA, 19 nt, Homo sapiens
cacuuugggaggcugaggc

SEQ ID NO: 24803 - RNA, 23 nt, Homo sapiens
acucauugcaaccuccaccuucu

SEQ ID NO: 24804 - RNA, 21 nt, Homo sapiens
ucccaaagugcugggaauuac

SEQ ID NO: 24805 - RNA, 22 nt, Homo sapiens
uauuuuuuaugaaacauuacag

SEQ ID NO: 24806 - RNA, 15 nt, Homo sapiens
cagcagagacggggu

SEQ ID NO: 24807 - RNA, 21 nt, Homo sapiens
auaaauaguuuaugauuccac

SEQ ID NO: 24808 - RNA, 19 nt, Homo sapiens
gcagagacgggguuugcca

SEQ ID NO: 24809 - RNA, 14 nt, Homo sapiens
ucucaucugugauu

SEQ ID NO: 24810 - RNA, 23 nt, Homo sapiens
aaggcuucucuuaaacacuaaaa

SEQ ID NO: 24811 - RNA, 19 nt, Homo sapiens
accaguaacggaacaguau

SEQ ID NO: 24812 - RNA, 15 nt, Homo sapiens
uuccuggacaguuuu

SEQ ID NO: 24813 - RNA, 20 nt, Homo sapiens
ucucuacuaaaaauacaaaa

SEQ ID NO: 24814 - RNA, 16 nt, Homo sapiens
auguguggcauuuuca

SEQ ID NO: 24815 - RNA, 15 nt, Homo sapiens
gcuaauuuguguauu

SEQ ID NO: 24816 - RNA, 19 nt, Homo sapiens
cuguaucuuguuuuuccac

SEQ ID NO: 24817 - RNA, 20 nt, Homo sapiens
ugcacuccagccugagcgac

SEQ ID NO: 24818 - RNA, 20 nt, Homo sapiens
caauucuauuacgugcaaua

SEQ ID NO: 24819 - RNA, 16 nt, Homo sapiens
acuccuaguaauuuaa

SEQ ID NO: 24820 - RNA, 18 nt, Homo sapiens
gcagcuuauucacaagac

SEQ ID NO: 24821 - RNA, 21 nt, Homo sapiens
aaaaaaauuuuauagugucuu

SEQ ID NO: 24822 - RNA, 21 nt, Homo sapiens
aguguuggaaaaugugcaaua

SEQ ID NO: 24823 - RNA, 13 nt, Homo sapiens
cauuugcacuauu

SEQ ID NO: 24824 - RNA, 22 nt, Homo sapiens
ugucuuacagagaaaagacaua

SEQ ID NO: 24825 - RNA, 16 nt, Homo sapiens
gaguggguuucacaag

SEQ ID NO: 24826 - RNA, 22 nt, Homo sapiens
ccgcaaugugacuuaaugccac

SEQ ID NO: 24827 - RNA, 16 nt, Homo sapiens
aucuaauauauaugaa

SEQ ID NO: 24828 - RNA, 23 nt, Homo sapiens
gugaauuuuucucuaacucagaa

SEQ ID NO: 24829 - RNA, 15 nt, Homo sapiens
aaucagaucauuuca

SEQ ID NO: 24830 - RNA, 15 nt, Homo sapiens
acuuuuggcuuguaa

SEQ ID NO: 24831 - RNA, 21 nt, Homo sapiens
cuuagacccucaugcugccaa

SEQ ID NO: 24832 - RNA, 14 nt, Homo sapiens
uucacuuauugacu

SEQ ID NO: 24833 - RNA, 19 nt, Homo sapiens
caacccaaauguucaucaa

SEQ ID NO: 24834 - RNA, 17 nt, Homo sapiens
aagugaaaaacauccag

SEQ ID NO: 24835 - RNA, 23 nt, Homo sapiens
agcuaaguugcaccaacuuugaa

SEQ ID NO: 24836 - RNA, 13 nt, Homo sapiens
aaaaugugcaaua

SEQ ID NO: 24837 - RNA, 20 nt, Homo sapiens
cugcauugagaacugcauau

SEQ ID NO: 24838 - RNA, 16 nt, Homo sapiens
uuuuuaugugcaauaa

SEQ ID NO: 24839 - RNA, 21 nt, Homo sapiens
aaauaacuaggcguggacuua

SEQ ID NO: 24840 - RNA, 20 nt, Homo sapiens
aaaaccaaauuuguauuuaa

SEQ ID NO: 24841 - RNA, 14 nt, Homo sapiens
gaaugagaagaaug

SEQ ID NO: 24842 - RNA, 16 nt, Homo sapiens
uggaacucaaggaaau

SEQ ID NO: 24843 - RNA, 20 nt, Homo sapiens
gcuaagugaaauaagccaga

SEQ ID NO: 24844 - RNA, 12 nt, Homo sapiens
ucaucaaugaau

SEQ ID NO: 24845 - RNA, 22 nt, Homo sapiens
agacagaaagcagaacagugau

SEQ ID NO: 24846 - RNA, 18 nt, Homo sapiens
cuucuggguucaagcgau

SEQ ID NO: 24847 - RNA, 20 nt, Homo sapiens
agguauauaaauuuucccaa

SEQ ID NO: 24848 - RNA, 15 nt, Homo sapiens
aacccaaauguucau

SEQ ID NO: 24849 - RNA, 21 nt, Homo sapiens
ggccuguugaagaugcuugua

SEQ ID NO: 24850 - RNA, 18 nt, Homo sapiens
ugaaaacauagcaucuca

SEQ ID NO: 24851 - RNA, 18 nt, Homo sapiens
uaagugaagugauacuau

SEQ ID NO: 24852 - RNA, 14 nt, Homo sapiens
gcagcuuauucaca

SEQ ID NO: 24853 - RNA, 19 nt, Homo sapiens
uccauugguuuaccuguga

SEQ ID NO: 24854 - RNA, 20 nt, Homo sapiens
uccugugacugucucacuua

SEQ ID NO: 24855 - RNA, 16 nt, Homo sapiens
ucccugcagacaugag

SEQ ID NO: 24856 - RNA, 17 nt, Homo sapiens
gaaagcagggacuugaa

SEQ ID NO: 24857 - RNA, 13 nt, Homo sapiens
auuuucacuuuug

SEQ ID NO: 24858 - RNA, 21 nt, Homo sapiens
auugaaucccuuaaacucagg

SEQ ID NO: 24859 - RNA, 23 nt, Homo sapiens
ugaacaaauuuacagagacagaa

SEQ ID NO: 24860 - RNA, 14 nt, Homo sapiens
uuccaaauucacaa

SEQ ID NO: 24861 - RNA, 16 nt, Homo sapiens
aauaauacaccagaga

SEQ ID NO: 24862 - RNA, 23 nt, Homo sapiens
aggcuggucucgaacugcuggau

SEQ ID NO: 24863 - RNA, 20 nt, Homo sapiens
ccagccugggugacagagca

SEQ ID NO: 24864 - RNA, 12 nt, Homo sapiens
aaagccaaaaac

SEQ ID NO: 24865 - RNA, 22 nt, Homo sapiens
augcaaccuuuggaugcacuuu

SEQ ID NO: 24866 - RNA, 21 nt, Homo sapiens
gaugccccagggaccuuugua

SEQ ID NO: 24867 - RNA, 11 nt, Homo sapiens
auuugagacag

SEQ ID NO: 24868 - RNA, 18 nt, Homo sapiens
cuguaaucccagcuacuu

SEQ ID NO: 24869 - RNA, 13 nt, Homo sapiens
uauaucaguccuc

SEQ ID NO: 24870 - RNA, 14 nt, Homo sapiens
uguggucacaggaa

SEQ ID NO: 24871 - RNA, 17 nt, Homo sapiens
aacuagaauuuauucaa

SEQ ID NO: 24872 - RNA, 12 nt, Homo sapiens
gggaguggcgcg

SEQ ID NO: 24873 - RNA, 14 nt, Homo sapiens
ggcuuuuauugcca

SEQ ID NO: 24874 - RNA, 17 nt, Homo sapiens
auagcagcuuauucaca

SEQ ID NO: 24875 - RNA, 17 nt, Homo sapiens
caguguccucaucugua

SEQ ID NO: 24876 - RNA, 14 nt, Homo sapiens
agcuucucugugaa

SEQ ID NO: 24877 - RNA, 13 nt, Homo sapiens
ugaaauagugucu

SEQ ID NO: 24878 - RNA, 21 nt, Homo sapiens
ugaggcggguggaucacuuga

SEQ ID NO: 24879 - RNA, 23 nt, Homo sapiens
gauuacaaggcuuuaucucaggg

SEQ ID NO: 24880 - RNA, 13 nt, Homo sapiens
gccccugcacucc

SEQ ID NO: 24881 - RNA, 20 nt, Homo sapiens
aaauugggaaaggaguagaa

SEQ ID NO: 24882 - RNA, 17 nt, Homo sapiens
ggaagaaauuccaggaa

SEQ ID NO: 24883 - RNA, 21 nt, Homo sapiens
gauaucaugccccuguacucc

SEQ ID NO: 24884 - RNA, 16 nt, Homo sapiens
augcauuugcacuauu

SEQ ID NO: 24885 - RNA, 13 nt, Homo sapiens
gaaauagugucug

SEQ ID NO: 24886 - RNA, 20 nt, Homo sapiens
uucugcccugcuuuugcuag

SEQ ID NO: 24887 - RNA, 20 nt, Homo sapiens
aaucugagccagugcuuuaa

SEQ ID NO: 24888 - RNA, 21 nt, Homo sapiens
uuuaacuagaauuuauucaau

SEQ ID NO: 24889 - RNA, 22 nt, Homo sapiens
ucgaacugcuggauucaaguga

SEQ ID NO: 24890 - RNA, 16 nt, Homo sapiens
acuggcucccuggaag

SEQ ID NO: 24891 - RNA, 19 nt, Homo sapiens
auuacaaggcuuuaucuca

SEQ ID NO: 24892 - RNA, 19 nt, Homo sapiens
uuccaggaaaaucugcacu

SEQ ID NO: 24893 - RNA, 19 nt, Homo sapiens
uguaaucacagcuacuugg

SEQ ID NO: 24894 - RNA, 13 nt, Homo sapiens
gacaaauucuguu

SEQ ID NO: 24895 - RNA, 13 nt, Homo sapiens
agaucaagccauc

SEQ ID NO: 24896 - RNA, 14 nt, Homo sapiens
aucuacacuccagu

SEQ ID NO: 24897 - RNA, 14 nt, Homo sapiens
augccugcaaucug

SEQ ID NO: 24898 - RNA, 12 nt, Homo sapiens
ccacuacugcua

SEQ ID NO: 24899 - RNA, 19 nt, Homo sapiens
acuugggcgggacacaggc

SEQ ID NO: 24900 - RNA, 18 nt, Homo sapiens
auucuauuacgugcaaua

SEQ ID NO: 24901 - RNA, 19 nt, Homo sapiens
caugugauuacccucuggg

SEQ ID NO: 24902 - RNA, 20 nt, Homo sapiens
auggagguuaagcacuuuaa

SEQ ID NO: 24903 - RNA, 15 nt, Homo sapiens
ucucacaagcacuuu

SEQ ID NO: 24904 - RNA, 19 nt, Homo sapiens
cuuuucaaaauuggacuua

SEQ ID NO: 24905 - RNA, 23 nt, Homo sapiens
agagacagaaagcagaacaguga

SEQ ID NO: 24906 - RNA, 20 nt, Homo sapiens
uagagugggacaguuccuga

SEQ ID NO: 24907 - RNA, 16 nt, Homo sapiens
aacaaaaaaagcauug

SEQ ID NO: 24908 - RNA, 20 nt, Homo sapiens
auuuucacuuuuggcuugua

SEQ ID NO: 24909 - RNA, 20 nt, Homo sapiens
ugcugggaauuacaggcgug

SEQ ID NO: 24910 - RNA, 16 nt, Homo sapiens
caguggcgcaaucuua

SEQ ID NO: 24911 - RNA, 14 nt, Homo sapiens
uguauagugcaugu

SEQ ID NO: 24912 - RNA, 15 nt, Homo sapiens
acagaggaucugcuu

SEQ ID NO: 24913 - RNA, 23 nt, Homo sapiens
caauuauaucaguccucuuucaa

SEQ ID NO: 24914 - RNA, 23 nt, Homo sapiens
cauugagaacugcauauguuucg

SEQ ID NO: 24915 - RNA, 16 nt, Homo sapiens
agcuguuuucccugac

SEQ ID NO: 24916 - RNA, 20 nt, Homo sapiens
ggccagaagucaaggcuuag

SEQ ID NO: 24917 - RNA, 14 nt, Homo sapiens
acccaaaguaucag

SEQ ID NO: 24918 - RNA, 15 nt, Homo sapiens
cuauguggcuguauc

SEQ ID NO: 24919 - RNA, 18 nt, Homo sapiens
cgaaugguuccauucucu

SEQ ID NO: 24920 - RNA, 18 nt, Homo sapiens
gcaggauagagugggaca

SEQ ID NO: 24921 - RNA, 15 nt, Homo sapiens
auuaaggcuucucuu

SEQ ID NO: 24922 - RNA, 17 nt, Homo sapiens
acagagaaaagacauaa

SEQ ID NO: 24923 - RNA, 13 nt, Homo sapiens
cacuccagccuga

SEQ ID NO: 24924 - RNA, 10 nt, Homo sapiens
auagugucuu

SEQ ID NO: 24925 - RNA, 17 nt, Homo sapiens
ccagugcuuuaauggca

SEQ ID NO: 24926 - RNA, 17 nt, Homo sapiens
auaagcaaagacuauga

SEQ ID NO: 24927 - RNA, 21 nt, Homo sapiens
uugccaaggcuggagugcagu

SEQ ID NO: 24928 - RNA, 16 nt, Homo sapiens
ggaguggcauguauga

SEQ ID NO: 24929 - RNA, 16 nt, Homo sapiens
gacuuuggcaaaugag

SEQ ID NO: 24930 - RNA, 21 nt, Homo sapiens
uaagcacuuuaacacaguguc

SEQ ID NO: 24931 - RNA, 23 nt, Homo sapiens
uuuaaaaaaaaaaaaaaagccaa

SEQ ID NO: 24932 - RNA, 21 nt, Homo sapiens
ucuuuuuagagaaauuugcca

SEQ ID NO: 24933 - RNA, 22 nt, Homo sapiens
gaauaguguuggaaaaugugca

SEQ ID NO: 24934 - RNA, 23 nt, Homo sapiens
uggacuuuccagagaccaguauu

SEQ ID NO: 24935 - RNA, 17 nt, Homo sapiens
agaaaauaaaagcacuu

SEQ ID NO: 24936 - RNA, 22 nt, Homo sapiens
uaucucaggggccaacuaggca

SEQ ID NO: 24937 - RNA, 15 nt, Homo sapiens
uggaacucaaggaaa

SEQ ID NO: 24938 - RNA, 13 nt, Homo sapiens
ucaugcauuugca

SEQ ID NO: 24939 - RNA, 16 nt, Homo sapiens
ugucucaguccaugaa

SEQ ID NO: 24940 - RNA, 13 nt, Homo sapiens
cauuuucacuuuu

SEQ ID NO: 24941 - RNA, 23 nt, Homo sapiens
caauaucuaauauauaugaauaa

SEQ ID NO: 24942 - RNA, 18 nt, Homo sapiens
uauauguguuuuucacau

SEQ ID NO: 24943 - RNA, 22 nt, Homo sapiens
aaacaucaguuacucugaaggg

SEQ ID NO: 24944 - RNA, 15 nt, Homo sapiens
uuaucuugucucugg

SEQ ID NO: 24945 - RNA, 18 nt, Homo sapiens
aagaaaggccagcaaauu

SEQ ID NO: 24946 - RNA, 17 nt, Homo sapiens
ucuuggucucaguguca

SEQ ID NO: 24947 - RNA, 20 nt, Homo sapiens
aaaagauuguauagugcaug

SEQ ID NO: 24948 - RNA, 22 nt, Homo sapiens
acuccugguuccuaggugagca

SEQ ID NO: 24949 - RNA, 20 nt, Homo sapiens
ggucaauuuuguuauguaua

SEQ ID NO: 24950 - RNA, 19 nt, Homo sapiens
agaaauuugccaauuuacu

SEQ ID NO: 24951 - RNA, 19 nt, Homo sapiens
cuucuggguucaagcgauu

SEQ ID NO: 24952 - RNA, 17 nt, Homo sapiens
ugccaugcuggccaggc

SEQ ID NO: 24953 - RNA, 22 nt, Homo sapiens
aagcagggacuugaacccauau

SEQ ID NO: 24954 - RNA, 18 nt, Homo sapiens
aauuaauggaauauguaa

SEQ ID NO: 24955 - RNA, 10 nt, Homo sapiens
acgugcaaua

SEQ ID NO: 24956 - RNA, 16 nt, Homo sapiens
auccagaaauaaugaa

SEQ ID NO: 24957 - RNA, 18 nt, Homo sapiens
uacaguuagagauuuuua

SEQ ID NO: 24958 - RNA, 16 nt, Homo sapiens
uccaagccucaugucc

SEQ ID NO: 24959 - RNA, 16 nt, Homo sapiens
uauggcuuaaugacac

SEQ ID NO: 24960 - RNA, 15 nt, Homo sapiens
ggcuuuaucucaggg

SEQ ID NO: 24961 - RNA, 9 nt, Homo sapiens
uaugugcaa

SEQ ID NO: 24962 - RNA, 14 nt, Homo sapiens
acaugauccugcaa

SEQ ID NO: 24963 - RNA, 16 nt, Homo sapiens
uaaaugauuucauuca

SEQ ID NO: 24964 - RNA, 16 nt, Homo sapiens
aacacuaaaaaggcau

SEQ ID NO: 24965 - RNA, 22 nt, Homo sapiens
cacgccuguaaucccagcacuu

SEQ ID NO: 24966 - RNA, 15 nt, Homo sapiens
acaaugaacacuuau

SEQ ID NO: 24967 - RNA, 21 nt, Homo sapiens
uauguaaauagaaacguguau

SEQ ID NO: 24968 - RNA, 15 nt, Homo sapiens
gcauuuucacuuuug

SEQ ID NO: 24969 - RNA, 13 nt, Homo sapiens
uggauucaaguga

SEQ ID NO: 24970 - RNA, 13 nt, Homo sapiens
uuaaaauguaauu

SEQ ID NO: 24971 - RNA, 17 nt, Homo sapiens
ggaucucacaagcacuu

SEQ ID NO: 24972 - RNA, 16 nt, Homo sapiens
guuggaaaaugugcaa

SEQ ID NO: 24973 - RNA, 19 nt, Homo sapiens
ugagugccuguaaucacag

SEQ ID NO: 24974 - RNA, 19 nt, Homo sapiens
ucuucccuuuuacauacug

SEQ ID NO: 24975 - RNA, 16 nt, Homo sapiens
gcaauaaaauguauuu

SEQ ID NO: 24976 - RNA, 15 nt, Homo sapiens
aucagcuaaguugca

SEQ ID NO: 24977 - RNA, 17 nt, Homo sapiens
aagugaaauaagccaga

SEQ ID NO: 24978 - RNA, 17 nt, Homo sapiens
gcucugggauagcugac

SEQ ID NO: 24979 - RNA, 20 nt, Homo sapiens
gacaccaccacccuugccau

SEQ ID NO: 24980 - RNA, 22 nt, Homo sapiens
auguacauccauggugugcugg

SEQ ID NO: 24981 - RNA, 19 nt, Homo sapiens
agugaacaaauuuacagag

SEQ ID NO: 24982 - RNA, 10 nt, Homo sapiens
caagacauag

SEQ ID NO: 24983 - RNA, 15 nt, Homo sapiens
gcaggcgugaccuga

SEQ ID NO: 24984 - RNA, 21 nt, Homo sapiens
cugcaaucugagccagugcuu

SEQ ID NO: 24985 - RNA, 14 nt, Homo sapiens
gaguuuggccagaa

SEQ ID NO: 24986 - RNA, 20 nt, Homo sapiens
acggagauaucccaggaaaa

SEQ ID NO: 24987 - RNA, 13 nt, Homo sapiens
uuuuccuucucau

SEQ ID NO: 24988 - RNA, 20 nt, Homo sapiens
gaggcaagagaauugcuuga

SEQ ID NO: 24989 - RNA, 22 nt, Homo sapiens
ucccauggguuguguguuuauu

SEQ ID NO: 24990 - RNA, 19 nt, Homo sapiens
gaaaaucugcacugugggc

SEQ ID NO: 24991 - RNA, 15 nt, Homo sapiens
aagcccaauauuaua

SEQ ID NO: 24992 - RNA, 21 nt, Homo sapiens
aauucuauuacgugcaauacu

SEQ ID NO: 24993 - RNA, 16 nt, Homo sapiens
auaauaugagaaucag

SEQ ID NO: 24994 - RNA, 13 nt, Homo sapiens
ccuguaaucacag

SEQ ID NO: 24995 - RNA, 13 nt, Homo sapiens
gcacucuauguuc

SEQ ID NO: 24996 - RNA, 22 nt, Homo sapiens
agaagugaaaaucuacacucca

SEQ ID NO: 24997 - RNA, 18 nt, Homo sapiens
aaacuuuaugcuaaguga

SEQ ID NO: 24998 - RNA, 16 nt, Homo sapiens
ggacuuacuauuuauu

SEQ ID NO: 24999 - RNA, 22 nt, Homo sapiens
cuauguucuaagaagugaaaau

SEQ ID NO: 25000 - RNA, 16 nt, Homo sapiens
cacuuauugacuauua

SEQ ID NO: 25001 - RNA, 19 nt, Homo sapiens
ucccuucucuucacaguca

SEQ ID NO: 25002 - RNA, 15 nt, Homo sapiens
guacuuuuuccagac

SEQ ID NO: 25003 - RNA, 12 nt, Homo sapiens
acauacaauuau

SEQ ID NO: 25004 - RNA, 12 nt, Homo sapiens
uuaugugcaaua

SEQ ID NO: 25005 - RNA, 23 nt, Homo sapiens
cuggcugggaguggcauguauga

SEQ ID NO: 25006 - RNA, 14 nt, Homo sapiens
cgggguuugccaug

SEQ ID NO: 25007 - RNA, 20 nt, Homo sapiens
aauauuuauuauuuucaccu

SEQ ID NO: 25008 - RNA, 20 nt, Homo sapiens
guguuggaaaaugugcaaua

SEQ ID NO: 25009 - RNA, 21 nt, Homo sapiens
acagcucugcauacucauuag

SEQ ID NO: 25010 - RNA, 13 nt, Homo sapiens
auuauagaaugga

SEQ ID NO: 25011 - RNA, 17 nt, Homo sapiens
agacagcaggucucaug

SEQ ID NO: 25012 - RNA, 14 nt, Homo sapiens
ggucucgaacugcu

SEQ ID NO: 25013 - RNA, 19 nt, Homo sapiens
agcuguggccagcuuguua

SEQ ID NO: 25014 - RNA, 17 nt, Homo sapiens
ccaaacagaacuaugga

SEQ ID NO: 25015 - RNA, 11 nt, Homo sapiens
uuacucugaag

SEQ ID NO: 25016 - RNA, 17 nt, Homo sapiens
uuguaccgcaaugugac

SEQ ID NO: 25017 - RNA, 23 nt, Homo sapiens
gugauucccuccugcuacucugu

SEQ ID NO: 25018 - RNA, 19 nt, Homo sapiens
gucagugcccaacuguuau

SEQ ID NO: 25019 - RNA, 16 nt, Homo sapiens
ugaaaaugaauaucua

SEQ ID NO: 25020 - RNA, 21 nt, Homo sapiens
uauagugucuugggaauuuuc

SEQ ID NO: 25021 - RNA, 16 nt, Homo sapiens
caaguuguguuugaua

SEQ ID NO: 25022 - RNA, 15 nt, Homo sapiens
uggcauuuucacuuu

SEQ ID NO: 25023 - RNA, 21 nt, Homo sapiens
gauagguuaccaguaacggaa

SEQ ID NO: 25024 - RNA, 19 nt, Homo sapiens
aauucuauuacgugcaaua

SEQ ID NO: 25025 - RNA, 23 nt, Homo sapiens
aaaucggaucuggggcucuggga

SEQ ID NO: 25026 - RNA, 20 nt, Homo sapiens
uccuuccuuaucacugacac

SEQ ID NO: 25027 - RNA, 14 nt, Homo sapiens
uuacagagacagaa

SEQ ID NO: 25028 - RNA, 13 nt, Homo sapiens
auuacgugcaaua

SEQ ID NO: 25029 - RNA, 20 nt, Homo sapiens
uagaauaauacuagucuuau

SEQ ID NO: 25030 - RNA, 14 nt, Homo sapiens
gcuggagugcagug

SEQ ID NO: 25031 - RNA, 20 nt, Homo sapiens
gaugggagaaucacuugaac

SEQ ID NO: 25032 - RNA, 12 nt, Homo sapiens
gauuucauucaa

SEQ ID NO: 25033 - RNA, 17 nt, Homo sapiens
ucuggacuuuccagaga

SEQ ID NO: 25034 - RNA, 22 nt, Homo sapiens
ugaaaaaaaauuuuauaguguc

SEQ ID NO: 25035 - RNA, 13 nt, Homo sapiens
acuagauacugaa

SEQ ID NO: 25036 - RNA, 12 nt, Homo sapiens
aaaagccaaaaa

SEQ ID NO: 25037 - RNA, 18 nt, Homo sapiens
gcuugaaauagugucuga

SEQ ID NO: 25038 - RNA, 12 nt, Homo sapiens
aacccugucucu

SEQ ID NO: 25039 - RNA, 15 nt, Homo sapiens
aguucugucuggacu

SEQ ID NO: 25040 - RNA, 17 nt, Homo sapiens
ccaugugauuacccucu

SEQ ID NO: 25041 - RNA, 18 nt, Homo sapiens
guuggaaaaugugcaaua

SEQ ID NO: 25042 - RNA, 10 nt, Homo sapiens
ggggcuuccu

SEQ ID NO: 25043 - RNA, 17 nt, Homo sapiens
cuuaaaaucuaauucaa

SEQ ID NO: 25044 - RNA, 21 nt, Homo sapiens
cuggcucccuggaagagauca

SEQ ID NO: 25045 - RNA, 17 nt, Homo sapiens
ugaugauuaauucaccu

SEQ ID NO: 25046 - RNA, 20 nt, Homo sapiens
cugaagggcaucaugcaucu

SEQ ID NO: 25047 - RNA, 15 nt, Homo sapiens
gacaacugugacugu

SEQ ID NO: 25048 - RNA, 14 nt, Homo sapiens
agauaauaugagaa

SEQ ID NO: 25049 - RNA, 18 nt, Homo sapiens
uggaauauguaaauagaa

SEQ ID NO: 25050 - RNA, 21 nt, Homo sapiens
uaauuuaucuugucucugggc

SEQ ID NO: 25051 - RNA, 19 nt, Homo sapiens
caaauucuguuucuugaga

SEQ ID NO: 25052 - RNA, 18 nt, Homo sapiens
aguuuaugcauacaguaa

SEQ ID NO: 25053 - RNA, 18 nt, Homo sapiens
uacagagaaaagacauaa

SEQ ID NO: 25054 - RNA, 19 nt, Homo sapiens
aagcuguuuccauagggug

SEQ ID NO: 25055 - RNA, 14 nt, Homo sapiens
aaucagaucauuuc

SEQ ID NO: 25056 - RNA, 19 nt, Homo sapiens
cugugucaguggaugcugc

SEQ ID NO: 25057 - RNA, 19 nt, Homo sapiens
gagccaccaaacccggccu

SEQ ID NO: 25058 - RNA, 17 nt, Homo sapiens
gaucucacaagcacuuu

SEQ ID NO: 25059 - RNA, 19 nt, Homo sapiens
acauaagcaaagacuauga

SEQ ID NO: 25060 - RNA, 19 nt, Homo sapiens
auucuauuacgugcaauac

SEQ ID NO: 25061 - RNA, 18 nt, Homo sapiens
ccuuuggaugcacuuuau

SEQ ID NO: 25062 - RNA, 17 nt, Homo sapiens
aggaaaaucugcacugu

SEQ ID NO: 25063 - RNA, 16 nt, Homo sapiens
aacggaacaguaucca

SEQ ID NO: 25064 - RNA, 17 nt, Homo sapiens
auauaaauuuucccaaa

SEQ ID NO: 25065 - RNA, 13 nt, Homo sapiens
aaauagugucuga

SEQ ID NO: 25066 - RNA, 12 nt, Homo sapiens
uugaauccagaa

SEQ ID NO: 25067 - RNA, 14 nt, Homo sapiens
caugaaaagauuau

SEQ ID NO: 25068 - RNA, 23 nt, Homo sapiens
auuggacuuaaaaucuaauucaa

SEQ ID NO: 25069 - RNA, 21 nt, Homo sapiens
ucacaagugaaaaacauccag

SEQ ID NO: 25070 - RNA, 23 nt, Homo sapiens
cuaagugaaauaagccagacauc

SEQ ID NO: 25071 - RNA, 14 nt, Homo sapiens
auuugagacaggga

SEQ ID NO: 25072 - RNA, 14 nt, Homo sapiens
aaaugagcaaaagu

SEQ ID NO: 25073 - RNA, 15 nt, Homo sapiens
uauccugugacuguc

SEQ ID NO: 25074 - RNA, 12 nt, Homo sapiens
auacagugucuu

SEQ ID NO: 25075 - RNA, 20 nt, Homo sapiens
acaugauccugcaauuccac

SEQ ID NO: 25076 - RNA, 15 nt, Homo sapiens
uauuuauugcugaau

SEQ ID NO: 25077 - RNA, 13 nt, Homo sapiens
augcacacagugc

SEQ ID NO: 25078 - RNA, 14 nt, Homo sapiens
caauauccuaauaa

SEQ ID NO: 25079 - RNA, 21 nt, Homo sapiens
cuguaaucccagcacuuuggg

SEQ ID NO: 25080 - RNA, 19 nt, Homo sapiens
uggaucucacaagcacuuu

SEQ ID NO: 25081 - RNA, 14 nt, Homo sapiens
caccacgcccagcu

SEQ ID NO: 25082 - RNA, 17 nt, Homo sapiens
agaaggauguacauuuc

SEQ ID NO: 25083 - RNA, 11 nt, Homo sapiens
aagucuuccau

SEQ ID NO: 25084 - RNA, 16 nt, Homo sapiens
uuuauuaccucugaua

SEQ ID NO: 25085 - RNA, 19 nt, Homo sapiens
augggagaaucacuugaac

SEQ ID NO: 25086 - RNA, 14 nt, Homo sapiens
gcugcucugugguc

SEQ ID NO: 25087 - RNA, 21 nt, Homo sapiens
agcacuuuaacacagugucug

SEQ ID NO: 25088 - RNA, 19 nt, Homo sapiens
ugaaagcagggacuugaac

SEQ ID NO: 25089 - RNA, 19 nt, Homo sapiens
guuuuuccacuacugcuac

SEQ ID NO: 25090 - RNA, 14 nt, Homo sapiens
uggagacaccacca

SEQ ID NO: 25091 - RNA, 13 nt, Homo sapiens
aaaacucauuucc

SEQ ID NO: 25092 - RNA, 17 nt, Homo sapiens
cuaaccagccuggucaa

SEQ ID NO: 25093 - RNA, 15 nt, Homo sapiens
aauagugucugauga

SEQ ID NO: 25094 - RNA, 19 nt, Homo sapiens
ugcuggcuuaaaauguaau

SEQ ID NO: 25095 - RNA, 18 nt, Homo sapiens
cagaaagcagaacaguga

SEQ ID NO: 25096 - RNA, 16 nt, Homo sapiens
uuccuuaucacugaca

SEQ ID NO: 25097 - RNA, 19 nt, Homo sapiens
augucagacagaacuugaa

SEQ ID NO: 25098 - RNA, 22 nt, Homo sapiens
aauuuucaaaaucaaauuccag

SEQ ID NO: 25099 - RNA, 23 nt, Homo sapiens
aaucugaggccuccucucucagu

SEQ ID NO: 25100 - RNA, 17 nt, Homo sapiens
uguguuuauuucacuug

SEQ ID NO: 25101 - RNA, 19 nt, Homo sapiens
aucaauagaaggauguaca

SEQ ID NO: 25102 - RNA, 22 nt, Homo sapiens
aagaguggguuucacaagugaa

SEQ ID NO: 25103 - RNA, 12 nt, Homo sapiens
gacuugaaccca

SEQ ID NO: 25104 - RNA, 16 nt, Homo sapiens
agauuucaugccuggu

SEQ ID NO: 25105 - RNA, 14 nt, Homo sapiens
aagccucaugucca

SEQ ID NO: 25106 - RNA, 16 nt, Homo sapiens
cacaaccacucauuca

SEQ ID NO: 25107 - RNA, 15 nt, Homo sapiens
cuuuccagagaccag

SEQ ID NO: 25108 - RNA, 18 nt, Homo sapiens
aauuuauucaauuccucu

SEQ ID NO: 25109 - RNA, 16 nt, Homo sapiens
cauuguggucacagga

SEQ ID NO: 25110 - RNA, 20 nt, Homo sapiens
acagagcaagacucugucuc

SEQ ID NO: 25111 - RNA, 17 nt, Homo sapiens
cuguaaucccagcacuu

SEQ ID NO: 25112 - RNA, 19 nt, Homo sapiens
cauuugcgaaugguuccau

SEQ ID NO: 25113 - RNA, 21 nt, Homo sapiens
agauguagauaaacucagaaa

SEQ ID NO: 25114 - RNA, 16 nt, Homo sapiens
uuugugacuuuccuaa

SEQ ID NO: 25115 - RNA, 15 nt, Homo sapiens
uaacuggcaguuuuc

SEQ ID NO: 25116 - RNA, 13 nt, Homo sapiens
aagcaacaucuag

SEQ ID NO: 25117 - RNA, 18 nt, Homo sapiens
uucaaacuaauagaauua

SEQ ID NO: 25118 - RNA, 20 nt, Homo sapiens
gacuauuauagaauggaacu

SEQ ID NO: 25119 - RNA, 19 nt, Homo sapiens
uuuguagccacuucacuuu

SEQ ID NO: 25120 - RNA, 13 nt, Homo sapiens
auagcaucucagg

SEQ ID NO: 25121 - RNA, 16 nt, Homo sapiens
uguaaaauggagacac

SEQ ID NO: 25122 - RNA, 21 nt, Homo sapiens
auuuuuuaugaaacauuacag

SEQ ID NO: 25123 - RNA, 19 nt, Homo sapiens
uaaauguaucuuauucaca

SEQ ID NO: 25124 - RNA, 20 nt, Homo sapiens
augugauuacccucuggguc

SEQ ID NO: 25125 - RNA, 11 nt, Homo sapiens
aaaggugacca

SEQ ID NO: 25126 - RNA, 16 nt, Homo sapiens
uaggaagagaaaccag

SEQ ID NO: 25127 - RNA, 18 nt, Homo sapiens
ccaagaaugagaagaaug

SEQ ID NO: 25128 - RNA, 17 nt, Homo sapiens
uauugcugaaugacuac

SEQ ID NO: 25129 - RNA, 20 nt, Homo sapiens
gauugugccccugcacucca

SEQ ID NO: 25130 - RNA, 20 nt, Homo sapiens
uaaugaaaaugaauaucuau

SEQ ID NO: 25131 - RNA, 19 nt, Homo sapiens
caucuuggucacauacaau

SEQ ID NO: 25132 - RNA, 15 nt, Homo sapiens
aucuuguuuuuccac

SEQ ID NO: 25133 - RNA, 20 nt, Homo sapiens
agcaaaauggauaugacaca

SEQ ID NO: 25134 - RNA, 10 nt, Homo sapiens
aggcugcaaa

SEQ ID NO: 25135 - RNA, 14 nt, Homo sapiens
uaggcuauucacaa

SEQ ID NO: 25136 - RNA, 21 nt, Homo sapiens
cagagaaaauaaaagcacuua

SEQ ID NO: 25137 - RNA, 20 nt, Homo sapiens
ucccuuuuacauacugcugu

SEQ ID NO: 25138 - RNA, 18 nt, Homo sapiens
uuuccacuacugcuacca

SEQ ID NO: 25139 - RNA, 17 nt, Homo sapiens
uguuggaaaaugugcaa

SEQ ID NO: 25140 - RNA, 16 nt, Homo sapiens
cuggcacuugggacaa

SEQ ID NO: 25141 - RNA, 22 nt, Homo sapiens
cacccuugccauggagguuaag

SEQ ID NO: 25142 - RNA, 19 nt, Homo sapiens
uguaaucccagcacuuugg

SEQ ID NO: 25143 - RNA, 13 nt, Homo sapiens
aacaaagaagaca

SEQ ID NO: 25144 - RNA, 16 nt, Homo sapiens
caucuguaaaauggag

SEQ ID NO: 25145 - RNA, 16 nt, Homo sapiens
auuuuuaugugcaaua

SEQ ID NO: 25146 - RNA, 12 nt, Homo sapiens
acugugacugua

SEQ ID NO: 25147 - RNA, 18 nt, Homo sapiens
uucccugaccucccucua

SEQ ID NO: 25148 - RNA, 20 nt, Homo sapiens
uuaugaaccuuuacauccag

SEQ ID NO: 25149 - RNA, 16 nt, Homo sapiens
aaacauccagauacac

SEQ ID NO: 25150 - RNA, 23 nt, Homo sapiens
auuucacuugaugauacaaugaa

SEQ ID NO: 25151 - RNA, 14 nt, Homo sapiens
gcuuccuaacugcu

SEQ ID NO: 25152 - RNA, 11 nt, Homo sapiens
augauguuucg

SEQ ID NO: 25153 - RNA, 14 nt, Homo sapiens
acugucucacuuaa

SEQ ID NO: 25154 - RNA, 19 nt, Homo sapiens
auccagauagguuaccagu

SEQ ID NO: 25155 - RNA, 20 nt, Homo sapiens
cccucugggucucagugucc

SEQ ID NO: 25156 - RNA, 19 nt, Homo sapiens
aggagaaacuggaacucuc

SEQ ID NO: 25157 - RNA, 14 nt, Homo sapiens
aacagaacuaugga

SEQ ID NO: 25158 - RNA, 16 nt, Homo sapiens
aacucagaaacaucag

SEQ ID NO: 25159 - RNA, 19 nt, Homo sapiens
ugaacaaauuuacagagac

SEQ ID NO: 25160 - RNA, 12 nt, Homo sapiens
ccaaacuggagc

SEQ ID NO: 25161 - RNA, 16 nt, Homo sapiens
cugauacccuuugaaa

SEQ ID NO: 25162 - RNA, 21 nt, Homo sapiens
ucaauucuauuacgugcaaua

SEQ ID NO: 25163 - RNA, 15 nt, Homo sapiens
cauaaagucagugcc

SEQ ID NO: 25164 - RNA, 19 nt, Homo sapiens
caccacccuugccauggag

SEQ ID NO: 25165 - RNA, 19 nt, Homo sapiens
ucaucuuggucacauacaa

SEQ ID NO: 25166 - RNA, 12 nt, Homo sapiens
cauuuucacuuu

SEQ ID NO: 25167 - RNA, 14 nt, Homo sapiens
aagucuuccauaga

SEQ ID NO: 25168 - RNA, 23 nt, Homo sapiens
uagaauauuuauuaccucugaua

SEQ ID NO: 25169 - RNA, 16 nt, Homo sapiens
gcugaggcaagagaau

SEQ ID NO: 25170 - RNA, 13 nt, Homo sapiens
accgcaaugugac

SEQ ID NO: 25171 - RNA, 19 nt, Homo sapiens
agaauugcuugaacccagg

SEQ ID NO: 25172 - RNA, 21 nt, Homo sapiens
aaaaaugguuuaaauggucaa

SEQ ID NO: 25173 - RNA, 13 nt, Homo sapiens
gcugagcagucag

SEQ ID NO: 25174 - RNA, 10 nt, Homo sapiens
uuugccaugc

SEQ ID NO: 25175 - RNA, 14 nt, Homo sapiens
uggaacucaaggaa

SEQ ID NO: 25176 - RNA, 19 nt, Homo sapiens
ugauacuuuuuucauuauu

SEQ ID NO: 25177 - RNA, 13 nt, Homo sapiens
auguaacugcauu

SEQ ID NO: 25178 - RNA, 15 nt, Homo sapiens
acauagcaucucagg

SEQ ID NO: 25179 - RNA, 13 nt, Homo sapiens
gaaauaagccaga

SEQ ID NO: 25180 - RNA, 17 nt, Homo sapiens
uuguaacuuaugaaccu

SEQ ID NO: 25181 - RNA, 11 nt, Homo sapiens
auuugcacuau

SEQ ID NO: 25182 - RNA, 21 nt, Homo sapiens
ccaacagaagcuuccauucca

SEQ ID NO: 25183 - RNA, 19 nt, Homo sapiens
auuuucaaaaucaaauucc

SEQ ID NO: 25184 - RNA, 15 nt, Homo sapiens
ucucugccuugguau

SEQ ID NO: 25185 - RNA, 12 nt, Homo sapiens
aaaaagccaaaa

SEQ ID NO: 25186 - RNA, 16 nt, Homo sapiens
agccacuucacuuuuu

SEQ ID NO: 25187 - RNA, 12 nt, Homo sapiens
cgacaguuuucc

SEQ ID NO: 25188 - RNA, 18 nt, Homo sapiens
cccuuuuacauacugcug

SEQ ID NO: 25189 - RNA, 16 nt, Homo sapiens
cuggagugcaguggcg

SEQ ID NO: 25190 - RNA, 21 nt, Homo sapiens
uuaaaaaaaaaccugagcccc

SEQ ID NO: 25191 - RNA, 22 nt, Homo sapiens
cauaaauuagaggucuccaaaa

SEQ ID NO: 25192 - RNA, 16 nt, Homo sapiens
gugccuguaaucacag

SEQ ID NO: 25193 - RNA, 18 nt, Homo sapiens
cuaauagaauuaauggaa

SEQ ID NO: 25194 - RNA, 13 nt, Homo sapiens
ggagaaacuggaa

SEQ ID NO: 25195 - RNA, 22 nt, Homo sapiens
ugauucccuccugcuacucugu

SEQ ID NO: 25196 - RNA, 11 nt, Homo sapiens
gcaacccaaau

SEQ ID NO: 25197 - RNA, 17 nt, Homo sapiens
auugaaaggcauucucu

SEQ ID NO: 25198 - RNA, 13 nt, Homo sapiens
ugagcgacaguga

SEQ ID NO: 25199 - RNA, 18 nt, Homo sapiens
gagcuugaaauagugucu

SEQ ID NO: 25200 - RNA, 18 nt, Homo sapiens
uacauuuccaaauucaca

SEQ ID NO: 25201 - RNA, 23 nt, Homo sapiens
aguuguaccgcaaugugacuuaa

SEQ ID NO: 25202 - RNA, 15 nt, Homo sapiens
aauucgcugcaaccu

SEQ ID NO: 25203 - RNA, 22 nt, Homo sapiens
aaugacacuagcuaauaucaau

SEQ ID NO: 25204 - RNA, 16 nt, Homo sapiens
ugagugccuguaauca

SEQ ID NO: 25205 - RNA, 14 nt, Homo sapiens
aguacagacuuuuu

SEQ ID NO: 25206 - RNA, 18 nt, Homo sapiens
aaaagcaguaacugacaa

SEQ ID NO: 25207 - RNA, 13 nt, Homo sapiens
ccuuuuacauacu

SEQ ID NO: 25208 - RNA, 21 nt, Homo sapiens
cagagacgggguuugccaugc

SEQ ID NO: 25209 - RNA, 22 nt, Homo sapiens
auaagugaagugauacuaucca

SEQ ID NO: 25210 - RNA, 14 nt, Homo sapiens
ccauuguggucaca

SEQ ID NO: 25211 - RNA, 17 nt, Homo sapiens
aucagcauuuuacuacu

SEQ ID NO: 25212 - RNA, 17 nt, Homo sapiens
uauuuuauaucaauuua

SEQ ID NO: 25213 - RNA, 16 nt, Homo sapiens
cacagcugaacuuguu

SEQ ID NO: 25214 - RNA, 12 nt, Homo sapiens
agcaucucagga

SEQ ID NO: 25215 - RNA, 15 nt, Homo sapiens
gacuggccugcugga

SEQ ID NO: 25216 - RNA, 16 nt, Homo sapiens
caaaauggauaugaca

SEQ ID NO: 25217 - RNA, 11 nt, Homo sapiens
aaaagacauaa

SEQ ID NO: 25218 - RNA, 15 nt, Homo sapiens
auauccugugacugu

SEQ ID NO: 25219 - RNA, 19 nt, Homo sapiens
gcuuuccguggcacugcau

SEQ ID NO: 25220 - RNA, 19 nt, Homo sapiens
ccagugagacagcucugca

SEQ ID NO: 25221 - RNA, 14 nt, Homo sapiens
gcagggacuugaac

SEQ ID NO: 25222 - RNA, 20 nt, Homo sapiens
ugagagcccuucaugcauuu

SEQ ID NO: 25223 - RNA, 15 nt, Homo sapiens
gaccugacagcccaa

SEQ ID NO: 25224 - RNA, 21 nt, Homo sapiens
uccugguuccuaggugagcag

SEQ ID NO: 25225 - RNA, 17 nt, Homo sapiens
gaaugagaagaaugacu

SEQ ID NO: 25226 - RNA, 17 nt, Homo sapiens
aggauagagugggacag

SEQ ID NO: 25227 - RNA, 20 nt, Homo sapiens
gagugacuuaguguacauga

SEQ ID NO: 25228 - RNA, 18 nt, Homo sapiens
agacgggguuugccaugc

SEQ ID NO: 25229 - RNA, 16 nt, Homo sapiens
guaacuggcaguuuuc

SEQ ID NO: 25230 - RNA, 15 nt, Homo sapiens
gauaucaugccccug

SEQ ID NO: 25231 - RNA, 17 nt, Homo sapiens
caucuuggucacauaca

SEQ ID NO: 25232 - RNA, 14 nt, Homo sapiens
gaaagaggaaugaa

SEQ ID NO: 25233 - RNA, 17 nt, Homo sapiens
auuugccaauuuacuuu

SEQ ID NO: 25234 - RNA, 17 nt, Homo sapiens
cccuucauguacaucca

SEQ ID NO: 25235 - RNA, 18 nt, Homo sapiens
ucugauuuuccuggacag

SEQ ID NO: 25236 - RNA, 15 nt, Homo sapiens
caaggcuuuaucuca

SEQ ID NO: 25237 - RNA, 19 nt, Homo sapiens
gcucccuggaagagaucaa

SEQ ID NO: 25238 - RNA, 20 nt, Homo sapiens
cacagcugaacuuguugaga

SEQ ID NO: 25239 - RNA, 20 nt, Homo sapiens
ucuugggaauuuucuuccaa

SEQ ID NO: 25240 - RNA, 18 nt, Homo sapiens
aagccaucggagcugcua

SEQ ID NO: 25241 - RNA, 19 nt, Homo sapiens
uuaaaauuaucaauaucua

SEQ ID NO: 25242 - RNA, 13 nt, Homo sapiens
agacucugucuca

SEQ ID NO: 25243 - RNA, 18 nt, Homo sapiens
ucucgaacugcuggauuc

SEQ ID NO: 25244 - RNA, 14 nt, Homo sapiens
aagaaauucugcaa

SEQ ID NO: 25245 - RNA, 15 nt, Homo sapiens
ucagggagcauuuau

SEQ ID NO: 25246 - RNA, 20 nt, Homo sapiens
uaucuaauauauaugaauaa

SEQ ID NO: 25247 - RNA, 20 nt, Homo sapiens
cuagcaaauguuaugcauaa

SEQ ID NO: 25248 - RNA, 18 nt, Homo sapiens
guguuuuucacauuugcg

SEQ ID NO: 25249 - RNA, 23 nt, Homo sapiens
agauuuuguuuuuaaacuggaaa

SEQ ID NO: 25250 - RNA, 23 nt, Homo sapiens
aaagcagggacuugaacccauau

SEQ ID NO: 25251 - RNA, 20 nt, Homo sapiens
gcccaucuccgucucccaaa

SEQ ID NO: 25252 - RNA, 18 nt, Homo sapiens
aaguuuaugcauacagua

SEQ ID NO: 25253 - RNA, 14 nt, Homo sapiens
uacaaggcuuuauc

SEQ ID NO: 25254 - RNA, 20 nt, Homo sapiens
caacuugaauaauacaccag

SEQ ID NO: 25255 - RNA, 14 nt, Homo sapiens
aucaaccaaaugga

SEQ ID NO: 25256 - RNA, 21 nt, Homo sapiens
ugaauaaaguguaaguucaca

SEQ ID NO: 25257 - RNA, 15 nt, Homo sapiens
uagccacuucacuuu

SEQ ID NO: 25258 - RNA, 19 nt, Homo sapiens
acaagacccaaaaggcaga

SEQ ID NO: 25259 - RNA, 14 nt, Homo sapiens
uaaaguacagacuu

SEQ ID NO: 25260 - RNA, 19 nt, Homo sapiens
auucacaagacccaaaagg

SEQ ID NO: 25261 - RNA, 14 nt, Homo sapiens
gaagcaacccaaau

SEQ ID NO: 25262 - RNA, 23 nt, Homo sapiens
aagauguagaggagaaacuggaa

SEQ ID NO: 25263 - RNA, 19 nt, Homo sapiens
aaguauccuucagccugaa

SEQ ID NO: 25264 - RNA, 19 nt, Homo sapiens
cugagcagucagaagaccu

SEQ ID NO: 25265 - RNA, 21 nt, Homo sapiens
uuauuaccucugauaccucaa

SEQ ID NO: 25266 - RNA, 22 nt, Homo sapiens
aagagaauauuagcuuuacugu

SEQ ID NO: 25267 - RNA, 19 nt, Homo sapiens
acagccaggcggcuggaau

SEQ ID NO: 25268 - RNA, 18 nt, Homo sapiens
guucuucuuggucucagu

SEQ ID NO: 25269 - RNA, 12 nt, Homo sapiens
uuaccucugaua

SEQ ID NO: 25270 - RNA, 23 nt, Homo sapiens
aagaaauucugcaagcuuuucaa

SEQ ID NO: 25271 - RNA, 20 nt, Homo sapiens
cagagguugcagugagccga

SEQ ID NO: 25272 - RNA, 19 nt, Homo sapiens
cuacuugggaggcugaggc

SEQ ID NO: 25273 - RNA, 14 nt, Homo sapiens
agugggacaguucc

SEQ ID NO: 25274 - RNA, 22 nt, Homo sapiens
cccccauuguggucacaggaag

SEQ ID NO: 25275 - RNA, 22 nt, Homo sapiens
ccucaucuguaaaauggagaca

SEQ ID NO: 25276 - RNA, 16 nt, Homo sapiens
acaucaguuacucuga

SEQ ID NO: 25277 - RNA, 15 nt, Homo sapiens
gcccuucaugcauuu

SEQ ID NO: 25278 - RNA, 23 nt, Homo sapiens
gcaaaugcuguauucuucuuugg

SEQ ID NO: 25279 - RNA, 16 nt, Homo sapiens
gaucucacaagcacuu

SEQ ID NO: 25280 - RNA, 22 nt, Homo sapiens
uuaauaaaccauuuuuacuugg

SEQ ID NO: 25281 - RNA, 14 nt, Homo sapiens
auaaauggacaaau

SEQ ID NO: 25282 - RNA, 19 nt, Homo sapiens
ugaacacuuauaagugaag

SEQ ID NO: 25283 - RNA, 11 nt, Homo sapiens
ccuugagaaac

SEQ ID NO: 25284 - RNA, 19 nt, Homo sapiens
cacuuuaacacagugucug

SEQ ID NO: 25285 - RNA, 18 nt, Homo sapiens
uguucacuuauugacuau

SEQ ID NO: 25286 - RNA, 15 nt, Homo sapiens
uuuccaaauucacaa

SEQ ID NO: 25287 - RNA, 21 nt, Homo sapiens
aacucaaggaaaucuguguca

SEQ ID NO: 25288 - RNA, 19 nt, Homo sapiens
accuuuggaugcacuuuau

SEQ ID NO: 25289 - RNA, 23 nt, Homo sapiens
gagcuugaaauagugucugauga

SEQ ID NO: 25290 - RNA, 17 nt, Homo sapiens
gacgggguuugccaugc

SEQ ID NO: 25291 - RNA, 16 nt, Homo sapiens
uccugagaccagccaa

SEQ ID NO: 25292 - RNA, 16 nt, Homo sapiens
agccagccuugcuccu

SEQ ID NO: 25293 - RNA, 15 nt, Homo sapiens
uguguucaguacaau

SEQ ID NO: 25294 - RNA, 20 nt, Homo sapiens
gcaaccuccaccuucugggu

SEQ ID NO: 25295 - RNA, 12 nt, Homo sapiens
cagccaaccugg

SEQ ID NO: 25296 - RNA, 19 nt, Homo sapiens
acuuuaacacagugucugg

SEQ ID NO: 25297 - RNA, 23 nt, Homo sapiens
guauuuuauuacaucuuucacau

SEQ ID NO: 25298 - RNA, 16 nt, Homo sapiens
gucucaguccaugaag

SEQ ID NO: 25299 - RNA, 13 nt, Homo sapiens
uagaauuuauuca

SEQ ID NO: 25300 - RNA, 12 nt, Homo sapiens
aucuacacucca

SEQ ID NO: 25301 - RNA, 18 nt, Homo sapiens
uucugucuggacuuucca

SEQ ID NO: 25302 - RNA, 15 nt, Homo sapiens
gaagcuuccauucca

SEQ ID NO: 25303 - RNA, 17 nt, Homo sapiens
cuguaaaauggagacac

SEQ ID NO: 25304 - RNA, 17 nt, Homo sapiens
acaaaccucaagccagc

SEQ ID NO: 25305 - RNA, 12 nt, Homo sapiens
ugcaauuccacu

SEQ ID NO: 25306 - RNA, 14 nt, Homo sapiens
ucucacaagcacuu

SEQ ID NO: 25307 - RNA, 14 nt, Homo sapiens
cuuggucucagugu

SEQ ID NO: 25308 - RNA, 16 nt, Homo sapiens
uuuauaaauggacaaa

SEQ ID NO: 25309 - RNA, 23 nt, Homo sapiens
aaucugagccagugcuuuaaugg

SEQ ID NO: 25310 - RNA, 19 nt, Homo sapiens
uugaaucccuuaaacucag

SEQ ID NO: 25311 - RNA, 17 nt, Homo sapiens
aaauucacaaguugugu

SEQ ID NO: 25312 - RNA, 22 nt, Homo sapiens
gaagaguggguuucacaaguga

SEQ ID NO: 25313 - RNA, 21 nt, Homo sapiens
guuauuuagggaacugcuuga

SEQ ID NO: 25314 - RNA, 12 nt, Homo sapiens
uuauuaccucug

SEQ ID NO: 25315 - RNA, 23 nt, Homo sapiens
gaugaaaacauagcaucucagga

SEQ ID NO: 25316 - RNA, 18 nt, Homo sapiens
ggacuugggcgggacaca

SEQ ID NO: 25317 - RNA, 17 nt, Homo sapiens
aauauuugcaagacaua

SEQ ID NO: 25318 - RNA, 15 nt, Homo sapiens
cuucuuggucucagu

SEQ ID NO: 25319 - RNA, 16 nt, Homo sapiens
cugccccugagcccau

SEQ ID NO: 25320 - RNA, 15 nt, Homo sapiens
gaggagaaacuggaa

SEQ ID NO: 25321 - RNA, 20 nt, Homo sapiens
aggcuggagugcaguggcgc

SEQ ID NO: 25322 - RNA, 23 nt, Homo sapiens
agaauuuucaaaaucaaauucca

SEQ ID NO: 25323 - RNA, 13 nt, Homo sapiens
aucaggacgagaa

SEQ ID NO: 25324 - RNA, 20 nt, Homo sapiens
aguuaggcuauucacaacca

SEQ ID NO: 25325 - RNA, 21 nt, Homo sapiens
uuguuuuaaaauuaaagcuaa

SEQ ID NO: 25326 - RNA, 18 nt, Homo sapiens
ccaaacuggagcuugaaa

SEQ ID NO: 25327 - RNA, 22 nt, Homo sapiens
acaguuuucugcuuuaauuuca

SEQ ID NO: 25328 - RNA, 18 nt, Homo sapiens
accaccacccuugccaug

SEQ ID NO: 25329 - RNA, 22 nt, Homo sapiens
uucuauuacgugcaauacuuca

SEQ ID NO: 25330 - RNA, 14 nt, Homo sapiens
gcaaaugcuguauu

SEQ ID NO: 25331 - RNA, 15 nt, Homo sapiens
acaggcgugagccac

SEQ ID NO: 25332 - RNA, 13 nt, Homo sapiens
gcgcagccaugug

SEQ ID NO: 25333 - RNA, 18 nt, Homo sapiens
auuuguuaaaauuaucaa

SEQ ID NO: 25334 - RNA, 14 nt, Homo sapiens
aauuaacacaugau

SEQ ID NO: 25335 - RNA, 22 nt, Homo sapiens
uccuagcgcagccaugugauua

SEQ ID NO: 25336 - RNA, 22 nt, Homo sapiens
ugaauaaaguguaaguucacaa

SEQ ID NO: 25337 - RNA, 13 nt, Homo sapiens
aauauuguugaca

SEQ ID NO: 25338 - RNA, 14 nt, Homo sapiens
uaugacacaucucu

SEQ ID NO: 25339 - RNA, 14 nt, Homo sapiens
ugagcgacagugag

SEQ ID NO: 25340 - RNA, 19 nt, Homo sapiens
uguagauaaacucagaaau

SEQ ID NO: 25341 - RNA, 14 nt, Homo sapiens
gacgaaccuugaaa

SEQ ID NO: 25342 - RNA, 14 nt, Homo sapiens
uccuauauccugug

SEQ ID NO: 25343 - RNA, 16 nt, Homo sapiens
uuaugaaacauuacag

SEQ ID NO: 25344 - RNA, 22 nt, Homo sapiens
uacucugaagggcaucaugcau

SEQ ID NO: 25345 - RNA, 15 nt, Homo sapiens
caggaaaaucugcac

SEQ ID NO: 25346 - RNA, 22 nt, Homo sapiens
augugucaggugacccugauga

SEQ ID NO: 25347 - RNA, 21 nt, Homo sapiens
acaaaaaaagcauuguaacuu

SEQ ID NO: 25348 - RNA, 22 nt, Homo sapiens
aggcagcaggauagagugggac

SEQ ID NO: 25349 - RNA, 18 nt, Homo sapiens
guuccuucacauccugug

SEQ ID NO: 25350 - RNA, 19 nt, Homo sapiens
uguguggcauuuucacuuu

SEQ ID NO: 25351 - RNA, 15 nt, Homo sapiens
guagccacuucacuu

SEQ ID NO: 25352 - RNA, 13 nt, Homo sapiens
uuuuucauuauug

SEQ ID NO: 25353 - RNA, 18 nt, Homo sapiens
augcaaccuuuggaugca

SEQ ID NO: 25354 - RNA, 14 nt, Homo sapiens
agcagaacagugau

SEQ ID NO: 25355 - RNA, 16 nt, Homo sapiens
uggaaaaaaaggaaga

SEQ ID NO: 25356 - RNA, 14 nt, Homo sapiens
aaaccucaagccag

SEQ ID NO: 25357 - RNA, 21 nt, Homo sapiens
ugaaaacauagcaucucagga

SEQ ID NO: 25358 - RNA, 16 nt, Homo sapiens
cuucaugcauuugcac

SEQ ID NO: 25359 - RNA, 23 nt, Homo sapiens
guagaaaaagcaguaacugacaa

SEQ ID NO: 25360 - RNA, 17 nt, Homo sapiens
caaaacuucagacauag

SEQ ID NO: 25361 - RNA, 19 nt, Homo sapiens
aaaauauuuuuaugugcaa

SEQ ID NO: 25362 - RNA, 13 nt, Homo sapiens
aauggcaugucag

SEQ ID NO: 25363 - RNA, 18 nt, Homo sapiens
cagaaauuuaauucaugu

SEQ ID NO: 25364 - RNA, 16 nt, Homo sapiens
aaagcagggacuugaa

SEQ ID NO: 25365 - RNA, 19 nt, Homo sapiens
gggucucccucuguugcca

SEQ ID NO: 25366 - RNA, 19 nt, Homo sapiens
caagcuuuucaaaauugga

SEQ ID NO: 25367 - RNA, 19 nt, Homo sapiens
gguuugccaugcuggccag

SEQ ID NO: 25368 - RNA, 13 nt, Homo sapiens
ugcuaagugaaau

SEQ ID NO: 25369 - RNA, 16 nt, Homo sapiens
aacauuucaaaaggua

SEQ ID NO: 25370 - RNA, 15 nt, Homo sapiens
caagccucaugucca

SEQ ID NO: 25371 - RNA, 22 nt, Homo sapiens
ugccuggaucucacaagcacuu

SEQ ID NO: 25372 - RNA, 12 nt, Homo sapiens
uauauccuguga

SEQ ID NO: 25373 - RNA, 13 nt, Homo sapiens
caacugugacugu

SEQ ID NO: 25374 - RNA, 16 nt, Homo sapiens
uucaugcauuugcacu

SEQ ID NO: 25375 - RNA, 18 nt, Homo sapiens
aaccacuucauucuugaa

SEQ ID NO: 25376 - RNA, 21 nt, Homo sapiens
cuuccaaacagaacuauggaa

SEQ ID NO: 25377 - RNA, 18 nt, Homo sapiens
aaaucuacacuccaguga

SEQ ID NO: 25378 - RNA, 22 nt, Homo sapiens
aucuuuuauacagugucuuaca

SEQ ID NO: 25379 - RNA, 15 nt, Homo sapiens
ggaauuuucuuccaa

SEQ ID NO: 25380 - RNA, 16 nt, Homo sapiens
gugaaguauacuguau

SEQ ID NO: 25381 - RNA, 16 nt, Homo sapiens
aauaaaaugagcaaaa

SEQ ID NO: 25382 - RNA, 10 nt, Homo sapiens
cauacugcug

SEQ ID NO: 25383 - RNA, 20 nt, Homo sapiens
auugugccccugcacuccag

SEQ ID NO: 25384 - RNA, 14 nt, Homo sapiens
ugaugaauguuaaa

SEQ ID NO: 25385 - RNA, 19 nt, Homo sapiens
aaagcagggacuugaaccc

SEQ ID NO: 25386 - RNA, 21 nt, Homo sapiens
cucuauagacucuaggacaua

SEQ ID NO: 25387 - RNA, 17 nt, Homo sapiens
aguuacugccgguuuga

SEQ ID NO: 25388 - RNA, 22 nt, Homo sapiens
auuuuguuuuuaaacuggaaau

SEQ ID NO: 25389 - RNA, 18 nt, Homo sapiens
uaaaauuaucaauaucua

SEQ ID NO: 25390 - RNA, 16 nt, Homo sapiens
cuuccucagcuguaga

SEQ ID NO: 25391 - RNA, 19 nt, Homo sapiens
aaucaaauuccagaaugau

SEQ ID NO: 25392 - RNA, 18 nt, Homo sapiens
auaucaguccucuuucaa

SEQ ID NO: 25393 - RNA, 18 nt, Homo sapiens
ugauccugcaauuccacu

SEQ ID NO: 25394 - RNA, 17 nt, Homo sapiens
auccugugacugucuca

SEQ ID NO: 25395 - RNA, 17 nt, Homo sapiens
aggcuagaaccaccugc

SEQ ID NO: 25396 - RNA, 21 nt, Homo sapiens
cuuguuuuuccacuacugcua

SEQ ID NO: 25397 - RNA, 18 nt, Homo sapiens
gagacgggguuugccaug

SEQ ID NO: 25398 - RNA, 14 nt, Homo sapiens
ccgaagucuuccau

SEQ ID NO: 25399 - RNA, 16 nt, Homo sapiens
gaggcugaggcaagag

SEQ ID NO: 25400 - RNA, 15 nt, Homo sapiens
uggauucaagugauc

SEQ ID NO: 25401 - RNA, 22 nt, Homo sapiens
uguuagcaaaauggauaugaca

SEQ ID NO: 25402 - RNA, 13 nt, Homo sapiens
caauuccucuggg

SEQ ID NO: 25403 - RNA, 23 nt, Homo sapiens
ccuuaaacucagggagcauuuau

SEQ ID NO: 25404 - RNA, 22 nt, Homo sapiens
uaaaauauuuuuaugugcaaua

SEQ ID NO: 25405 - RNA, 22 nt, Homo sapiens
aguauaaauaaaaugagcaaaa

SEQ ID NO: 25406 - RNA, 19 nt, Homo sapiens
uagagaaauuugccaauuu

SEQ ID NO: 25407 - RNA, 18 nt, Homo sapiens
gaauaaauaaauguaucu

SEQ ID NO: 25408 - RNA, 17 nt, Homo sapiens
augaggaauauuugcaa

SEQ ID NO: 25409 - RNA, 21 nt, Homo sapiens
gugaccugacagcccaagggu

SEQ ID NO: 25410 - RNA, 16 nt, Homo sapiens
gacugucucacuuaau

SEQ ID NO: 25411 - RNA, 22 nt, Homo sapiens
ugucuugggaauuuucuuccaa

SEQ ID NO: 25412 - RNA, 22 nt, Homo sapiens
uccugagaccagccaaccuggg

SEQ ID NO: 25413 - RNA, 20 nt, Homo sapiens
cuacuugggaggcugaggca

SEQ ID NO: 25414 - RNA, 18 nt, Homo sapiens
ugccuugguauagcauau

SEQ ID NO: 25415 - RNA, 19 nt, Homo sapiens
agcuugaaauagugucuga

SEQ ID NO: 25416 - RNA, 19 nt, Homo sapiens
auuacgugcaauacuucaa

SEQ ID NO: 25417 - RNA, 18 nt, Homo sapiens
aguagauaugaggcauuu

SEQ ID NO: 25418 - RNA, 18 nt, Homo sapiens
uuguaaaauggugugacc

SEQ ID NO: 25419 - RNA, 13 nt, Homo sapiens
gagcgacagugag

SEQ ID NO: 25420 - RNA, 15 nt, Homo sapiens
ggauagagugggaca

SEQ ID NO: 25421 - RNA, 15 nt, Homo sapiens
agcugaauacauucu

SEQ ID NO: 25422 - RNA, 20 nt, Homo sapiens
ggaggcagagguugcaguga

SEQ ID NO: 25423 - RNA, 16 nt, Homo sapiens
uggguucaagcgauuc

SEQ ID NO: 25424 - RNA, 18 nt, Homo sapiens
uuaugaaacauuacaguu

SEQ ID NO: 25425 - RNA, 18 nt, Homo sapiens
cauagcagcuuauucaca

SEQ ID NO: 25426 - RNA, 16 nt, Homo sapiens
ucucgaacugcuggau

SEQ ID NO: 25427 - RNA, 11 nt, Homo sapiens
ugcaagcuuuu

SEQ ID NO: 25428 - RNA, 19 nt, Homo sapiens
cacuaaauugacacuuaaa

SEQ ID NO: 25429 - RNA, 12 nt, Homo sapiens
aaaaaagccaaa

SEQ ID NO: 25430 - RNA, 14 nt, Homo sapiens
uggccagaagucaa

SEQ ID NO: 25431 - RNA, 16 nt, Homo sapiens
uccccaaccacuucau

SEQ ID NO: 25432 - RNA, 23 nt, Homo sapiens
aucggaucuggggcucugggaua

SEQ ID NO: 25433 - RNA, 19 nt, Homo sapiens
gccaaggcuggagugcagu

SEQ ID NO: 25434 - RNA, 15 nt, Homo sapiens
gcagauaaacaguag

SEQ ID NO: 25435 - RNA, 17 nt, Homo sapiens
caaacagaacuauggaa

SEQ ID NO: 25436 - RNA, 19 nt, Homo sapiens
augaauuuuuuucaucuuc

SEQ ID NO: 25437 - RNA, 13 nt, Homo sapiens
gugacuggccugc

SEQ ID NO: 25438 - RNA, 12 nt, Homo sapiens
gagcgacaguga

SEQ ID NO: 25439 - RNA, 20 nt, Homo sapiens
cauauguuuuuguaaguuua

SEQ ID NO: 25440 - RNA, 17 nt, Homo sapiens
ggcuuuagggaccugcu

SEQ ID NO: 25441 - RNA, 20 nt, Homo sapiens
gugauuacccucugggucuc

SEQ ID NO: 25442 - RNA, 13 nt, Homo sapiens
uaaguaauuucag

SEQ ID NO: 25443 - RNA, 16 nt, Homo sapiens
auucacaagacccaaa

SEQ ID NO: 25444 - RNA, 18 nt, Homo sapiens
caagugauccgcccaucu

SEQ ID NO: 25445 - RNA, 22 nt, Homo sapiens
gaaagcuguggccagcuuguua

SEQ ID NO: 25446 - RNA, 21 nt, Homo sapiens
uugaagaugcuuguauuuuac

SEQ ID NO: 25447 - RNA, 16 nt, Homo sapiens
aauagugucugaugaa

SEQ ID NO: 25448 - RNA, 14 nt, Homo sapiens
ugcauuugcacuau

SEQ ID NO: 25449 - RNA, 23 nt, Homo sapiens
aaggcuuagacccucaugcugcc

SEQ ID NO: 25450 - RNA, 14 nt, Homo sapiens
ucaccuuccagugu

SEQ ID NO: 25451 - RNA, 17 nt, Homo sapiens
auuuauuaccucugaua

SEQ ID NO: 25452 - RNA, 13 nt, Homo sapiens
acccuugccaugg

SEQ ID NO: 25453 - RNA, 21 nt, Homo sapiens
ucauuuccuauguaacugcau

SEQ ID NO: 25454 - RNA, 18 nt, Homo sapiens
guuuaaugggcacagggu

SEQ ID NO: 25455 - RNA, 21 nt, Homo sapiens
uaaauaaauguaucuuauuca

SEQ ID NO: 25456 - RNA, 13 nt, Homo sapiens
cuuaaaauguaau

SEQ ID NO: 25457 - RNA, 20 nt, Homo sapiens
gggaggcagagguugcagug

SEQ ID NO: 25458 - RNA, 16 nt, Homo sapiens
cagagaccaguauucc

SEQ ID NO: 25459 - RNA, 21 nt, Homo sapiens
gugcuuuccguggcacugcau

SEQ ID NO: 25460 - RNA, 21 nt, Homo sapiens
cucugugaacgauuuagaaag

SEQ ID NO: 25461 - RNA, 17 nt, Homo sapiens
aagcagaacagugauua

SEQ ID NO: 25462 - RNA, 14 nt, Homo sapiens
augaaaaugaauau

SEQ ID NO: 25463 - RNA, 19 nt, Homo sapiens
uaaacacuaaaaaggcaug

SEQ ID NO: 25464 - RNA, 23 nt, Homo sapiens
ucaucugugauucccuccugcua

SEQ ID NO: 25465 - RNA, 15 nt, Homo sapiens
ggagaaucacuugaa

SEQ ID NO: 25466 - RNA, 21 nt, Homo sapiens
gcgcaaucuuaacucauugca

SEQ ID NO: 25467 - RNA, 21 nt, Homo sapiens
gaaguauccuucagccugaaa

SEQ ID NO: 25468 - RNA, 22 nt, Homo sapiens
gaccaauaaccaugcccaagaa

SEQ ID NO: 25469 - RNA, 13 nt, Homo sapiens
aguacagacuuuu

SEQ ID NO: 25470 - RNA, 23 nt, Homo sapiens
cauacaauuauuuuuacaguucu

SEQ ID NO: 25471 - RNA, 22 nt, Homo sapiens
auucaccuuccagugucucgga

SEQ ID NO: 25472 - RNA, 17 nt, Homo sapiens
agagacgggguuugcca

SEQ ID NO: 25473 - RNA, 18 nt, Homo sapiens
ucugccuugguauagcau

SEQ ID NO: 25474 - RNA, 14 nt, Homo sapiens
cugcuuuaauuuca

SEQ ID NO: 25475 - RNA, 13 nt, Homo sapiens
aggucuccaaaau

SEQ ID NO: 25476 - RNA, 21 nt, Homo sapiens
ucaucuguaaaauggagacac

SEQ ID NO: 25477 - RNA, 15 nt, Homo sapiens
caggcuccaaacugg

SEQ ID NO: 25478 - RNA, 15 nt, Homo sapiens
aaucccagcuacuug

SEQ ID NO: 25479 - RNA, 18 nt, Homo sapiens
cuggcuggggccuguuga

SEQ ID NO: 25480 - RNA, 12 nt, Homo sapiens
uaacuagaauuu

SEQ ID NO: 25481 - RNA, 14 nt, Homo sapiens
aauaaaagcacuua

SEQ ID NO: 25482 - RNA, 16 nt, Homo sapiens
cacgccuguaauccca

SEQ ID NO: 25483 - RNA, 16 nt, Homo sapiens
auuuccaaauucacaa

SEQ ID NO: 25484 - RNA, 18 nt, Homo sapiens
aacucauugcaaccucca

SEQ ID NO: 25485 - RNA, 22 nt, Homo sapiens
cugaugaaaacauagcaucuca

SEQ ID NO: 25486 - RNA, 15 nt, Homo sapiens
guggaugauguuucg

SEQ ID NO: 25487 - RNA, 23 nt, Homo sapiens
uccugcuacucuguuccuucaca

SEQ ID NO: 25488 - RNA, 18 nt, Homo sapiens
cucaaaacuucagacaua

SEQ ID NO: 25489 - RNA, 14 nt, Homo sapiens
ggugacagagcaag

SEQ ID NO: 25490 - RNA, 21 nt, Homo sapiens
gcaugucagacagaacuugaa

SEQ ID NO: 25491 - RNA, 13 nt, Homo sapiens
uguugauagcaag

SEQ ID NO: 25492 - RNA, 13 nt, Homo sapiens
cccaaaaggcaga

SEQ ID NO: 25493 - RNA, 22 nt, Homo sapiens
aacccggccugauuaaaguuaa

SEQ ID NO: 25494 - RNA, 14 nt, Homo sapiens
accagccaaccugg

SEQ ID NO: 25495 - RNA, 16 nt, Homo sapiens
auuuuucucuaacuca

SEQ ID NO: 25496 - RNA, 14 nt, Homo sapiens
aaacaguagugaua

SEQ ID NO: 25497 - RNA, 15 nt, Homo sapiens
agccaccaaacccgg

SEQ ID NO: 25498 - RNA, 18 nt, Homo sapiens
uaauuuuaaguaauuuca

SEQ ID NO: 25499 - RNA, 20 nt, Homo sapiens
aacccaggagauggaaguug

SEQ ID NO: 25500 - RNA, 21 nt, Homo sapiens
auccuaauaaaaaggugacca

SEQ ID NO: 25501 - RNA, 14 nt, Homo sapiens
gaaaaugugcaaua

SEQ ID NO: 25502 - RNA, 18 nt, Homo sapiens
ggaguuaggcuauucaca

SEQ ID NO: 25503 - RNA, 19 nt, Homo sapiens
uauuuauugagcaccugca

SEQ ID NO: 25504 - RNA, 20 nt, Homo sapiens
agaaggauguacauuuccaa

SEQ ID NO: 25505 - RNA, 20 nt, Homo sapiens
uauuuguacaccaauauuca

SEQ ID NO: 25506 - RNA, 16 nt, Homo sapiens
uucucuaacucagaaa

SEQ ID NO: 25507 - RNA, 18 nt, Homo sapiens
cuguuccuucacauccug

SEQ ID NO: 25508 - RNA, 22 nt, Homo sapiens
uugcuccuggcuggggccuguu

SEQ ID NO: 25509 - RNA, 17 nt, Homo sapiens
cuggacuuuccagagac

SEQ ID NO: 25510 - RNA, 13 nt, Homo sapiens
ucacaagcacuuu

SEQ ID NO: 25511 - RNA, 15 nt, Homo sapiens
gcugggaguggcaug

SEQ ID NO: 25512 - RNA, 15 nt, Homo sapiens
ucagacagaacuuga

SEQ ID NO: 25513 - RNA, 19 nt, Homo sapiens
cugucuggacuuuccagag

SEQ ID NO: 25514 - RNA, 22 nt, Homo sapiens
cuauauccugugacugucucac

SEQ ID NO: 25515 - RNA, 19 nt, Homo sapiens
uguaaucccagcuacuugg

SEQ ID NO: 25516 - RNA, 18 nt, Homo sapiens
aacuugaaugugucaggu

SEQ ID NO: 25517 - RNA, 17 nt, Homo sapiens
gaauauguaaauagaaa

SEQ ID NO: 25518 - RNA, 20 nt, Homo sapiens
caagcuuuucaaaauuggac

SEQ ID NO: 25519 - RNA, 21 nt, Homo sapiens
cugugauucccuccugcuacu

SEQ ID NO: 25520 - RNA, 11 nt, Homo sapiens
uacgugcaaua

SEQ ID NO: 25521 - RNA, 19 nt, Homo sapiens
cuuccaaacagaacuaugg

SEQ ID NO: 25522 - RNA, 14 nt, Homo sapiens
ugauuuuacaauug

SEQ ID NO: 25523 - RNA, 13 nt, Homo sapiens
gauaauaugagaa

SEQ ID NO: 25524 - RNA, 22 nt, Homo sapiens
agacuaugaggaauauuugcaa

SEQ ID NO: 25525 - RNA, 16 nt, Homo sapiens
ucagaagaaauucugc

SEQ ID NO: 25526 - RNA, 14 nt, Homo sapiens
aacugcauugagaa

SEQ ID NO: 25527 - RNA, 21 nt, Homo sapiens
uuacuauuuauugcugaauga

SEQ ID NO: 25528 - RNA, 15 nt, Homo sapiens
gacaucaacagauaa

SEQ ID NO: 25529 - RNA, 18 nt, Homo sapiens
ccuggcugggaguggcau

SEQ ID NO: 25530 - RNA, 23 nt, Homo sapiens
aaauauuguugacaacugugacu

SEQ ID NO: 25531 - RNA, 20 nt, Homo sapiens
auauauguguuuuucacauu

SEQ ID NO: 25532 - RNA, 15 nt, Homo sapiens
gcacuugggacaaaa

SEQ ID NO: 25533 - RNA, 22 nt, Homo sapiens
uggcaaaucucuauuaggaaau

SEQ ID NO: 25534 - RNA, 20 nt, Homo sapiens
uaaguugcaccaacuuugaa

SEQ ID NO: 25535 - RNA, 19 nt, Homo sapiens
acauccagauagguuacca

SEQ ID NO: 25536 - RNA, 17 nt, Homo sapiens
uuggaaaaugugcaaua

SEQ ID NO: 25537 - RNA, 21 nt, Homo sapiens
cggaucuggggcucugggaua

SEQ ID NO: 25538 - RNA, 13 nt, Homo sapiens
gaaauuaaccaua

SEQ ID NO: 25539 - RNA, 12 nt, Homo sapiens
aaucuacacucc

SEQ ID NO: 25540 - RNA, 23 nt, Homo sapiens
gaagagaauauuagcuuuacugu

SEQ ID NO: 25541 - RNA, 13 nt, Homo sapiens
cuggagcucugcc

SEQ ID NO: 25542 - RNA, 20 nt, Homo sapiens
accaaacccggccugauuaa

SEQ ID NO: 25543 - RNA, 20 nt, Homo sapiens
uaaaauauuuuuaugugcaa

SEQ ID NO: 25544 - RNA, 15 nt, Homo sapiens
auugagaacugcaua

SEQ ID NO: 25545 - RNA, 13 nt, Homo sapiens
ucugauaccucaa

SEQ ID NO: 25546 - RNA, 14 nt, Homo sapiens
auacuccuaguaau

SEQ ID NO: 25547 - RNA, 19 nt, Homo sapiens
gcacuuuaacacagugucu

SEQ ID NO: 25548 - RNA, 22 nt, Homo sapiens
cccaaaacugauacccuuugaa

SEQ ID NO: 25549 - RNA, 23 nt, Homo sapiens
gguuaccaguaacggaacaguau

SEQ ID NO: 25550 - RNA, 20 nt, Homo sapiens
auugagcaccugcaggcgug

SEQ ID NO: 25551 - RNA, 23 nt, Homo sapiens
auaucaugccccuguacuccagc

SEQ ID NO: 25552 - RNA, 19 nt, Homo sapiens
gcuggagugcaguggcgca

SEQ ID NO: 25553 - RNA, 16 nt, Homo sapiens
acuuaguguacaugaa

SEQ ID NO: 25554 - RNA, 23 nt, Homo sapiens
guuuccuagcgcagccaugugau

SEQ ID NO: 25555 - RNA, 21 nt, Homo sapiens
gagacaccaccacccuugcca

SEQ ID NO: 25556 - RNA, 19 nt, Homo sapiens
ugacuaauuaggcaaggcu

SEQ ID NO: 25557 - RNA, 18 nt, Homo sapiens
cucauuccccaaccacuu

SEQ ID NO: 25558 - RNA, 15 nt, Homo sapiens
cccugcacuccagcc

SEQ ID NO: 25559 - RNA, 17 nt, Homo sapiens
aagugauacuauccagu

SEQ ID NO: 25560 - RNA, 20 nt, Homo sapiens
ccaacuuugaagucugauuu

SEQ ID NO: 25561 - RNA, 21 nt, Homo sapiens
ucugucuggacuuuccagaga

SEQ ID NO: 25562 - RNA, 17 nt, Homo sapiens
uuccguggcacugcaua

SEQ ID NO: 25563 - RNA, 17 nt, Homo sapiens
ugccccugcacuccagc

SEQ ID NO: 25564 - RNA, 20 nt, Homo sapiens
uuuuagucuaauugaauccc

SEQ ID NO: 25565 - RNA, 13 nt, Homo sapiens
cucuuggugccuc

SEQ ID NO: 25566 - RNA, 14 nt, Homo sapiens
auaaauuugguucu

SEQ ID NO: 25567 - RNA, 19 nt, Homo sapiens
aagguauuuuaaucaccaa

SEQ ID NO: 25568 - RNA, 17 nt, Homo sapiens
cagucacauuccaagcc

SEQ ID NO: 25569 - RNA, 19 nt, Homo sapiens
auuccuauauccugugacu

SEQ ID NO: 25570 - RNA, 20 nt, Homo sapiens
uaaaauuaucaauaucuaau

SEQ ID NO: 25571 - RNA, 14 nt, Homo sapiens
gucucccaaagugc

SEQ ID NO: 25572 - RNA, 17 nt, Homo sapiens
uuuaauggcaugucaga

SEQ ID NO: 25573 - RNA, 23 nt, Homo sapiens
guucuucccuuuuacauacugcu

SEQ ID NO: 25574 - RNA, 17 nt, Homo sapiens
uaaauuugguucuaggc

SEQ ID NO: 25575 - RNA, 20 nt, Homo sapiens
cugucccugcagacaugaga

SEQ ID NO: 25576 - RNA, 20 nt, Homo sapiens
augaaaagauuaugaucuca

SEQ ID NO: 25577 - RNA, 20 nt, Homo sapiens
acauuacaguuagagauuuu

SEQ ID NO: 25578 - RNA, 17 nt, Homo sapiens
auacuucaauacuucau

SEQ ID NO: 25579 - RNA, 14 nt, Homo sapiens
cuuaaaaucuaauu

SEQ ID NO: 25580 - RNA, 23 nt, Homo sapiens
uuuuuccuuccuuaucacugaca

SEQ ID NO: 25581 - RNA, 13 nt, Homo sapiens
ucauguacaucca

SEQ ID NO: 25582 - RNA, 15 nt, Homo sapiens
ugacccugaugaaaa

SEQ ID NO: 25583 - RNA, 20 nt, Homo sapiens
aaccaaauggagugacuuag

SEQ ID NO: 25584 - RNA, 17 nt, Homo sapiens
uuguaaguuuaugcaua

SEQ ID NO: 25585 - RNA, 22 nt, Homo sapiens
uuucaugaaaagauuaugaucu

SEQ ID NO: 25586 - RNA, 15 nt, Homo sapiens
caauuccucugggaa

SEQ ID NO: 25587 - RNA, 17 nt, Homo sapiens
auuuuuagacucaucaa

SEQ ID NO: 25588 - RNA, 13 nt, Homo sapiens
cuaauuaggcaag

SEQ ID NO: 25589 - RNA, 14 nt, Homo sapiens
agacucugucucag

SEQ ID NO: 25590 - RNA, 17 nt, Homo sapiens
gaaaccuuauuguaccu

SEQ ID NO: 25591 - RNA, 20 nt, Homo sapiens
aaagauuucuugaguuuugu

SEQ ID NO: 25592 - RNA, 20 nt, Homo sapiens
ccuggacaguuuucugcuuu

SEQ ID NO: 25593 - RNA, 21 nt, Homo sapiens
uucaaaaucaaauuccagaau

SEQ ID NO: 25594 - RNA, 16 nt, Homo sapiens
aagcaaaaugugauau

SEQ ID NO: 25595 - RNA, 16 nt, Homo sapiens
auaugacacaucucug

SEQ ID NO: 25596 - RNA, 22 nt, Homo sapiens
aacccaaauguucaucaaugaa

SEQ ID NO: 25597 - RNA, 15 nt, Homo sapiens
cuugguauagcauau

SEQ ID NO: 25598 - RNA, 22 nt, Homo sapiens
aaucugaggccuccucucucag

SEQ ID NO: 25599 - RNA, 23 nt, Homo sapiens
auauuuuuuaugaaacauuacag

SEQ ID NO: 25600 - RNA, 18 nt, Homo sapiens
guuuuuccacuacugcua

SEQ ID NO: 25601 - RNA, 15 nt, Homo sapiens
ccauagagacuuugu

SEQ ID NO: 25602 - RNA, 20 nt, Homo sapiens
uaagcacuuuaacacagugu

SEQ ID NO: 25603 - RNA, 11 nt, Homo sapiens
cuuuaucucag

SEQ ID NO: 25604 - RNA, 18 nt, Homo sapiens
auauuuuuaugugcaaua

SEQ ID NO: 25605 - RNA, 21 nt, Homo sapiens
aaugagaagaaugacuaugca

SEQ ID NO: 25606 - RNA, 20 nt, Homo sapiens
cugaauacauucugcuuuca

SEQ ID NO: 25607 - RNA, 21 nt, Homo sapiens
cagccuggucaacauggugaa

SEQ ID NO: 25608 - RNA, 13 nt, Homo sapiens
cucacaagcacuu

SEQ ID NO: 25609 - RNA, 12 nt, Homo sapiens
aaaaugugcaau

SEQ ID NO: 25610 - RNA, 15 nt, Homo sapiens
cugagcgacagugag

SEQ ID NO: 25611 - RNA, 19 nt, Homo sapiens
uacaaggcuuuaucucagg

SEQ ID NO: 25612 - RNA, 21 nt, Homo sapiens
auauuguugacaacugugacu

SEQ ID NO: 25613 - RNA, 14 nt, Homo sapiens
ggugugaccacugc

SEQ ID NO: 25614 - RNA, 23 nt, Homo sapiens
gaaagcuugcccuggugccucac

SEQ ID NO: 25615 - RNA, 17 nt, Homo sapiens
gaacgguaaauuucugu

SEQ ID NO: 25616 - RNA, 22 nt, Homo sapiens
agaguucugucuggacuuucca

SEQ ID NO: 25617 - RNA, 14 nt, Homo sapiens
ucacauccuguguu

SEQ ID NO: 25618 - RNA, 17 nt, Homo sapiens
uguaaguuuaugcauac

SEQ ID NO: 25619 - RNA, 18 nt, Homo sapiens
cugcuggauucaagugau

SEQ ID NO: 25620 - RNA, 17 nt, Homo sapiens
ccuggucaacaugguga

SEQ ID NO: 25621 - RNA, 21 nt, Homo sapiens
uguauauuuuauaucaauuua

SEQ ID NO: 25622 - RNA, 12 nt, Homo sapiens
ucuguaaucuuc

SEQ ID NO: 25623 - RNA, 23 nt, Homo sapiens
gagcaccugcaggcgugaccuga

SEQ ID NO: 25624 - RNA, 20 nt, Homo sapiens
gagaaaccuuauuguaccuc

SEQ ID NO: 25625 - RNA, 17 nt, Homo sapiens
uaacuagaauuuauuca

SEQ ID NO: 25626 - RNA, 18 nt, Homo sapiens
agauuguauagugcaugu

SEQ ID NO: 25627 - RNA, 14 nt, Homo sapiens
uguguuuuucacau

SEQ ID NO: 25628 - RNA, 18 nt, Homo sapiens
acaacuugaauaauacac

SEQ ID NO: 25629 - RNA, 20 nt, Homo sapiens
ccuggcuggggccuguugaa

SEQ ID NO: 25630 - RNA, 21 nt, Homo sapiens
auuacaaggcuuuaucucagg

SEQ ID NO: 25631 - RNA, 21 nt, Homo sapiens
aaagaaaaucaggcuggccaa

SEQ ID NO: 25632 - RNA, 14 nt, Homo sapiens
aacagaagcuucca

SEQ ID NO: 25633 - RNA, 16 nt, Homo sapiens
ccauagagacuuugug

SEQ ID NO: 25634 - RNA, 23 nt, Homo sapiens
ucacauuccaagccucaugucca

SEQ ID NO: 25635 - RNA, 17 nt, Homo sapiens
gaguucugucuggacuu

SEQ ID NO: 25636 - RNA, 16 nt, Homo sapiens
gcacuuuaaacauuua

SEQ ID NO: 25637 - RNA, 12 nt, Homo sapiens
agccccaaaagg

SEQ ID NO: 25638 - RNA, 19 nt, Homo sapiens
aauauauuuuuagacucau

SEQ ID NO: 25639 - RNA, 17 nt, Homo sapiens
agccccgggaguggcgc

SEQ ID NO: 25640 - RNA, 16 nt, Homo sapiens
uuauuacaucuuucac

SEQ ID NO: 25641 - RNA, 13 nt, Homo sapiens
uggcacuugggac

SEQ ID NO: 25642 - RNA, 16 nt, Homo sapiens
uggcugggaguggcau

SEQ ID NO: 25643 - RNA, 17 nt, Homo sapiens
uggcugggaguggcaug

SEQ ID NO: 25644 - RNA, 23 nt, Homo sapiens
uggcuaguaucaaaagaaagaaa

SEQ ID NO: 25645 - RNA, 21 nt, Homo sapiens
ugggauagcugacccagcccc

SEQ ID NO: 25646 - RNA, 15 nt, Homo sapiens
ugggguggguggggc

SEQ ID NO: 25647 - RNA, 16 nt, Homo sapiens
uggggcagugcuuggc

SEQ ID NO: 25648 - RNA, 18 nt, Homo sapiens
uggugcuuccaaauauug

SEQ ID NO: 25649 - RNA, 17 nt, Homo sapiens
uggguuucacaagugaa

SEQ ID NO: 25650 - RNA, 16 nt, Homo sapiens
uggguggggcagugcu

SEQ ID NO: 25651 - RNA, 21 nt, Homo sapiens
uggguggggcagugcuuggcc

SEQ ID NO: 25652 - RNA, 23 nt, Homo sapiens
uguguuugauauccaaagcugaa

SEQ ID NO: 25653 - RNA, 17 nt, Homo sapiens
uggcgcgcgccaccacg

SEQ ID NO: 25654 - RNA, 22 nt, Homo sapiens
uggcccaggaguuuggccagaa

SEQ ID NO: 25655 - RNA, 21 nt, Homo sapiens
uggcccaggaguuuggccaga

SEQ ID NO: 25656 - RNA, 17 nt, Homo sapiens
uggcccaggaguuuggc

SEQ ID NO: 25657 - RNA, 20 nt, Homo sapiens
uggcccaggaguuuggccag

SEQ ID NO: 25658 - RNA, 18 nt, Homo sapiens
uggccagaagucaaggcu

SEQ ID NO: 25659 - RNA, 19 nt, Homo sapiens
uggccagaagucaaggcuu

SEQ ID NO: 25660 - RNA, 20 nt, Homo sapiens
uggccagaagucaaggcuua

SEQ ID NO: 25661 - RNA, 21 nt, Homo sapiens
uggagcucugcccauccugcc

SEQ ID NO: 25662 - RNA, 17 nt, Homo sapiens
uggagugcaguggcgca

SEQ ID NO: 25663 - RNA, 18 nt, Homo sapiens
uggagugcaguggcgcaa

SEQ ID NO: 25664 - RNA, 21 nt, Homo sapiens
ugcugggaauuacaggcguga

SEQ ID NO: 25665 - RNA, 14 nt, Homo sapiens
uugggaggcugagg

SEQ ID NO: 25666 - RNA, 15 nt, Homo sapiens
uugggaggcugaggc

SEQ ID NO: 25667 - RNA, 18 nt, Homo sapiens
uuggcccaggaguuuggc

SEQ ID NO: 25668 - RNA, 20 nt, Homo sapiens
uugguucuaauagaacucag

SEQ ID NO: 25669 - RNA, 21 nt, Homo sapiens
uuuaaaaaaaaaccugagccc

SEQ ID NO: 25670 - RNA, 17 nt, Homo sapiens
uuugguucuaggccggg

SEQ ID NO: 25671 - RNA, 16 nt, Homo sapiens
uugcuggagcucugcc

SEQ ID NO: 25672 - RNA, 17 nt, Homo sapiens
uugcuggagcucugccc

SEQ ID NO: 25673 - RNA, 13 nt, Homo sapiens
uugccaugcuggc

SEQ ID NO: 25674 - RNA, 20 nt, Homo sapiens
uugccaugcuggccaggcug

SEQ ID NO: 25675 - RNA, 20 nt, Homo sapiens
uugacccacaagaaaugaaa

SEQ ID NO: 25676 - RNA, 12 nt, Homo sapiens
uugagcaccugc

SEQ ID NO: 25677 - RNA, 23 nt, Homo sapiens
uucugcagauaaacaguagugau

SEQ ID NO: 25678 - RNA, 14 nt, Homo sapiens
uucuagggaaauga

SEQ ID NO: 25679 - RNA, 15 nt, Homo sapiens
uucccugccuggauc

SEQ ID NO: 25680 - RNA, 13 nt, Homo sapiens
uuccuagcgcagc

SEQ ID NO: 25681 - RNA, 15 nt, Homo sapiens
uuagacccucaugcu

SEQ ID NO: 25682 - RNA, 16 nt, Homo sapiens
uucacaggggacagga

SEQ ID NO: 25683 - RNA, 10 nt, Homo sapiens
uuagccgggc

SEQ ID NO: 25684 - RNA, 12 nt, Homo sapiens
uuagccgggcau

SEQ ID NO: 25685 - RNA, 12 nt, Homo sapiens
uuagccgggcgu

SEQ ID NO: 25686 - RNA, 13 nt, Homo sapiens
uuagccgggcgug

SEQ ID NO: 25687 - RNA, 18 nt, Homo sapiens
uuagccgggcgugguggu

SEQ ID NO: 25688 - RNA, 21 nt, Homo sapiens
uuagccgggcgugguggugag

SEQ ID NO: 25689 - RNA, 15 nt, Homo sapiens
uuaccugggaaaggg

SEQ ID NO: 25690 - RNA, 14 nt, Homo sapiens
uguugccaaggcug

SEQ ID NO: 25691 - RNA, 23 nt, Homo sapiens
uguuuacaaaccucaagccagcc

SEQ ID NO: 25692 - RNA, 17 nt, Homo sapiens
uguugacaugggacauu

SEQ ID NO: 25693 - RNA, 19 nt, Homo sapiens
uagacccucaugcugccaa

SEQ ID NO: 25694 - RNA, 22 nt, Homo sapiens
uagccgggcaugguggcgcgca

SEQ ID NO: 25695 - RNA, 16 nt, Homo sapiens
uaguaauuggaaaggc

SEQ ID NO: 25696 - RNA, 17 nt, Homo sapiens
uaguaauuggaaaggca

SEQ ID NO: 25697 - RNA, 23 nt, Homo sapiens
uauccuaauaaaaaggugaccau

SEQ ID NO: 25698 - RNA, 19 nt, Homo sapiens
uaucuaauauauaugaaua

SEQ ID NO: 25699 - RNA, 16 nt, Homo sapiens
guuuccauagggugac

SEQ ID NO: 25700 - RNA, 17 nt, Homo sapiens
guuuccauagggugaca

SEQ ID NO: 25701 - RNA, 23 nt, Homo sapiens
guuugccaugcuggccaggcugg

SEQ ID NO: 25702 - RNA, 17 nt, Homo sapiens
guuuuccuucucaucug

SEQ ID NO: 25703 - RNA, 15 nt, Homo sapiens
uaaugaaaaugaaua

SEQ ID NO: 25704 - RNA, 19 nt, Homo sapiens
uacaaaaauuagccgggca

SEQ ID NO: 25705 - RNA, 18 nt, Homo sapiens
uacaaaaauuagccgggc

SEQ ID NO: 25706 - RNA, 14 nt, Homo sapiens
uaaguuacauaagg

SEQ ID NO: 25707 - RNA, 18 nt, Homo sapiens
uaauagaauuaauggaau

SEQ ID NO: 25708 - RNA, 22 nt, Homo sapiens
ucaauauuuauuauuuucaccu

SEQ ID NO: 25709 - RNA, 23 nt, Homo sapiens
ucaauauuuauuauuuucaccug

SEQ ID NO: 25710 - RNA, 22 nt, Homo sapiens
ucacaggaaguagaggaggcca

SEQ ID NO: 25711 - RNA, 15 nt, Homo sapiens
ucaauuccucuggga

SEQ ID NO: 25712 - RNA, 16 nt, Homo sapiens
ucaaugaaugaaugaa

SEQ ID NO: 25713 - RNA, 17 nt, Homo sapiens
ucaaugaaugaaugaau

SEQ ID NO: 25714 - RNA, 23 nt, Homo sapiens
ucagccccgggaguggcgcgcgc

SEQ ID NO: 25715 - RNA, 22 nt, Homo sapiens
ucaggagauuucaugccuggug

SEQ ID NO: 25716 - RNA, 13 nt, Homo sapiens
ucacuugaugaua

SEQ ID NO: 25717 - RNA, 10 nt, Homo sapiens
uauuugagac

SEQ ID NO: 25718 - RNA, 22 nt, Homo sapiens
ucaaaagguauuuauugagcac

SEQ ID NO: 25719 - RNA, 23 nt, Homo sapiens
uauucagccccgggaguggcgcg

SEQ ID NO: 25720 - RNA, 19 nt, Homo sapiens
uauguucuaagaagugaaa

SEQ ID NO: 25721 - RNA, 19 nt, Homo sapiens
uccagugagacagcucugc

SEQ ID NO: 25722 - RNA, 15 nt, Homo sapiens
ucaucaaugaaugaa

SEQ ID NO: 25723 - RNA, 16 nt, Homo sapiens
ucaucaaugaaugaau

SEQ ID NO: 25724 - RNA, 20 nt, Homo sapiens
ucaucaaugaaugaaugaau

SEQ ID NO: 25725 - RNA, 16 nt, Homo sapiens
ucaggugacccugaug

SEQ ID NO: 25726 - RNA, 19 nt, Homo sapiens
ucaggugacccugaugaaa

SEQ ID NO: 25727 - RNA, 18 nt, Homo sapiens
ucauucuugaaagcugug

SEQ ID NO: 25728 - RNA, 20 nt, Homo sapiens
ugaccaauaaccaugcccaa

SEQ ID NO: 25729 - RNA, 14 nt, Homo sapiens
ugaauucccugccu

SEQ ID NO: 25730 - RNA, 17 nt, Homo sapiens
ugagcagucaggaaaga

SEQ ID NO: 25731 - RNA, 22 nt, Homo sapiens
ugagccaccaaacccggccuga

SEQ ID NO: 25732 - RNA, 15 nt, Homo sapiens
ugagaccagccaacc

SEQ ID NO: 25733 - RNA, 14 nt, Homo sapiens
ugacgugacuggcc

SEQ ID NO: 25734 - RNA, 19 nt, Homo sapiens
ugagguacugagagugaac

SEQ ID NO: 25735 - RNA, 16 nt, Homo sapiens
ugccuaagugcagccc

SEQ ID NO: 25736 - RNA, 23 nt, Homo sapiens
ugcuggauucaagugauccgccc

SEQ ID NO: 25737 - RNA, 20 nt, Homo sapiens
ugcuccuggcuggggccugu

SEQ ID NO: 25738 - RNA, 16 nt, Homo sapiens
ugccaugcuggccagg

SEQ ID NO: 25739 - RNA, 13 nt, Homo sapiens
ugcagugagccga

SEQ ID NO: 25740 - RNA, 17 nt, Homo sapiens
ugccaaggcuggagugc

SEQ ID NO: 25741 - RNA, 12 nt, Homo sapiens
ugcagugagccg

SEQ ID NO: 25742 - RNA, 20 nt, Homo sapiens
uccuaauaaaaaggugacca

SEQ ID NO: 25743 - RNA, 21 nt, Homo sapiens
uccuaauaaaaaggugaccau

SEQ ID NO: 25744 - RNA, 18 nt, Homo sapiens
uccuaggugagcagguga

SEQ ID NO: 25745 - RNA, 13 nt, Homo sapiens
ucccucuuggugc

SEQ ID NO: 25746 - RNA, 14 nt, Homo sapiens
ucccucuuggugcc

SEQ ID NO: 25747 - RNA, 17 nt, Homo sapiens
uccucaucuguaaaaug

SEQ ID NO: 25748 - RNA, 14 nt, Homo sapiens
ucgaacugcuggau

SEQ ID NO: 25749 - RNA, 17 nt, Homo sapiens
ucgccaucacagcugaa

SEQ ID NO: 25750 - RNA, 18 nt, Homo sapiens
ucucccaaagugcuggga

SEQ ID NO: 25751 - RNA, 20 nt, Homo sapiens
ucuccccaugauguuuagaa

SEQ ID NO: 25752 - RNA, 20 nt, Homo sapiens
ucucccucuguugccaaggc

SEQ ID NO: 25753 - RNA, 14 nt, Homo sapiens
ucuaggccgggcgc

SEQ ID NO: 25754 - RNA, 21 nt, Homo sapiens
ucggaucuggggcucugggau

SEQ ID NO: 25755 - RNA, 23 nt, Homo sapiens
ucugcccauccugccccugagcc

SEQ ID NO: 25756 - RNA, 17 nt, Homo sapiens
ucugauaccucaacccc

SEQ ID NO: 25757 - RNA, 13 nt, Homo sapiens
ucuggaaaccaca

SEQ ID NO: 25758 - RNA, 22 nt, Homo sapiens
ucugggauagcugacccagccc

SEQ ID NO: 25759 - RNA, 21 nt, Homo sapiens
gaccacgcuuucuagcuguug

SEQ ID NO: 25760 - RNA, 19 nt, Homo sapiens
gaccagccaaccugggggc

SEQ ID NO: 25761 - RNA, 14 nt, Homo sapiens
gacccucaugcugc

SEQ ID NO: 25762 - RNA, 17 nt, Homo sapiens
gacccucaugcugccaa

SEQ ID NO: 25763 - RNA, 14 nt, Homo sapiens
gacuggccugcugg

SEQ ID NO: 25764 - RNA, 15 nt, Homo sapiens
gacuggccugcugga

SEQ ID NO: 25765 - RNA, 12 nt, Homo sapiens
gagaagaaugac

SEQ ID NO: 25766 - RNA, 21 nt, Homo sapiens
gacgguuuaaugggcacaggg

SEQ ID NO: 25767 - RNA, 18 nt, Homo sapiens
gagaccagccaaccuggg

SEQ ID NO: 25768 - RNA, 22 nt, Homo sapiens
gagaaucagaucauuucaaaac

SEQ ID NO: 25769 - RNA, 22 nt, Homo sapiens
gaauugaauucccugccuggau

SEQ ID NO: 25770 - RNA, 15 nt, Homo sapiens
gaauuggagcucgug

SEQ ID NO: 25771 - RNA, 13 nt, Homo sapiens
gacaagcucacag

SEQ ID NO: 25772 - RNA, 17 nt, Homo sapiens
gacaagcucacagaccu

SEQ ID NO: 25773 - RNA, 11 nt, Homo sapiens
gacaccaccac

SEQ ID NO: 25774 - RNA, 17 nt, Homo sapiens
gacaccaccacccuugc

SEQ ID NO: 25775 - RNA, 13 nt, Homo sapiens
gacagaaagcaga

SEQ ID NO: 25776 - RNA, 19 nt, Homo sapiens
gacagaaagcagaacagug

SEQ ID NO: 25777 - RNA, 20 nt, Homo sapiens
gacaguuccugagaccagcc

SEQ ID NO: 25778 - RNA, 19 nt, Homo sapiens
gaauaucuauuaauauaug

SEQ ID NO: 25779 - RNA, 11 nt, Homo sapiens
gaacugcugga

SEQ ID NO: 25780 - RNA, 14 nt, Homo sapiens
gaagaaauuccagg

SEQ ID NO: 25781 - RNA, 12 nt, Homo sapiens
gaaccaccugcc

SEQ ID NO: 25782 - RNA, 18 nt, Homo sapiens
gaacaaauuuacagagac

SEQ ID NO: 25783 - RNA, 22 nt, Homo sapiens
gcacuuuaacacagugucuggc

SEQ ID NO: 25784 - RNA, 18 nt, Homo sapiens
gcagcaggauagaguggg

SEQ ID NO: 25785 - RNA, 16 nt, Homo sapiens
gcaauaaaauguauuu

SEQ ID NO: 25786 - RNA, 17 nt, Homo sapiens
gaucuggggcucuggga

SEQ ID NO: 25787 - RNA, 12 nt, Homo sapiens
gcaaccuccacc

SEQ ID NO: 25788 - RNA, 16 nt, Homo sapiens
gcaccuguaaucccag

SEQ ID NO: 25789 - RNA, 17 nt, Homo sapiens
gcaccuguaaucccagc

SEQ ID NO: 25790 - RNA, 13 nt, Homo sapiens
gaugauguuucgu

SEQ ID NO: 25791 - RNA, 23 nt, Homo sapiens
gcaaagacuaugaggaauauuug

SEQ ID NO: 25792 - RNA, 15 nt, Homo sapiens
gauuuguaauauuuc

SEQ ID NO: 25793 - RNA, 19 nt, Homo sapiens
gagcuguuuucccugaccu

SEQ ID NO: 25794 - RNA, 18 nt, Homo sapiens
gaggaauauuugcaagac

SEQ ID NO: 25795 - RNA, 17 nt, Homo sapiens
gaggcugaggcgggugg

SEQ ID NO: 25796 - RNA, 14 nt, Homo sapiens
gagacagaaagcag

SEQ ID NO: 25797 - RNA, 12 nt, Homo sapiens
gauaggccaugg

SEQ ID NO: 25798 - RNA, 13 nt, Homo sapiens
gauccgcccaucu

SEQ ID NO: 25799 - RNA, 17 nt, Homo sapiens
gauccugcaauuccacu

SEQ ID NO: 25800 - RNA, 14 nt, Homo sapiens
gauccuggaaauca

SEQ ID NO: 25801 - RNA, 14 nt, Homo sapiens
gagugcaguggcgc

SEQ ID NO: 25802 - RNA, 14 nt, Homo sapiens
gagugccuguaauc

SEQ ID NO: 25803 - RNA, 16 nt, Homo sapiens
gaguucugucuggacu

SEQ ID NO: 25804 - RNA, 17 nt, Homo sapiens
gaguucugucuggacuu

SEQ ID NO: 25805 - RNA, 12 nt, Homo sapiens
gaguuuggccag

SEQ ID NO: 25806 - RNA, 18 nt, Homo sapiens
gagggcuugaggacuugg

SEQ ID NO: 25807 - RNA, 17 nt, Homo sapiens
gccgggcguggugguga

SEQ ID NO: 25808 - RNA, 12 nt, Homo sapiens
gccccgggagug

SEQ ID NO: 25809 - RNA, 18 nt, Homo sapiens
gccgagauugugccccug

SEQ ID NO: 25810 - RNA, 19 nt, Homo sapiens
gccgagauugugccccugc

SEQ ID NO: 25811 - RNA, 16 nt, Homo sapiens
gccuaagugcagcccc

SEQ ID NO: 25812 - RNA, 18 nt, Homo sapiens
gccugaaagaggaaugaa

SEQ ID NO: 25813 - RNA, 14 nt, Homo sapiens
gccugcaauauuug

SEQ ID NO: 25814 - RNA, 13 nt, Homo sapiens
gcgccaccacgcc

SEQ ID NO: 25815 - RNA, 14 nt, Homo sapiens
gcgccaccacgccc

SEQ ID NO: 25816 - RNA, 14 nt, Homo sapiens
gccugggugacaga

SEQ ID NO: 25817 - RNA, 19 nt, Homo sapiens
gccuguaaucccagcacuu

SEQ ID NO: 25818 - RNA, 18 nt, Homo sapiens
gccuuggggcugaugcag

SEQ ID NO: 25819 - RNA, 18 nt, Homo sapiens
gccuggcugggaguggca

SEQ ID NO: 25820 - RNA, 13 nt, Homo sapiens
gccuggcugggag

SEQ ID NO: 25821 - RNA, 12 nt, Homo sapiens
gccugcuggaug

SEQ ID NO: 25822 - RNA, 13 nt, Homo sapiens
gccugcuggaugu

SEQ ID NO: 25823 - RNA, 13 nt, Homo sapiens
gcgcgccaccacg

SEQ ID NO: 25824 - RNA, 14 nt, Homo sapiens
gcgcgccaccacgc

SEQ ID NO: 25825 - RNA, 12 nt, Homo sapiens
gcgcgccaccac

SEQ ID NO: 25826 - RNA, 22 nt, Homo sapiens
gcgaaugguuccauucucucuc

SEQ ID NO: 25827 - RNA, 12 nt, Homo sapiens
gcgccaccacgc

SEQ ID NO: 25828 - RNA, 13 nt, Homo sapiens
gcgcgcgccacca

SEQ ID NO: 25829 - RNA, 14 nt, Homo sapiens
gcgcgcgccaccac

SEQ ID NO: 25830 - RNA, 12 nt, Homo sapiens
gcgcgcgccacc

SEQ ID NO: 25831 - RNA, 12 nt, Homo sapiens
gcagugagccga

SEQ ID NO: 25832 - RNA, 17 nt, Homo sapiens
gcccaggaguuuggcca

SEQ ID NO: 25833 - RNA, 21 nt, Homo sapiens
gcccaagggugggugggguga

SEQ ID NO: 25834 - RNA, 16 nt, Homo sapiens
gcccauccugccccug

SEQ ID NO: 25835 - RNA, 20 nt, Homo sapiens
gcccauccugccccugagcc

SEQ ID NO: 25836 - RNA, 21 nt, Homo sapiens
gcccauccugccccugagccc

SEQ ID NO: 25837 - RNA, 19 nt, Homo sapiens
gcccaggaguuuggccaga

SEQ ID NO: 25838 - RNA, 22 nt, Homo sapiens
gcccaggaguuuggccagaagu

SEQ ID NO: 25839 - RNA, 18 nt, Homo sapiens
gcccaggaguuuggccag

SEQ ID NO: 25840 - RNA, 12 nt, Homo sapiens
gccccuugggca

SEQ ID NO: 25841 - RNA, 13 nt, Homo sapiens
gccccuugggcag

SEQ ID NO: 25842 - RNA, 17 nt, Homo sapiens
gccccugcacuccagcc

SEQ ID NO: 25843 - RNA, 23 nt, Homo sapiens
gccggagccccuugggcagguca

SEQ ID NO: 25844 - RNA, 22 nt, Homo sapiens
gcagccaaccuaagcaagaucc

SEQ ID NO: 25845 - RNA, 17 nt, Homo sapiens
gcagggacuugaaccca

SEQ ID NO: 25846 - RNA, 12 nt, Homo sapiens
gcaggcgugacc

SEQ ID NO: 25847 - RNA, 22 nt, Homo sapiens
gcaggcgugaccugacagccca

SEQ ID NO: 25848 - RNA, 23 nt, Homo sapiens
gcaggcgugaccugacagcccaa

SEQ ID NO: 25849 - RNA, 20 nt, Homo sapiens
gcaggucacacaaccugucc

SEQ ID NO: 25850 - RNA, 14 nt, Homo sapiens
gcagugcuuggccc

SEQ ID NO: 25851 - RNA, 12 nt, Homo sapiens
gcagugcuuggc

SEQ ID NO: 25852 - RNA, 13 nt, Homo sapiens
gcagugcuuggcc

SEQ ID NO: 25853 - RNA, 17 nt, Homo sapiens
gcaguuguugcccacag

SEQ ID NO: 25854 - RNA, 13 nt, Homo sapiens
gccagaagucaag

SEQ ID NO: 25855 - RNA, 20 nt, Homo sapiens
gcaugggccuagcccacugg

SEQ ID NO: 25856 - RNA, 12 nt, Homo sapiens
ggagacaccacc

SEQ ID NO: 25857 - RNA, 13 nt, Homo sapiens
ggacuugggcggg

SEQ ID NO: 25858 - RNA, 18 nt, Homo sapiens
ggagccaacagaagcuuc

SEQ ID NO: 25859 - RNA, 11 nt, Homo sapiens
ggagacaccac

SEQ ID NO: 25860 - RNA, 16 nt, Homo sapiens
ggaguggcgcgcgcca

SEQ ID NO: 25861 - RNA, 24 nt, Homo sapiens
ggacaguuccugagaccagccaac

SEQ ID NO: 25862 - RNA, 15 nt, Homo sapiens
ggacauuugcucaug

SEQ ID NO: 25863 - RNA, 21 nt, Homo sapiens
ggcagugcuuggcccaggagu

SEQ ID NO: 25864 - RNA, 18 nt, Homo sapiens
ggcagugcuuggcccagg

SEQ ID NO: 25865 - RNA, 13 nt, Homo sapiens
ggcagugcuuggc

SEQ ID NO: 25866 - RNA, 18 nt, Homo sapiens
ggcagcuuuccucaaaac

SEQ ID NO: 25867 - RNA, 14 nt, Homo sapiens
ggcacaggguuuau

SEQ ID NO: 25868 - RNA, 18 nt, Homo sapiens
ggcgcgcgccaccacgcc

SEQ ID NO: 25869 - RNA, 19 nt, Homo sapiens
ggcgcgcgccaccacgccc

SEQ ID NO: 25870 - RNA, 21 nt, Homo sapiens
ggcgcgcgccaccacgcccag

SEQ ID NO: 25871 - RNA, 20 nt, Homo sapiens
ggcgcgcaccuguaauccca

SEQ ID NO: 25872 - RNA, 21 nt, Homo sapiens
ggcgcgcaccuguaaucccag

SEQ ID NO: 25873 - RNA, 14 nt, Homo sapiens
ggcgcgcgccacca

SEQ ID NO: 25874 - RNA, 20 nt, Homo sapiens
ggcccaggaguuuggccaga

SEQ ID NO: 25875 - RNA, 22 nt, Homo sapiens
ggcccaggaguuuggccagaag

SEQ ID NO: 25876 - RNA, 19 nt, Homo sapiens
ggcaugguggcgcgcaccu

SEQ ID NO: 25877 - RNA, 21 nt, Homo sapiens
ggcauguaugacgugacuggc

SEQ ID NO: 25878 - RNA, 20 nt, Homo sapiens
gcuggucucgaacugcugga

SEQ ID NO: 25879 - RNA, 19 nt, Homo sapiens
gcuggauguggagggggcg

SEQ ID NO: 25880 - RNA, 13 nt, Homo sapiens
gcugaggcgggug

SEQ ID NO: 25881 - RNA, 21 nt, Homo sapiens
gcuuagacccucaugcugcca

SEQ ID NO: 25882 - RNA, 19 nt, Homo sapiens
gcuguaugauucccagcca

SEQ ID NO: 25883 - RNA, 14 nt, Homo sapiens
gcuguggccagcuu

SEQ ID NO: 25884 - RNA, 14 nt, Homo sapiens
gcuuccaaauauug

SEQ ID NO: 25885 - RNA, 18 nt, Homo sapiens
gcuugaaauagugucuga

SEQ ID NO: 25886 - RNA, 13 nt, Homo sapiens
gcuugaacccagg

SEQ ID NO: 25887 - RNA, 19 nt, Homo sapiens
gcuuggcccaggaguuugg

SEQ ID NO: 25888 - RNA, 22 nt, Homo sapiens
gcuugaggacuugggcgggaca

SEQ ID NO: 25889 - RNA, 17 nt, Homo sapiens
gcuucaccuguccccga

SEQ ID NO: 25890 - RNA, 20 nt, Homo sapiens
gcuaucgccaucacagcuga

SEQ ID NO: 25891 - RNA, 15 nt, Homo sapiens
gcuccaaacuggagc

SEQ ID NO: 25892 - RNA, 13 nt, Homo sapiens
gcucuggaaacca

SEQ ID NO: 25893 - RNA, 15 nt, Homo sapiens
gcugccaauauccua

SEQ ID NO: 25894 - RNA, 22 nt, Homo sapiens
gcugccucuaaaaggccugucc

SEQ ID NO: 25895 - RNA, 17 nt, Homo sapiens
ggucgucgucuugacuu

SEQ ID NO: 25896 - RNA, 23 nt, Homo sapiens
ggucgucgucuugacuuuggcaa

SEQ ID NO: 25897 - RNA, 16 nt, Homo sapiens
ggugaaacccugucuc

SEQ ID NO: 25898 - RNA, 22 nt, Homo sapiens
gguucuaggccgggcgcggugg

SEQ ID NO: 25899 - RNA, 15 nt, Homo sapiens
gguuugccaugcugg

SEQ ID NO: 25900 - RNA, 16 nt, Homo sapiens
gguuugccaugcuggc

SEQ ID NO: 25901 - RNA, 22 nt, Homo sapiens
ggcuauucacaaccacucauuc

SEQ ID NO: 25902 - RNA, 21 nt, Homo sapiens
ggcgugaccugacagcccaag

SEQ ID NO: 25903 - RNA, 15 nt, Homo sapiens
ggcgugagccaccaa

SEQ ID NO: 25904 - RNA, 14 nt, Homo sapiens
ggcgugagccacca

SEQ ID NO: 25905 - RNA, 22 nt, Homo sapiens
ggccagaagucaaggcuuagac

SEQ ID NO: 25906 - RNA, 17 nt, Homo sapiens
ggcgcgcgccaccacgc

SEQ ID NO: 25907 - RNA, 20 nt, Homo sapiens
ggcggcuggaauugaauucc

SEQ ID NO: 25908 - RNA, 23 nt, Homo sapiens
ggcgggacacaggcuccaaacug

SEQ ID NO: 25909 - RNA, 13 nt, Homo sapiens
gggaguggcgcgc

SEQ ID NO: 25910 - RNA, 14 nt, Homo sapiens
gggaguggcgcgcg

SEQ ID NO: 25911 - RNA, 17 nt, Homo sapiens
gggaguggcgcgcgcca

SEQ ID NO: 25912 - RNA, 12 nt, Homo sapiens
ggcuggucucga

SEQ ID NO: 25913 - RNA, 20 nt, Homo sapiens
ggcuggucucgaacugcugg

SEQ ID NO: 25914 - RNA, 22 nt, Homo sapiens
ggcuuagacccucaugcugcca

SEQ ID NO: 25915 - RNA, 21 nt, Homo sapiens
ggcuggagugcaguggcgcaa

SEQ ID NO: 25916 - RNA, 10 nt, Homo sapiens
gggaguggcg

SEQ ID NO: 25917 - RNA, 20 nt, Homo sapiens
gggcagugcuuggcccagga

SEQ ID NO: 25918 - RNA, 17 nt, Homo sapiens
gggccuggcugggagug

SEQ ID NO: 25919 - RNA, 12 nt, Homo sapiens
gggccuggcugg

SEQ ID NO: 25920 - RNA, 15 nt, Homo sapiens
gggcgggacacaggc

SEQ ID NO: 25921 - RNA, 22 nt, Homo sapiens
gggcgggacacaggcuccaaac

SEQ ID NO: 25922 - RNA, 16 nt, Homo sapiens
gucucgaacugcugga

SEQ ID NO: 25923 - RNA, 18 nt, Homo sapiens
gucucgaacugcuggauu

SEQ ID NO: 25924 - RNA, 12 nt, Homo sapiens
gugacuggccug

SEQ ID NO: 25925 - RNA, 19 nt, Homo sapiens
gugauuacccucugggucu

SEQ ID NO: 25926 - RNA, 15 nt, Homo sapiens
gucaaugcagccccc

SEQ ID NO: 25927 - RNA, 16 nt, Homo sapiens
gucaaugcagccccca

SEQ ID NO: 25928 - RNA, 13 nt, Homo sapiens
guauggcagcuuu

SEQ ID NO: 25929 - RNA, 14 nt, Homo sapiens
guauggcagcuuuc

SEQ ID NO: 25930 - RNA, 17 nt, Homo sapiens
guaucaaaagaaagaaa

SEQ ID NO: 25931 - RNA, 16 nt, Homo sapiens
guggcgcgcgccacca

SEQ ID NO: 25932 - RNA, 16 nt, Homo sapiens
guggguggggcagugc

SEQ ID NO: 25933 - RNA, 13 nt, Homo sapiens
gugcuuggcccag

SEQ ID NO: 25934 - RNA, 14 nt, Homo sapiens
gugcuuggcccagg

SEQ ID NO: 25935 - RNA, 16 nt, Homo sapiens
gugacaagcucacaga

SEQ ID NO: 25936 - RNA, 15 nt, Homo sapiens
guugccaaggcugga

SEQ ID NO: 25937 - RNA, 19 nt, Homo sapiens
guugccaaggcuggagugc

SEQ ID NO: 25938 - RNA, 14 nt, Homo sapiens
guuggaggcugcaa

SEQ ID NO: 25939 - RNA, 22 nt, Homo sapiens
guugaccaauaaccaugcccaa

SEQ ID NO: 25940 - RNA, 16 nt, Homo sapiens
guuccugagaccagcc

SEQ ID NO: 25941 - RNA, 23 nt, Homo sapiens
gcaaucuuaacucauugcaaccu

SEQ ID NO: 25942 - RNA, 22 nt, Homo sapiens
gauggaaguugcagugagcuga

SEQ ID NO: 25943 - RNA, 19 nt, Homo sapiens
gauguggagggggcgcgug

SEQ ID NO: 25944 - RNA, 21 nt, Homo sapiens
gauucucuuuauucagccccg

SEQ ID NO: 25945 - RNA, 18 nt, Homo sapiens
gauuguaaaaugguguga

SEQ ID NO: 25946 - RNA, 16 nt, Homo sapiens
gcaccugcaggcguga

SEQ ID NO: 25947 - RNA, 13 nt, Homo sapiens
gcaaccuccaccu

SEQ ID NO: 25948 - RNA, 13 nt, Homo sapiens
gcagauaaacagu

SEQ ID NO: 25949 - RNA, 17 nt, Homo sapiens
gcacuccagccugagcg

SEQ ID NO: 25950 - RNA, 14 nt, Homo sapiens
gcagcuuauucaca

SEQ ID NO: 25951 - RNA, 23 nt, Homo sapiens
gcagccaaccuaagcaagauccc

SEQ ID NO: 25952 - RNA, 18 nt, Homo sapiens
gcaggauagagugggaca

SEQ ID NO: 25953 - RNA, 15 nt, Homo sapiens
gccagaagucaaggc

SEQ ID NO: 25954 - RNA, 18 nt, Homo sapiens
gccagacaucaacagaua

SEQ ID NO: 25955 - RNA, 20 nt, Homo sapiens
gccaacuggggugggugggg

SEQ ID NO: 25956 - RNA, 15 nt, Homo sapiens
gccaccaaacccggc

SEQ ID NO: 25957 - RNA, 17 nt, Homo sapiens
gccaaggcuggagugca

SEQ ID NO: 25958 - RNA, 9 nt, Homo sapiens
gccaaaaac

SEQ ID NO: 25959 - RNA, 15 nt, Homo sapiens
gcaggcgugaccuga

SEQ ID NO: 25960 - RNA, 13 nt, Homo sapiens
gcaggcgugaccu

SEQ ID NO: 25961 - RNA, 15 nt, Homo sapiens
gcagugcuuggccca

SEQ ID NO: 25962 - RNA, 16 nt, Homo sapiens
gcagugcuuggcccag

SEQ ID NO: 25963 - RNA, 17 nt, Homo sapiens
gcagugcuuggcccagg

SEQ ID NO: 25964 - RNA, 15 nt, Homo sapiens
gcauguaugacguga

SEQ ID NO: 25965 - RNA, 22 nt, Homo sapiens
gcaugggaagugacgguuuaau

SEQ ID NO: 25966 - RNA, 18 nt, Homo sapiens
gcagugcuuggcccagga

SEQ ID NO: 25967 - RNA, 13 nt, Homo sapiens
gcauauguuucgc

SEQ ID NO: 25968 - RNA, 18 nt, Homo sapiens
gccccugcacuccagccu

SEQ ID NO: 25969 - RNA, 15 nt, Homo sapiens
gccgagauugugccc

SEQ ID NO: 25970 - RNA, 12 nt, Homo sapiens
gccugggugaca

SEQ ID NO: 25971 - RNA, 13 nt, Homo sapiens
gccugggugacag

SEQ ID NO: 25972 - RNA, 16 nt, Homo sapiens
gcgcgccaccacgccc

SEQ ID NO: 25973 - RNA, 14 nt, Homo sapiens
gccgggcgcggugg

SEQ ID NO: 25974 - RNA, 17 nt, Homo sapiens
gccuaagugcagccccg

SEQ ID NO: 25975 - RNA, 15 nt, Homo sapiens
gccggagccccuugg

SEQ ID NO: 25976 - RNA, 15 nt, Homo sapiens
gccucuuagaugcag

SEQ ID NO: 25977 - RNA, 19 nt, Homo sapiens
gccugaaagaggaaugaag

SEQ ID NO: 25978 - RNA, 11 nt, Homo sapiens
gccuggcuggg

SEQ ID NO: 25979 - RNA, 12 nt, Homo sapiens
gagccccaaaag

SEQ ID NO: 25980 - RNA, 16 nt, Homo sapiens
gaggaaugaaguacuc

SEQ ID NO: 25981 - RNA, 15 nt, Homo sapiens
gaggacuugggcggg

SEQ ID NO: 25982 - RNA, 16 nt, Homo sapiens
gaguggguuucacaag

SEQ ID NO: 25983 - RNA, 17 nt, Homo sapiens
gaguuccuaaccagccu

SEQ ID NO: 25984 - RNA, 18 nt, Homo sapiens
gaguuccuaaccagccug

SEQ ID NO: 25985 - RNA, 18 nt, Homo sapiens
gaguucugucuggacuuu

SEQ ID NO: 25986 - RNA, 10 nt, Homo sapiens
gagggcuuga

SEQ ID NO: 25987 - RNA, 13 nt, Homo sapiens
gagugcaguggcg

SEQ ID NO: 25988 - RNA, 15 nt, Homo sapiens
gaugaucauguauuu

SEQ ID NO: 25989 - RNA, 21 nt, Homo sapiens
gaucauuucaaaacucauuuc

SEQ ID NO: 25990 - RNA, 19 nt, Homo sapiens
gauccgcccaucuccgucu

SEQ ID NO: 25991 - RNA, 23 nt, Homo sapiens
gauuccaccuacaugagguacug

SEQ ID NO: 25992 - RNA, 14 nt, Homo sapiens
gagacaccaccacc

SEQ ID NO: 25993 - RNA, 15 nt, Homo sapiens
gagacaccaccaccc

SEQ ID NO: 25994 - RNA, 22 nt, Homo sapiens
gagaccagccaaccugggggcu

SEQ ID NO: 25995 - RNA, 20 nt, Homo sapiens
gagacgggguuugccaugcu

SEQ ID NO: 25996 - RNA, 23 nt, Homo sapiens
gagacgggguuugccaugcuggc

SEQ ID NO: 25997 - RNA, 13 nt, Homo sapiens
gagacaccaccac

SEQ ID NO: 25998 - RNA, 20 nt, Homo sapiens
gacgugacuggccugcugga

SEQ ID NO: 25999 - RNA, 13 nt, Homo sapiens
gacuugggcggga

SEQ ID NO: 26000 - RNA, 14 nt, Homo sapiens
gacgaaccuugaaa

SEQ ID NO: 26001 - RNA, 13 nt, Homo sapiens
gacgggguuugcc

SEQ ID NO: 26002 - RNA, 17 nt, Homo sapiens
gacgggguuugccaugc

SEQ ID NO: 26003 - RNA, 23 nt, Homo sapiens
gacgggguuugccaugcuggcca

SEQ ID NO: 26004 - RNA, 12 nt, Homo sapiens
acaacugugacu

SEQ ID NO: 26005 - RNA, 13 nt, Homo sapiens
gaacucucgagcg

SEQ ID NO: 26006 - RNA, 19 nt, Homo sapiens
gaacuuguugagauccccg

SEQ ID NO: 26007 - RNA, 12 nt, Homo sapiens
acaccaccaccc

SEQ ID NO: 26008 - RNA, 22 nt, Homo sapiens
acaccagagauaauaugagaau

SEQ ID NO: 26009 - RNA, 18 nt, Homo sapiens
gaacagugauuaccaggg

SEQ ID NO: 26010 - RNA, 14 nt, Homo sapiens
acacagugucuggc

SEQ ID NO: 26011 - RNA, 15 nt, Homo sapiens
acacaugauccugca

SEQ ID NO: 26012 - RNA, 23 nt, Homo sapiens
acaagguucuucccuuuuacaua

SEQ ID NO: 26013 - RNA, 13 nt, Homo sapiens
aauuacaggcgug

SEQ ID NO: 26014 - RNA, 20 nt, Homo sapiens
aauuccuauauccugugacu

SEQ ID NO: 26015 - RNA, 13 nt, Homo sapiens
aauuccucuggga

SEQ ID NO: 26016 - RNA, 14 nt, Homo sapiens
aauuccucugggaa

SEQ ID NO: 26017 - RNA, 17 nt, Homo sapiens
acaaaaauuagccgggc

SEQ ID NO: 26018 - RNA, 22 nt, Homo sapiens
gacaccaccacccuugccaugg

SEQ ID NO: 26019 - RNA, 20 nt, Homo sapiens
gacagcccuucuuuccacag

SEQ ID NO: 26020 - RNA, 23 nt, Homo sapiens
gacacaggcuccaaacuggagcu

SEQ ID NO: 26021 - RNA, 19 nt, Homo sapiens
gacauguuuacaaaccuca

SEQ ID NO: 26022 - RNA, 20 nt, Homo sapiens
gacauguuuacaaaccucaa

SEQ ID NO: 26023 - RNA, 16 nt, Homo sapiens
gacccucaugcugcca

SEQ ID NO: 26024 - RNA, 15 nt, Homo sapiens
gacccucaugcugcc

SEQ ID NO: 26025 - RNA, 18 nt, Homo sapiens
gacaagcucacagaccuu

SEQ ID NO: 26026 - RNA, 18 nt, Homo sapiens
gaauugcuugaacccagg

SEQ ID NO: 26027 - RNA, 21 nt, Homo sapiens
gaauuacaggcgugagccacc

SEQ ID NO: 26028 - RNA, 13 nt, Homo sapiens
gaagcaucacagg

SEQ ID NO: 26029 - RNA, 13 nt, Homo sapiens
cgcgccaccacgc

SEQ ID NO: 26030 - RNA, 21 nt, Homo sapiens
cgcgcaccuguaaucccagcu

SEQ ID NO: 26031 - RNA, 16 nt, Homo sapiens
ccuugcuccuggcugg

SEQ ID NO: 26032 - RNA, 19 nt, Homo sapiens
cgcgccaccacgcccagcu

SEQ ID NO: 26033 - RNA, 11 nt, Homo sapiens
cgggcauggug

SEQ ID NO: 26034 - RNA, 15 nt, Homo sapiens
cgcgccaccacgccc

SEQ ID NO: 26035 - RNA, 12 nt, Homo sapiens
cgcgcgccacca

SEQ ID NO: 26036 - RNA, 14 nt, Homo sapiens
cgcgugcaggcagc

SEQ ID NO: 26037 - RNA, 15 nt, Homo sapiens
cguugcuggggggga

SEQ ID NO: 26038 - RNA, 16 nt, Homo sapiens
cguggaacaguuaccu

SEQ ID NO: 26039 - RNA, 16 nt, Homo sapiens
cuaauaaaaaggugac

SEQ ID NO: 26040 - RNA, 18 nt, Homo sapiens
cuaccagcccuacaccau

SEQ ID NO: 26041 - RNA, 18 nt, Homo sapiens
cuacagccaggcggcugg

SEQ ID NO: 26042 - RNA, 19 nt, Homo sapiens
cuacagccaggcggcugga

SEQ ID NO: 26043 - RNA, 23 nt, Homo sapiens
cgucuugacuuuggcaaaugagc

SEQ ID NO: 26044 - RNA, 13 nt, Homo sapiens
cuagaguuuagcu

SEQ ID NO: 26045 - RNA, 17 nt, Homo sapiens
cgugaccugacagccca

SEQ ID NO: 26046 - RNA, 21 nt, Homo sapiens
cgugaccugacagcccaaggg

SEQ ID NO: 26047 - RNA, 15 nt, Homo sapiens
cgugacuggccugcu

SEQ ID NO: 26048 - RNA, 19 nt, Homo sapiens
cgugacuggccugcuggau

SEQ ID NO: 26049 - RNA, 18 nt, Homo sapiens
cgucucccaaagugcugg

SEQ ID NO: 26050 - RNA, 22 nt, Homo sapiens
cgggaguggcgcgcgccaccac

SEQ ID NO: 26051 - RNA, 12 nt, Homo sapiens
cgggacacaggc

SEQ ID NO: 26052 - RNA, 12 nt, Homo sapiens
cgggaguggcgc

SEQ ID NO: 26053 - RNA, 16 nt, Homo sapiens
cgggaguggcgcgcgc

SEQ ID NO: 26054 - RNA, 17 nt, Homo sapiens
cgggaguggcgcgcgcc

SEQ ID NO: 26055 - RNA, 18 nt, Homo sapiens
cgggaguggcgcgcgcca

SEQ ID NO: 26056 - RNA, 21 nt, Homo sapiens
cgggaguggcgcgcgccacca

SEQ ID NO: 26057 - RNA, 19 nt, Homo sapiens
cucauggaauuggagcucg

SEQ ID NO: 26058 - RNA, 16 nt, Homo sapiens
cuccaccuucuggguu

SEQ ID NO: 26059 - RNA, 18 nt, Homo sapiens
cuauguucuaagaaguga

SEQ ID NO: 26060 - RNA, 15 nt, Homo sapiens
cuauguuguugcacu

SEQ ID NO: 26061 - RNA, 16 nt, Homo sapiens
cuauguuguugcacuu

SEQ ID NO: 26062 - RNA, 21 nt, Homo sapiens
cucagugucaaugcagccccc

SEQ ID NO: 26063 - RNA, 14 nt, Homo sapiens
cuagcuaauaucaa

SEQ ID NO: 26064 - RNA, 15 nt, Homo sapiens
cuagcuaauaucaau

SEQ ID NO: 26065 - RNA, 11 nt, Homo sapiens
cuaggccgggc

SEQ ID NO: 26066 - RNA, 22 nt, Homo sapiens
cugggaauuacaggcgugagcc

SEQ ID NO: 26067 - RNA, 17 nt, Homo sapiens
cuggccaggcuggucuc

SEQ ID NO: 26068 - RNA, 16 nt, Homo sapiens
cuggcugggaguggca

SEQ ID NO: 26069 - RNA, 19 nt, Homo sapiens
cugggaauuacaggcguga

SEQ ID NO: 26070 - RNA, 18 nt, Homo sapiens
cugccuaagugcagcccc

SEQ ID NO: 26071 - RNA, 17 nt, Homo sapiens
cugcuguuuccuagcgc

SEQ ID NO: 26072 - RNA, 18 nt, Homo sapiens
cugcuguuuccuagcgca

SEQ ID NO: 26073 - RNA, 15 nt, Homo sapiens
cugcuuuaauuucau

SEQ ID NO: 26074 - RNA, 16 nt, Homo sapiens
cuggccaacgggguga

SEQ ID NO: 26075 - RNA, 18 nt, Homo sapiens
cuggagugcaguggcgca

SEQ ID NO: 26076 - RNA, 19 nt, Homo sapiens
cuggagugcaguggcgcaa

SEQ ID NO: 26077 - RNA, 17 nt, Homo sapiens
cugccuaagugcagccc

SEQ ID NO: 26078 - RNA, 15 nt, Homo sapiens
cugagagugaacaaa

SEQ ID NO: 26079 - RNA, 14 nt, Homo sapiens
cugagcgacaguga

SEQ ID NO: 26080 - RNA, 16 nt, Homo sapiens
cugacccagccccuug

SEQ ID NO: 26081 - RNA, 17 nt, Homo sapiens
cuccagccugggugaca

SEQ ID NO: 26082 - RNA, 12 nt, Homo sapiens
cucgaacugcug

SEQ ID NO: 26083 - RNA, 13 nt, Homo sapiens
cucgaacugcugg

SEQ ID NO: 26084 - RNA, 15 nt, Homo sapiens
cucgaacugcuggau

SEQ ID NO: 26085 - RNA, 13 nt, Homo sapiens
cucgugggacagu

SEQ ID NO: 26086 - RNA, 19 nt, Homo sapiens
cucucuuauagaauauuua

SEQ ID NO: 26087 - RNA, 21 nt, Homo sapiens
cucucuuuuuagagaaauuug

SEQ ID NO: 26088 - RNA, 12 nt, Homo sapiens
cucuggaaacca

SEQ ID NO: 26089 - RNA, 20 nt, Homo sapiens
cuugaugauacaaugaacac

SEQ ID NO: 26090 - RNA, 12 nt, Homo sapiens
cuugaacccagg

SEQ ID NO: 26091 - RNA, 15 nt, Homo sapiens
cuugaacccgggagg

SEQ ID NO: 26092 - RNA, 14 nt, Homo sapiens
cuugagaagagaau

SEQ ID NO: 26093 - RNA, 18 nt, Homo sapiens
cuuagacccucaugcugc

SEQ ID NO: 26094 - RNA, 23 nt, Homo sapiens
cuucccuuuuacauacugcuguc

SEQ ID NO: 26095 - RNA, 17 nt, Homo sapiens
cuggugccucaccccuu

SEQ ID NO: 26096 - RNA, 22 nt, Homo sapiens
cuguaaaauggagacaccacca

SEQ ID NO: 26097 - RNA, 23 nt, Homo sapiens
cuguaaaauggagacaccaccac

SEQ ID NO: 26098 - RNA, 24 nt, Homo sapiens
cuguaaaauggagacaccaccacc

SEQ ID NO: 26099 - RNA, 19 nt, Homo sapiens
cuguaaaauggagacacca

SEQ ID NO: 26100 - RNA, 17 nt, Homo sapiens
cuuucacaggggacagg

SEQ ID NO: 26101 - RNA, 20 nt, Homo sapiens
cuuugaugauuaauucaccu

SEQ ID NO: 26102 - RNA, 21 nt, Homo sapiens
cuuugaugauuaauucaccuu

SEQ ID NO: 26103 - RNA, 20 nt, Homo sapiens
gaaaagacauaagcaaagac

SEQ ID NO: 26104 - RNA, 22 nt, Homo sapiens
cuugggacaaaaacaaacaaac

SEQ ID NO: 26105 - RNA, 19 nt, Homo sapiens
cuuggcccaggaguuuggc

SEQ ID NO: 26106 - RNA, 13 nt, Homo sapiens
cuugucucugggc

SEQ ID NO: 26107 - RNA, 13 nt, Homo sapiens
gaaagaagcccaa

SEQ ID NO: 26108 - RNA, 20 nt, Homo sapiens
gaaaggagaaguuaagcaac

SEQ ID NO: 26109 - RNA, 22 nt, Homo sapiens
gaaagggucucccucuguugcc

SEQ ID NO: 26110 - RNA, 18 nt, Homo sapiens
aaucugaggccuccucuc

SEQ ID NO: 26111 - RNA, 14 nt, Homo sapiens
ggagacaccaccac

SEQ ID NO: 26112 - RNA, 20 nt, Homo sapiens
ggaguuaggcuauucacaac

SEQ ID NO: 26113 - RNA, 21 nt, Homo sapiens
ggaguuaggcuauucacaacc

SEQ ID NO: 26114 - RNA, 14 nt, Homo sapiens
ggaguuuggccaga

SEQ ID NO: 26115 - RNA, 19 nt, Homo sapiens
ggagcucugcccauccugc

SEQ ID NO: 26116 - RNA, 20 nt, Homo sapiens
ggagcucugcccauccugcc

SEQ ID NO: 26117 - RNA, 21 nt, Homo sapiens
ggagcucugcccauccugccc

SEQ ID NO: 26118 - RNA, 17 nt, Homo sapiens
ggagacaccaccacccu

SEQ ID NO: 26119 - RNA, 16 nt, Homo sapiens
ggagacaccaccaccc

SEQ ID NO: 26120 - RNA, 15 nt, Homo sapiens
ggagacaccaccacc

SEQ ID NO: 26121 - RNA, 13 nt, Homo sapiens
ggagacaccacca

SEQ ID NO: 26122 - RNA, 11 nt, Homo sapiens
ggaccugcugu

SEQ ID NO: 26123 - RNA, 17 nt, Homo sapiens
ggacagucaccucaugg

SEQ ID NO: 26124 - RNA, 22 nt, Homo sapiens
ggacagcccuucuuuccacaga

SEQ ID NO: 26125 - RNA, 16 nt, Homo sapiens
ggacauuugcucaugg

SEQ ID NO: 26126 - RNA, 18 nt, Homo sapiens
gcuggagcucugcccauc

SEQ ID NO: 26127 - RNA, 12 nt, Homo sapiens
gcuggagugcag

SEQ ID NO: 26128 - RNA, 17 nt, Homo sapiens
gcuggagugcaguggcg

SEQ ID NO: 26129 - RNA, 18 nt, Homo sapiens
gcugauaucaugccccug

SEQ ID NO: 26130 - RNA, 17 nt, Homo sapiens
gcuggccaacgggguga

SEQ ID NO: 26131 - RNA, 23 nt, Homo sapiens
gcugggaauuacaggcgugagcc

SEQ ID NO: 26132 - RNA, 24 nt, Homo sapiens
gcugggaauuacaggcgugagcca

SEQ ID NO: 26133 - RNA, 20 nt, Homo sapiens
gcuuagacccucaugcugcc

SEQ ID NO: 26134 - RNA, 22 nt, Homo sapiens
gcuuagacccucaugcugccaa

SEQ ID NO: 26135 - RNA, 14 nt, Homo sapiens
gcuuggcccaggag

SEQ ID NO: 26136 - RNA, 21 nt, Homo sapiens
gcuuuccucaaaacuucagac

SEQ ID NO: 26137 - RNA, 23 nt, Homo sapiens
gcuuucuagcuguugagcuguuu

SEQ ID NO: 26138 - RNA, 19 nt, Homo sapiens
gcuuuugcuaggucacaga

SEQ ID NO: 26139 - RNA, 17 nt, Homo sapiens
ggaauuggagcucgugg

SEQ ID NO: 26140 - RNA, 23 nt, Homo sapiens
gcuaucgccaucacagcugaacu

SEQ ID NO: 26141 - RNA, 16 nt, Homo sapiens
gcuauuuaaagacaaa

SEQ ID NO: 26142 - RNA, 21 nt, Homo sapiens
gcuaucgccaucacagcugaa

SEQ ID NO: 26143 - RNA, 21 nt, Homo sapiens
gcuacucuguuccuucacauc

SEQ ID NO: 26144 - RNA, 23 nt, Homo sapiens
gcucacgccuguaaucccagcac

SEQ ID NO: 26145 - RNA, 11 nt, Homo sapiens
gcgcgcgccac

SEQ ID NO: 26146 - RNA, 20 nt, Homo sapiens
gccuggucaacauggugaaa

SEQ ID NO: 26147 - RNA, 14 nt, Homo sapiens
gcgugagccaccaa

SEQ ID NO: 26148 - RNA, 22 nt, Homo sapiens
gcggcuggaauugaauucccug

SEQ ID NO: 26149 - RNA, 21 nt, Homo sapiens
ggaguuuggccagaagucaag

SEQ ID NO: 26150 - RNA, 13 nt, Homo sapiens
ggcgcgugcaggc

SEQ ID NO: 26151 - RNA, 19 nt, Homo sapiens
ggcagugcuuggcccagga

SEQ ID NO: 26152 - RNA, 20 nt, Homo sapiens
ggcagugcuuggcccaggag

SEQ ID NO: 26153 - RNA, 14 nt, Homo sapiens
ggccagaagucaag

SEQ ID NO: 26154 - RNA, 16 nt, Homo sapiens
ggccagaagucaaggc

SEQ ID NO: 26155 - RNA, 13 nt, Homo sapiens
ggccuccucucuc

SEQ ID NO: 26156 - RNA, 21 nt, Homo sapiens
ggcccaggaguuuggccagaa

SEQ ID NO: 26157 - RNA, 19 nt, Homo sapiens
ggcgugaccugacagccca

SEQ ID NO: 26158 - RNA, 15 nt, Homo sapiens
ggcgcgcgccaccac

SEQ ID NO: 26159 - RNA, 17 nt, Homo sapiens
ggcaggucacacaaccu

SEQ ID NO: 26160 - RNA, 14 nt, Homo sapiens
ggcagugcuuggcc

SEQ ID NO: 26161 - RNA, 12 nt, Homo sapiens
ggccuggcuggg

SEQ ID NO: 26162 - RNA, 13 nt, Homo sapiens
ggcuccaaacugg

SEQ ID NO: 26163 - RNA, 13 nt, Homo sapiens
ggcuauucacaac

SEQ ID NO: 26164 - RNA, 14 nt, Homo sapiens
ggcuauucacaacc

SEQ ID NO: 26165 - RNA, 20 nt, Homo sapiens
ggcucacgccuguaauccca

SEQ ID NO: 26166 - RNA, 21 nt, Homo sapiens
ggcucacgccuguaaucccag

SEQ ID NO: 26167 - RNA, 16 nt, Homo sapiens
ggcgugagccaccaaa

SEQ ID NO: 26168 - RNA, 17 nt, Homo sapiens
ggcgugagccaccaaac

SEQ ID NO: 26169 - RNA, 20 nt, Homo sapiens
ggcuggagugcaguggcgca

SEQ ID NO: 26170 - RNA, 15 nt, Homo sapiens
ggcugaggcgggugg

SEQ ID NO: 26171 - RNA, 13 nt, Homo sapiens
gguggguggggca

SEQ ID NO: 26172 - RNA, 15 nt, Homo sapiens
gguugcagugagccg

SEQ ID NO: 26173 - RNA, 15 nt, Homo sapiens
guaacugacaacuug

SEQ ID NO: 26174 - RNA, 22 nt, Homo sapiens
guaucuuguuuuuccacuacug

SEQ ID NO: 26175 - RNA, 16 nt, Homo sapiens
guaugacgugacuggc

SEQ ID NO: 26176 - RNA, 14 nt, Homo sapiens
gucaaugcagcccc

SEQ ID NO: 26177 - RNA, 23 nt, Homo sapiens
gucacacaaccugucccagcgag

SEQ ID NO: 26178 - RNA, 15 nt, Homo sapiens
gucacagaggaucug

SEQ ID NO: 26179 - RNA, 16 nt, Homo sapiens
gucacagaggaucugc

SEQ ID NO: 26180 - RNA, 12 nt, Homo sapiens
gucacauuccaa

SEQ ID NO: 26181 - RNA, 22 nt, Homo sapiens
gguauauaaauuuucccaaaac

SEQ ID NO: 26182 - RNA, 17 nt, Homo sapiens
ggggcuuuagggaccug

SEQ ID NO: 26183 - RNA, 14 nt, Homo sapiens
ggguggggcagugc

SEQ ID NO: 26184 - RNA, 13 nt, Homo sapiens
ggguggguggggc

SEQ ID NO: 26185 - RNA, 12 nt, Homo sapiens
ggguuucacaag

SEQ ID NO: 26186 - RNA, 16 nt, Homo sapiens
ggucucaguguccuca

SEQ ID NO: 26187 - RNA, 22 nt, Homo sapiens
ggugacccugaugaaaacauag

SEQ ID NO: 26188 - RNA, 22 nt, Homo sapiens
ggucaggaguuccuaaccagcc

SEQ ID NO: 26189 - RNA, 20 nt, Homo sapiens
gggccuggcugggaguggca

SEQ ID NO: 26190 - RNA, 21 nt, Homo sapiens
gggcgcgugcaggcagcagga

SEQ ID NO: 26191 - RNA, 13 nt, Homo sapiens
gggcagugcuugg

SEQ ID NO: 26192 - RNA, 16 nt, Homo sapiens
ggcuggucucgaacug

SEQ ID NO: 26193 - RNA, 17 nt, Homo sapiens
ugacuggccugcuggau

SEQ ID NO: 26194 - RNA, 19 nt, Homo sapiens
ugagcaccugcaggcguga

SEQ ID NO: 26195 - RNA, 19 nt, Homo sapiens
ugagcagucaggaaagaga

SEQ ID NO: 26196 - RNA, 19 nt, Homo sapiens
ugaccaauaaccaugccca

SEQ ID NO: 26197 - RNA, 15 nt, Homo sapiens
ugaauucccugccug

SEQ ID NO: 26198 - RNA, 22 nt, Homo sapiens
ucuguaaaauggagacaccacc

SEQ ID NO: 26199 - RNA, 12 nt, Homo sapiens
ucuggaaaccac

SEQ ID NO: 26200 - RNA, 21 nt, Homo sapiens
ucugggauagcugacccagcc

SEQ ID NO: 26201 - RNA, 17 nt, Homo sapiens
ucucccaaagugcuggg

SEQ ID NO: 26202 - RNA, 15 nt, Homo sapiens
ucucgaacugcugga

SEQ ID NO: 26203 - RNA, 18 nt, Homo sapiens
ucucgaacugcuggauuc

SEQ ID NO: 26204 - RNA, 12 nt, Homo sapiens
ucuaggccgggc

SEQ ID NO: 26205 - RNA, 13 nt, Homo sapiens
ucuaggccgggcg

SEQ ID NO: 26206 - RNA, 20 nt, Homo sapiens
ucggaucuggggcucuggga

SEQ ID NO: 26207 - RNA, 22 nt, Homo sapiens
ugcaugguuuagaaagcuugcc

SEQ ID NO: 26208 - RNA, 19 nt, Homo sapiens
ugaggacuugggcgggaca

SEQ ID NO: 26209 - RNA, 15 nt, Homo sapiens
ugagggcuugaggac

SEQ ID NO: 26210 - RNA, 22 nt, Homo sapiens
ugcucauggaauuggagcucgu

SEQ ID NO: 26211 - RNA, 21 nt, Homo sapiens
ugcuccuggcuggggccuguu

SEQ ID NO: 26212 - RNA, 17 nt, Homo sapiens
ucgagcguugcuggggg

SEQ ID NO: 26213 - RNA, 18 nt, Homo sapiens
ucgagcguugcugggggg

SEQ ID NO: 26214 - RNA, 16 nt, Homo sapiens
ucgccaucacagcuga

SEQ ID NO: 26215 - RNA, 22 nt, Homo sapiens
ucgcugauauauguguuuuuca

SEQ ID NO: 26216 - RNA, 24 nt, Homo sapiens
ucgcugauauauguguuuuucaca

SEQ ID NO: 26217 - RNA, 23 nt, Homo sapiens
ucuaauuuaucuugucucugggc

SEQ ID NO: 26218 - RNA, 24 nt, Homo sapiens
ucuaauuuaucuugucucugggcu

SEQ ID NO: 26219 - RNA, 14 nt, Homo sapiens
uccccgaaacuacc

SEQ ID NO: 26220 - RNA, 22 nt, Homo sapiens
ucccucuguugccaaggcugga

SEQ ID NO: 26221 - RNA, 13 nt, Homo sapiens
uccugagaccagc

SEQ ID NO: 26222 - RNA, 12 nt, Homo sapiens
uccuauauccug

SEQ ID NO: 26223 - RNA, 16 nt, Homo sapiens
uccucaucuguaaaau

SEQ ID NO: 26224 - RNA, 17 nt, Homo sapiens
ucagacauagaauuaac

SEQ ID NO: 26225 - RNA, 18 nt, Homo sapiens
ucagccccgggaguggcg

SEQ ID NO: 26226 - RNA, 19 nt, Homo sapiens
ucagccccgggaguggcgc

SEQ ID NO: 26227 - RNA, 21 nt, Homo sapiens
ucagccccgggaguggcgcgc

SEQ ID NO: 26228 - RNA, 21 nt, Homo sapiens
ucagccugaaagaggaaugaa

SEQ ID NO: 26229 - RNA, 22 nt, Homo sapiens
ucagccugaaagaggaaugaag

SEQ ID NO: 26230 - RNA, 14 nt, Homo sapiens
ucagcgguuuauau

SEQ ID NO: 26231 - RNA, 18 nt, Homo sapiens
ucagugucaaugcagccc

SEQ ID NO: 26232 - RNA, 15 nt, Homo sapiens
ucaguguccucaucu

SEQ ID NO: 26233 - RNA, 20 nt, Homo sapiens
ucaggugacccugaugaaaa

SEQ ID NO: 26234 - RNA, 12 nt, Homo sapiens
uccagccugggu

SEQ ID NO: 26235 - RNA, 16 nt, Homo sapiens
ucauugcaaccuccac

SEQ ID NO: 26236 - RNA, 20 nt, Homo sapiens
uccagugagacagcucugca

SEQ ID NO: 26237 - RNA, 16 nt, Homo sapiens
ucacaagacccaaaag

SEQ ID NO: 26238 - RNA, 10 nt, Homo sapiens
ucaauauuua

SEQ ID NO: 26239 - RNA, 24 nt, Homo sapiens
ucaauauuuauuauuuucaccugu

SEQ ID NO: 26240 - RNA, 21 nt, Homo sapiens
ucacauacaauuauuuuuaca

SEQ ID NO: 26241 - RNA, 17 nt, Homo sapiens
uauuaauauuuaacauu

SEQ ID NO: 26242 - RNA, 18 nt, Homo sapiens
uaucgccaucacagcuga

SEQ ID NO: 26243 - RNA, 19 nt, Homo sapiens
uaucgccaucacagcugaa

SEQ ID NO: 26244 - RNA, 22 nt, Homo sapiens
uauccuaauaaaaaggugacca

SEQ ID NO: 26245 - RNA, 12 nt, Homo sapiens
uacagccaggcg

SEQ ID NO: 26246 - RNA, 13 nt, Homo sapiens
uacagccaggcgg

SEQ ID NO: 26247 - RNA, 23 nt, Homo sapiens
uagaauuaacacaugauccugca

SEQ ID NO: 26248 - RNA, 16 nt, Homo sapiens
uaggaagagaaaccag

SEQ ID NO: 26249 - RNA, 18 nt, Homo sapiens
gucucccaaagugcuggg

SEQ ID NO: 26250 - RNA, 12 nt, Homo sapiens
gugagccaccaa

SEQ ID NO: 26251 - RNA, 20 nt, Homo sapiens
gugagccaccaaacccggcc

SEQ ID NO: 26252 - RNA, 13 nt, Homo sapiens
gugacuggccugc

SEQ ID NO: 26253 - RNA, 21 nt, Homo sapiens
gucucagugucaaugcagccc

SEQ ID NO: 26254 - RNA, 17 nt, Homo sapiens
gucucccaaagugcugg

SEQ ID NO: 26255 - RNA, 13 nt, Homo sapiens
guggagggggcgc

SEQ ID NO: 26256 - RNA, 15 nt, Homo sapiens
gugucuggcacuugg

SEQ ID NO: 26257 - RNA, 23 nt, Homo sapiens
gugggacaguuccugagaccagc

SEQ ID NO: 26258 - RNA, 13 nt, Homo sapiens
gugggugggguga

SEQ ID NO: 26259 - RNA, 18 nt, Homo sapiens
gugcuuggcccaggaguu

SEQ ID NO: 26260 - RNA, 17 nt, Homo sapiens
gugccucaccccuugcc

SEQ ID NO: 26261 - RNA, 12 nt, Homo sapiens
gugcaauaugug

SEQ ID NO: 26262 - RNA, 17 nt, Homo sapiens
guuccugagaccagcca

SEQ ID NO: 26263 - RNA, 22 nt, Homo sapiens
guuccugagaccagccaaccug

SEQ ID NO: 26264 - RNA, 23 nt, Homo sapiens
guuccugagaccagccaaccugg

SEQ ID NO: 26265 - RNA, 14 nt, Homo sapiens
guugccaaggcugg

SEQ ID NO: 26266 - RNA, 16 nt, Homo sapiens
guucuuuggggagcca

SEQ ID NO: 26267 - RNA, 12 nt, Homo sapiens
gugugcuggcuu

SEQ ID NO: 26268 - RNA, 20 nt, Homo sapiens
guuauuuagggaacugcuug

SEQ ID NO: 26269 - RNA, 15 nt, Homo sapiens
guuuaugauuccacc

SEQ ID NO: 26270 - RNA, 19 nt, Homo sapiens
uaaaaaaaaaccugagccc

SEQ ID NO: 26271 - RNA, 14 nt, Homo sapiens
guuuuuaagcuguu

SEQ ID NO: 26272 - RNA, 18 nt, Homo sapiens
guuuccauagggugacac

SEQ ID NO: 26273 - RNA, 13 nt, Homo sapiens
guuguuggaggcu

SEQ ID NO: 26274 - RNA, 11 nt, Homo sapiens
caccaauauuc

SEQ ID NO: 26275 - RNA, 24 nt, Homo sapiens
cacucuauguucuaagaagugaaa

SEQ ID NO: 26276 - RNA, 15 nt, Homo sapiens
cacuugaacccggga

SEQ ID NO: 26277 - RNA, 23 nt, Homo sapiens
cagagacgggguuugccaugcug

SEQ ID NO: 26278 - RNA, 16 nt, Homo sapiens
cagaucauuucaaaac

SEQ ID NO: 26279 - RNA, 15 nt, Homo sapiens
cagccagcacagccu

SEQ ID NO: 26280 - RNA, 13 nt, Homo sapiens
cagcacuuuggga

SEQ ID NO: 26281 - RNA, 17 nt, Homo sapiens
cagccaggcggcuggaa

SEQ ID NO: 26282 - RNA, 12 nt, Homo sapiens
cagcccuacacc

SEQ ID NO: 26283 - RNA, 22 nt, Homo sapiens
cagcuacuugggaggcugagau

SEQ ID NO: 26284 - RNA, 23 nt, Homo sapiens
caggcuggucucgaacugcugga

SEQ ID NO: 26285 - RNA, 11 nt, Homo sapiens
caggcuggcca

SEQ ID NO: 26286 - RNA, 22 nt, Homo sapiens
caggcuccaaacuggagcuuga

SEQ ID NO: 26287 - RNA, 20 nt, Homo sapiens
cagugcuuggcccaggaguu

SEQ ID NO: 26288 - RNA, 20 nt, Homo sapiens
caggugacccugaugaaaac

SEQ ID NO: 26289 - RNA, 14 nt, Homo sapiens
cagucagaagaccu

SEQ ID NO: 26290 - RNA, 15 nt, Homo sapiens
caggcgugagccacc

SEQ ID NO: 26291 - RNA, 16 nt, Homo sapiens
caggcgugagccacca

SEQ ID NO: 26292 - RNA, 23 nt, Homo sapiens
caggcgugagccaccaaacccgg

SEQ ID NO: 26293 - RNA, 15 nt, Homo sapiens
caggcuagauguaug

SEQ ID NO: 26294 - RNA, 19 nt, Homo sapiens
caggcgugagccaccaaac

SEQ ID NO: 26295 - RNA, 16 nt, Homo sapiens
caggaguuuggccaga

SEQ ID NO: 26296 - RNA, 22 nt, Homo sapiens
caggaguuccuaaccagccugg

SEQ ID NO: 26297 - RNA, 18 nt, Homo sapiens
cagugucaaugcagcccc

SEQ ID NO: 26298 - RNA, 23 nt, Homo sapiens
caguuccugagaccagccaaccu

SEQ ID NO: 26299 - RNA, 14 nt, Homo sapiens
caucaaugaaugaa

SEQ ID NO: 26300 - RNA, 12 nt, Homo sapiens
cauagcagcuua

SEQ ID NO: 26301 - RNA, 19 nt, Homo sapiens
caucaaugaaugaaugaau

SEQ ID NO: 26302 - RNA, 20 nt, Homo sapiens
caugauccugcaauuccacu

SEQ ID NO: 26303 - RNA, 22 nt, Homo sapiens
caugggccuagcccacuggcuc

SEQ ID NO: 26304 - RNA, 17 nt, Homo sapiens
caugcuggccaggcugg

SEQ ID NO: 26305 - RNA, 16 nt, Homo sapiens
caugcuggccaggcug

SEQ ID NO: 26306 - RNA, 15 nt, Homo sapiens
caugcugccaauauc

SEQ ID NO: 26307 - RNA, 19 nt, Homo sapiens
caugcugccaauauccuaa

SEQ ID NO: 26308 - RNA, 15 nt, Homo sapiens
ccaauuuacuuuguu

SEQ ID NO: 26309 - RNA, 19 nt, Homo sapiens
ccacaaaauugggaaagga

SEQ ID NO: 26310 - RNA, 19 nt, Homo sapiens
ccaccaaacccggccugau

SEQ ID NO: 26311 - RNA, 15 nt, Homo sapiens
ccaccacgcccagcu

SEQ ID NO: 26312 - RNA, 16 nt, Homo sapiens
ccaccuucuggguuca

SEQ ID NO: 26313 - RNA, 19 nt, Homo sapiens
cauuguaauugcuaucgcc

SEQ ID NO: 26314 - RNA, 18 nt, Homo sapiens
cauucuugaaagcugugg

SEQ ID NO: 26315 - RNA, 22 nt, Homo sapiens
cauggaucugguagggggaaaa

SEQ ID NO: 26316 - RNA, 17 nt, Homo sapiens
cauggugugcuggcuua

SEQ ID NO: 26317 - RNA, 20 nt, Homo sapiens
cauguaugacgugacuggcc

SEQ ID NO: 26318 - RNA, 19 nt, Homo sapiens
cccgggaguggcgcgcgcc

SEQ ID NO: 26319 - RNA, 14 nt, Homo sapiens
cccgggaguggcgc

SEQ ID NO: 26320 - RNA, 19 nt, Homo sapiens
ccccugcacuccagccuga

SEQ ID NO: 26321 - RNA, 20 nt, Homo sapiens
ccccugcacuccagccugag

SEQ ID NO: 26322 - RNA, 12 nt, Homo sapiens
cccucaugcugc

SEQ ID NO: 26323 - RNA, 12 nt, Homo sapiens
cccuacaccauu

SEQ ID NO: 26324 - RNA, 12 nt, Homo sapiens
cccucugggucu

SEQ ID NO: 26325 - RNA, 18 nt, Homo sapiens
cccucuguugccaaggcu

SEQ ID NO: 26326 - RNA, 19 nt, Homo sapiens
cccucuguugccaaggcug

SEQ ID NO: 26327 - RNA, 20 nt, Homo sapiens
cccucuguugccaaggcugg

SEQ ID NO: 26328 - RNA, 22 nt, Homo sapiens
cccucuguugccaaggcuggag

SEQ ID NO: 26329 - RNA, 12 nt, Homo sapiens
cccugccuggau

SEQ ID NO: 26330 - RNA, 15 nt, Homo sapiens
ccauggagguuaagc

SEQ ID NO: 26331 - RNA, 16 nt, Homo sapiens
ccauugugggcucugg

SEQ ID NO: 26332 - RNA, 18 nt, Homo sapiens
cccaggaguuuggccaga

SEQ ID NO: 26333 - RNA, 22 nt, Homo sapiens
cccauccugccccugagcccau

SEQ ID NO: 26334 - RNA, 23 nt, Homo sapiens
cccagcgagggacaccgaguggc

SEQ ID NO: 26335 - RNA, 24 nt, Homo sapiens
cccagcgagggacaccgaguggcc

SEQ ID NO: 26336 - RNA, 12 nt, Homo sapiens
ccagugagacag

SEQ ID NO: 26337 - RNA, 12 nt, Homo sapiens
ccaggcggcugg

SEQ ID NO: 26338 - RNA, 18 nt, Homo sapiens
ccagcuacuugggaggcu

SEQ ID NO: 26339 - RNA, 18 nt, Homo sapiens
ccagcacuuugggaggcu

SEQ ID NO: 26340 - RNA, 23 nt, Homo sapiens
ccagcacuuugggaggcugaggc

SEQ ID NO: 26341 - RNA, 14 nt, Homo sapiens
ccacuacugcuacc

SEQ ID NO: 26342 - RNA, 24 nt, Homo sapiens
cccucuguugccaaggcuggagug

SEQ ID NO: 26343 - RNA, 18 nt, Homo sapiens
cccuguacuccagccugg

SEQ ID NO: 26344 - RNA, 19 nt, Homo sapiens
cccuguacuccagccuggg

SEQ ID NO: 26345 - RNA, 18 nt, Homo sapiens
ccgggaguggcgcgcgcc

SEQ ID NO: 26346 - RNA, 22 nt, Homo sapiens
ccgggaguggcgcgcgccacca

SEQ ID NO: 26347 - RNA, 23 nt, Homo sapiens
ccgggaguggcgcgcgccaccac

SEQ ID NO: 26348 - RNA, 19 nt, Homo sapiens
ccgucucccaaagugcugg

SEQ ID NO: 26349 - RNA, 17 nt, Homo sapiens
ccuaauaaaaaggugac

SEQ ID NO: 26350 - RNA, 13 nt, Homo sapiens
ccgggcauggugg

SEQ ID NO: 26351 - RNA, 19 nt, Homo sapiens
ccuaauaaaaaggugacca

SEQ ID NO: 26352 - RNA, 14 nt, Homo sapiens
ccucaagccagccu

SEQ ID NO: 26353 - RNA, 16 nt, Homo sapiens
ccuggucaacauggug

SEQ ID NO: 26354 - RNA, 17 nt, Homo sapiens
ccuggucaacaugguga

SEQ ID NO: 26355 - RNA, 16 nt, Homo sapiens
ccugccccugagccca

SEQ ID NO: 26356 - RNA, 15 nt, Homo sapiens
ccuguacuccagccu

SEQ ID NO: 26357 - RNA, 15 nt, Homo sapiens
ccuugcuccuggcug

SEQ ID NO: 26358 - RNA, 13 nt, Homo sapiens
ccuuugggaaagg

SEQ ID NO: 26359 - RNA, 14 nt, Homo sapiens
ccuuugggaaagga

SEQ ID NO: 26360 - RNA, 10 nt, Homo sapiens
ccuuuuuccu

SEQ ID NO: 26361 - RNA, 15 nt, Homo sapiens
ccugcaggcgugacc

SEQ ID NO: 26362 - RNA, 14 nt, Homo sapiens
ccugcaggcgugac

SEQ ID NO: 26363 - RNA, 9 nt, Homo sapiens
ccugagccc

SEQ ID NO: 26364 - RNA, 14 nt, Homo sapiens
ccucaugcugccaa

SEQ ID NO: 26365 - RNA, 15 nt, Homo sapiens
ccucaugcugccaau

SEQ ID NO: 26366 - RNA, 16 nt, Homo sapiens
cuccagccugggugac

SEQ ID NO: 26367 - RNA, 15 nt, Homo sapiens
cuccagccugagcga

SEQ ID NO: 26368 - RNA, 14 nt, Homo sapiens
cucgaacugcugga

SEQ ID NO: 26369 - RNA, 13 nt, Homo sapiens
cucugucucaguc

SEQ ID NO: 26370 - RNA, 17 nt, Homo sapiens
cucuguuccuucacauc

SEQ ID NO: 26371 - RNA, 21 nt, Homo sapiens
cugaagaagaugguaccacca

SEQ ID NO: 26372 - RNA, 16 nt, Homo sapiens
cucuuuauucagcccc

SEQ ID NO: 26373 - RNA, 21 nt, Homo sapiens
cugcuguuuccuagcgcagcc

SEQ ID NO: 26374 - RNA, 17 nt, Homo sapiens
cuggacuuuccagagac

SEQ ID NO: 26375 - RNA, 23 nt, Homo sapiens
cugccgguuugaaaauaugccug

SEQ ID NO: 26376 - RNA, 16 nt, Homo sapiens
cugccaauauccuaau

SEQ ID NO: 26377 - RNA, 13 nt, Homo sapiens
cucguggaacagu

SEQ ID NO: 26378 - RNA, 15 nt, Homo sapiens
cugacccagccccuu

SEQ ID NO: 26379 - RNA, 14 nt, Homo sapiens
cugccccugagccc

SEQ ID NO: 26380 - RNA, 15 nt, Homo sapiens
cugccccugagccca

SEQ ID NO: 26381 - RNA, 14 nt, Homo sapiens
cugcagacaugaga

SEQ ID NO: 26382 - RNA, 19 nt, Homo sapiens
cugcacuccagccugagcg

SEQ ID NO: 26383 - RNA, 19 nt, Homo sapiens
cugggguggguggggcagu

SEQ ID NO: 26384 - RNA, 20 nt, Homo sapiens
cugggguggguggggcagug

SEQ ID NO: 26385 - RNA, 21 nt, Homo sapiens
cugggguggguggggcagugc

SEQ ID NO: 26386 - RNA, 14 nt, Homo sapiens
cuggggcucuggga

SEQ ID NO: 26387 - RNA, 15 nt, Homo sapiens
cuggcuggggccugu

SEQ ID NO: 26388 - RNA, 16 nt, Homo sapiens
cuggcuggggccuguu

SEQ ID NO: 26389 - RNA, 16 nt, Homo sapiens
cuggcacuugggacaa

SEQ ID NO: 26390 - RNA, 13 nt, Homo sapiens
cuggccugcugga

SEQ ID NO: 26391 - RNA, 15 nt, Homo sapiens
cuggccugcuggaug

SEQ ID NO: 26392 - RNA, 16 nt, Homo sapiens
cuggccugcuggaugu

SEQ ID NO: 26393 - RNA, 15 nt, Homo sapiens
cugguucuucuuggu

SEQ ID NO: 26394 - RNA, 21 nt, Homo sapiens
cuguaaucacagcuacuuggg

SEQ ID NO: 26395 - RNA, 20 nt, Homo sapiens
cuuagacccucaugcugcca

SEQ ID NO: 26396 - RNA, 21 nt, Homo sapiens
cuuagacccucaugcugccaa

SEQ ID NO: 26397 - RNA, 22 nt, Homo sapiens
cuuugggaggcugaggcgggug

SEQ ID NO: 26398 - RNA, 23 nt, Homo sapiens
cuuugggaggcugaggcgggugg

SEQ ID NO: 26399 - RNA, 21 nt, Homo sapiens
cuuugggaggcugaggcgggu

SEQ ID NO: 26400 - RNA, 15 nt, Homo sapiens
gaaaccagggagccc

SEQ ID NO: 26401 - RNA, 17 nt, Homo sapiens
gaaauaagccagacauc

SEQ ID NO: 26402 - RNA, 16 nt, Homo sapiens
gaaagggucucccucu

SEQ ID NO: 26403 - RNA, 21 nt, Homo sapiens
cuugaaauagugucugaugaa

SEQ ID NO: 26404 - RNA, 18 nt, Homo sapiens
cuguugccaaggcuggag

SEQ ID NO: 26405 - RNA, 17 nt, Homo sapiens
cuauguuguugcacuuu

SEQ ID NO: 26406 - RNA, 19 nt, Homo sapiens
cuaauaaaaaggugaccau

SEQ ID NO: 26407 - RNA, 19 nt, Homo sapiens
cuaccagcccuacaccauu

SEQ ID NO: 26408 - RNA, 12 nt, Homo sapiens
cuaggccgggcg

SEQ ID NO: 26409 - RNA, 13 nt, Homo sapiens
cuaggccgggcgc

SEQ ID NO: 26410 - RNA, 16 nt, Homo sapiens
cuagcuaauaucaaua

SEQ ID NO: 26411 - RNA, 15 nt, Homo sapiens
cgggacacaggcucc

SEQ ID NO: 26412 - RNA, 14 nt, Homo sapiens
cgggaguggcgcgc

SEQ ID NO: 26413 - RNA, 12 nt, Homo sapiens
cgggcauggugg

SEQ ID NO: 26414 - RNA, 18 nt, Homo sapiens
cgggguuugccaugcugg

SEQ ID NO: 26415 - RNA, 21 nt, Homo sapiens
cgggguuugccaugcuggcca

SEQ ID NO: 26416 - RNA, 12 nt, Homo sapiens
cgggcgcggugg

SEQ ID NO: 26417 - RNA, 15 nt, Homo sapiens
cgggcguggugguga

SEQ ID NO: 26418 - RNA, 21 nt, Homo sapiens
cgugacuggccugcuggaugu

SEQ ID NO: 26419 - RNA, 13 nt, Homo sapiens
cggguggaucacu

SEQ ID NO: 26420 - RNA, 16 nt, Homo sapiens
cgugacuggccugcug

SEQ ID NO: 26421 - RNA, 19 nt, Homo sapiens
cgucucccaaagugcuggg

SEQ ID NO: 26422 - RNA, 16 nt, Homo sapiens
cgugggacagucaccu

SEQ ID NO: 26423 - RNA, 14 nt, Homo sapiens
cgcgccaccacgcc

SEQ ID NO: 26424 - RNA, 16 nt, Homo sapiens
cgagcguugcuggggg

SEQ ID NO: 26425 - RNA, 17 nt, Homo sapiens
cgagcguugcugggggg

SEQ ID NO: 26426 - RNA, 16 nt, Homo sapiens
cgccuguaaucccagc

SEQ ID NO: 26427 - RNA, 20 nt, Homo sapiens
cgaaguauccuucagccuga

SEQ ID NO: 26428 - RNA, 17 nt, Homo sapiens
cgcaccuguaaucccag

SEQ ID NO: 26429 - RNA, 20 nt, Homo sapiens
ugcuguuuccuagcgcagcc

SEQ ID NO: 26430 - RNA, 23 nt, Homo sapiens
ugcugggaauuacaggcgugagc

SEQ ID NO: 26431 - RNA, 23 nt, Homo sapiens
ugcuggauguggagggggcgcgu

SEQ ID NO: 26432 - RNA, 16 nt, Homo sapiens
uggagugcaguggcgc

SEQ ID NO: 26433 - RNA, 16 nt, Homo sapiens
uggagacaccaccacc

SEQ ID NO: 26434 - RNA, 15 nt, Homo sapiens
uggagacaccaccac

SEQ ID NO: 26435 - RNA, 12 nt, Homo sapiens
uggagacaccac

SEQ ID NO: 26436 - RNA, 18 nt, Homo sapiens
uggcgcgcgccaccacgc

SEQ ID NO: 26437 - RNA, 23 nt, Homo sapiens
uggccagaagucaaggcuuagac

SEQ ID NO: 26438 - RNA, 13 nt, Homo sapiens
uggcaguuuucca

SEQ ID NO: 26439 - RNA, 19 nt, Homo sapiens
uggcccaggaguuuggcca

SEQ ID NO: 26440 - RNA, 17 nt, Homo sapiens
ugggauagcugacccag

SEQ ID NO: 26441 - RNA, 18 nt, Homo sapiens
uggggagccaacagaagc

SEQ ID NO: 26442 - RNA, 17 nt, Homo sapiens
uggggcagugcuuggcc

SEQ ID NO: 26443 - RNA, 19 nt, Homo sapiens
uggggcagugcuuggccca

SEQ ID NO: 26444 - RNA, 18 nt, Homo sapiens
uguuaaaacugggacagg

SEQ ID NO: 26445 - RNA, 23 nt, Homo sapiens
uguggcuguaucuuguuuuucca

SEQ ID NO: 26446 - RNA, 16 nt, Homo sapiens
uguugacaugggacau

SEQ ID NO: 26447 - RNA, 16 nt, Homo sapiens
uggcgcgcgccaccac

SEQ ID NO: 26448 - RNA, 14 nt, Homo sapiens
uggugccucaguuu

SEQ ID NO: 26449 - RNA, 13 nt, Homo sapiens
uguacuuuuucca

SEQ ID NO: 26450 - RNA, 11 nt, Homo sapiens
uugagcaccug

SEQ ID NO: 26451 - RNA, 14 nt, Homo sapiens
uuccugagaccagc

SEQ ID NO: 26452 - RNA, 22 nt, Homo sapiens
uguuuacaaaccucaagccagc

SEQ ID NO: 26453 - RNA, 11 nt, Homo sapiens
uuagccgggca

SEQ ID NO: 26454 - RNA, 11 nt, Homo sapiens
uuagccgggcg

SEQ ID NO: 26455 - RNA, 22 nt, Homo sapiens
uuagccgggcgugguggugagu

SEQ ID NO: 26456 - RNA, 12 nt, Homo sapiens
accacugcagaa

SEQ ID NO: 26457 - RNA, 20 nt, Homo sapiens
acaugagagacagcaggucu

SEQ ID NO: 26458 - RNA, 23 nt, Homo sapiens
acccaaaguaucaggacgagaau

SEQ ID NO: 26459 - RNA, 13 nt, Homo sapiens
acccggccugauu

SEQ ID NO: 26460 - RNA, 12 nt, Homo sapiens
acccgggaggca

SEQ ID NO: 26461 - RNA, 16 nt, Homo sapiens
acagggaaagggucuc

SEQ ID NO: 26462 - RNA, 20 nt, Homo sapiens
acagugucuggcacuuggga

SEQ ID NO: 26463 - RNA, 21 nt, Homo sapiens
uugccaugcuggccaggcugg

SEQ ID NO: 26464 - RNA, 14 nt, Homo sapiens
agacaccaccaccc

SEQ ID NO: 26465 - RNA, 13 nt, Homo sapiens
agacagcaggucu

SEQ ID NO: 26466 - RNA, 19 nt, Homo sapiens
agacagggaaagggucucc

SEQ ID NO: 26467 - RNA, 13 nt, Homo sapiens
agacaccaccacc

SEQ ID NO: 26468 - RNA, 21 nt, Homo sapiens
agacgggguuugccaugcugg

SEQ ID NO: 26469 - RNA, 22 nt, Homo sapiens
agaagucaaggcuuagacccuc

SEQ ID NO: 26470 - RNA, 17 nt, Homo sapiens
agacccucaugcugcca

SEQ ID NO: 26471 - RNA, 20 nt, Homo sapiens
agacccucaugcugccaaua

SEQ ID NO: 26472 - RNA, 12 nt, Homo sapiens
agagacuuugug

SEQ ID NO: 26473 - RNA, 23 nt, Homo sapiens
agauaugaggcauuugcagcugu

SEQ ID NO: 26474 - RNA, 21 nt, Homo sapiens
acugggguggguggggcagug

SEQ ID NO: 26475 - RNA, 14 nt, Homo sapiens
acuugggaggcuga

SEQ ID NO: 26476 - RNA, 15 nt, Homo sapiens
acuuugggaggcuga

SEQ ID NO: 26477 - RNA, 20 nt, Homo sapiens
acuuuaacacagugucuggc

SEQ ID NO: 26478 - RNA, 23 nt, Homo sapiens
agccaugugauuacccucugggu

SEQ ID NO: 26479 - RNA, 20 nt, Homo sapiens
agccuugcuccuggcugggg

SEQ ID NO: 26480 - RNA, 22 nt, Homo sapiens
agcaccugcaggcgugaccuga

SEQ ID NO: 26481 - RNA, 12 nt, Homo sapiens
accugagcccca

SEQ ID NO: 26482 - RNA, 14 nt, Homo sapiens
accuguaaucccag

SEQ ID NO: 26483 - RNA, 15 nt, Homo sapiens
accuguaaucccagc

SEQ ID NO: 26484 - RNA, 15 nt, Homo sapiens
uuugaauuuuaaauc

SEQ ID NO: 26485 - RNA, 21 nt, Homo sapiens
uuugccaugcuggccaggcug

SEQ ID NO: 26486 - RNA, 15 nt, Homo sapiens
uugcuggagcucugc

SEQ ID NO: 26487 - RNA, 14 nt, Homo sapiens
uugcuugaacccag

SEQ ID NO: 26488 - RNA, 15 nt, Homo sapiens
uugcuugaacccagg

SEQ ID NO: 26489 - RNA, 14 nt, Homo sapiens
acccucaugcugcc

SEQ ID NO: 26490 - RNA, 13 nt, Homo sapiens
acccucugggucu

SEQ ID NO: 26491 - RNA, 11 nt, Homo sapiens
uugggaaagga

SEQ ID NO: 26492 - RNA, 17 nt, Homo sapiens
uuggccagaagucaagg

SEQ ID NO: 26493 - RNA, 15 nt, Homo sapiens
accuguccccgaaac

SEQ ID NO: 26494 - RNA, 14 nt, Homo sapiens
accuucuggguuca

SEQ ID NO: 26495 - RNA, 18 nt, Homo sapiens
acgugacuggccugcugg

SEQ ID NO: 26496 - RNA, 20 nt, Homo sapiens
acgugacuggccugcuggau

SEQ ID NO: 26497 - RNA, 14 nt, Homo sapiens
acgugacuggccug

SEQ ID NO: 26498 - RNA, 23 nt, Homo sapiens
acgaaguauccuucagccugaaa

SEQ ID NO: 26499 - RNA, 16 nt, Homo sapiens
acgccuguaaucccag

SEQ ID NO: 26500 - RNA, 14 nt, Homo sapiens
acuggccugcugga

SEQ ID NO: 26501 - RNA, 17 nt, Homo sapiens
acugggguggguggggc

SEQ ID NO: 26502 - RNA, 17 nt, Homo sapiens
acugagcuucucuguga

SEQ ID NO: 26503 - RNA, 16 nt, Homo sapiens
acguguauauuuuuua

SEQ ID NO: 26504 - RNA, 21 nt, Homo sapiens
aggcuuagacccucaugcugc

SEQ ID NO: 26505 - RNA, 12 nt, Homo sapiens
aguaaugauaac

SEQ ID NO: 26506 - RNA, 21 nt, Homo sapiens
agguuguuggauaaaucagug

SEQ ID NO: 26507 - RNA, 18 nt, Homo sapiens
agucaaggcuuagacccu

SEQ ID NO: 26508 - RNA, 15 nt, Homo sapiens
aggcgugagccacca

SEQ ID NO: 26509 - RNA, 17 nt, Homo sapiens
agggccuggcugggagu

SEQ ID NO: 26510 - RNA, 22 nt, Homo sapiens
aggguccuuugggaaaggagaa

SEQ ID NO: 26511 - RNA, 18 nt, Homo sapiens
aggaucugcuuggucuug

SEQ ID NO: 26512 - RNA, 13 nt, Homo sapiens
aggcaagagaauu

SEQ ID NO: 26513 - RNA, 21 nt, Homo sapiens
aggcuggagugcaguggcgca

SEQ ID NO: 26514 - RNA, 22 nt, Homo sapiens
aggcuggagugcaguggcgcaa

SEQ ID NO: 26515 - RNA, 15 nt, Homo sapiens
aggcggguggaucac

SEQ ID NO: 26516 - RNA, 13 nt, Homo sapiens
agcuguugagcug

SEQ ID NO: 26517 - RNA, 19 nt, Homo sapiens
agcucugcccauccugccc

SEQ ID NO: 26518 - RNA, 23 nt, Homo sapiens
aucacagcuacuugggaggcuga

SEQ ID NO: 26519 - RNA, 15 nt, Homo sapiens
auccuucagccugaa

SEQ ID NO: 26520 - RNA, 16 nt, Homo sapiens
auccuucagccugaaa

SEQ ID NO: 26521 - RNA, 16 nt, Homo sapiens
agugucaaugcagccc

SEQ ID NO: 26522 - RNA, 22 nt, Homo sapiens
aguggcgcgcgccaccacgccc

SEQ ID NO: 26523 - RNA, 23 nt, Homo sapiens
aguguuggagaagaacugaaauc

SEQ ID NO: 26524 - RNA, 16 nt, Homo sapiens
aguggcgcgcgccacc

SEQ ID NO: 26525 - RNA, 16 nt, Homo sapiens
aguugcagugagcuga

SEQ ID NO: 26526 - RNA, 13 nt, Homo sapiens
auacaaucaucaa

SEQ ID NO: 26527 - RNA, 15 nt, Homo sapiens
auaccacaggaacca

SEQ ID NO: 26528 - RNA, 12 nt, Homo sapiens
auacaaucauca

SEQ ID NO: 26529 - RNA, 18 nt, Homo sapiens
auacuguauuuuuaccuu

SEQ ID NO: 26530 - RNA, 20 nt, Homo sapiens
caccuguuuuuaagcuguuu

SEQ ID NO: 26531 - RNA, 21 nt, Homo sapiens
caccuguuuuuaagcuguuuc

SEQ ID NO: 26532 - RNA, 14 nt, Homo sapiens
caccugcaggcgug

SEQ ID NO: 26533 - RNA, 15 nt, Homo sapiens
caccugcaggcguga

SEQ ID NO: 26534 - RNA, 17 nt, Homo sapiens
caccugcaggcgugacc

SEQ ID NO: 26535 - RNA, 21 nt, Homo sapiens
caccugcaggcgugaccugac

SEQ ID NO: 26536 - RNA, 20 nt, Homo sapiens
cacccaaaguaucaggacga

SEQ ID NO: 26537 - RNA, 16 nt, Homo sapiens
caccagggccuggcug

SEQ ID NO: 26538 - RNA, 23 nt, Homo sapiens
cacagcugaacuuguugagaucc

SEQ ID NO: 26539 - RNA, 19 nt, Homo sapiens
cacaagaaaugaaagcagg

SEQ ID NO: 26540 - RNA, 23 nt, Homo sapiens
cacaaguuguguuugauauccaa

SEQ ID NO: 26541 - RNA, 23 nt, Homo sapiens
cacauggcuucaccuguccccga

SEQ ID NO: 26542 - RNA, 24 nt, Homo sapiens
cacauggcuucaccuguccccgaa

SEQ ID NO: 26543 - RNA, 13 nt, Homo sapiens
caccacccuugcc

SEQ ID NO: 26544 - RNA, 14 nt, Homo sapiens
caccaaacccggcc

SEQ ID NO: 26545 - RNA, 16 nt, Homo sapiens
caccaaacccggccug

SEQ ID NO: 26546 - RNA, 15 nt, Homo sapiens
auuuuccugaaaacc

SEQ ID NO: 26547 - RNA, 12 nt, Homo sapiens
auuccuauaucc

SEQ ID NO: 26548 - RNA, 13 nt, Homo sapiens
caaagaagacaac

SEQ ID NO: 26549 - RNA, 19 nt, Homo sapiens
caagugauccgcccaucuc

SEQ ID NO: 26550 - RNA, 15 nt, Homo sapiens
caagugauccgccca

SEQ ID NO: 26551 - RNA, 12 nt, Homo sapiens
caagccugacca

SEQ ID NO: 26552 - RNA, 22 nt, Homo sapiens
caagcacuuucccucuuggugc

SEQ ID NO: 26553 - RNA, 17 nt, Homo sapiens
caaggcuuagacccuca

SEQ ID NO: 26554 - RNA, 16 nt, Homo sapiens
caagaaaugaaagcag

SEQ ID NO: 26555 - RNA, 20 nt, Homo sapiens
caacugggguggguggggca

SEQ ID NO: 26556 - RNA, 13 nt, Homo sapiens
caaccuaaauuug

SEQ ID NO: 26557 - RNA, 15 nt, Homo sapiens
caaccugggggcuuu

SEQ ID NO: 26558 - RNA, 13 nt, Homo sapiens
auugguuuaccug

SEQ ID NO: 26559 - RNA, 12 nt, Homo sapiens
auuguugacaac

SEQ ID NO: 26560 - RNA, 17 nt, Homo sapiens
auugagcaccugcaggc

SEQ ID NO: 26561 - RNA, 18 nt, Homo sapiens
auuauggcugguaacaua

SEQ ID NO: 26562 - RNA, 17 nt, Homo sapiens
auggagacaccaccacc

SEQ ID NO: 26563 - RNA, 15 nt, Homo sapiens
auggagacaccacca

SEQ ID NO: 26564 - RNA, 14 nt, Homo sapiens
augagccggagccc

SEQ ID NO: 26565 - RNA, 15 nt, Homo sapiens
augauaacuggaaac

SEQ ID NO: 26566 - RNA, 19 nt, Homo sapiens
augccuggugcuuccaaau

SEQ ID NO: 26567 - RNA, 14 nt, Homo sapiens
augacgugacuggc

SEQ ID NO: 26568 - RNA, 10 nt, Homo sapiens
augauuucau

SEQ ID NO: 26569 - RNA, 21 nt, Homo sapiens
augcaucuuacugaagguaaa

SEQ ID NO: 26570 - RNA, 18 nt, Homo sapiens
auggagacaccaccaccc

SEQ ID NO: 26571 - RNA, 18 nt, Homo sapiens
augguuuaaauggucaau

SEQ ID NO: 26572 - RNA, 16 nt, Homo sapiens
ccuggcugggaguggc

SEQ ID NO: 26573 - RNA, 17 nt, Homo sapiens
ccuggcugggaguggca

SEQ ID NO: 26574 - RNA, 16 nt, Homo sapiens
ccuguaaucccagcac

SEQ ID NO: 26575 - RNA, 17 nt, Homo sapiens
ccuguaaucccagcuac

SEQ ID NO: 26576 - RNA, 16 nt, Homo sapiens
ccuguacuccagccug

SEQ ID NO: 26577 - RNA, 16 nt, Homo sapiens
ccuucuggguucaagc

SEQ ID NO: 26578 - RNA, 21 nt, Homo sapiens
ccuguguuucuagggaaauga

SEQ ID NO: 26579 - RNA, 15 nt, Homo sapiens
ccugccccugagccc

SEQ ID NO: 26580 - RNA, 12 nt, Homo sapiens
cgaacugcugga

SEQ ID NO: 26581 - RNA, 13 nt, Homo sapiens
cgaacugcuggau

SEQ ID NO: 26582 - RNA, 21 nt, Homo sapiens
cgaaguauccuucagccugaa

SEQ ID NO: 26583 - RNA, 18 nt, Homo sapiens
cgcaccuguaaucccagc

SEQ ID NO: 26584 - RNA, 15 nt, Homo sapiens
cgccuguaaucccag

SEQ ID NO: 26585 - RNA, 18 nt, Homo sapiens
ccuaauaaaaaggugacc

SEQ ID NO: 26586 - RNA, 20 nt, Homo sapiens
ccuaauaaaaaggugaccau

SEQ ID NO: 26587 - RNA, 20 nt, Homo sapiens
ccgucucccaaagugcuggg

SEQ ID NO: 26588 - RNA, 19 nt, Homo sapiens
ccgggcgcgguggcucacg

SEQ ID NO: 26589 - RNA, 21 nt, Homo sapiens
ccucauggaauuggagcucgu

SEQ ID NO: 26590 - RNA, 22 nt, Homo sapiens
ccuaaccucauuccccaaccac

SEQ ID NO: 26591 - RNA, 11 nt, Homo sapiens
ccucaagccag

SEQ ID NO: 26592 - RNA, 15 nt, Homo sapiens
ccucaagccagccuu

SEQ ID NO: 26593 - RNA, 21 nt, Homo sapiens
ccuccugccuaagugcagccc

SEQ ID NO: 26594 - RNA, 23 nt, Homo sapiens
ccugcuggauguggagggggcgc

SEQ ID NO: 26595 - RNA, 16 nt, Homo sapiens
cccaggaguuuggcca

SEQ ID NO: 26596 - RNA, 19 nt, Homo sapiens
cccaggaguuuggccagaa

SEQ ID NO: 26597 - RNA, 13 nt, Homo sapiens
cccgggaguggcg

SEQ ID NO: 26598 - RNA, 22 nt, Homo sapiens
cccgggaguggcgcgcgccacc

SEQ ID NO: 26599 - RNA, 23 nt, Homo sapiens
cccgggaguggcgcgcgccacca

SEQ ID NO: 26600 - RNA, 12 nt, Homo sapiens
cccgggaguggc

SEQ ID NO: 26601 - RNA, 22 nt, Homo sapiens
ccccugcacuccagccugagcg

SEQ ID NO: 26602 - RNA, 11 nt, Homo sapiens
cccuacaccau

SEQ ID NO: 26603 - RNA, 13 nt, Homo sapiens
cccucaugcugcc

SEQ ID NO: 26604 - RNA, 18 nt, Homo sapiens
cccugcacuccagccuga

SEQ ID NO: 26605 - RNA, 23 nt, Homo sapiens
ccggagccccuugggcaggucac

SEQ ID NO: 26606 - RNA, 14 nt, Homo sapiens
ccauagggugacac

SEQ ID NO: 26607 - RNA, 13 nt, Homo sapiens
ccauagggugaca

SEQ ID NO: 26608 - RNA, 11 nt, Homo sapiens
ccaugcuggcc

SEQ ID NO: 26609 - RNA, 16 nt, Homo sapiens
ccaugcuggccaggcu

SEQ ID NO: 26610 - RNA, 15 nt, Homo sapiens
ccauagggugacaca

SEQ ID NO: 26611 - RNA, 20 nt, Homo sapiens
cccagccccuugagaaaccu

SEQ ID NO: 26612 - RNA, 19 nt, Homo sapiens
cccagccccuugagaaacc

SEQ ID NO: 26613 - RNA, 16 nt, Homo sapiens
cccacaagaaaugaaa

SEQ ID NO: 26614 - RNA, 12 nt, Homo sapiens
ccauuccaagcc

SEQ ID NO: 26615 - RNA, 13 nt, Homo sapiens
ccauuccaagccu

SEQ ID NO: 26616 - RNA, 15 nt, Homo sapiens
ccauuccaagccuga

SEQ ID NO: 26617 - RNA, 19 nt, Homo sapiens
ccagcuacuugggaggcug

SEQ ID NO: 26618 - RNA, 23 nt, Homo sapiens
ccagcuacuugggaggcugaggc

SEQ ID NO: 26619 - RNA, 19 nt, Homo sapiens
ccagcacuuugggaggcug

SEQ ID NO: 26620 - RNA, 11 nt, Homo sapiens
ccaggcggcug

SEQ ID NO: 26621 - RNA, 16 nt, Homo sapiens
ccaggaguuuggccag

SEQ ID NO: 26622 - RNA, 12 nt, Homo sapiens
ccaggcuggucu

SEQ ID NO: 26623 - RNA, 19 nt, Homo sapiens
ccagggacugaggggaggg

SEQ ID NO: 26624 - RNA, 20 nt, Homo sapiens
ccagggacugaggggagggg

SEQ ID NO: 26625 - RNA, 13 nt, Homo sapiens
ccagugagacagc

SEQ ID NO: 26626 - RNA, 21 nt, Homo sapiens
ccacaccagggccuggcuggg

SEQ ID NO: 26627 - RNA, 13 nt, Homo sapiens
ccaaauucacaag

SEQ ID NO: 26628 - RNA, 13 nt, Homo sapiens
ccacucauucaaa

SEQ ID NO: 26629 - RNA, 21 nt, Homo sapiens
ccacuuauaggaauugaccca

SEQ ID NO: 26630 - RNA, 20 nt, Homo sapiens
caugugauuacccucugggu

SEQ ID NO: 26631 - RNA, 18 nt, Homo sapiens
cauuguaauugcuaucgc

SEQ ID NO: 26632 - RNA, 15 nt, Homo sapiens
cauuuaaaauauuuu

SEQ ID NO: 26633 - RNA, 13 nt, Homo sapiens
ccaaagugcuggg

SEQ ID NO: 26634 - RNA, 14 nt, Homo sapiens
cauuuuuacuuggg

SEQ ID NO: 26635 - RNA, 15 nt, Homo sapiens
cauuuuuacuugggu

SEQ ID NO: 26636 - RNA, 18 nt, Homo sapiens
ccaaccuaagcaagaucc

SEQ ID NO: 26637 - RNA, 21 nt, Homo sapiens
ccaacugggguggguggggca

SEQ ID NO: 26638 - RNA, 23 nt, Homo sapiens
ccaacugggguggguggggcagu

SEQ ID NO: 26639 - RNA, 17 nt, Homo sapiens
caggcgugagccaccaa

SEQ ID NO: 26640 - RNA, 22 nt, Homo sapiens
caggcgugaccugacagcccaa

SEQ ID NO: 26641 - RNA, 21 nt, Homo sapiens
caggcuccaaacuggagcuug

SEQ ID NO: 26642 - RNA, 22 nt, Homo sapiens
caggcgugagccaccaaacccg

SEQ ID NO: 26643 - RNA, 16 nt, Homo sapiens
caggaguuccuaacca

SEQ ID NO: 26644 - RNA, 20 nt, Homo sapiens
caggaaguagaggaggccac

SEQ ID NO: 26645 - RNA, 14 nt, Homo sapiens
caggcagcaggaua

SEQ ID NO: 26646 - RNA, 15 nt, Homo sapiens
caggcagcaggauag

SEQ ID NO: 26647 - RNA, 17 nt, Homo sapiens
cagugucaaugcagccc

SEQ ID NO: 26648 - RNA, 22 nt, Homo sapiens
cagugucaaugcagcccccauu

SEQ ID NO: 26649 - RNA, 19 nt, Homo sapiens
cagugucuggcacuuggga

SEQ ID NO: 26650 - RNA, 22 nt, Homo sapiens
cagugucuggcacuugggacaa

SEQ ID NO: 26651 - RNA, 12 nt, Homo sapiens
cagugcuuggcc

SEQ ID NO: 26652 - RNA, 11 nt, Homo sapiens
caggucuacca

SEQ ID NO: 26653 - RNA, 16 nt, Homo sapiens
cagugauuaccaggga

SEQ ID NO: 26654 - RNA, 13 nt, Homo sapiens
cagggagccccuu

SEQ ID NO: 26655 - RNA, 14 nt, Homo sapiens
cagggccuggcugg

SEQ ID NO: 26656 - RNA, 18 nt, Homo sapiens
cagggccuggcugggagu

SEQ ID NO: 26657 - RNA, 15 nt, Homo sapiens
cagucacauuccaag

SEQ ID NO: 26658 - RNA, 15 nt, Homo sapiens
caucaaugaaugaau

SEQ ID NO: 26659 - RNA, 18 nt, Homo sapiens
caucaaugaaugaaugaa

SEQ ID NO: 26660 - RNA, 20 nt, Homo sapiens
cauagcagauuuuaauuuug

SEQ ID NO: 26661 - RNA, 17 nt, Homo sapiens
cauagaauuaacacaug

SEQ ID NO: 26662 - RNA, 16 nt, Homo sapiens
caugcugccaauaucc

SEQ ID NO: 26663 - RNA, 15 nt, Homo sapiens
caugcugucuacacu

SEQ ID NO: 26664 - RNA, 19 nt, Homo sapiens
caugagguacugagaguga

SEQ ID NO: 26665 - RNA, 23 nt, Homo sapiens
caugggccuagcccacuggcucc

SEQ ID NO: 26666 - RNA, 14 nt, Homo sapiens
auuccaagccugac

SEQ ID NO: 26667 - RNA, 14 nt, Homo sapiens
auucaaaaguugaa

SEQ ID NO: 26668 - RNA, 21 nt, Homo sapiens
auguuaugcauaaagucagug

SEQ ID NO: 26669 - RNA, 14 nt, Homo sapiens
auugugggcucugg

SEQ ID NO: 26670 - RNA, 13 nt, Homo sapiens
auugcugaaugac

SEQ ID NO: 26671 - RNA, 15 nt, Homo sapiens
auugcuaucgccauc

SEQ ID NO: 26672 - RNA, 14 nt, Homo sapiens
auugagcaccugca

SEQ ID NO: 26673 - RNA, 14 nt, Homo sapiens
auugcaaccuccac

SEQ ID NO: 26674 - RNA, 19 nt, Homo sapiens
caauauucauagcagcuua

SEQ ID NO: 26675 - RNA, 18 nt, Homo sapiens
caaggcuuagacccucau

SEQ ID NO: 26676 - RNA, 13 nt, Homo sapiens
caaggcuggagug

SEQ ID NO: 26677 - RNA, 15 nt, Homo sapiens
caaggcuggagugca

SEQ ID NO: 26678 - RNA, 19 nt, Homo sapiens
caagaaaugaaagcaggga

SEQ ID NO: 26679 - RNA, 13 nt, Homo sapiens
caagcauuuagau

SEQ ID NO: 26680 - RNA, 22 nt, Homo sapiens
caacugggguggguggggcagu

SEQ ID NO: 26681 - RNA, 12 nt, Homo sapiens
caaauucacaag

SEQ ID NO: 26682 - RNA, 14 nt, Homo sapiens
auuuuccugaaaac

SEQ ID NO: 26683 - RNA, 15 nt, Homo sapiens
caaaauugggaaagg

SEQ ID NO: 26684 - RNA, 16 nt, Homo sapiens
caaaauugggaaagga

SEQ ID NO: 26685 - RNA, 23 nt, Homo sapiens
caauuuaaaaaaaaaccugagcc

SEQ ID NO: 26686 - RNA, 14 nt, Homo sapiens
cacaggacagcccu

SEQ ID NO: 26687 - RNA, 24 nt, Homo sapiens
cacaaguuguguuugauauccaaa

SEQ ID NO: 26688 - RNA, 11 nt, Homo sapiens
caccugcaggc

SEQ ID NO: 26689 - RNA, 12 nt, Homo sapiens
caccugcaggcg

SEQ ID NO: 26690 - RNA, 21 nt, Homo sapiens
caccauuccuucugcccugcu

SEQ ID NO: 26691 - RNA, 22 nt, Homo sapiens
caccauuccuucugcccugcuu

SEQ ID NO: 26692 - RNA, 17 nt, Homo sapiens
caccagggccuggcugg

SEQ ID NO: 26693 - RNA, 19 nt, Homo sapiens
cacgccuguaaucccagca

SEQ ID NO: 26694 - RNA, 20 nt, Homo sapiens
cacggacgaaccuugaaaac

SEQ ID NO: 26695 - RNA, 13 nt, Homo sapiens
cagcuacuuggga

SEQ ID NO: 26696 - RNA, 17 nt, Homo sapiens
cagcuacuugggaggcu

SEQ ID NO: 26697 - RNA, 18 nt, Homo sapiens
cagcuacuugggaggcug

SEQ ID NO: 26698 - RNA, 11 nt, Homo sapiens
cagcccuacac

SEQ ID NO: 26699 - RNA, 14 nt, Homo sapiens
cagccaaccugggg

SEQ ID NO: 26700 - RNA, 16 nt, Homo sapiens
cagccaggcggcugga

SEQ ID NO: 26701 - RNA, 17 nt, Homo sapiens
cagauaaacaguaguga

SEQ ID NO: 26702 - RNA, 21 nt, Homo sapiens
cagauaaauaguuuaugauuc

SEQ ID NO: 26703 - RNA, 14 nt, Homo sapiens
cagaucauuucaaa

SEQ ID NO: 26704 - RNA, 20 nt, Homo sapiens
cacuuuaacacagugucugg

SEQ ID NO: 26705 - RNA, 21 nt, Homo sapiens
cacuuuaacacagugucuggc

SEQ ID NO: 26706 - RNA, 18 nt, Homo sapiens
cagaaagcagaacaguga

SEQ ID NO: 26707 - RNA, 13 nt, Homo sapiens
cagaagcaaccca

SEQ ID NO: 26708 - RNA, 20 nt, Homo sapiens
cagaagcaacccaaauguuc

SEQ ID NO: 26709 - RNA, 16 nt, Homo sapiens
cagagaaaauaaaagc

SEQ ID NO: 26710 - RNA, 18 nt, Homo sapiens
cagagaaaauaaaagcac

SEQ ID NO: 26711 - RNA, 15 nt, Homo sapiens
cagagguugcaguga

SEQ ID NO: 26712 - RNA, 19 nt, Homo sapiens
cagagaaaauaaaagcacu

SEQ ID NO: 26713 - RNA, 20 nt, Homo sapiens
cacuugggacaaaaacaaac

SEQ ID NO: 26714 - RNA, 22 nt, Homo sapiens
aggcuuagacccucaugcugcc

SEQ ID NO: 26715 - RNA, 23 nt, Homo sapiens
aggcuuagacccucaugcugcca

SEQ ID NO: 26716 - RNA, 14 nt, Homo sapiens
aggcggguggauca

SEQ ID NO: 26717 - RNA, 20 nt, Homo sapiens
aggcuuagacccucaugcug

SEQ ID NO: 26718 - RNA, 23 nt, Homo sapiens
aggcuggucucgaacugcuggau

SEQ ID NO: 26719 - RNA, 11 nt, Homo sapiens
agggaccugcu

SEQ ID NO: 26720 - RNA, 14 nt, Homo sapiens
agggcuugaggacu

SEQ ID NO: 26721 - RNA, 19 nt, Homo sapiens
agggcuugaggacuugggc

SEQ ID NO: 26722 - RNA, 14 nt, Homo sapiens
agggggcgcgugca

SEQ ID NO: 26723 - RNA, 16 nt, Homo sapiens
agugagacucugucuc

SEQ ID NO: 26724 - RNA, 21 nt, Homo sapiens
aguggcgcgcgccaccacgcc

SEQ ID NO: 26725 - RNA, 18 nt, Homo sapiens
aguggcgcgcgccaccac

SEQ ID NO: 26726 - RNA, 17 nt, Homo sapiens
agugcuuggcccaggag

SEQ ID NO: 26727 - RNA, 13 nt, Homo sapiens
agugcuuggccca

SEQ ID NO: 26728 - RNA, 16 nt, Homo sapiens
auagcugacccagccc

SEQ ID NO: 26729 - RNA, 13 nt, Homo sapiens
auagacucuagga

SEQ ID NO: 26730 - RNA, 12 nt, Homo sapiens
auagcaagugaa

SEQ ID NO: 26731 - RNA, 18 nt, Homo sapiens
auaguuuaugauuccacc

SEQ ID NO: 26732 - RNA, 9 nt, Homo sapiens
auaaauuug

SEQ ID NO: 26733 - RNA, 15 nt, Homo sapiens
aguugcagugagcug

SEQ ID NO: 26734 - RNA, 21 nt, Homo sapiens
aguguuggaaaaugugcaaua

SEQ ID NO: 26735 - RNA, 22 nt, Homo sapiens
augcagcccccauuguggucac

SEQ ID NO: 26736 - RNA, 20 nt, Homo sapiens
augcaucuuacugaagguaa

SEQ ID NO: 26737 - RNA, 14 nt, Homo sapiens
augaauguuaaauu

SEQ ID NO: 26738 - RNA, 13 nt, Homo sapiens
auggagacaccac

SEQ ID NO: 26739 - RNA, 22 nt, Homo sapiens
augcuuaugaaacuaagauuug

SEQ ID NO: 26740 - RNA, 16 nt, Homo sapiens
auggagacaccaccac

SEQ ID NO: 26741 - RNA, 10 nt, Homo sapiens
augugcaaua

SEQ ID NO: 26742 - RNA, 23 nt, Homo sapiens
auguggagggggcgcgugcaggc

SEQ ID NO: 26743 - RNA, 19 nt, Homo sapiens
aucuauuuauuaauauuua

SEQ ID NO: 26744 - RNA, 14 nt, Homo sapiens
auccuucagccuga

SEQ ID NO: 26745 - RNA, 15 nt, Homo sapiens
aucuugucucugggc

SEQ ID NO: 26746 - RNA, 22 nt, Homo sapiens
aucucuauuaggaaauauucug

SEQ ID NO: 26747 - RNA, 21 nt, Homo sapiens
auccuaauaaaaaggugacca

SEQ ID NO: 26748 - RNA, 20 nt, Homo sapiens
auccuaauaaaaaggugacc

SEQ ID NO: 26749 - RNA, 18 nt, Homo sapiens
auccuaauaaaaagguga

SEQ ID NO: 26750 - RNA, 19 nt, Homo sapiens
auccuaauaaaaaggugac

SEQ ID NO: 26751 - RNA, 9 nt, Homo sapiens
aucaauauc

SEQ ID NO: 26752 - RNA, 10 nt, Homo sapiens
aucaauaucu

SEQ ID NO: 26753 - RNA, 15 nt, Homo sapiens
aucaggcuggccaac

SEQ ID NO: 26754 - RNA, 12 nt, Homo sapiens
auaugugaaaua

SEQ ID NO: 26755 - RNA, 21 nt, Homo sapiens
auauuuuuuguuaaaugauuu

SEQ ID NO: 26756 - RNA, 22 nt, Homo sapiens
auauuuuuuguuaaaugauuuc

SEQ ID NO: 26757 - RNA, 14 nt, Homo sapiens
aaaguucugcagau

SEQ ID NO: 26758 - RNA, 13 nt, Homo sapiens
aaauaaugaaaua

SEQ ID NO: 26759 - RNA, 15 nt, Homo sapiens
aacaguauccaguac

SEQ ID NO: 26760 - RNA, 12 nt, Homo sapiens
aaccagccuggu

SEQ ID NO: 26761 - RNA, 13 nt, Homo sapiens
aaccagccugguc

SEQ ID NO: 26762 - RNA, 22 nt, Homo sapiens
aaauuugguucuaggccgggcg

SEQ ID NO: 26763 - RNA, 21 nt, Homo sapiens
aaccaaauggagugacuuagu

SEQ ID NO: 26764 - RNA, 15 nt, Homo sapiens
aaccagccuggucaa

SEQ ID NO: 26765 - RNA, 21 nt, Homo sapiens
aacacagugucuggcacuugg

SEQ ID NO: 26766 - RNA, 18 nt, Homo sapiens
aacacaugauccugcaau

SEQ ID NO: 26767 - RNA, 21 nt, Homo sapiens
aaauuugguucuaggccgggc

SEQ ID NO: 26768 - RNA, 23 nt, Homo sapiens
aaauuugguucuaggccgggcgc

SEQ ID NO: 26769 - RNA, 11 nt, Homo sapiens
aaagugcuggg

SEQ ID NO: 26770 - RNA, 12 nt, Homo sapiens
aaagugcuggga

SEQ ID NO: 26771 - RNA, 14 nt, Homo sapiens
aaaggccugucccu

SEQ ID NO: 26772 - RNA, 22 nt, Homo sapiens
aaagguauuuauugagcaccug

SEQ ID NO: 26773 - RNA, 23 nt, Homo sapiens
aaagguauuuauugagcaccugc

SEQ ID NO: 26774 - RNA, 17 nt, Homo sapiens
aaaguagauuaagagau

SEQ ID NO: 26775 - RNA, 16 nt, Homo sapiens
aaaauggugugaccac

SEQ ID NO: 26776 - RNA, 15 nt, Homo sapiens
aaagacaaagacaaa

SEQ ID NO: 26777 - RNA, 13 nt, Homo sapiens
aaaaaggugacca

SEQ ID NO: 26778 - RNA, 15 nt, Homo sapiens
aagagauggguuuga

SEQ ID NO: 26779 - RNA, 23 nt, Homo sapiens
aagaggauguguggcauuuucac

SEQ ID NO: 26780 - RNA, 11 nt, Homo sapiens
aaccuccaccu

SEQ ID NO: 26781 - RNA, 16 nt, Homo sapiens
aacccggccugauuaa

SEQ ID NO: 26782 - RNA, 18 nt, Homo sapiens
aaccucauuccccaacca

SEQ ID NO: 26783 - RNA, 22 nt, Homo sapiens
aaccuguugauagcaagugaau

SEQ ID NO: 26784 - RNA, 17 nt, Homo sapiens
aaccuuuacauccagau

SEQ ID NO: 26785 - RNA, 13 nt, Homo sapiens
aaccugagcccca

SEQ ID NO: 26786 - RNA, 13 nt, Homo sapiens
aacucauuuccua

SEQ ID NO: 26787 - RNA, 21 nt, Homo sapiens
aagcacuuucccucuuggugc

SEQ ID NO: 26788 - RNA, 17 nt, Homo sapiens
aagcaugggccuagccc

SEQ ID NO: 26789 - RNA, 21 nt, Homo sapiens
aagguauuuuaaucaccaagg

SEQ ID NO: 26790 - RNA, 12 nt, Homo sapiens
aaguaauuucag

SEQ ID NO: 26791 - RNA, 14 nt, Homo sapiens
aagaguggguuuca

SEQ ID NO: 26792 - RNA, 20 nt, Homo sapiens
acaccaccacccuugccaug

SEQ ID NO: 26793 - RNA, 14 nt, Homo sapiens
acacaugauccugc

SEQ ID NO: 26794 - RNA, 21 nt, Homo sapiens
acagacuuuuuuuuuuuuuua

SEQ ID NO: 26795 - RNA, 10 nt, Homo sapiens
acagagacag

SEQ ID NO: 26796 - RNA, 11 nt, Homo sapiens
acagagacaga

SEQ ID NO: 26797 - RNA, 13 nt, Homo sapiens
acagaggaucugc

SEQ ID NO: 26798 - RNA, 18 nt, Homo sapiens
acaagugaaaaacaucca

SEQ ID NO: 26799 - RNA, 13 nt, Homo sapiens
acaaccuguccca

SEQ ID NO: 26800 - RNA, 20 nt, Homo sapiens
acaggcuccaaacuggagcu

SEQ ID NO: 26801 - RNA, 16 nt, Homo sapiens
acaggcgugagccacc

SEQ ID NO: 26802 - RNA, 18 nt, Homo sapiens
acaggcgugagccaccaa

SEQ ID NO: 26803 - RNA, 11 nt, Homo sapiens
acaggcgugag

SEQ ID NO: 26804 - RNA, 10 nt, Homo sapiens
acaggcguga

SEQ ID NO: 26805 - RNA, 19 nt, Homo sapiens
acaguuccugagaccagcc

SEQ ID NO: 26806 - RNA, 20 nt, Homo sapiens
acaguuccugagaccagcca

SEQ ID NO: 26807 - RNA, 20 nt, Homo sapiens
aauacaaaaauuagccgggc

SEQ ID NO: 26808 - RNA, 23 nt, Homo sapiens
aagugcugggaauuacaggcgug

SEQ ID NO: 26809 - RNA, 20 nt, Homo sapiens
aauacucuuaggaagagaaa

SEQ ID NO: 26810 - RNA, 15 nt, Homo sapiens
aauagugucugauga

SEQ ID NO: 26811 - RNA, 16 nt, Homo sapiens
aauagugucugaugaa

SEQ ID NO: 26812 - RNA, 15 nt, Homo sapiens
aauggagacaccacc

SEQ ID NO: 26813 - RNA, 17 nt, Homo sapiens
aauggagacaccaccac

SEQ ID NO: 26814 - RNA, 19 nt, Homo sapiens
aauccuuuguuuucugacu

SEQ ID NO: 26815 - RNA, 18 nt, Homo sapiens
acaaaaauuagccgggca

SEQ ID NO: 26816 - RNA, 23 nt, Homo sapiens
accugcuguuuccuagcgcagcc

SEQ ID NO: 26817 - RNA, 22 nt, Homo sapiens
accugcuguuuccuagcgcagc

SEQ ID NO: 26818 - RNA, 11 nt, Homo sapiens
accugagcccc

SEQ ID NO: 26819 - RNA, 18 nt, Homo sapiens
accucugccucagaaaac

SEQ ID NO: 26820 - RNA, 13 nt, Homo sapiens
accuucuggguuc

SEQ ID NO: 26821 - RNA, 13 nt, Homo sapiens
acccgggaggcag

SEQ ID NO: 26822 - RNA, 14 nt, Homo sapiens
acccgggaggcaga

SEQ ID NO: 26823 - RNA, 22 nt, Homo sapiens
accuccugccuaagugcagccc

SEQ ID NO: 26824 - RNA, 14 nt, Homo sapiens
acccucugggucuc

SEQ ID NO: 26825 - RNA, 15 nt, Homo sapiens
acccucugggucuca

SEQ ID NO: 26826 - RNA, 17 nt, Homo sapiens
accuguaaucccagcua

SEQ ID NO: 26827 - RNA, 17 nt, Homo sapiens
acgccuguaaucccagc

SEQ ID NO: 26828 - RNA, 10 nt, Homo sapiens
acgugcaaua

SEQ ID NO: 26829 - RNA, 11 nt, Homo sapiens
acgugcaauac

SEQ ID NO: 26830 - RNA, 18 nt, Homo sapiens
acugggguggguggggca

SEQ ID NO: 26831 - RNA, 17 nt, Homo sapiens
acugccgguuugaaaau

SEQ ID NO: 26832 - RNA, 19 nt, Homo sapiens
acucauugcaaccuccacc

SEQ ID NO: 26833 - RNA, 19 nt, Homo sapiens
acucuuaggaagagaaacc

SEQ ID NO: 26834 - RNA, 14 nt, Homo sapiens
acucagaaacauca

SEQ ID NO: 26835 - RNA, 20 nt, Homo sapiens
acuuauaggaauugacccac

SEQ ID NO: 26836 - RNA, 23 nt, Homo sapiens
acuucauucuugaaagcuguggc

SEQ ID NO: 26837 - RNA, 15 nt, Homo sapiens
acuuuuuuucuuuuc

SEQ ID NO: 26838 - RNA, 12 nt, Homo sapiens
aggcaagagaau

SEQ ID NO: 26839 - RNA, 13 nt, Homo sapiens
aggaguuuggcca

SEQ ID NO: 26840 - RNA, 14 nt, Homo sapiens
agcuguugagcugu

SEQ ID NO: 26841 - RNA, 19 nt, Homo sapiens
aggcauuugcagcugugcc

SEQ ID NO: 26842 - RNA, 20 nt, Homo sapiens
aggcauuugcagcugugcca

SEQ ID NO: 26843 - RNA, 10 nt, Homo sapiens
aggccgggcg

SEQ ID NO: 26844 - RNA, 12 nt, Homo sapiens
agccccgggagu

SEQ ID NO: 26845 - RNA, 21 nt, Homo sapiens
agccgggcaugguggcgcgca

SEQ ID NO: 26846 - RNA, 18 nt, Homo sapiens
agccuugcuccuggcugg

SEQ ID NO: 26847 - RNA, 19 nt, Homo sapiens
agccuugcuccuggcuggg

SEQ ID NO: 26848 - RNA, 23 nt, Homo sapiens
agauagguuaccaguaacggaac

SEQ ID NO: 26849 - RNA, 22 nt, Homo sapiens
agacgggguuugccaugcuggc

SEQ ID NO: 26850 - RNA, 12 nt, Homo sapiens
agacaccaccac

SEQ ID NO: 26851 - RNA, 19 nt, Homo sapiens
agaaguuaagcaacaucua

SEQ ID NO: 26852 - RNA, 19 nt, Homo sapiens
agagacgggguuugccaug

SEQ ID NO: 26853 - RNA, 23 nt, Homo sapiens
agacgggguuugccaugcuggcc

SEQ ID NO: 26854 - RNA, 18 nt, Homo sapiens
agccccuugggcagguca

SEQ ID NO: 26855 - RNA, 16 nt, Homo sapiens
agccuaguugaucagc

SEQ ID NO: 26856 - RNA, 24 nt, Homo sapiens
agcaccugcaggcgugaccugaca

SEQ ID NO: 26857 - RNA, 24 nt, Homo sapiens
agccaugugauuacccucuggguc

SEQ ID NO: 26858 - RNA, 15 nt, Homo sapiens
ucacagguugaccaa

SEQ ID NO: 26859 - RNA, 21 nt, Homo sapiens
cuguaaucccagcacuuuggg

SEQ ID NO: 26860 - RNA, 21 nt, Homo sapiens
ugugguccgaagucuuccaua

SEQ ID NO: 26861 - RNA, 13 nt, Homo sapiens
uuuuccuucucau

SEQ ID NO: 26862 - RNA, 23 nt, Homo sapiens
gaagagaauauuagcuuuacugu

SEQ ID NO: 26863 - RNA, 23 nt, Homo sapiens
cuaagugaaauaagccagacauc

SEQ ID NO: 26864 - RNA, 17 nt, Homo sapiens
gguccgaagucuuccau

SEQ ID NO: 26865 - RNA, 14 nt, Homo sapiens
aaaugagcaaaagu

SEQ ID NO: 26866 - RNA, 14 nt, Homo sapiens
aguacagacuuuuu

SEQ ID NO: 26867 - RNA, 21 nt, Homo sapiens
ucacaagugaaaaacauccag

SEQ ID NO: 26868 - RNA, 17 nt, Homo sapiens
uguguuuauuucacuug

SEQ ID NO: 26869 - RNA, 15 nt, Homo sapiens
uugaacccaggagau

SEQ ID NO: 26870 - RNA, 14 nt, Homo sapiens
caauauccuaauaa

SEQ ID NO: 26871 - RNA, 18 nt, Homo sapiens
caaccuccaccuucuggg

SEQ ID NO: 26872 - RNA, 19 nt, Homo sapiens
auucuauuacgugcaauac

SEQ ID NO: 26873 - RNA, 16 nt, Homo sapiens
aacucagaaacaucag

SEQ ID NO: 26874 - RNA, 13 nt, Homo sapiens
augcacacagugc

SEQ ID NO: 26875 - RNA, 15 nt, Homo sapiens
uauuuauugcugaau

SEQ ID NO: 26876 - RNA, 19 nt, Homo sapiens
gagccaccaaacccggccu

SEQ ID NO: 26877 - RNA, 11 nt, Homo sapiens
cccuugccaug

SEQ ID NO: 26878 - RNA, 12 nt, Homo sapiens
aaguauccuuca

SEQ ID NO: 26879 - RNA, 21 nt, Homo sapiens
auugcuuguuagcaaaaugga

SEQ ID NO: 26880 - RNA, 19 nt, Homo sapiens
caagacucugucucaaaaa

SEQ ID NO: 26881 - RNA, 23 nt, Homo sapiens
agccaaccugggggcuuuaggga

SEQ ID NO: 26882 - RNA, 19 nt, Homo sapiens
agaauauuuauuaccucug

SEQ ID NO: 26883 - RNA, 19 nt, Homo sapiens
aaaacuuuaugcuaaguga

SEQ ID NO: 26884 - RNA, 18 nt, Homo sapiens
ccuuuggaugcacuuuau

SEQ ID NO: 26885 - RNA, 19 nt, Homo sapiens
cugugucaguggaugcugc

SEQ ID NO: 26886 - RNA, 23 nt, Homo sapiens
uuuuuccuuccuuaucacugaca

SEQ ID NO: 26887 - RNA, 16 nt, Homo sapiens
agauuucaugccuggu

SEQ ID NO: 26888 - RNA, 20 nt, Homo sapiens
acagagcaagacucugucuc

SEQ ID NO: 26889 - RNA, 10 nt, Homo sapiens
uuugccaugc

SEQ ID NO: 26890 - RNA, 15 nt, Homo sapiens
aauagugucugauga

SEQ ID NO: 26891 - RNA, 21 nt, Homo sapiens
uaauuuaucuugucucugggc

SEQ ID NO: 26892 - RNA, 23 nt, Homo sapiens
guucuucccuuuuacauacugcu

SEQ ID NO: 26893 - RNA, 13 nt, Homo sapiens
uacauacugcugu

SEQ ID NO: 26894 - RNA, 21 nt, Homo sapiens
agaauuuauucaauuccucug

SEQ ID NO: 26895 - RNA, 20 nt, Homo sapiens
uaagcacuuuaacacagugu

SEQ ID NO: 26896 - RNA, 15 nt, Homo sapiens
aaccaugcccaagaa

SEQ ID NO: 26897 - RNA, 12 nt, Homo sapiens
ccaaacuggagc

SEQ ID NO: 26898 - RNA, 20 nt, Homo sapiens
cacagcugaacuuguugaga

SEQ ID NO: 26899 - RNA, 23 nt, Homo sapiens
auuggacuuaaaaucuaauucaa

SEQ ID NO: 26900 - RNA, 21 nt, Homo sapiens
caauucuauuacgugcaauac

SEQ ID NO: 26901 - RNA, 16 nt, Homo sapiens
uacauuuccaaauuca

SEQ ID NO: 26902 - RNA, 16 nt, Homo sapiens
cugauacccuuugaaa

SEQ ID NO: 26903 - RNA, 22 nt, Homo sapiens
aagaguggguuucacaagugaa

SEQ ID NO: 26904 - RNA, 15 nt, Homo sapiens
ucccugcagacauga

SEQ ID NO: 26905 - RNA, 16 nt, Homo sapiens
uuuuacauacugcugu

SEQ ID NO: 26906 - RNA, 17 nt, Homo sapiens
gaaagcagggacuugaa

SEQ ID NO: 26907 - RNA, 12 nt, Homo sapiens
ccaacuaggcag

SEQ ID NO: 26908 - RNA, 23 nt, Homo sapiens
agcuaaguugcaccaacuuugaa

SEQ ID NO: 26909 - RNA, 20 nt, Homo sapiens
guucuucuuggucucagugu

SEQ ID NO: 26910 - RNA, 15 nt, Homo sapiens
acgaaaaacauuuca

SEQ ID NO: 26911 - RNA, 17 nt, Homo sapiens
aauggaaaguaacucau

SEQ ID NO: 26912 - RNA, 19 nt, Homo sapiens
ccuggucaacauggugaaa

SEQ ID NO: 26913 - RNA, 21 nt, Homo sapiens
cucugugaacgauuuagaaag

SEQ ID NO: 26914 - RNA, 11 nt, Homo sapiens
uaugugcaaua

SEQ ID NO: 26915 - RNA, 22 nt, Homo sapiens
aauucgcugcaaccuguugaua

SEQ ID NO: 26916 - RNA, 21 nt, Homo sapiens
gcuuauucacaagacccaaaa

SEQ ID NO: 26917 - RNA, 18 nt, Homo sapiens
ccuggcugggaguggcau

SEQ ID NO: 26918 - RNA, 21 nt, Homo sapiens
cugugauucccuccugcuacu

SEQ ID NO: 26919 - RNA, 14 nt, Homo sapiens
auauccugugacug

SEQ ID NO: 26920 - RNA, 23 nt, Homo sapiens
aaggcuuagacccucaugcugcc

SEQ ID NO: 26921 - RNA, 16 nt, Homo sapiens
aagcagaacagugauu

SEQ ID NO: 26922 - RNA, 21 nt, Homo sapiens
gauaucaugccccuguacucc

SEQ ID NO: 26923 - RNA, 12 nt, Homo sapiens
aauucauguuuc

SEQ ID NO: 26924 - RNA, 16 nt, Homo sapiens
gaaaggcauucucuga

SEQ ID NO: 26925 - RNA, 19 nt, Homo sapiens
gaaguacucauacauguua

SEQ ID NO: 26926 - RNA, 15 nt, Homo sapiens
acaggcgugagccac

SEQ ID NO: 26927 - RNA, 19 nt, Homo sapiens
gcuuguuagcaaaauggau

SEQ ID NO: 26928 - RNA, 19 nt, Homo sapiens
caugugauuacccucuggg

SEQ ID NO: 26929 - RNA, 13 nt, Homo sapiens
caacugugacugu

SEQ ID NO: 26930 - RNA, 14 nt, Homo sapiens
cugcuuuaauuuca

SEQ ID NO: 26931 - RNA, 15 nt, Homo sapiens
uuuagggaccugcug

SEQ ID NO: 26932 - RNA, 17 nt, Homo sapiens
auuuuuagacucaucaa

SEQ ID NO: 26933 - RNA, 16 nt, Homo sapiens
augaauaaaguguaag

SEQ ID NO: 26934 - RNA, 21 nt, Homo sapiens
uucaaaaucaaauuccagaau

SEQ ID NO: 26935 - RNA, 23 nt, Homo sapiens
caauaucuaauauauaugaauaa

SEQ ID NO: 26936 - RNA, 23 nt, Homo sapiens
cauugagaacugcauauguuucg

SEQ ID NO: 26937 - RNA, 23 nt, Homo sapiens
caauuauaucaguccucuuucaa

SEQ ID NO: 26938 - RNA, 19 nt, Homo sapiens
aaugacuaaaaaacaaaga

SEQ ID NO: 26939 - RNA, 19 nt, Homo sapiens
gccauaauuacuaugucau

SEQ ID NO: 26940 - RNA, 14 nt, Homo sapiens
uaauuacuauguca

SEQ ID NO: 26941 - RNA, 12 nt, Homo sapiens
gauagcaaguga

SEQ ID NO: 26942 - RNA, 22 nt, Homo sapiens
ucgaacugcuggauucaaguga

SEQ ID NO: 26943 - RNA, 18 nt, Homo sapiens
ggacuugggcgggacaca

SEQ ID NO: 26944 - RNA, 21 nt, Homo sapiens
ugaaauaagccagacaucaac

SEQ ID NO: 26945 - RNA, 15 nt, Homo sapiens
agaagacaacauuaa

SEQ ID NO: 26946 - RNA, 20 nt, Homo sapiens
uauuuguacaccaauauuca

SEQ ID NO: 26947 - RNA, 24 nt, Homo sapiens
augcaaccuuuggaugcacuuuau

SEQ ID NO: 26948 - RNA, 15 nt, Homo sapiens
agcaucucaggagau

SEQ ID NO: 26949 - RNA, 16 nt, Homo sapiens
acuggcucccuggaag

SEQ ID NO: 26950 - RNA, 20 nt, Homo sapiens
ggccagaagucaaggcuuag

SEQ ID NO: 26951 - RNA, 21 nt, Homo sapiens
uaguguuggaaaaugugcaau

SEQ ID NO: 26952 - RNA, 15 nt, Homo sapiens
uguuuuuaaacugga

SEQ ID NO: 26953 - RNA, 14 nt, Homo sapiens
aguggcauguauga

SEQ ID NO: 26954 - RNA, 20 nt, Homo sapiens
ucucaggggccaacuaggca

SEQ ID NO: 26955 - RNA, 18 nt, Homo sapiens
agauuguauagugcaugu

SEQ ID NO: 26956 - RNA, 16 nt, Homo sapiens
acuuuuguguaaugaa

SEQ ID NO: 26957 - RNA, 23 nt, Homo sapiens
gauuacaaggcuuuaucucaggg

SEQ ID NO: 26958 - RNA, 22 nt, Homo sapiens
aaaauauuuuuaugugcaauaa

SEQ ID NO: 26959 - RNA, 12 nt, Homo sapiens
agcaucucagga

SEQ ID NO: 26960 - RNA, 21 nt, Homo sapiens
cuuaguguacaugaaagcgua

SEQ ID NO: 26961 - RNA, 12 nt, Homo sapiens
aauuuacuuugu

SEQ ID NO: 26962 - RNA, 12 nt, Homo sapiens
ugcaauuccacu

SEQ ID NO: 26963 - RNA, 16 nt, Homo sapiens
auaauacuagucuuau

SEQ ID NO: 26964 - RNA, 23 nt, Homo sapiens
aaggaagaaauuccaggaaaauc

SEQ ID NO: 26965 - RNA, 16 nt, Homo sapiens
guaaaauggagacacc

SEQ ID NO: 26966 - RNA, 22 nt, Homo sapiens
uugcuccuggcuggggccuguu

SEQ ID NO: 26967 - RNA, 20 nt, Homo sapiens
gcuacucuguuccuucacau

SEQ ID NO: 26968 - RNA, 20 nt, Homo sapiens
acauagaauuaacacaugau

SEQ ID NO: 26969 - RNA, 19 nt, Homo sapiens
auccugcaauuccacuuau

SEQ ID NO: 26970 - RNA, 21 nt, Homo sapiens
ucugauuuuccuggacaguuu

SEQ ID NO: 26971 - RNA, 20 nt, Homo sapiens
gccuguaaucccagcacuuu

SEQ ID NO: 26972 - RNA, 17 nt, Homo sapiens
gcauuguaacuuaugaa

SEQ ID NO: 26973 - RNA, 16 nt, Homo sapiens
auuuccaaauucacaa

SEQ ID NO: 26974 - RNA, 22 nt, Homo sapiens
agcuuuucaaaauuggacuuaa

SEQ ID NO: 26975 - RNA, 20 nt, Homo sapiens
gggaggcagagguugcagug

SEQ ID NO: 26976 - RNA, 21 nt, Homo sapiens
cggaucuggggcucugggaua

SEQ ID NO: 26977 - RNA, 15 nt, Homo sapiens
gguggcgcgcaccug

SEQ ID NO: 26978 - RNA, 20 nt, Homo sapiens
aaauauuuuuaugugcaaua

SEQ ID NO: 26979 - RNA, 12 nt, Homo sapiens
aacugugacugu

SEQ ID NO: 26980 - RNA, 14 nt, Homo sapiens
agcagaacagugau

SEQ ID NO: 26981 - RNA, 18 nt, Homo sapiens
gagacgggguuugccaug

SEQ ID NO: 26982 - RNA, 20 nt, Homo sapiens
auggagguuaagcacuuuaa

SEQ ID NO: 26983 - RNA, 21 nt, Homo sapiens
ucuuuuuagagaaauuugcca

SEQ ID NO: 26984 - RNA, 16 nt, Homo sapiens
cuaaaguaucuguauu

SEQ ID NO: 26985 - RNA, 17 nt, Homo sapiens
agagacgggguuugcca

SEQ ID NO: 26986 - RNA, 22 nt, Homo sapiens
auaauuccuauauccugugacu

SEQ ID NO: 26987 - RNA, 20 nt, Homo sapiens
uugacuauuauagaauggaa

SEQ ID NO: 26988 - RNA, 13 nt, Homo sapiens
uguugauagcaag

SEQ ID NO: 26989 - RNA, 17 nt, Homo sapiens
uaaaaaggcauguaauu

SEQ ID NO: 26990 - RNA, 23 nt, Homo sapiens
gaauucuuacauguuuucuuugc

SEQ ID NO: 26991 - RNA, 13 nt, Homo sapiens
aucuauuuauuaa

SEQ ID NO: 26992 - RNA, 18 nt, Homo sapiens
aaccuuauuguaccucuc

SEQ ID NO: 26993 - RNA, 18 nt, Homo sapiens
agacgggguuugccaugc

SEQ ID NO: 26994 - RNA, 14 nt, Homo sapiens
gcaaaugcuguauu

SEQ ID NO: 26995 - RNA, 19 nt, Homo sapiens
cagagacgggguuugccau

SEQ ID NO: 26996 - RNA, 12 nt, Homo sapiens
cucugauaccuc

SEQ ID NO: 26997 - RNA, 19 nt, Homo sapiens
uacauuuccaaauucacaa

SEQ ID NO: 26998 - RNA, 13 nt, Homo sapiens
uucugcaagcuuu

SEQ ID NO: 26999 - RNA, 22 nt, Homo sapiens
aauuccuauauccugugacugu

SEQ ID NO: 27000 - RNA, 18 nt, Homo sapiens
cuaaaaaggcauguaauu

SEQ ID NO: 27001 - RNA, 14 nt, Homo sapiens
uaguguacaugaaa

SEQ ID NO: 27002 - RNA, 15 nt, Homo sapiens
gccacuucacuuuuu

SEQ ID NO: 27003 - RNA, 21 nt, Homo sapiens
gaauauuuauuaccucugaua

SEQ ID NO: 27004 - RNA, 23 nt, Homo sapiens
gaauaguguuggaaaaugugcaa

SEQ ID NO: 27005 - RNA, 19 nt, Homo sapiens
gcuuuccguggcacugcau

SEQ ID NO: 27006 - RNA, 16 nt, Homo sapiens
uuccguggcacugcau

SEQ ID NO: 27007 - RNA, 15 nt, Homo sapiens
cucuggcgacaguuu

SEQ ID NO: 27008 - RNA, 19 nt, Homo sapiens
cacuaaauugacacuuaaa

SEQ ID NO: 27009 - RNA, 11 nt, Homo sapiens
caagaaugaga

SEQ ID NO: 27010 - RNA, 18 nt, Homo sapiens
auuguugacaacugugac

SEQ ID NO: 27011 - RNA, 14 nt, Homo sapiens
uuguaaaauggugu

SEQ ID NO: 27012 - RNA, 22 nt, Homo sapiens
guuaagcacuuuaacacagugu

SEQ ID NO: 27013 - RNA, 15 nt, Homo sapiens
ggcugggaguggcau

SEQ ID NO: 27014 - RNA, 23 nt, Homo sapiens
ucacuuuuuuucuuuucucugcc

SEQ ID NO: 27015 - RNA, 13 nt, Homo sapiens
cuuaaaauguaau

SEQ ID NO: 27016 - RNA, 20 nt, Homo sapiens
cgguuugaaaauaugccugc

SEQ ID NO: 27017 - RNA, 22 nt, Homo sapiens
ccucaucuguaaaauggagaca

SEQ ID NO: 27018 - RNA, 15 nt, Homo sapiens
gagugcaguggcgca

SEQ ID NO: 27019 - RNA, 14 nt, Homo sapiens
agccacuucacuuu

SEQ ID NO: 27020 - RNA, 13 nt, Homo sapiens
ugcuaagugaaau

SEQ ID NO: 27021 - RNA, 18 nt, Homo sapiens
guaucaaccaaauggagu

SEQ ID NO: 27022 - RNA, 16 nt, Homo sapiens
uagaauuaacacauga

SEQ ID NO: 27023 - RNA, 18 nt, Homo sapiens
gaggcugaggcgggugga

SEQ ID NO: 27024 - RNA, 20 nt, Homo sapiens
ucucuacuaaaaauacaaaa

SEQ ID NO: 27025 - RNA, 16 nt, Homo sapiens
ccuuauuguaccucuc

SEQ ID NO: 27026 - RNA, 19 nt, Homo sapiens
uaaacacuaaaaaggcaug

SEQ ID NO: 27027 - RNA, 23 nt, Homo sapiens
ucaucugugauucccuccugcua

SEQ ID NO: 27028 - RNA, 14 nt, Homo sapiens
uucacuuauugacu

SEQ ID NO: 27029 - RNA, 19 nt, Homo sapiens
agagcaagacucugucuca

SEQ ID NO: 27030 - RNA, 17 nt, Homo sapiens
accuuuggaugcacuuu

SEQ ID NO: 27031 - RNA, 18 nt, Homo sapiens
cuguaaucccagcuacuu

SEQ ID NO: 27032 - RNA, 18 nt, Homo sapiens
uaagugaagugauacuau

SEQ ID NO: 27033 - RNA, 19 nt, Homo sapiens
gguuugccaugcuggccag

SEQ ID NO: 27034 - RNA, 20 nt, Homo sapiens
uaaaauuaucaauaucuaau

SEQ ID NO: 27035 - RNA, 13 nt, Homo sapiens
auuauuuuuacag

SEQ ID NO: 27036 - RNA, 9 nt, Homo sapiens
ugugcaaua

SEQ ID NO: 27037 - RNA, 12 nt, Homo sapiens
gagcgacaguga

SEQ ID NO: 27038 - RNA, 19 nt, Homo sapiens
caggauagagugggacagu

SEQ ID NO: 27039 - RNA, 23 nt, Homo sapiens
aaucugagccagugcuuuaaugg

SEQ ID NO: 27040 - RNA, 13 nt, Homo sapiens
aucaaaagaaaga

SEQ ID NO: 27041 - RNA, 20 nt, Homo sapiens
aaauugggaaaggaguagaa

SEQ ID NO: 27042 - RNA, 18 nt, Homo sapiens
cuggcuggggccuguuga

SEQ ID NO: 27043 - RNA, 21 nt, Homo sapiens
augaaaacauagcaucucagg

SEQ ID NO: 27044 - RNA, 18 nt, Homo sapiens
gagccaccaaacccggcc

SEQ ID NO: 27045 - RNA, 18 nt, Homo sapiens
ugcauugagaacugcaua

SEQ ID NO: 27046 - RNA, 19 nt, Homo sapiens
ucccucuaauuuaucuugu

SEQ ID NO: 27047 - RNA, 14 nt, Homo sapiens
gauagagugggaca

SEQ ID NO: 27048 - RNA, 20 nt, Homo sapiens
ugcuacaaauacucuuagga

SEQ ID NO: 27049 - RNA, 20 nt, Homo sapiens
aaaaccaaauuuguauuuaa

SEQ ID NO: 27050 - RNA, 13 nt, Homo sapiens
gugcaauauguga

SEQ ID NO: 27051 - RNA, 12 nt, Homo sapiens
gggaguggcgcg

SEQ ID NO: 27052 - RNA, 24 nt, Homo sapiens
aaugauuuuacggagauaucccag

SEQ ID NO: 27053 - RNA, 15 nt, Homo sapiens
acuuuuggcuuguaa

SEQ ID NO: 27054 - RNA, 13 nt, Homo sapiens
uuuauuaccucug

SEQ ID NO: 27055 - RNA, 15 nt, Homo sapiens
agugagcugauauca

SEQ ID NO: 27056 - RNA, 18 nt, Homo sapiens
uccaagccucauguccac

SEQ ID NO: 27057 - RNA, 17 nt, Homo sapiens
ugaaaggcauucucuga

SEQ ID NO: 27058 - RNA, 18 nt, Homo sapiens
ucaucuuggucacauaca

SEQ ID NO: 27059 - RNA, 18 nt, Homo sapiens
acaacuugaauaauacac

SEQ ID NO: 27060 - RNA, 21 nt, Homo sapiens
aguguuggaaaaugugcaaua

SEQ ID NO: 27061 - RNA, 14 nt, Homo sapiens
acuaaaaaggcaug

SEQ ID NO: 27062 - RNA, 15 nt, Homo sapiens
ggaggcugaggcaag

SEQ ID NO: 27063 - RNA, 21 nt, Homo sapiens
aauuacaggcgugagccacca

SEQ ID NO: 27064 - RNA, 20 nt, Homo sapiens
cucuaacucagaaacaucag

SEQ ID NO: 27065 - RNA, 17 nt, Homo sapiens
uuugcagcugugccaua

SEQ ID NO: 27066 - RNA, 20 nt, Homo sapiens
aacccaggagauggaaguug

SEQ ID NO: 27067 - RNA, 16 nt, Homo sapiens
ucccugcagacaugag

SEQ ID NO: 27068 - RNA, 16 nt, Homo sapiens
aauaaaaugagcaaaa

SEQ ID NO: 27069 - RNA, 13 nt, Homo sapiens
ugacccacaagaa

SEQ ID NO: 27070 - RNA, 14 nt, Homo sapiens
aucuacacuccagu

SEQ ID NO: 27071 - RNA, 14 nt, Homo sapiens
cagaacuugaaugu

SEQ ID NO: 27072 - RNA, 23 nt, Homo sapiens
guaaaauugaaaggcauucucug

SEQ ID NO: 27073 - RNA, 19 nt, Homo sapiens
gagcauuuauaaauggaca

SEQ ID NO: 27074 - RNA, 22 nt, Homo sapiens
gaccuggucgucgucuugacuu

SEQ ID NO: 27075 - RNA, 14 nt, Homo sapiens
uauagacucuagga

SEQ ID NO: 27076 - RNA, 16 nt, Homo sapiens
uggcugggaguggcau

SEQ ID NO: 27077 - RNA, 18 nt, Homo sapiens
cugaaagaggaaugaagu

SEQ ID NO: 27078 - RNA, 23 nt, Homo sapiens
uaucucaggggccaacuaggcag

SEQ ID NO: 27079 - RNA, 19 nt, Homo sapiens
gcagagacgggguuugcca

SEQ ID NO: 27080 - RNA, 16 nt, Homo sapiens
uacauucugcuuucau

SEQ ID NO: 27081 - RNA, 13 nt, Homo sapiens
agaucaagccauc

SEQ ID NO: 27082 - RNA, 19 nt, Homo sapiens
aaucaaauuccagaaugau

SEQ ID NO: 27083 - RNA, 14 nt, Homo sapiens
gaguuuggccagaa

SEQ ID NO: 27084 - RNA, 13 nt, Homo sapiens
cucuuggugccuc

SEQ ID NO: 27085 - RNA, 17 nt, Homo sapiens
uauagaauggaacucaa

SEQ ID NO: 27086 - RNA, 17 nt, Homo sapiens
gagacgggguuugccau

SEQ ID NO: 27087 - RNA, 19 nt, Homo sapiens
gaagcaacccaaauguuca

SEQ ID NO: 27088 - RNA, 21 nt, Homo sapiens
ucuuaaacacuaaaaaggcau

SEQ ID NO: 27089 - RNA, 23 nt, Homo sapiens
gugaauuuuucucuaacucagaa

SEQ ID NO: 27090 - RNA, 15 nt, Homo sapiens
gcuaauuuguguauu

SEQ ID NO: 27091 - RNA, 17 nt, Homo sapiens
uaccucugauaccucaa

SEQ ID NO: 27092 - RNA, 13 nt, Homo sapiens
gacaaauucuguu

SEQ ID NO: 27093 - RNA, 23 nt, Homo sapiens
aucggaucuggggcucugggaua

SEQ ID NO: 27094 - RNA, 16 nt, Homo sapiens
ucucgaacugcuggau

SEQ ID NO: 27095 - RNA, 16 nt, Homo sapiens
auguguggcauuuuca

SEQ ID NO: 27096 - RNA, 15 nt, Homo sapiens
gcaaugugacuuaau

SEQ ID NO: 27097 - RNA, 17 nt, Homo sapiens
auacuucaauacuucau

SEQ ID NO: 27098 - RNA, 16 nt, Homo sapiens
ccacgcccagcuaauu

SEQ ID NO: 27099 - RNA, 21 nt, Homo sapiens
cuggcucccuggaagagauca

SEQ ID NO: 27100 - RNA, 11 nt, Homo sapiens
augauguuucg

SEQ ID NO: 27101 - RNA, 22 nt, Homo sapiens
acuccugguuccuaggugagca

SEQ ID NO: 27102 - RNA, 14 nt, Homo sapiens
agcaaaaugugaua

SEQ ID NO: 27103 - RNA, 13 nt, Homo sapiens
ucauguacaucca

SEQ ID NO: 27104 - RNA, 12 nt, Homo sapiens
auuuucuuccaa

SEQ ID NO: 27105 - RNA, 17 nt, Homo sapiens
cagucacauuccaagcc

SEQ ID NO: 27106 - RNA, 17 nt, Homo sapiens
aaagacuaugaggaaua

SEQ ID NO: 27107 - RNA, 11 nt, Homo sapiens
cucaugcugcc

SEQ ID NO: 27108 - RNA, 15 nt, Homo sapiens
uccuuaucacugaca

SEQ ID NO: 27109 - RNA, 9 nt, Homo sapiens
uaugugcaa

SEQ ID NO: 27110 - RNA, 15 nt, Homo sapiens
cuuaacucauugcaa

SEQ ID NO: 27111 - RNA, 13 nt, Homo sapiens
uagggaccugcug

SEQ ID NO: 27112 - RNA, 13 nt, Homo sapiens
acccuugccaugg

SEQ ID NO: 27113 - RNA, 14 nt, Homo sapiens
agacucugucucag

SEQ ID NO: 27114 - RNA, 21 nt, Homo sapiens
uguauauuuuauaucaauuua

SEQ ID NO: 27115 - RNA, 20 nt, Homo sapiens
gccaaggcuggagugcagug

SEQ ID NO: 27116 - RNA, 20 nt, Homo sapiens
agguauauaaauuuucccaa

SEQ ID NO: 27117 - RNA, 19 nt, Homo sapiens
uagcgcagccaugugauua

SEQ ID NO: 27118 - RNA, 17 nt, Homo sapiens
ggaucucacaagcacuu

SEQ ID NO: 27119 - RNA, 22 nt, Homo sapiens
auguacauccauggugugcugg

SEQ ID NO: 27120 - RNA, 22 nt, Homo sapiens
ugcuggcuuaaaauguaauuaa

SEQ ID NO: 27121 - RNA, 19 nt, Homo sapiens
ugagugccuguaaucacag

SEQ ID NO: 27122 - RNA, 15 nt, Homo sapiens
gacaacugugacugu

SEQ ID NO: 27123 - RNA, 20 nt, Homo sapiens
gugaaauaagccagacauca

SEQ ID NO: 27124 - RNA, 21 nt, Homo sapiens
aauucuauuacgugcaauacu

SEQ ID NO: 27125 - RNA, 23 nt, Homo sapiens
aguuguaccgcaaugugacuuaa

SEQ ID NO: 27126 - RNA, 15 nt, Homo sapiens
aagcccaauauuaua

SEQ ID NO: 27127 - RNA, 14 nt, Homo sapiens
aaucagaucauuuc

SEQ ID NO: 27128 - RNA, 17 nt, Homo sapiens
guaaaguacagacuuuu

SEQ ID NO: 27129 - RNA, 15 nt, Homo sapiens
cugagcgacagugag

SEQ ID NO: 27130 - RNA, 14 nt, Homo sapiens
aagucuuccauaga

SEQ ID NO: 27131 - RNA, 20 nt, Homo sapiens
uaaaauauuuuuaugugcaa

SEQ ID NO: 27132 - RNA, 23 nt, Homo sapiens
uccugcuacucuguuccuucaca

SEQ ID NO: 27133 - RNA, 20 nt, Homo sapiens
gacauagaauuaacacauga

SEQ ID NO: 27134 - RNA, 19 nt, Homo sapiens
aauauauuuuuagacucau

SEQ ID NO: 27135 - RNA, 16 nt, Homo sapiens
accuaaauuugguucu

SEQ ID NO: 27136 - RNA, 20 nt, Homo sapiens
aagcaacaucuagcaaaugu

SEQ ID NO: 27137 - RNA, 22 nt, Homo sapiens
cugccuaagugcagccccgugg

SEQ ID NO: 27138 - RNA, 20 nt, Homo sapiens
accacugcagaagacaguau

SEQ ID NO: 27139 - RNA, 14 nt, Homo sapiens
ggugacagagcaag

SEQ ID NO: 27140 - RNA, 14 nt, Homo sapiens
gagaaguuaagcaa

SEQ ID NO: 27141 - RNA, 13 nt, Homo sapiens
ccuguaaucacag

SEQ ID NO: 27142 - RNA, 20 nt, Homo sapiens
uuuuagucuaauugaauccc

SEQ ID NO: 27143 - RNA, 21 nt, Homo sapiens
cugcaaucugagccagugcuu

SEQ ID NO: 27144 - RNA, 19 nt, Homo sapiens
gucagugcccaacuguuau

SEQ ID NO: 27145 - RNA, 18 nt, Homo sapiens
ugacuuaguguacaugaa

SEQ ID NO: 27146 - RNA, 14 nt, Homo sapiens
gaauuuucuuccaa

SEQ ID NO: 27147 - RNA, 16 nt, Homo sapiens
auccagaaauaaugaa

SEQ ID NO: 27148 - RNA, 20 nt, Homo sapiens
caaaacugauacccuuugaa

SEQ ID NO: 27149 - RNA, 19 nt, Homo sapiens
gcacuuuaacacagugucu

SEQ ID NO: 27150 - RNA, 17 nt, Homo sapiens
aucagcauuuuacuacu

SEQ ID NO: 27151 - RNA, 20 nt, Homo sapiens
caaaugagccggagccccuu

SEQ ID NO: 27152 - RNA, 13 nt, Homo sapiens
cuggagcucugcc

SEQ ID NO: 27153 - RNA, 17 nt, Homo sapiens
gccagacaucaacagau

SEQ ID NO: 27154 - RNA, 14 nt, Homo sapiens
ucacauccuguguu

SEQ ID NO: 27155 - RNA, 17 nt, Homo sapiens
aauugaaaggcauucuc

SEQ ID NO: 27156 - RNA, 13 nt, Homo sapiens
uauaucaguccuc

SEQ ID NO: 27157 - RNA, 19 nt, Homo sapiens
agcuguggccagcuuguua

SEQ ID NO: 27158 - RNA, 14 nt, Homo sapiens
ggucucgaacugcu

SEQ ID NO: 27159 - RNA, 10 nt, Homo sapiens
augacuaugc

SEQ ID NO: 27160 - RNA, 13 nt, Homo sapiens
cucacaagcacuu

SEQ ID NO: 27161 - RNA, 13 nt, Homo sapiens
cauacauguuaca

SEQ ID NO: 27162 - RNA, 19 nt, Homo sapiens
cuguaucuuguuuuuccac

SEQ ID NO: 27163 - RNA, 15 nt, Homo sapiens
ucaucaaugaaugaa

SEQ ID NO: 27164 - RNA, 19 nt, Homo sapiens
ucuucccuuuuacauacug

SEQ ID NO: 27165 - RNA, 16 nt, Homo sapiens
ccauagagacuuugug

SEQ ID NO: 27166 - RNA, 18 nt, Homo sapiens
uucacuugaugauacaau

SEQ ID NO: 27167 - RNA, 20 nt, Homo sapiens
acauuacaguuagagauuuu

SEQ ID NO: 27168 - RNA, 14 nt, Homo sapiens
aauugacacuuaaa

SEQ ID NO: 27169 - RNA, 18 nt, Homo sapiens
caguuccugagaccagcc

SEQ ID NO: 27170 - RNA, 20 nt, Homo sapiens
uagaauaauacuagucuuau

SEQ ID NO: 27171 - RNA, 21 nt, Homo sapiens
agaggaaugaaguacucauac

SEQ ID NO: 27172 - RNA, 15 nt, Homo sapiens
acaucaacagauaaa

SEQ ID NO: 27173 - RNA, 22 nt, Homo sapiens
caaauucgcugcaaccuguuga

SEQ ID NO: 27174 - RNA, 15 nt, Homo sapiens
aaaaugugcaauaug

SEQ ID NO: 27175 - RNA, 20 nt, Homo sapiens
gauugugccccugcacucca

SEQ ID NO: 27176 - RNA, 17 nt, Homo sapiens
ucuggacuuuccagaga

SEQ ID NO: 27177 - RNA, 14 nt, Homo sapiens
uguguuuuucacau

SEQ ID NO: 27178 - RNA, 18 nt, Homo sapiens
aguuuaugcauacaguaa

SEQ ID NO: 27179 - RNA, 21 nt, Homo sapiens
auuacaaggcuuuaucucagg

SEQ ID NO: 27180 - RNA, 18 nt, Homo sapiens
cucauuccccaaccacuu

SEQ ID NO: 27181 - RNA, 18 nt, Homo sapiens
aaacuuuaugcuaaguga

SEQ ID NO: 27182 - RNA, 19 nt, Homo sapiens
uucucuggcgacaguuuuc

SEQ ID NO: 27183 - RNA, 20 nt, Homo sapiens
aauauuuauuaccucugaua

SEQ ID NO: 27184 - RNA, 13 nt, Homo sapiens
uaauuucagaaga

SEQ ID NO: 27185 - RNA, 19 nt, Homo sapiens
ucaucuuggucacauacaa

SEQ ID NO: 27186 - RNA, 11 nt, Homo sapiens
aaaggugacca

SEQ ID NO: 27187 - RNA, 18 nt, Homo sapiens
uucaaacuaauagaauua

SEQ ID NO: 27188 - RNA, 20 nt, Homo sapiens
uaaugaaaaugaauaucuau

SEQ ID NO: 27189 - RNA, 20 nt, Homo sapiens
agcaaaauggauaugacaca

SEQ ID NO: 27190 - RNA, 17 nt, Homo sapiens
aauauuuauuaccucug

SEQ ID NO: 27191 - RNA, 23 nt, Homo sapiens
agacaccaccacccuugccaugg

SEQ ID NO: 27192 - RNA, 23 nt, Homo sapiens
gaaagcuugcccuggugccucac

SEQ ID NO: 27193 - RNA, 20 nt, Homo sapiens
gccuguugaagaugcuugua

SEQ ID NO: 27194 - RNA, 13 nt, Homo sapiens
cucaucaaucaaa

SEQ ID NO: 27195 - RNA, 16 nt, Homo sapiens
caucuguaaaauggag

SEQ ID NO: 27196 - RNA, 16 nt, Homo sapiens
aaacauccagauacac

SEQ ID NO: 27197 - RNA, 15 nt, Homo sapiens
agaauucuuacaugu

SEQ ID NO: 27198 - RNA, 15 nt, Homo sapiens
ccuaaccucauuccc

SEQ ID NO: 27199 - RNA, 15 nt, Homo sapiens
uaacuggcaguuuuc

SEQ ID NO: 27200 - RNA, 21 nt, Homo sapiens
aaugagaagaaugacuaugca

SEQ ID NO: 27201 - RNA, 16 nt, Homo sapiens
uauggcuuaaugacac

SEQ ID NO: 27202 - RNA, 17 nt, Homo sapiens
uaaauuugguucuaggc

SEQ ID NO: 27203 - RNA, 23 nt, Homo sapiens
cuugccauggagguuaagcacuu

SEQ ID NO: 27204 - RNA, 17 nt, Homo sapiens
aagugauacuauccagu

SEQ ID NO: 27205 - RNA, 12 nt, Homo sapiens
aaaaugugcaau

SEQ ID NO: 27206 - RNA, 13 nt, Homo sapiens
cacugcauacaau

SEQ ID NO: 27207 - RNA, 20 nt, Homo sapiens
ucuugggaauuuucuuccaa

SEQ ID NO: 27208 - RNA, 18 nt, Homo sapiens
ucugauuuuccuggacag

SEQ ID NO: 27209 - RNA, 22 nt, Homo sapiens
aggcagcaggauagagugggac

SEQ ID NO: 27210 - RNA, 19 nt, Homo sapiens
augucagacagaacuugaa

SEQ ID NO: 27211 - RNA, 19 nt, Homo sapiens
aagcuguuuccauagggug

SEQ ID NO: 27212 - RNA, 17 nt, Homo sapiens
uuacaaaccucaagcca

SEQ ID NO: 27213 - RNA, 21 nt, Homo sapiens
uuaaaaaaaaaccugagcccc

SEQ ID NO: 27214 - RNA, 20 nt, Homo sapiens
ccucauuccccaaccacuuc

SEQ ID NO: 27215 - RNA, 14 nt, Homo sapiens
caccacgcccagcu

SEQ ID NO: 27216 - RNA, 14 nt, Homo sapiens
cuuauugacuauua

SEQ ID NO: 27217 - RNA, 17 nt, Homo sapiens
cccuucauguacaucca

SEQ ID NO: 27218 - RNA, 16 nt, Homo sapiens
cgcaaugugacuuaau

SEQ ID NO: 27219 - RNA, 21 nt, Homo sapiens
auagugucugaugaauguuaa

SEQ ID NO: 27220 - RNA, 19 nt, Homo sapiens
aucaugcaaaugcuguauu

SEQ ID NO: 27221 - RNA, 14 nt, Homo sapiens
agaacuugaaugug

SEQ ID NO: 27222 - RNA, 19 nt, Homo sapiens
ugaaagcagggacuugaac

SEQ ID NO: 27223 - RNA, 13 nt, Homo sapiens
agacucugucuca

SEQ ID NO: 27224 - RNA, 14 nt, Homo sapiens
gacgaaccuugaaa

SEQ ID NO: 27225 - RNA, 16 nt, Homo sapiens
aucaaccaaauggagu

SEQ ID NO: 27226 - RNA, 13 nt, Homo sapiens
acauagcaucuca

SEQ ID NO: 27227 - RNA, 17 nt, Homo sapiens
auuugccaauuuacuuu

SEQ ID NO: 27228 - RNA, 20 nt, Homo sapiens
uaucuaauauauaugaauaa

SEQ ID NO: 27229 - RNA, 17 nt, Homo sapiens
gaauauguaaauagaaa

SEQ ID NO: 27230 - RNA, 20 nt, Homo sapiens
caagcuuuucaaaauuggac

SEQ ID NO: 27231 - RNA, 22 nt, Homo sapiens
ugacaacugugacuguacccaa

SEQ ID NO: 27232 - RNA, 15 nt, Homo sapiens
gauaucaugccccug

SEQ ID NO: 27233 - RNA, 19 nt, Homo sapiens
cuuccaaacagaacuaugg

SEQ ID NO: 27234 - RNA, 17 nt, Homo sapiens
aagugaaauaagccaga

SEQ ID NO: 27235 - RNA, 15 nt, Homo sapiens
gacaucaacagauaa

SEQ ID NO: 27236 - RNA, 15 nt, Homo sapiens
cauaaagucagugcc

SEQ ID NO: 27237 - RNA, 18 nt, Homo sapiens
cucaaaacuucagacaua

SEQ ID NO: 27238 - RNA, 23 nt, Homo sapiens
cuggcugggaguggcauguauga

SEQ ID NO: 27239 - RNA, 18 nt, Homo sapiens
aagaaaggccagcaaauu

SEQ ID NO: 27240 - RNA, 16 nt, Homo sapiens
ugugucaguggaugcu

SEQ ID NO: 27241 - RNA, 23 nt, Homo sapiens
aaccaaauuuguauuuaagguau

SEQ ID NO: 27242 - RNA, 15 nt, Homo sapiens
aaggcuuuaucucag

SEQ ID NO: 27243 - RNA, 13 nt, Homo sapiens
caaccaaauggag

SEQ ID NO: 27244 - RNA, 22 nt, Homo sapiens
uguaaguuuaugcauacaguaa

SEQ ID NO: 27245 - RNA, 14 nt, Homo sapiens
uccuuccuuaucac

SEQ ID NO: 27246 - RNA, 10 nt, Homo sapiens
caguaacuga

SEQ ID NO: 27247 - RNA, 20 nt, Homo sapiens
cucaguguccucaucuguaa

SEQ ID NO: 27248 - RNA, 13 nt, Homo sapiens
aaaacucauuucc

SEQ ID NO: 27249 - RNA, 18 nt, Homo sapiens
aaguuuaugcauacagua

SEQ ID NO: 27250 - RNA, 11 nt, Homo sapiens
aagucuuccau

SEQ ID NO: 27251 - RNA, 17 nt, Homo sapiens
aggaaaaucugcacugu

SEQ ID NO: 27252 - RNA, 22 nt, Homo sapiens
gccaugugauuacccucugggu

SEQ ID NO: 27253 - RNA, 18 nt, Homo sapiens
gacaaagacaaauucugu

SEQ ID NO: 27254 - RNA, 23 nt, Homo sapiens
uagaauauuuauuaccucugaua

SEQ ID NO: 27255 - RNA, 21 nt, Homo sapiens
agcccccauuguggucacagg

SEQ ID NO: 27256 - RNA, 15 nt, Homo sapiens
aauucgcugcaaccu

SEQ ID NO: 27257 - RNA, 19 nt, Homo sapiens
aucaauagaaggauguaca

SEQ ID NO: 27258 - RNA, 19 nt, Homo sapiens
cuucuuggucucaguguca

SEQ ID NO: 27259 - RNA, 18 nt, Homo sapiens
auuagaggucuccaaaau

SEQ ID NO: 27260 - RNA, 13 nt, Homo sapiens
aaauagugucuga

SEQ ID NO: 27261 - RNA, 20 nt, Homo sapiens
uagaauauuuauuaccucug

SEQ ID NO: 27262 - RNA, 21 nt, Homo sapiens
aacucaaggaaaucuguguca

SEQ ID NO: 27263 - RNA, 12 nt, Homo sapiens
caggaaaauuaa

SEQ ID NO: 27264 - RNA, 19 nt, Homo sapiens
ugauacuuuuuucauuauu

SEQ ID NO: 27265 - RNA, 14 nt, Homo sapiens
caugaaaagauuau

SEQ ID NO: 27266 - RNA, 15 nt, Homo sapiens
auucugcaagcuuuu

SEQ ID NO: 27267 - RNA, 13 nt, Homo sapiens
augauuucauuca

SEQ ID NO: 27268 - RNA, 13 nt, Homo sapiens
cgaagucuuccau

SEQ ID NO: 27269 - RNA, 19 nt, Homo sapiens
caccacccuugccauggag

SEQ ID NO: 27270 - RNA, 17 nt, Homo sapiens
ccucccuucucuucaca

SEQ ID NO: 27271 - RNA, 22 nt, Homo sapiens
agcagagacgggguuugccaug

SEQ ID NO: 27272 - RNA, 14 nt, Homo sapiens
gaagcaacccaaau

SEQ ID NO: 27273 - RNA, 16 nt, Homo sapiens
agccacuucacuuuuu

SEQ ID NO: 27274 - RNA, 17 nt, Homo sapiens
ugaugauuaauucaccu

SEQ ID NO: 27275 - RNA, 18 nt, Homo sapiens
aggugagcaggugaugcc

SEQ ID NO: 27276 - RNA, 14 nt, Homo sapiens
uuaguguacaugaa

SEQ ID NO: 27277 - RNA, 16 nt, Homo sapiens
auacuauccaguuacu

SEQ ID NO: 27278 - RNA, 22 nt, Homo sapiens
uucugcagauaaacaguaguga

SEQ ID NO: 27279 - RNA, 16 nt, Homo sapiens
gccuaucagcauuuua

SEQ ID NO: 27280 - RNA, 19 nt, Homo sapiens
gcucccuggaagagaucaa

SEQ ID NO: 27281 - RNA, 16 nt, Homo sapiens
cauaauuacuauguca

SEQ ID NO: 27282 - RNA, 19 nt, Homo sapiens
aauaauacaccagagauaa

SEQ ID NO: 27283 - RNA, 18 nt, Homo sapiens
ccaaggcuggagugcagu

SEQ ID NO: 27284 - RNA, 13 nt, Homo sapiens
accgcaaugugac

SEQ ID NO: 27285 - RNA, 12 nt, Homo sapiens
cauuuucacuuu

SEQ ID NO: 27286 - RNA, 14 nt, Homo sapiens
uuacagagacagaa

SEQ ID NO: 27287 - RNA, 11 nt, Homo sapiens
auuugcacuau

SEQ ID NO: 27288 - RNA, 12 nt, Homo sapiens
aaaaagccaaaa

SEQ ID NO: 27289 - RNA, 20 nt, Homo sapiens
agcccuucaugcauuugcac

SEQ ID NO: 27290 - RNA, 18 nt, Homo sapiens
cccuuuuacauacugcug

SEQ ID NO: 27291 - RNA, 18 nt, Homo sapiens
aaauauuuuuaugugcaa

SEQ ID NO: 27292 - RNA, 14 nt, Homo sapiens
ucucacaagcacuu

SEQ ID NO: 27293 - RNA, 17 nt, Homo sapiens
caaagcugaauacauuc

SEQ ID NO: 27294 - RNA, 13 nt, Homo sapiens
gcugagcagucag

SEQ ID NO: 27295 - RNA, 17 nt, Homo sapiens
aacuggaaauaaaagau

SEQ ID NO: 27296 - RNA, 16 nt, Homo sapiens
gcaaauguuaugcaua

SEQ ID NO: 27297 - RNA, 18 nt, Homo sapiens
aaaagcaguaacugacaa

SEQ ID NO: 27298 - RNA, 19 nt, Homo sapiens
uguagauaaacucagaaau

SEQ ID NO: 27299 - RNA, 13 nt, Homo sapiens
gagcgacagugag

SEQ ID NO: 27300 - RNA, 19 nt, Homo sapiens
auguuucgcugauauaugu

SEQ ID NO: 27301 - RNA, 17 nt, Homo sapiens
caaaacuucagacauag

SEQ ID NO: 27302 - RNA, 18 nt, Homo sapiens
cauagcagcuuauucaca

SEQ ID NO: 27303 - RNA, 16 nt, Homo sapiens
uggaaaaaaaggaaga

SEQ ID NO: 27304 - RNA, 18 nt, Homo sapiens
uggaauauguaaauagaa

SEQ ID NO: 27305 - RNA, 16 nt, Homo sapiens
aaagcagggacuugaa

SEQ ID NO: 27306 - RNA, 22 nt, Homo sapiens
auuuuguuuuuaaacuggaaau

SEQ ID NO: 27307 - RNA, 21 nt, Homo sapiens
uaaaauauuuuuaugugcaau

SEQ ID NO: 27308 - RNA, 15 nt, Homo sapiens
cuaugugauuacaag

SEQ ID NO: 27309 - RNA, 11 nt, Homo sapiens
ugcaagcuuuu

SEQ ID NO: 27310 - RNA, 15 nt, Homo sapiens
cacuugaugauacaa

SEQ ID NO: 27311 - RNA, 19 nt, Homo sapiens
gccaaggcuggagugcagu

SEQ ID NO: 27312 - RNA, 18 nt, Homo sapiens
agcaacccaaauguucau

SEQ ID NO: 27313 - RNA, 23 nt, Homo sapiens
guagaaaaagcaguaacugacaa

SEQ ID NO: 27314 - RNA, 20 nt, Homo sapiens
gcuaagugaaauaagccaga

SEQ ID NO: 27315 - RNA, 20 nt, Homo sapiens
ugccaaggcuggagugcagu

SEQ ID NO: 27316 - RNA, 16 nt, Homo sapiens
uggguucaagcgauuc

SEQ ID NO: 27317 - RNA, 23 nt, Homo sapiens
ugaacaaauuuacagagacagaa

SEQ ID NO: 27318 - RNA, 21 nt, Homo sapiens
cuuccaaacagaacuauggaa

SEQ ID NO: 27319 - RNA, 15 nt, Homo sapiens
uuccuauguaacugc

SEQ ID NO: 27320 - RNA, 21 nt, Homo sapiens
ucccaaagugcugggaauuac

SEQ ID NO: 27321 - RNA, 21 nt, Homo sapiens
guaaguuuaugcauacaguaa

SEQ ID NO: 27322 - RNA, 14 nt, Homo sapiens
ccaauuuacuuugu

SEQ ID NO: 27323 - RNA, 17 nt, Homo sapiens
auuaccucugauaccuc

SEQ ID NO: 27324 - RNA, 15 nt, Homo sapiens
ggauagagugggaca

SEQ ID NO: 27325 - RNA, 19 nt, Homo sapiens
caaauucuguuucuugaga

SEQ ID NO: 27326 - RNA, 14 nt, Homo sapiens
augccugcaaucug

SEQ ID NO: 27327 - RNA, 15 nt, Homo sapiens
gacuaauuaggcaag

SEQ ID NO: 27328 - RNA, 18 nt, Homo sapiens
uuaugaaacauuacaguu

SEQ ID NO: 27329 - RNA, 14 nt, Homo sapiens
uggccagaagucaa

SEQ ID NO: 27330 - RNA, 14 nt, Homo sapiens
aacagaagcuucca

SEQ ID NO: 27331 - RNA, 17 nt, Homo sapiens
uuccguggcacugcaua

SEQ ID NO: 27332 - RNA, 19 nt, Homo sapiens
aggagaaacuggaacucuc

SEQ ID NO: 27333 - RNA, 19 nt, Homo sapiens
auuccuauauccugugacu

SEQ ID NO: 27334 - RNA, 16 nt, Homo sapiens
uaggaagagaaaccag

SEQ ID NO: 27335 - RNA, 16 nt, Homo sapiens
gcacuuuaaacauuua

SEQ ID NO: 27336 - RNA, 14 nt, Homo sapiens
auaaauuugguucu

SEQ ID NO: 27337 - RNA, 21 nt, Homo sapiens
agcaagugaauuuuucucuaa

SEQ ID NO: 27338 - RNA, 21 nt, Homo sapiens
aaaauuagccgggcauggugg

SEQ ID NO: 27339 - RNA, 12 nt, Homo sapiens
aucuacacucca

SEQ ID NO: 27340 - RNA, 17 nt, Homo sapiens
aaaguucugcagauaaa

SEQ ID NO: 27341 - RNA, 20 nt, Homo sapiens
ccaacuuugaagucugauuu

SEQ ID NO: 27342 - RNA, 12 nt, Homo sapiens
aaucuacacucc

SEQ ID NO: 27343 - RNA, 16 nt, Homo sapiens
auuuuuaugugcaaua

SEQ ID NO: 27344 - RNA, 12 nt, Homo sapiens
ugacacaucucu

SEQ ID NO: 27345 - RNA, 15 nt, Homo sapiens
aaauauaauaugcac

SEQ ID NO: 27346 - RNA, 15 nt, Homo sapiens
gcacuugggacaaaa

SEQ ID NO: 27347 - RNA, 12 nt, Homo sapiens
caguaacugaca

SEQ ID NO: 27348 - RNA, 14 nt, Homo sapiens
gcaggcgugaccug

SEQ ID NO: 27349 - RNA, 17 nt, Homo sapiens
uaacuagaauuuauuca

SEQ ID NO: 27350 - RNA, 18 nt, Homo sapiens
aauuuauucaauuccucu

SEQ ID NO: 27351 - RNA, 13 nt, Homo sapiens
gaaauuaaccaua

SEQ ID NO: 27352 - RNA, 11 nt, Homo sapiens
ucacauuugcg

SEQ ID NO: 27353 - RNA, 14 nt, Homo sapiens
ugcauuugcacuau

SEQ ID NO: 27354 - RNA, 16 nt, Homo sapiens
agccagccuugcuccu

SEQ ID NO: 27355 - RNA, 21 nt, Homo sapiens
uaacugcauugagaacugcau

SEQ ID NO: 27356 - RNA, 16 nt, Homo sapiens
cauuguggucacagga

SEQ ID NO: 27357 - RNA, 14 nt, Homo sapiens
ucaccuuccagugu

SEQ ID NO: 27358 - RNA, 18 nt, Homo sapiens
augcaaccuuuggaugca

SEQ ID NO: 27359 - RNA, 14 nt, Homo sapiens
aauaaaagcacuua

SEQ ID NO: 27360 - RNA, 22 nt, Homo sapiens
ugccuggaucucacaagcacuu

SEQ ID NO: 27361 - RNA, 15 nt, Homo sapiens
uguguucaguacaau

SEQ ID NO: 27362 - RNA, 16 nt, Homo sapiens
uaacugacaacuugaa

SEQ ID NO: 27363 - RNA, 15 nt, Homo sapiens
gcagauaaacaguag

SEQ ID NO: 27364 - RNA, 16 nt, Homo sapiens
cacaaccacucauuca

SEQ ID NO: 27365 - RNA, 17 nt, Homo sapiens
caguguccucaucugua

SEQ ID NO: 27366 - RNA, 22 nt, Homo sapiens
augcaaccuuuggaugcacuuu

SEQ ID NO: 27367 - RNA, 13 nt, Homo sapiens
aauggcaugucag

SEQ ID NO: 27368 - RNA, 18 nt, Homo sapiens
gugagacagcucugcaua

SEQ ID NO: 27369 - RNA, 13 nt, Homo sapiens
cauuugcacuauu

SEQ ID NO: 27370 - RNA, 15 nt, Homo sapiens
guugacaacugugac

SEQ ID NO: 27371 - RNA, 23 nt, Homo sapiens
cauacaauuauuuuuacaguucu

SEQ ID NO: 27372 - RNA, 21 nt, Homo sapiens
caagguucuucccuuuuacau

SEQ ID NO: 27373 - RNA, 14 nt, Homo sapiens
uguggucacaggaa

SEQ ID NO: 27374 - RNA, 20 nt, Homo sapiens
ccagccugggugacagagca

SEQ ID NO: 27375 - RNA, 17 nt, Homo sapiens
uuuaucuugucucuggg

SEQ ID NO: 27376 - RNA, 18 nt, Homo sapiens
cagaaauuuaauucaugu

SEQ ID NO: 27377 - RNA, 17 nt, Homo sapiens
aaacccggccugauuaa

SEQ ID NO: 27378 - RNA, 14 nt, Homo sapiens
uccuauauccugug

SEQ ID NO: 27379 - RNA, 19 nt, Homo sapiens
uaaaaggccugucccugca

SEQ ID NO: 27380 - RNA, 13 nt, Homo sapiens
aacaaagaagaca

SEQ ID NO: 27381 - RNA, 21 nt, Homo sapiens
gaaguauccuucagccugaaa

SEQ ID NO: 27382 - RNA, 22 nt, Homo sapiens
agaguucugucuggacuuucca

SEQ ID NO: 27383 - RNA, 18 nt, Homo sapiens
auucuauuacgugcaaua

SEQ ID NO: 27384 - RNA, 21 nt, Homo sapiens
auugaaucccuuaaacucagg

SEQ ID NO: 27385 - RNA, 13 nt, Homo sapiens
aauuccucuggga

SEQ ID NO: 27386 - RNA, 16 nt, Homo sapiens
uggaacucaaggaaau

SEQ ID NO: 27387 - RNA, 11 nt, Homo sapiens
auuugagacag

SEQ ID NO: 27388 - RNA, 19 nt, Homo sapiens
aaaauauuuuuaugugcaa

SEQ ID NO: 27389 - RNA, 20 nt, Homo sapiens
uugaaauagugucugaugaa

SEQ ID NO: 27390 - RNA, 21 nt, Homo sapiens
auucuucuuugguggagauaa

SEQ ID NO: 27391 - RNA, 14 nt, Homo sapiens
gaaaaugugcaaua

SEQ ID NO: 27392 - RNA, 18 nt, Homo sapiens
uuuccacuacugcuacca

SEQ ID NO: 27393 - RNA, 10 nt, Homo sapiens
uaugugcaau

SEQ ID NO: 27394 - RNA, 19 nt, Homo sapiens
cuggaucucacaagcacuu

SEQ ID NO: 27395 - RNA, 20 nt, Homo sapiens
cugaauacauucugcuuuca

SEQ ID NO: 27396 - RNA, 23 nt, Homo sapiens
agagacagaaagcagaacaguga

SEQ ID NO: 27397 - RNA, 17 nt, Homo sapiens
caaacagaacuauggaa

SEQ ID NO: 27398 - RNA, 20 nt, Homo sapiens
uccugugacugucucacuua

SEQ ID NO: 27399 - RNA, 19 nt, Homo sapiens
gggucucccucuguugcca

SEQ ID NO: 27400 - RNA, 20 nt, Homo sapiens
augugauuacccucuggguc

SEQ ID NO: 27401 - RNA, 19 nt, Homo sapiens
auuacgugcaauacuucaa

SEQ ID NO: 27402 - RNA, 15 nt, Homo sapiens
uuccuggacaguuuu

SEQ ID NO: 27403 - RNA, 14 nt, Homo sapiens
ugaugaauguuaaa

SEQ ID NO: 27404 - RNA, 18 nt, Homo sapiens
gcagcuuauucacaagac

SEQ ID NO: 27405 - RNA, 18 nt, Homo sapiens
cauaagcaaagacuauga

SEQ ID NO: 27406 - RNA, 19 nt, Homo sapiens
caagcuuuucaaaauugga

SEQ ID NO: 27407 - RNA, 17 nt, Homo sapiens
aguuacugccgguuuga

SEQ ID NO: 27408 - RNA, 15 nt, Homo sapiens
uaaucccagcacuuu

SEQ ID NO: 27409 - RNA, 12 nt, Homo sapiens
acugugacugua

SEQ ID NO: 27410 - RNA, 18 nt, Homo sapiens
ucacuuuuuuucuuuucu

SEQ ID NO: 27411 - RNA, 16 nt, Homo sapiens
cuuccucagcuguaga

SEQ ID NO: 27412 - RNA, 19 nt, Homo sapiens
auccagauagguuaccagu

SEQ ID NO: 27413 - RNA, 19 nt, Homo sapiens
ugaacacuuauaagugaag

SEQ ID NO: 27414 - RNA, 16 nt, Homo sapiens
aggagauuucaugccu

SEQ ID NO: 27415 - RNA, 20 nt, Homo sapiens
cuacuugggaggcugaggca

SEQ ID NO: 27416 - RNA, 17 nt, Homo sapiens
aaauucacaaguugugu

SEQ ID NO: 27417 - RNA, 20 nt, Homo sapiens
gugucuggcacuugggacaa

SEQ ID NO: 27418 - RNA, 21 nt, Homo sapiens
auuuuuuaugaaacauuacag

SEQ ID NO: 27419 - RNA, 14 nt, Homo sapiens
gagaaaagacauaa

SEQ ID NO: 27420 - RNA, 20 nt, Homo sapiens
uaagcaaaaugugauaugua

SEQ ID NO: 27421 - RNA, 15 nt, Homo sapiens
uaugcuaagugaaau

SEQ ID NO: 27422 - RNA, 17 nt, Homo sapiens
gugagacagcucugcau

SEQ ID NO: 27423 - RNA, 20 nt, Homo sapiens
aagaccuggucgucgucuug

SEQ ID NO: 27424 - RNA, 17 nt, Homo sapiens
uauuugcaagacauaga

SEQ ID NO: 27425 - RNA, 16 nt, Homo sapiens
uuaugcuaagugaaau

SEQ ID NO: 27426 - RNA, 19 nt, Homo sapiens
ucccuucucuucacaguca

SEQ ID NO: 27427 - RNA, 14 nt, Homo sapiens
ggugugaccacugc

SEQ ID NO: 27428 - RNA, 14 nt, Homo sapiens
aaucccagcacuuu

SEQ ID NO: 27429 - RNA, 21 nt, Homo sapiens
auagcagcuuauucacaagac

SEQ ID NO: 27430 - RNA, 20 nt, Homo sapiens
gacaccaccacccuugccau

SEQ ID NO: 27431 - RNA, 23 nt, Homo sapiens
gguuaccaguaacggaacaguau

SEQ ID NO: 27432 - RNA, 16 nt, Homo sapiens
caaguuguguuugaua

SEQ ID NO: 27433 - RNA, 20 nt, Homo sapiens
guguuggaaaaugugcaaua

SEQ ID NO: 27434 - RNA, 22 nt, Homo sapiens
aacccaaauguucaucaaugaa

SEQ ID NO: 27435 - RNA, 11 nt, Homo sapiens
uuacucugaag

SEQ ID NO: 27436 - RNA, 12 nt, Homo sapiens
accagggacuga

SEQ ID NO: 27437 - RNA, 16 nt, Homo sapiens
cacuuauugacuauua

SEQ ID NO: 27438 - RNA, 21 nt, Homo sapiens
auccuaauaaaaaggugacca

SEQ ID NO: 27439 - RNA, 16 nt, Homo sapiens
gcaauaaaauguauuu

SEQ ID NO: 27440 - RNA, 15 nt, Homo sapiens
guggaugauguuucg

SEQ ID NO: 27441 - RNA, 20 nt, Homo sapiens
agagcaagacucugucucaa

SEQ ID NO: 27442 - RNA, 22 nt, Homo sapiens
uggcaaaucucuauuaggaaau

SEQ ID NO: 27443 - RNA, 19 nt, Homo sapiens
cuucuggguucaagcgauu

SEQ ID NO: 27444 - RNA, 18 nt, Homo sapiens
aacuugaaugugucaggu

SEQ ID NO: 27445 - RNA, 13 nt, Homo sapiens
auagcaucucagg

SEQ ID NO: 27446 - RNA, 17 nt, Homo sapiens
ccaaacagaacuaugga

SEQ ID NO: 27447 - RNA, 13 nt, Homo sapiens
aucauguauuuau

SEQ ID NO: 27448 - RNA, 16 nt, Homo sapiens
auaugacacaucucug

SEQ ID NO: 27449 - RNA, 13 nt, Homo sapiens
agauuaugaucuc

SEQ ID NO: 27450 - RNA, 22 nt, Homo sapiens
aucuuuuauacagugucuuaca

SEQ ID NO: 27451 - RNA, 12 nt, Homo sapiens
cugauaccucaa

SEQ ID NO: 27452 - RNA, 15 nt, Homo sapiens
aaauaaaagcacuua

SEQ ID NO: 27453 - RNA, 17 nt, Homo sapiens
agaaaauaaaagcacuu

SEQ ID NO: 27454 - RNA, 17 nt, Homo sapiens
uuuaauggcaugucaga

SEQ ID NO: 27455 - RNA, 11 nt, Homo sapiens
cuuuaucucag

SEQ ID NO: 27456 - RNA, 14 nt, Homo sapiens
aaugaaguacucau

SEQ ID NO: 27457 - RNA, 14 nt, Homo sapiens
auccugcaauucca

SEQ ID NO: 27458 - RNA, 22 nt, Homo sapiens
cuauauccugugacugucucac

SEQ ID NO: 27459 - RNA, 15 nt, Homo sapiens
ggaauuuucuuccaa

SEQ ID NO: 27460 - RNA, 12 nt, Homo sapiens
uagcaucucagg

SEQ ID NO: 27461 - RNA, 14 nt, Homo sapiens
auacuccuaguaau

SEQ ID NO: 27462 - RNA, 20 nt, Homo sapiens
aaagauuucuugaguuuugu

SEQ ID NO: 27463 - RNA, 18 nt, Homo sapiens
auaucaguccucuuucaa

SEQ ID NO: 27464 - RNA, 21 nt, Homo sapiens
cagagaaaauaaaagcacuua

SEQ ID NO: 27465 - RNA, 18 nt, Homo sapiens
aauuaauggaauauguaa

SEQ ID NO: 27466 - RNA, 21 nt, Homo sapiens
ucugucuggacuuuccagaga

SEQ ID NO: 27467 - RNA, 22 nt, Homo sapiens
cccaaaacugauacccuuugaa

SEQ ID NO: 27468 - RNA, 17 nt, Homo sapiens
ucauguacauccauggu

SEQ ID NO: 27469 - RNA, 16 nt, Homo sapiens
ugaaaaugaauaucua

SEQ ID NO: 27470 - RNA, 21 nt, Homo sapiens
ggccuguugaagaugcuugua

SEQ ID NO: 27471 - RNA, 16 nt, Homo sapiens
uucaugcauuugcacu

SEQ ID NO: 27472 - RNA, 14 nt, Homo sapiens
gcuuccuaacugcu

SEQ ID NO: 27473 - RNA, 21 nt, Homo sapiens
aucaauucuauuacgugcaau

SEQ ID NO: 27474 - RNA, 17 nt, Homo sapiens
ugauuacaaggcuuuau

SEQ ID NO: 27475 - RNA, 17 nt, Homo sapiens
ugccccugcacuccagc

SEQ ID NO: 27476 - RNA, 13 nt, Homo sapiens
auauauuuuuaga

SEQ ID NO: 27477 - RNA, 15 nt, Homo sapiens
caauuccucugggaa

SEQ ID NO: 27478 - RNA, 15 nt, Homo sapiens
cuauauccugugacu

SEQ ID NO: 27479 - RNA, 12 nt, Homo sapiens
auagaauuaaca

SEQ ID NO: 27480 - RNA, 14 nt, Homo sapiens
gucucccaaagugc

SEQ ID NO: 27481 - RNA, 12 nt, Homo sapiens
cacuugaacccg

SEQ ID NO: 27482 - RNA, 21 nt, Homo sapiens
gcagugagcugauaucaugcc

SEQ ID NO: 27483 - RNA, 21 nt, Homo sapiens
uugguacuagauacugaaugu

SEQ ID NO: 27484 - RNA, 17 nt, Homo sapiens
gaguucugucuggacuu

SEQ ID NO: 27485 - RNA, 19 nt, Homo sapiens
gcuggagugcaguggcgca

SEQ ID NO: 27486 - RNA, 16 nt, Homo sapiens
ucagaagaaauucugc

SEQ ID NO: 27487 - RNA, 12 nt, Homo sapiens
aaaagccaaaaa

SEQ ID NO: 27488 - RNA, 20 nt, Homo sapiens
uucaccuuccagugucucgg

SEQ ID NO: 27489 - RNA, 21 nt, Homo sapiens
agauguagauaaacucagaaa

SEQ ID NO: 27490 - RNA, 19 nt, Homo sapiens
cugcuggauucaagugauc

SEQ ID NO: 27491 - RNA, 23 nt, Homo sapiens
agauuuuguuuuuaaacuggaaa

SEQ ID NO: 27492 - RNA, 15 nt, Homo sapiens
guaaacaaaggaauu

SEQ ID NO: 27493 - RNA, 21 nt, Homo sapiens
aaacuaccagcccuacaccau

SEQ ID NO: 27494 - RNA, 13 nt, Homo sapiens
auuacgugcaaua

SEQ ID NO: 27495 - RNA, 20 nt, Homo sapiens
ccuggcuggggccuguugaa

SEQ ID NO: 27496 - RNA, 15 nt, Homo sapiens
ccauagagacuuugu

SEQ ID NO: 27497 - RNA, 19 nt, Homo sapiens
gcaaccuuuggaugcacuu

SEQ ID NO: 27498 - RNA, 20 nt, Homo sapiens
aaaagauuguauagugcaug

SEQ ID NO: 27499 - RNA, 22 nt, Homo sapiens
aaucugaggccuccucucucag

SEQ ID NO: 27500 - RNA, 22 nt, Homo sapiens
aacccggccugauuaaaguuaa

SEQ ID NO: 27501 - RNA, 16 nt, Homo sapiens
acuaaaaauacaaaaa

SEQ ID NO: 27502 - RNA, 21 nt, Homo sapiens
cagccuggucaacauggugaa

SEQ ID NO: 27503 - RNA, 14 nt, Homo sapiens
aucuuacugaaggu

SEQ ID NO: 27504 - RNA, 21 nt, Homo sapiens
uucaugaaaagauuaugaucu

SEQ ID NO: 27505 - RNA, 18 nt, Homo sapiens
gcuugaaauagugucuga

SEQ ID NO: 27506 - RNA, 15 nt, Homo sapiens
gaaaaugugcaauau

SEQ ID NO: 27507 - RNA, 19 nt, Homo sapiens
acuugggcgggacacaggc

SEQ ID NO: 27508 - RNA, 14 nt, Homo sapiens
gcuggagugcagug

SEQ ID NO: 27509 - RNA, 18 nt, Homo sapiens
uacagagaaaagacauaa

SEQ ID NO: 27510 - RNA, 18 nt, Homo sapiens
guuggaaaaugugcaaua

SEQ ID NO: 27511 - RNA, 17 nt, Homo sapiens
ggaagaaauuccaggaa

SEQ ID NO: 27512 - RNA, 17 nt, Homo sapiens
auggcagcuuuccucaa

SEQ ID NO: 27513 - RNA, 15 nt, Homo sapiens
aggcuccaaacugga

SEQ ID NO: 27514 - RNA, 16 nt, Homo sapiens
agggauuccccuaacc

SEQ ID NO: 27515 - RNA, 23 nt, Homo sapiens
auucccuuuugcugccucuaaaa

SEQ ID NO: 27516 - RNA, 18 nt, Homo sapiens
uaaauaguuuaugauucc

SEQ ID NO: 27517 - RNA, 18 nt, Homo sapiens
ugguccgaagucuuccau

SEQ ID NO: 27518 - RNA, 21 nt, Homo sapiens
uaagguauauaaauuuuccca

SEQ ID NO: 27519 - RNA, 15 nt, Homo sapiens
aggcauucucugaag

SEQ ID NO: 27520 - RNA, 16 nt, Homo sapiens
uuguuggauaaaucag

SEQ ID NO: 27521 - RNA, 22 nt, Homo sapiens
acaguauggcagcuuuccucaa

SEQ ID NO: 27522 - RNA, 23 nt, Homo sapiens
ugagaugggagaaucacuugaac

SEQ ID NO: 27523 - RNA, 14 nt, Homo sapiens
uuauuguaccucuc

SEQ ID NO: 27524 - RNA, 20 nt, Homo sapiens
ggaauauuugcaagacauag

SEQ ID NO: 27525 - RNA, 16 nt, Homo sapiens
agaaucacuugaaccc

SEQ ID NO: 27526 - RNA, 18 nt, Homo sapiens
guuuuuccacuacugcua

SEQ ID NO: 27527 - RNA, 11 nt, Homo sapiens
uacgugcaaua

SEQ ID NO: 27528 - RNA, 14 nt, Homo sapiens
auuugcaagacaua

SEQ ID NO: 27529 - RNA, 20 nt, Homo sapiens
cuuuccagagaccaguauuc

SEQ ID NO: 27530 - RNA, 23 nt, Homo sapiens
agacauagaauuaacacaugauc

SEQ ID NO: 27531 - RNA, 15 nt, Homo sapiens
caaccacucauucaa

SEQ ID NO: 27532 - RNA, 21 nt, Homo sapiens
caguaauuuuaaguaauuuca

SEQ ID NO: 27533 - RNA, 15 nt, Homo sapiens
accuguaaucccagc

SEQ ID NO: 27534 - RNA, 15 nt, Homo sapiens
augacacaucucuga

SEQ ID NO: 27535 - RNA, 23 nt, Homo sapiens
aaacauuuaaauuauacaaucau

SEQ ID NO: 27536 - RNA, 19 nt, Homo sapiens
cuguuuccauagggugaca

SEQ ID NO: 27537 - RNA, 14 nt, Homo sapiens
auagcaucucagga

SEQ ID NO: 27538 - RNA, 14 nt, Homo sapiens
aaaaugaauaucua

SEQ ID NO: 27539 - RNA, 21 nt, Homo sapiens
acagcucugcauacucauuag

SEQ ID NO: 27540 - RNA, 17 nt, Homo sapiens
uguagauaaacucagaa

SEQ ID NO: 27541 - RNA, 23 nt, Homo sapiens
auaucaugccccuguacuccagc

SEQ ID NO: 27542 - RNA, 21 nt, Homo sapiens
auauuguugacaacugugacu

SEQ ID NO: 27543 - RNA, 12 nt, Homo sapiens
aaauagugucug

SEQ ID NO: 27544 - RNA, 21 nt, Homo sapiens
gcaugucagacagaacuugaa

SEQ ID NO: 27545 - RNA, 21 nt, Homo sapiens
uauuuacugagcuucucugug

SEQ ID NO: 27546 - RNA, 16 nt, Homo sapiens
uuuaaucaccaaggcu

SEQ ID NO: 27547 - RNA, 15 nt, Homo sapiens
uuaggcuauucacaa

SEQ ID NO: 27548 - RNA, 15 nt, Homo sapiens
aucagcuaaguugca

SEQ ID NO: 27549 - RNA, 16 nt, Homo sapiens
gcuuuaauuucaugaa

SEQ ID NO: 27550 - RNA, 23 nt, Homo sapiens
ugucuuacagagaaaagacauaa

SEQ ID NO: 27551 - RNA, 23 nt, Homo sapiens
aguguccucaucuguaaaaugga

SEQ ID NO: 27552 - RNA, 20 nt, Homo sapiens
cgucucuacuaaaaauacaa

SEQ ID NO: 27553 - RNA, 21 nt, Homo sapiens
uuacuauuuauugcugaauga

SEQ ID NO: 27554 - RNA, 19 nt, Homo sapiens
uguguggcauuuucacuuu

SEQ ID NO: 27555 - RNA, 17 nt, Homo sapiens
aaggcuuuaucucaggg

SEQ ID NO: 27556 - RNA, 16 nt, Homo sapiens
agcuguuuucccugac

SEQ ID NO: 27557 - RNA, 17 nt, Homo sapiens
aaugaaugaauggcuaa

SEQ ID NO: 27558 - RNA, 20 nt, Homo sapiens
aggcggguggaucacuugag

SEQ ID NO: 27559 - RNA, 15 nt, Homo sapiens
uaaacaguagugaua

SEQ ID NO: 27560 - RNA, 20 nt, Homo sapiens
aagcagaacagugauuacca

SEQ ID NO: 27561 - RNA, 12 nt, Homo sapiens
cacagugucugg

SEQ ID NO: 27562 - RNA, 20 nt, Homo sapiens
gagaaaccuuauuguaccuc

SEQ ID NO: 27563 - RNA, 19 nt, Homo sapiens
accuacaugagguacugag

SEQ ID NO: 27564 - RNA, 23 nt, Homo sapiens
gagcaccugcaggcgugaccuga

SEQ ID NO: 27565 - RNA, 19 nt, Homo sapiens
uuccuucucaucugugauu

SEQ ID NO: 27566 - RNA, 14 nt, Homo sapiens
ccauuguggucaca

SEQ ID NO: 27567 - RNA, 21 nt, Homo sapiens
ugcaagacauagaauaguguu

SEQ ID NO: 27568 - RNA, 21 nt, Homo sapiens
ccuuauuguaccucucuuaua

SEQ ID NO: 27569 - RNA, 21 nt, Homo sapiens
gacaccaccacccuugccaug

SEQ ID NO: 27570 - RNA, 12 nt, Homo sapiens
agccccaaaagg

SEQ ID NO: 27571 - RNA, 13 nt, Homo sapiens
uccuggacaguuu

SEQ ID NO: 27572 - RNA, 17 nt, Homo sapiens
cacuuuaacacaguguc

SEQ ID NO: 27573 - RNA, 12 nt, Homo sapiens
cacaagcacuuu

SEQ ID NO: 27574 - RNA, 21 nt, Homo sapiens
uccuagcgcagccaugugauu

SEQ ID NO: 27575 - RNA, 22 nt, Homo sapiens
uuuccuagcgcagccaugugau

SEQ ID NO: 27576 - RNA, 18 nt, Homo sapiens
acaaggcuuuaucucagg

SEQ ID NO: 27577 - RNA, 17 nt, Homo sapiens
agauagguuaccaguaa

SEQ ID NO: 27578 - RNA, 15 nt, Homo sapiens
agcagggacuugaac

SEQ ID NO: 27579 - RNA, 23 nt, Homo sapiens
gauuucaugccuggugcuuccaa

SEQ ID NO: 27580 - RNA, 17 nt, Homo sapiens
ccuggucaacaugguga

SEQ ID NO: 27581 - RNA, 19 nt, Homo sapiens
guugaaaaaguucugcaga

SEQ ID NO: 27582 - RNA, 20 nt, Homo sapiens
cucaggggccaacuaggcag

SEQ ID NO: 27583 - RNA, 15 nt, Homo sapiens
cuugguauagcauau

SEQ ID NO: 27584 - RNA, 18 nt, Homo sapiens
cuauauuaucaugcaaau

SEQ ID NO: 27585 - RNA, 16 nt, Homo sapiens
uguguggcauuuucac

SEQ ID NO: 27586 - RNA, 21 nt, Homo sapiens
cccccauuguggucacaggaa

SEQ ID NO: 27587 - RNA, 14 nt, Homo sapiens
ccaaguuuauauac

SEQ ID NO: 27588 - RNA, 16 nt, Homo sapiens
uucacuuauugacuau

SEQ ID NO: 27589 - RNA, 17 nt, Homo sapiens
uuguaaguuuaugcaua

SEQ ID NO: 27590 - RNA, 12 nt, Homo sapiens
acuuugugaaaa

SEQ ID NO: 27591 - RNA, 16 nt, Homo sapiens
uagagugggacaguuc

SEQ ID NO: 27592 - RNA, 22 nt, Homo sapiens
auacaauuauuuuuacaguucu

SEQ ID NO: 27593 - RNA, 22 nt, Homo sapiens
uucucuucacagucacauucca

SEQ ID NO: 27594 - RNA, 17 nt, Homo sapiens
gaaucagaucauuucaa

SEQ ID NO: 27595 - RNA, 20 nt, Homo sapiens
cagcauuuuacuacuuuaaa

SEQ ID NO: 27596 - RNA, 19 nt, Homo sapiens
ugacacuagcuaauaucaa

SEQ ID NO: 27597 - RNA, 18 nt, Homo sapiens
gcccccauuguggucaca

SEQ ID NO: 27598 - RNA, 17 nt, Homo sapiens
aaacauagcaucucagg

SEQ ID NO: 27599 - RNA, 16 nt, Homo sapiens
auucucucuccuguac

SEQ ID NO: 27600 - RNA, 12 nt, Homo sapiens
aaguuuaugcau

SEQ ID NO: 27601 - RNA, 20 nt, Homo sapiens
aucaugccccuguacuccag

SEQ ID NO: 27602 - RNA, 20 nt, Homo sapiens
agugaacaaauuuacagaga

SEQ ID NO: 27603 - RNA, 21 nt, Homo sapiens
aggaauauuugcaagacauag

SEQ ID NO: 27604 - RNA, 20 nt, Homo sapiens
cacuuauaggaauugaccca

SEQ ID NO: 27605 - RNA, 21 nt, Homo sapiens
ggagcuugaaauagugucuga

SEQ ID NO: 27606 - RNA, 15 nt, Homo sapiens
ugcagauaaacagua

SEQ ID NO: 27607 - RNA, 22 nt, Homo sapiens
aucuuguuuuuccacuacugcu

SEQ ID NO: 27608 - RNA, 16 nt, Homo sapiens
cuuauaggaauugacc

SEQ ID NO: 27609 - RNA, 19 nt, Homo sapiens
gagaaaauaaaagcacuua

SEQ ID NO: 27610 - RNA, 23 nt, Homo sapiens
gccagugcuuuaauggcauguca

SEQ ID NO: 27611 - RNA, 18 nt, Homo sapiens
uuguagccacuucacuuu

SEQ ID NO: 27612 - RNA, 18 nt, Homo sapiens
ucaggaguuccuaaccag

SEQ ID NO: 27613 - RNA, 14 nt, Homo sapiens
gcaccaacuuugaa

SEQ ID NO: 27614 - RNA, 20 nt, Homo sapiens
gcaaccuccaccuucugggu

SEQ ID NO: 27615 - RNA, 15 nt, Homo sapiens
ugaauaaaguguaag

SEQ ID NO: 27616 - RNA, 16 nt, Homo sapiens
cuauuacgugcaauac

SEQ ID NO: 27617 - RNA, 14 nt, Homo sapiens
ucaguccucuuuca

SEQ ID NO: 27618 - RNA, 14 nt, Homo sapiens
agacagaacuugaa

SEQ ID NO: 27619 - RNA, 14 nt, Homo sapiens
agugggacaguucc

SEQ ID NO: 27620 - RNA, 22 nt, Homo sapiens
uucugugggagaauucuuacau

SEQ ID NO: 27621 - RNA, 14 nt, Homo sapiens
ggacuugggcggga

SEQ ID NO: 27622 - RNA, 19 nt, Homo sapiens
auuuuuacaguucucccaa

SEQ ID NO: 27623 - RNA, 20 nt, Homo sapiens
gcugucuauguggcuguauc

SEQ ID NO: 27624 - RNA, 24 nt, Homo sapiens
ggacuugggcgggacacaggcucc

SEQ ID NO: 27625 - RNA, 12 nt, Homo sapiens
uauauccuguga

SEQ ID NO: 27626 - RNA, 16 nt, Homo sapiens
guaaucccagcacuuu

SEQ ID NO: 27627 - RNA, 18 nt, Homo sapiens
guuccuucacauccugug

SEQ ID NO: 27628 - RNA, 19 nt, Homo sapiens
augauuccaccuacaugag

SEQ ID NO: 27629 - RNA, 17 nt, Homo sapiens
accuuauuguaccucuc

SEQ ID NO: 27630 - RNA, 18 nt, Homo sapiens
uguaaugaaaaugaauau

SEQ ID NO: 27631 - RNA, 18 nt, Homo sapiens
uacucuguuccuucacau

SEQ ID NO: 27632 - RNA, 13 nt, Homo sapiens
gacagaaagcaga

SEQ ID NO: 27633 - RNA, 18 nt, Homo sapiens
uuguaaaauggugugacc

SEQ ID NO: 27634 - RNA, 20 nt, Homo sapiens
aaggcuuagacccucaugcu

SEQ ID NO: 27635 - RNA, 19 nt, Homo sapiens
ugcuuguuagcaaaaugga

SEQ ID NO: 27636 - RNA, 19 nt, Homo sapiens
gacauaagcaaagacuaug

SEQ ID NO: 27637 - RNA, 11 nt, Homo sapiens
aaaagccaaaa

SEQ ID NO: 27638 - RNA, 16 nt, Homo sapiens
cagcccaagggugggu

SEQ ID NO: 27639 - RNA, 11 nt, Homo sapiens
aaaagcacuua

SEQ ID NO: 27640 - RNA, 19 nt, Homo sapiens
accaguaacggaacaguau

SEQ ID NO: 27641 - RNA, 21 nt, Homo sapiens
cuuugcuuuaaguguaacugg

SEQ ID NO: 27642 - RNA, 15 nt, Homo sapiens
uauguucuaagaagu

SEQ ID NO: 27643 - RNA, 15 nt, Homo sapiens
cagcagagacggggu

SEQ ID NO: 27644 - RNA, 16 nt, Homo sapiens
auacuguauuuuuacc

SEQ ID NO: 27645 - RNA, 18 nt, Homo sapiens
gcccaucuccgucuccca

SEQ ID NO: 27646 - RNA, 23 nt, Homo sapiens
ccuuaaacucagggagcauuuau

SEQ ID NO: 27647 - RNA, 22 nt, Homo sapiens
ugucuugggaauuuucuuccaa

SEQ ID NO: 27648 - RNA, 22 nt, Homo sapiens
agagcccuucaugcauuugcac

SEQ ID NO: 27649 - RNA, 21 nt, Homo sapiens
aaaaaaauuuuauagugucuu

SEQ ID NO: 27650 - RNA, 16 nt, Homo sapiens
acuccuaguaauuuaa

SEQ ID NO: 27651 - RNA, 20 nt, Homo sapiens
gaaauuuaauucauguuucu

SEQ ID NO: 27652 - RNA, 13 nt, Homo sapiens
ugugacuuuccua

SEQ ID NO: 27653 - RNA, 17 nt, Homo sapiens
cauuuccaaauucacaa

SEQ ID NO: 27654 - RNA, 16 nt, Homo sapiens
aggugacccugaugaa

SEQ ID NO: 27655 - RNA, 12 nt, Homo sapiens
cacuucacuuuu

SEQ ID NO: 27656 - RNA, 22 nt, Homo sapiens
acacaugauccugcaauuccac

SEQ ID NO: 27657 - RNA, 23 nt, Homo sapiens
aucaauucuauuacgugcaauac

SEQ ID NO: 27658 - RNA, 19 nt, Homo sapiens
aauagaaggauguacauuu

SEQ ID NO: 27659 - RNA, 23 nt, Homo sapiens
aaugugucaggugacccugauga

SEQ ID NO: 27660 - RNA, 17 nt, Homo sapiens
gcacuuuaacacagugu

SEQ ID NO: 27661 - RNA, 16 nt, Homo sapiens
acagagaaaagacaua

SEQ ID NO: 27662 - RNA, 21 nt, Homo sapiens
caauagaaggauguacauuuc

SEQ ID NO: 27663 - RNA, 21 nt, Homo sapiens
uguuuucugacuaauuaggca

SEQ ID NO: 27664 - RNA, 20 nt, Homo sapiens
aggagauggaaguugcagug

SEQ ID NO: 27665 - RNA, 16 nt, Homo sapiens
uguacaccaauauuca

SEQ ID NO: 27666 - RNA, 12 nt, Homo sapiens
auagcaagugaa

SEQ ID NO: 27667 - RNA, 15 nt, Homo sapiens
uuuaugcuaagugaa

SEQ ID NO: 27668 - RNA, 14 nt, Homo sapiens
ugccuguaaucaca

SEQ ID NO: 27669 - RNA, 14 nt, Homo sapiens
gcagaagacaguau

SEQ ID NO: 27670 - RNA, 13 nt, Homo sapiens
uuuacuuccucag

SEQ ID NO: 27671 - RNA, 14 nt, Homo sapiens
uauuuuuaugugca

SEQ ID NO: 27672 - RNA, 17 nt, Homo sapiens
aaaguguaaguucacaa

SEQ ID NO: 27673 - RNA, 24 nt, Homo sapiens
gccggagccccuugggcaggucac

SEQ ID NO: 27674 - RNA, 18 nt, Homo sapiens
cuuuaacacagugucugg

SEQ ID NO: 27675 - RNA, 18 nt, Homo sapiens
agguacugagagugaaca

SEQ ID NO: 27676 - RNA, 14 nt, Homo sapiens
aagccagacaucaa

SEQ ID NO: 27677 - RNA, 21 nt, Homo sapiens
uuauagaauauuuauuaccuc

SEQ ID NO: 27678 - RNA, 13 nt, Homo sapiens
uuugcaagacaua

SEQ ID NO: 27679 - RNA, 19 nt, Homo sapiens
aacaucaguuacucugaag

SEQ ID NO: 27680 - RNA, 18 nt, Homo sapiens
gaaagcagggacuugaac

SEQ ID NO: 27681 - RNA, 20 nt, Homo sapiens
caacuauauuaucaugcaaa

SEQ ID NO: 27682 - RNA, 12 nt, Homo sapiens
caaauuccagaa

SEQ ID NO: 27683 - RNA, 15 nt, Homo sapiens
aagugauacuaucca

SEQ ID NO: 27684 - RNA, 16 nt, Homo sapiens
ccaaauuuguauuuaa

SEQ ID NO: 27685 - RNA, 13 nt, Homo sapiens
guaaaauugaaag

SEQ ID NO: 27686 - RNA, 19 nt, Homo sapiens
augguuccauucucucucc

SEQ ID NO: 27687 - RNA, 18 nt, Homo sapiens
ccaaaaucggaucugggg

SEQ ID NO: 27688 - RNA, 20 nt, Homo sapiens
uuucacuuuuggcuuguaaa

SEQ ID NO: 27689 - RNA, 20 nt, Homo sapiens
ccuccaccuucuggguucaa

SEQ ID NO: 27690 - RNA, 13 nt, Homo sapiens
auuaucaugcaaa

SEQ ID NO: 27691 - RNA, 17 nt, Homo sapiens
acccaaauguucaucaa

SEQ ID NO: 27692 - RNA, 15 nt, Homo sapiens
agacucugucucagu

SEQ ID NO: 27693 - RNA, 21 nt, Homo sapiens
caaucugagccagugcuuuaa

SEQ ID NO: 27694 - RNA, 21 nt, Homo sapiens
aucauuucaaaacucauuucc

SEQ ID NO: 27695 - RNA, 21 nt, Homo sapiens
uggacaguuuucugcuuuaau

SEQ ID NO: 27696 - RNA, 18 nt, Homo sapiens
ugggagaaucacuugaac

SEQ ID NO: 27697 - RNA, 17 nt, Homo sapiens
uaguuuaugauuccacc

SEQ ID NO: 27698 - RNA, 16 nt, Homo sapiens
caggcuccaaacugga

SEQ ID NO: 27699 - RNA, 17 nt, Homo sapiens
uguauuuuauuacaucu

SEQ ID NO: 27700 - RNA, 19 nt, Homo sapiens
ucccagcgagggacaccga

SEQ ID NO: 27701 - RNA, 19 nt, Homo sapiens
aagguauuuuaaucaccaa

SEQ ID NO: 27702 - RNA, 16 nt, Homo sapiens
gaagucuuccauagag

SEQ ID NO: 27703 - RNA, 13 nt, Homo sapiens
aaguacagacuuu

SEQ ID NO: 27704 - RNA, 16 nt, Homo sapiens
cuaaccagccugguca

SEQ ID NO: 27705 - RNA, 20 nt, Homo sapiens
gaaaacauagcaucucagga

SEQ ID NO: 27706 - RNA, 20 nt, Homo sapiens
guaaucccagcuacuuggga

SEQ ID NO: 27707 - RNA, 18 nt, Homo sapiens
ugagacagcucugcauac

SEQ ID NO: 27708 - RNA, 20 nt, Homo sapiens
acgugacuggccugcuggau

SEQ ID NO: 27709 - RNA, 15 nt, Homo sapiens
uccuauguaacugca

SEQ ID NO: 27710 - RNA, 15 nt, Homo sapiens
ccuuuuuguuauuag

SEQ ID NO: 27711 - RNA, 15 nt, Homo sapiens
uagccacuucacuuu

SEQ ID NO: 27712 - RNA, 15 nt, Homo sapiens
ccuuuacauccagau

SEQ ID NO: 27713 - RNA, 14 nt, Homo sapiens
aucaaccaaaugga

SEQ ID NO: 27714 - RNA, 14 nt, Homo sapiens
ccgaagucuuccau

SEQ ID NO: 27715 - RNA, 19 nt, Homo sapiens
uagagaaauuugccaauuu

SEQ ID NO: 27716 - RNA, 15 nt, Homo sapiens
gcccuucaugcauuu

SEQ ID NO: 27717 - RNA, 15 nt, Homo sapiens
acaguuccugagacc

SEQ ID NO: 27718 - RNA, 14 nt, Homo sapiens
uauguggcuguauc

SEQ ID NO: 27719 - RNA, 13 nt, Homo sapiens
cuuuaucucaggg

SEQ ID NO: 27720 - RNA, 20 nt, Homo sapiens
cagagguugcagugagccga

SEQ ID NO: 27721 - RNA, 17 nt, Homo sapiens
auggagguuaagcacuu

SEQ ID NO: 27722 - RNA, 20 nt, Homo sapiens
gagauggaaguugcagugag

SEQ ID NO: 27723 - RNA, 14 nt, Homo sapiens
ggcauucucugaag

SEQ ID NO: 27724 - RNA, 12 nt, Homo sapiens
acucauugcaac

SEQ ID NO: 27725 - RNA, 20 nt, Homo sapiens
cagugagcugauaucaugcc

SEQ ID NO: 27726 - RNA, 20 nt, Homo sapiens
gccauaauuacuaugucauu

SEQ ID NO: 27727 - RNA, 14 nt, Homo sapiens
agcuguuuccauag

SEQ ID NO: 27728 - RNA, 13 nt, Homo sapiens
aucaggacgagaa

SEQ ID NO: 27729 - RNA, 23 nt, Homo sapiens
guauuuuauuacaucuuucacau

SEQ ID NO: 27730 - RNA, 13 nt, Homo sapiens
uacauuuccaaau

SEQ ID NO: 27731 - RNA, 22 nt, Homo sapiens
ugcagcccccauuguggucaca

SEQ ID NO: 27732 - RNA, 17 nt, Homo sapiens
aaaauuaucaauaucua

SEQ ID NO: 27733 - RNA, 20 nt, Homo sapiens
gagcuguuuucccugaccuc

SEQ ID NO: 27734 - RNA, 16 nt, Homo sapiens
ccugugacugucucac

SEQ ID NO: 27735 - RNA, 20 nt, Homo sapiens
caacuugaauaauacaccag

SEQ ID NO: 27736 - RNA, 14 nt, Homo sapiens
uaugacacaucucu

SEQ ID NO: 27737 - RNA, 16 nt, Homo sapiens
ucucuuauagaauauu

SEQ ID NO: 27738 - RNA, 14 nt, Homo sapiens
uugaaugugucagg

SEQ ID NO: 27739 - RNA, 12 nt, Homo sapiens
gccaauuuacuu

SEQ ID NO: 27740 - RNA, 21 nt, Homo sapiens
gcgcaaucuuaacucauugca

SEQ ID NO: 27741 - RNA, 13 nt, Homo sapiens
aacacagugucug

SEQ ID NO: 27742 - RNA, 17 nt, Homo sapiens
aagcagaacagugauua

SEQ ID NO: 27743 - RNA, 21 nt, Homo sapiens
uugaagaugcuuguauuuuac

SEQ ID NO: 27744 - RNA, 13 nt, Homo sapiens
aauauuguugaca

SEQ ID NO: 27745 - RNA, 19 nt, Homo sapiens
gaaaaaguucugcagauaa

SEQ ID NO: 27746 - RNA, 17 nt, Homo sapiens
uagaauauuuauuaccu

SEQ ID NO: 27747 - RNA, 19 nt, Homo sapiens
gacuaugaggaauauuugc

SEQ ID NO: 27748 - RNA, 20 nt, Homo sapiens
auugagcaccugcaggcgug

SEQ ID NO: 27749 - RNA, 19 nt, Homo sapiens
uuauuuagggaacugcuug

SEQ ID NO: 27750 - RNA, 12 nt, Homo sapiens
cauguacaucca

SEQ ID NO: 27751 - RNA, 21 nt, Homo sapiens
uuuacauacugcugucuaugu

SEQ ID NO: 27752 - RNA, 21 nt, Homo sapiens
uuguuuuaaaauuaaagcuaa

SEQ ID NO: 27753 - RNA, 14 nt, Homo sapiens
uaugcauacaguaa

SEQ ID NO: 27754 - RNA, 19 nt, Homo sapiens
uucgugaaguauacuguau

SEQ ID NO: 27755 - RNA, 23 nt, Homo sapiens
auaauuccuauauccugugacug

SEQ ID NO: 27756 - RNA, 16 nt, Homo sapiens
aagaaugacuaugcaa

SEQ ID NO: 27757 - RNA, 16 nt, Homo sapiens
agauccccguguuacu

SEQ ID NO: 27758 - RNA, 15 nt, Homo sapiens
caaaaucaaauucca

SEQ ID NO: 27759 - RNA, 15 nt, Homo sapiens
uuauuaccucugaua

SEQ ID NO: 27760 - RNA, 15 nt, Homo sapiens
cuagauacugaaugu

SEQ ID NO: 27761 - RNA, 20 nt, Homo sapiens
caauucuauuacgugcaaua

SEQ ID NO: 27762 - RNA, 23 nt, Homo sapiens
cuaucagcauuuuacuacuuuaa

SEQ ID NO: 27763 - RNA, 13 nt, Homo sapiens
uugaaaaaguaua

SEQ ID NO: 27764 - RNA, 17 nt, Homo sapiens
uauuuuauaucaauuua

SEQ ID NO: 27765 - RNA, 22 nt, Homo sapiens
ugaauaaaguguaaguucacaa

SEQ ID NO: 27766 - RNA, 16 nt, Homo sapiens
uuggaugcacuuuaua

SEQ ID NO: 27767 - RNA, 15 nt, Homo sapiens
aucagcauuuuacua

SEQ ID NO: 27768 - RNA, 23 nt, Homo sapiens
uccucuuucaaagguagccauca

SEQ ID NO: 27769 - RNA, 12 nt, Homo sapiens
ugcaagacauag

SEQ ID NO: 27770 - RNA, 15 nt, Homo sapiens
aaugguuccauucuc

SEQ ID NO: 27771 - RNA, 22 nt, Homo sapiens
uaucucaggggccaacuaggca

SEQ ID NO: 27772 - RNA, 12 nt, Homo sapiens
uuacgugcaaua

SEQ ID NO: 27773 - RNA, 12 nt, Homo sapiens
caaacagaacua

SEQ ID NO: 27774 - RNA, 12 nt, Homo sapiens
auuaauucaccu

SEQ ID NO: 27775 - RNA, 19 nt, Homo sapiens
cccuuugaugauuaauuca

SEQ ID NO: 27776 - RNA, 14 nt, Homo sapiens
gauuucaugccugg

SEQ ID NO: 27777 - RNA, 20 nt, Homo sapiens
gccauggagguuaagcacuu

SEQ ID NO: 27778 - RNA, 13 nt, Homo sapiens
cauuuucacuuuu

SEQ ID NO: 27779 - RNA, 16 nt, Homo sapiens
uauuacgugcaauacu

SEQ ID NO: 27780 - RNA, 19 nt, Homo sapiens
cugcaaucugagccagugc

SEQ ID NO: 27781 - RNA, 17 nt, Homo sapiens
uccaaauauuguugaca

SEQ ID NO: 27782 - RNA, 20 nt, Homo sapiens
cugcagaagacaguauggca

SEQ ID NO: 27783 - RNA, 17 nt, Homo sapiens
uucuauuacgugcaaua

SEQ ID NO: 27784 - RNA, 20 nt, Homo sapiens
cucuacuaaaaauacaaaaa

SEQ ID NO: 27785 - RNA, 22 nt, Homo sapiens
uucuauuacgugcaauacuuca

SEQ ID NO: 27786 - RNA, 17 nt, Homo sapiens
auagaauuaacacauga

SEQ ID NO: 27787 - RNA, 14 nt, Homo sapiens
cgcagccaugugau

SEQ ID NO: 27788 - RNA, 14 nt, Homo sapiens
uaaauguaucuuau

SEQ ID NO: 27789 - RNA, 16 nt, Homo sapiens
caaauauuguugacaa

SEQ ID NO: 27790 - RNA, 20 nt, Homo sapiens
gagugacuuaguguacauga

SEQ ID NO: 27791 - RNA, 17 nt, Homo sapiens
ccuggacaguuuucugc

SEQ ID NO: 27792 - RNA, 19 nt, Homo sapiens
cauggcacucuauguucua

SEQ ID NO: 27793 - RNA, 19 nt, Homo sapiens
uaguguuggaaaaugugca

SEQ ID NO: 27794 - RNA, 21 nt, Homo sapiens
uauucacaaccacucauucaa

SEQ ID NO: 27795 - RNA, 19 nt, Homo sapiens
aggcaaggcuaugugauua

SEQ ID NO: 27796 - RNA, 22 nt, Homo sapiens
uaguguuggaaaaugugcaaua

SEQ ID NO: 27797 - RNA, 18 nt, Homo sapiens
cuguuccuucacauccug

SEQ ID NO: 27798 - RNA, 15 nt, Homo sapiens
cuucuuggucucagu

SEQ ID NO: 27799 - RNA, 23 nt, Homo sapiens
aaagucagugcccaacuguuaua

SEQ ID NO: 27800 - RNA, 18 nt, Homo sapiens
cuuggucacauacaauua

SEQ ID NO: 27801 - RNA, 16 nt, Homo sapiens
auaaacucagaaauuu

SEQ ID NO: 27802 - RNA, 19 nt, Homo sapiens
uauuuauugagcaccugca

SEQ ID NO: 27803 - RNA, 15 nt, Homo sapiens
gacuuaaaaucuaau

SEQ ID NO: 27804 - RNA, 19 nt, Homo sapiens
gcaacccaaauguucauca

SEQ ID NO: 27805 - RNA, 16 nt, Homo sapiens
uguaucuuauucacau

SEQ ID NO: 27806 - RNA, 19 nt, Homo sapiens
auuguugacaacugugacu

SEQ ID NO: 27807 - RNA, 14 nt, Homo sapiens
augaaugaauggcu

SEQ ID NO: 27808 - RNA, 13 nt, Homo sapiens
auguaacugcauu

SEQ ID NO: 27809 - RNA, 21 nt, Homo sapiens
uauuuauaauuccuauauccu

SEQ ID NO: 27810 - RNA, 13 nt, Homo sapiens
uaagcaacaucua

SEQ ID NO: 27811 - RNA, 14 nt, Homo sapiens
uuuaaguaauuuca

SEQ ID NO: 27812 - RNA, 15 nt, Homo sapiens
uauuuuuaugugcaa

SEQ ID NO: 27813 - RNA, 22 nt, Homo sapiens
agcacuuucccucuuggugccu

SEQ ID NO: 27814 - RNA, 22 nt, Homo sapiens
agaccuggucgucgucuugacu

SEQ ID NO: 27815 - RNA, 21 nt, Homo sapiens
gacagaaagcagaacagugau

SEQ ID NO: 27816 - RNA, 18 nt, Homo sapiens
aggcauguaauugcuugu

SEQ ID NO: 27817 - RNA, 19 nt, Homo sapiens
ugcuggccaggcuggucuc

SEQ ID NO: 27818 - RNA, 22 nt, Homo sapiens
aaacaucaguuacucugaaggg

SEQ ID NO: 27819 - RNA, 16 nt, Homo sapiens
aacaaaaaaagcauug

SEQ ID NO: 27820 - RNA, 21 nt, Homo sapiens
gcuacucuguuccuucacauc

SEQ ID NO: 27821 - RNA, 14 nt, Homo sapiens
augaaaaugaauau

SEQ ID NO: 27822 - RNA, 18 nt, Homo sapiens
auuuuauuacaucuuuca

SEQ ID NO: 27823 - RNA, 19 nt, Homo sapiens
aaucaccaaggcugauuaa

SEQ ID NO: 27824 - RNA, 14 nt, Homo sapiens
cuguaaucacagcu

SEQ ID NO: 27825 - RNA, 19 nt, Homo sapiens
cauuugcuggagcucugcc

SEQ ID NO: 27826 - RNA, 16 nt, Homo sapiens
cacgccuguaauccca

SEQ ID NO: 27827 - RNA, 14 nt, Homo sapiens
uaacugcauugaga

SEQ ID NO: 27828 - RNA, 13 nt, Homo sapiens
acaacugugacug

SEQ ID NO: 27829 - RNA, 15 nt, Homo sapiens
uuggaaaaugugcaa

SEQ ID NO: 27830 - RNA, 22 nt, Homo sapiens
cugaugaaaacauagcaucuca

SEQ ID NO: 27831 - RNA, 13 nt, Homo sapiens
gccccugcacucc

SEQ ID NO: 27832 - RNA, 21 nt, Homo sapiens
cucuauagacucuaggacaua

SEQ ID NO: 27833 - RNA, 20 nt, Homo sapiens
auaauaugcacacagugcuu

SEQ ID NO: 27834 - RNA, 13 nt, Homo sapiens
ucacaagcacuuu

SEQ ID NO: 27835 - RNA, 18 nt, Homo sapiens
ugauccugcaauuccacu

SEQ ID NO: 27836 - RNA, 18 nt, Homo sapiens
aaaucuacacuccaguga

SEQ ID NO: 27837 - RNA, 14 nt, Homo sapiens
cuuggucucagugu

SEQ ID NO: 27838 - RNA, 17 nt, Homo sapiens
uaacuuaugaaccuuua

SEQ ID NO: 27839 - RNA, 16 nt, Homo sapiens
guggcauuuucacuuu

SEQ ID NO: 27840 - RNA, 23 nt, Homo sapiens
ucacauuccaagccucaugucca

SEQ ID NO: 27841 - RNA, 24 nt, Homo sapiens
uuucaaaaucaaauuccagaauga

SEQ ID NO: 27842 - RNA, 23 nt, Homo sapiens
ugauccugcaauuccacuuauag

SEQ ID NO: 27843 - RNA, 20 nt, Homo sapiens
uuagacccucaugcugccaa

SEQ ID NO: 27844 - RNA, 15 nt, Homo sapiens
gucucaguccaugaa

SEQ ID NO: 27845 - RNA, 22 nt, Homo sapiens
ugucuuacagagaaaagacaua

SEQ ID NO: 27846 - RNA, 14 nt, Homo sapiens
gguacauauuucuu

SEQ ID NO: 27847 - RNA, 22 nt, Homo sapiens
aagucagugcccaacuguuaua

SEQ ID NO: 27848 - RNA, 18 nt, Homo sapiens
auuuguuaaaauuaucaa

SEQ ID NO: 27849 - RNA, 23 nt, Homo sapiens
gaaauuugccaauuuacuuuguu

SEQ ID NO: 27850 - RNA, 22 nt, Homo sapiens
gcuugaaauagugucugaugaa

SEQ ID NO: 27851 - RNA, 13 nt, Homo sapiens
aggaauauuugca

SEQ ID NO: 27852 - RNA, 23 nt, Homo sapiens
uuuaaaaaaaaaaaaaaagccaa

SEQ ID NO: 27853 - RNA, 16 nt, Homo sapiens
uuaugaaccuuuacau

SEQ ID NO: 27854 - RNA, 16 nt, Homo sapiens
gacuuuggcaaaugag

SEQ ID NO: 27855 - RNA, 15 nt, Homo sapiens
agugaaaaacaucca

SEQ ID NO: 27856 - RNA, 21 nt, Homo sapiens
agggucucccucuguugccaa

SEQ ID NO: 27857 - RNA, 15 nt, Homo sapiens
uuuccacuacugcua

SEQ ID NO: 27858 - RNA, 17 nt, Homo sapiens
ccagugcuuuaauggca

SEQ ID NO: 27859 - RNA, 15 nt, Homo sapiens
uuaucuugucucugg

SEQ ID NO: 27860 - RNA, 15 nt, Homo sapiens
aaugauuucauucaa

SEQ ID NO: 27861 - RNA, 13 nt, Homo sapiens
uauuuuaaucacc

SEQ ID NO: 27862 - RNA, 15 nt, Homo sapiens
aaucagaucauuuca

SEQ ID NO: 27863 - RNA, 23 nt, Homo sapiens
auauuuuuuaugaaacauuacag

SEQ ID NO: 27864 - RNA, 12 nt, Homo sapiens
accacauggcuu

SEQ ID NO: 27865 - RNA, 18 nt, Homo sapiens
uauauguguuuuucacau

SEQ ID NO: 27866 - RNA, 17 nt, Homo sapiens
caacuauauuaucaugc

SEQ ID NO: 27867 - RNA, 22 nt, Homo sapiens
cuguacuccagccugggugaca

SEQ ID NO: 27868 - RNA, 19 nt, Homo sapiens
aucuccgucucccaaagug

SEQ ID NO: 27869 - RNA, 17 nt, Homo sapiens
auaagcaaagacuauga

SEQ ID NO: 27870 - RNA, 20 nt, Homo sapiens
auuuucacuuuuggcuugua

SEQ ID NO: 27871 - RNA, 21 nt, Homo sapiens
ucauuuccuauguaacugcau

SEQ ID NO: 27872 - RNA, 16 nt, Homo sapiens
ucucuaacucagaaac

SEQ ID NO: 27873 - RNA, 20 nt, Homo sapiens
ccuggacaguuuucugcuuu

SEQ ID NO: 27874 - RNA, 16 nt, Homo sapiens
uucucuaacucagaaa

SEQ ID NO: 27875 - RNA, 19 nt, Homo sapiens
uacaaggcuuuaucucagg

SEQ ID NO: 27876 - RNA, 15 nt, Homo sapiens
uugacaacugugacu

SEQ ID NO: 27877 - RNA, 12 nt, Homo sapiens
ucuuggugccuc

SEQ ID NO: 27878 - RNA, 16 nt, Homo sapiens
cauuuccaaauucaca

SEQ ID NO: 27879 - RNA, 12 nt, Homo sapiens
aaaaaagccaaa

SEQ ID NO: 27880 - RNA, 18 nt, Homo sapiens
uuacagagaaaagacaua

SEQ ID NO: 27881 - RNA, 18 nt, Homo sapiens
caacagaagcuuccauuc

SEQ ID NO: 27882 - RNA, 16 nt, Homo sapiens
aggcuuuaucucaggg

SEQ ID NO: 27883 - RNA, 14 nt, Homo sapiens
aaaccucaagccag

SEQ ID NO: 27884 - RNA, 11 nt, Homo sapiens
gcaacccaaau

SEQ ID NO: 27885 - RNA, 10 nt, Homo sapiens
auagugucuu

SEQ ID NO: 27886 - RNA, 18 nt, Homo sapiens
ugaaagcagggacuugaa

SEQ ID NO: 27887 - RNA, 13 nt, Homo sapiens
agaaucacuugaa

SEQ ID NO: 27888 - RNA, 13 nt, Homo sapiens
caauuccucuggg

SEQ ID NO: 27889 - RNA, 13 nt, Homo sapiens
gaaauagugucug

SEQ ID NO: 27890 - RNA, 21 nt, Homo sapiens
aaagaaaaucaggcuggccaa

SEQ ID NO: 27891 - RNA, 20 nt, Homo sapiens
auugugccccugcacuccag

SEQ ID NO: 27892 - RNA, 13 nt, Homo sapiens
cacuccagccuga

SEQ ID NO: 27893 - RNA, 14 nt, Homo sapiens
agcuucucugugaa

SEQ ID NO: 27894 - RNA, 18 nt, Homo sapiens
aacucauugcaaccucca

SEQ ID NO: 27895 - RNA, 18 nt, Homo sapiens
uggaucucacaagcacuu

SEQ ID NO: 27896 - RNA, 12 nt, Homo sapiens
uuaccucugaua

SEQ ID NO: 27897 - RNA, 13 nt, Homo sapiens
ugaaauagugucu

SEQ ID NO: 27898 - RNA, 12 nt, Homo sapiens
gaaaaugugcaa

SEQ ID NO: 27899 - RNA, 17 nt, Homo sapiens
caaauguucaucaauga

SEQ ID NO: 27900 - RNA, 17 nt, Homo sapiens
aggcuagaaccaccugc

SEQ ID NO: 27901 - RNA, 21 nt, Homo sapiens
guauauaaauuuucccaaaac

SEQ ID NO: 27902 - RNA, 17 nt, Homo sapiens
aagugaaaaacauccag

SEQ ID NO: 27903 - RNA, 17 nt, Homo sapiens
ugaaaaucuacacucca

SEQ ID NO: 27904 - RNA, 22 nt, Homo sapiens
aguauaaauaaaaugagcaaaa

SEQ ID NO: 27905 - RNA, 19 nt, Homo sapiens
cagccugggugacagagca

SEQ ID NO: 27906 - RNA, 15 nt, Homo sapiens
uauuucacuugauga

SEQ ID NO: 27907 - RNA, 21 nt, Homo sapiens
cuguaaucccagcuacuuggg

SEQ ID NO: 27908 - RNA, 16 nt, Homo sapiens
uauugagcaccugcag

SEQ ID NO: 27909 - RNA, 17 nt, Homo sapiens
aaagcuaaaguaucugu

SEQ ID NO: 27910 - RNA, 15 nt, Homo sapiens
caagccucaugucca

SEQ ID NO: 27911 - RNA, 22 nt, Homo sapiens
aucaauucuauuacgugcaaua

SEQ ID NO: 27912 - RNA, 13 nt, Homo sapiens
uuuuucauuauug

SEQ ID NO: 27913 - RNA, 17 nt, Homo sapiens
uguggcauuuucacuuu

SEQ ID NO: 27914 - RNA, 20 nt, Homo sapiens
uuaaaaucuaauucaaacua

SEQ ID NO: 27915 - RNA, 22 nt, Homo sapiens
aagauguagaggagaaacugga

SEQ ID NO: 27916 - RNA, 20 nt, Homo sapiens
aaccaaauggagugacuuag

SEQ ID NO: 27917 - RNA, 16 nt, Homo sapiens
cagacaucaacagaua

SEQ ID NO: 27918 - RNA, 13 nt, Homo sapiens
ucaaauuccagaa

SEQ ID NO: 27919 - RNA, 14 nt, Homo sapiens
uucccaaaacugau

SEQ ID NO: 27920 - RNA, 20 nt, Homo sapiens
auuuauuuuuuuacuuccuc

SEQ ID NO: 27921 - RNA, 18 nt, Homo sapiens
aaccacuucauucuugaa

SEQ ID NO: 27922 - RNA, 16 nt, Homo sapiens
aacauuucaaaaggua

SEQ ID NO: 27923 - RNA, 17 nt, Homo sapiens
gggcuuuagggaccugc

SEQ ID NO: 27924 - RNA, 15 nt, Homo sapiens
aaacauguucacuua

SEQ ID NO: 27925 - RNA, 15 nt, Homo sapiens
caguauccaguacuc

SEQ ID NO: 27926 - RNA, 18 nt, Homo sapiens
ugaaaacauagcaucuca

SEQ ID NO: 27927 - RNA, 21 nt, Homo sapiens
gagauugugccccugcacucc

SEQ ID NO: 27928 - RNA, 13 nt, Homo sapiens
cuaugugauuaca

SEQ ID NO: 27929 - RNA, 20 nt, Homo sapiens
gaaguugcagugagcugaua

SEQ ID NO: 27930 - RNA, 15 nt, Homo sapiens
gcugggaguggcaug

SEQ ID NO: 27931 - RNA, 20 nt, Homo sapiens
uuacugagcuucucugugaa

SEQ ID NO: 27932 - RNA, 15 nt, Homo sapiens
auuuuuaugugcaau

SEQ ID NO: 27933 - RNA, 10 nt, Homo sapiens
caagacauag

SEQ ID NO: 27934 - RNA, 15 nt, Homo sapiens
auuuaaagacaaaga

SEQ ID NO: 27935 - RNA, 23 nt, Homo sapiens
guuuccuagcgcagccaugugau

SEQ ID NO: 27936 - RNA, 20 nt, Homo sapiens
agaaggauguacauuuccaa

SEQ ID NO: 27937 - RNA, 12 nt, Homo sapiens
cagaacagugau

SEQ ID NO: 27938 - RNA, 20 nt, Homo sapiens
aauuuaucuugucucugggc

SEQ ID NO: 27939 - RNA, 17 nt, Homo sapiens
aacuagaauuuauucaa

SEQ ID NO: 27940 - RNA, 14 nt, Homo sapiens
cagucacauuccaa

SEQ ID NO: 27941 - RNA, 22 nt, Homo sapiens
ugagacagcucugcauacucau

SEQ ID NO: 27942 - RNA, 21 nt, Homo sapiens
ugaaaaucuacacuccaguga

SEQ ID NO: 27943 - RNA, 11 nt, Homo sapiens
uuuaugugcaa

SEQ ID NO: 27944 - RNA, 20 nt, Homo sapiens
aguucugucuggacuuucca

SEQ ID NO: 27945 - RNA, 15 nt, Homo sapiens
guagccacuucacuu

SEQ ID NO: 27946 - RNA, 12 nt, Homo sapiens
ucaucaaugaau

SEQ ID NO: 27947 - RNA, 12 nt, Homo sapiens
caucuuucacau

SEQ ID NO: 27948 - RNA, 21 nt, Homo sapiens
caccaaacccggccugauuaa

SEQ ID NO: 27949 - RNA, 16 nt, Homo sapiens
ggcauuuucacuuuug

SEQ ID NO: 27950 - RNA, 13 nt, Homo sapiens
uuuauugccauga

SEQ ID NO: 27951 - RNA, 16 nt, Homo sapiens
cagagaaaagacauaa

SEQ ID NO: 27952 - RNA, 17 nt, Homo sapiens
auuuauuuuuuuacuuc

SEQ ID NO: 27953 - RNA, 14 nt, Homo sapiens
guaccucucuuaua

SEQ ID NO: 27954 - RNA, 12 nt, Homo sapiens
ucuguaaucuuc

SEQ ID NO: 27955 - RNA, 15 nt, Homo sapiens
uuaaagaauuuucaa

SEQ ID NO: 27956 - RNA, 18 nt, Homo sapiens
ucuaacucagaaacauca

SEQ ID NO: 27957 - RNA, 17 nt, Homo sapiens
aucuacacuccagugag

SEQ ID NO: 27958 - RNA, 23 nt, Homo sapiens
aagucuuccauagagacuuugug

SEQ ID NO: 27959 - RNA, 20 nt, Homo sapiens
cugucccugcagacaugaga

SEQ ID NO: 27960 - RNA, 17 nt, Homo sapiens
auauaaauuuucccaaa

SEQ ID NO: 27961 - RNA, 18 nt, Homo sapiens
gaguuaggcuauucacaa

SEQ ID NO: 27962 - RNA, 19 nt, Homo sapiens
augaauuuuuuucaucuuc

SEQ ID NO: 27963 - RNA, 20 nt, Homo sapiens
acagcuacuugggaggcuga

SEQ ID NO: 27964 - RNA, 15 nt, Homo sapiens
agcugaauacauucu

SEQ ID NO: 27965 - RNA, 12 nt, Homo sapiens
acaacugugacu

SEQ ID NO: 27966 - RNA, 16 nt, Homo sapiens
gacugucucacuuaau

SEQ ID NO: 27967 - RNA, 14 nt, Homo sapiens
aucaguuacucuga

SEQ ID NO: 27968 - RNA, 16 nt, Homo sapiens
acuggcaguuuuccau

SEQ ID NO: 27969 - RNA, 21 nt, Homo sapiens
cauuucuauuuauuuacugag

SEQ ID NO: 27970 - RNA, 22 nt, Homo sapiens
acccucugggucucaguguccu

SEQ ID NO: 27971 - RNA, 15 nt, Homo sapiens
ggaaaaugugcaaua

SEQ ID NO: 27972 - RNA, 13 nt, Homo sapiens
gugacuggccugc

SEQ ID NO: 27973 - RNA, 12 nt, Homo sapiens
gauuucauucaa

SEQ ID NO: 27974 - RNA, 11 nt, Homo sapiens
augugcaauau

SEQ ID NO: 27975 - RNA, 15 nt, Homo sapiens
auugagaacugcaua

SEQ ID NO: 27976 - RNA, 19 nt, Homo sapiens
aaagcagggacuugaaccc

SEQ ID NO: 27977 - RNA, 18 nt, Homo sapiens
cuggcuuaaaauguaauu

SEQ ID NO: 27978 - RNA, 11 nt, Homo sapiens
acaucuuucac

SEQ ID NO: 27979 - RNA, 20 nt, Homo sapiens
uuaugaaccuuuacauccag

SEQ ID NO: 27980 - RNA, 17 nt, Homo sapiens
agccccgggaguggcgc

SEQ ID NO: 27981 - RNA, 18 nt, Homo sapiens
acuuaaaaucuaauucaa

SEQ ID NO: 27982 - RNA, 14 nt, Homo sapiens
agcagggacuugaa

SEQ ID NO: 27983 - RNA, 20 nt, Homo sapiens
aaacuuuaugcuaagugaaa

SEQ ID NO: 27984 - RNA, 22 nt, Homo sapiens
ugaaaaaaaauuuuauaguguc

SEQ ID NO: 27985 - RNA, 15 nt, Homo sapiens
cuuuuauugccauga

SEQ ID NO: 27986 - RNA, 15 nt, Homo sapiens
cauccagauagguua

SEQ ID NO: 27987 - RNA, 13 nt, Homo sapiens
aauaaaagcacuu

SEQ ID NO: 27988 - RNA, 13 nt, Homo sapiens
uggcacugcauac

SEQ ID NO: 27989 - RNA, 19 nt, Homo sapiens
ugacuaauuaggcaaggcu

SEQ ID NO: 27990 - RNA, 11 nt, Homo sapiens
uuuacuuuguu

SEQ ID NO: 27991 - RNA, 21 nt, Homo sapiens
cuuguuuuuccacuacugcua

SEQ ID NO: 27992 - RNA, 15 nt, Homo sapiens
guacuuuuuccagac

SEQ ID NO: 27993 - RNA, 23 nt, Homo sapiens
cagaagaaauucugcaagcuuuu

SEQ ID NO: 27994 - RNA, 19 nt, Homo sapiens
gaagaguggguuucacaag

SEQ ID NO: 27995 - RNA, 17 nt, Homo sapiens
gaauuuauucaauuccu

SEQ ID NO: 27996 - RNA, 11 nt, Homo sapiens
aggcauguaau

SEQ ID NO: 27997 - RNA, 14 nt, Homo sapiens
acugucucacuuaa

SEQ ID NO: 27998 - RNA, 20 nt, Homo sapiens
uuugcugccucuaaaaggcc

SEQ ID NO: 27999 - RNA, 16 nt, Homo sapiens
aagcaaaaugugauau

SEQ ID NO: 28000 - RNA, 14 nt, Homo sapiens
uaaaaucuaauuca

SEQ ID NO: 28001 - RNA, 18 nt, Homo sapiens
auauuuuuaugugcaaua

SEQ ID NO: 28002 - RNA, 15 nt, Homo sapiens
cccugcacuccagcc

SEQ ID NO: 28003 - RNA, 16 nt, Homo sapiens
acuuaguguacaugaa

SEQ ID NO: 28004 - RNA, 20 nt, Homo sapiens
cccucugggucucagugucc

SEQ ID NO: 28005 - RNA, 22 nt, Homo sapiens
cacccuugccauggagguuaag

SEQ ID NO: 28006 - RNA, 17 nt, Homo sapiens
auuguaacuuaugaacc

SEQ ID NO: 28007 - RNA, 16 nt, Homo sapiens
ucccaaagugcuggga

SEQ ID NO: 28008 - RNA, 21 nt, Homo sapiens
cucugcccauccugccccuga

SEQ ID NO: 28009 - RNA, 14 nt, Homo sapiens
uugaaauagugucu

SEQ ID NO: 28010 - RNA, 22 nt, Homo sapiens
aagcuuccauuccaagccugac

SEQ ID NO: 28011 - RNA, 19 nt, Homo sapiens
ugcuggcuuaaaauguaau

SEQ ID NO: 28012 - RNA, 20 nt, Homo sapiens
agcuacuugggaggcugaga

SEQ ID NO: 28013 - RNA, 20 nt, Homo sapiens
accaaacccggccugauuaa

SEQ ID NO: 28014 - RNA, 13 nt, Homo sapiens
gggaguggcgcgc

SEQ ID NO: 28015 - RNA, 19 nt, Homo sapiens
uguaaucccagcuacuugg

SEQ ID NO: 28016 - RNA, 23 nt, Homo sapiens
uccaagccugaccacgcuuucua

SEQ ID NO: 28017 - RNA, 22 nt, Homo sapiens
gaauaguguuggaaaaugugca

SEQ ID NO: 28018 - RNA, 14 nt, Homo sapiens
agauaauaugagaa

SEQ ID NO: 28019 - RNA, 10 nt, Homo sapiens
ggggcuuccu

SEQ ID NO: 28020 - RNA, 23 nt, Homo sapiens
uaacucagaaacaucaguuacuc

SEQ ID NO: 28021 - RNA, 19 nt, Homo sapiens
gagaacugcauauguuucg

SEQ ID NO: 28022 - RNA, 22 nt, Homo sapiens
cauaaauuagaggucuccaaaa

SEQ ID NO: 28023 - RNA, 22 nt, Homo sapiens
caaauaaguauuuauaauagca

SEQ ID NO: 28024 - RNA, 15 nt, Homo sapiens
cuaaauuugguucua

SEQ ID NO: 28025 - RNA, 20 nt, Homo sapiens
cugaagggcaucaugcaucu

SEQ ID NO: 28026 - RNA, 20 nt, Homo sapiens
ugaggacuugggcgggacac

SEQ ID NO: 28027 - RNA, 15 nt, Homo sapiens
auuugcaagacauag

SEQ ID NO: 28028 - RNA, 13 nt, Homo sapiens
gcuuuaauuucau

SEQ ID NO: 28029 - RNA, 14 nt, Homo sapiens
cuuaaaaucuaauu

SEQ ID NO: 28030 - RNA, 17 nt, Homo sapiens
uugaaauuaaccauaga

SEQ ID NO: 28031 - RNA, 18 nt, Homo sapiens
auuacaggcgugagccac

SEQ ID NO: 28032 - RNA, 20 nt, Homo sapiens
acauuguuugucugucuuca

SEQ ID NO: 28033 - RNA, 13 nt, Homo sapiens
uggauucaaguga

SEQ ID NO: 28034 - RNA, 20 nt, Homo sapiens
aaccuccaccuucuggguuc

SEQ ID NO: 28035 - RNA, 11 nt, Homo sapiens
aggcauucucu

SEQ ID NO: 28036 - RNA, 22 nt, Homo sapiens
uugggaggcugaggcaagagaa

SEQ ID NO: 28037 - RNA, 17 nt, Homo sapiens
gagggggcgcgugcagg

SEQ ID NO: 28038 - RNA, 13 nt, Homo sapiens
gauaauaugagaa

SEQ ID NO: 28039 - RNA, 22 nt, Homo sapiens
gucucaguguccucaucuguaa

SEQ ID NO: 28040 - RNA, 17 nt, Homo sapiens
uuggaaaaugugcaaua

SEQ ID NO: 28041 - RNA, 18 nt, Homo sapiens
uacaguuagagauuuuua

SEQ ID NO: 28042 - RNA, 13 nt, Homo sapiens
ucaugcauuugca

SEQ ID NO: 28043 - RNA, 14 nt, Homo sapiens
aacugcauugagaa

SEQ ID NO: 28044 - RNA, 23 nt, Homo sapiens
augcuuguauuuuacuuuuccau

SEQ ID NO: 28045 - RNA, 12 nt, Homo sapiens
acuagucuuaua

SEQ ID NO: 28046 - RNA, 22 nt, Homo sapiens
uuucaugaaaagauuaugaucu

SEQ ID NO: 28047 - RNA, 21 nt, Homo sapiens
uuaucaugcaaaugcuguauu

SEQ ID NO: 28048 - RNA, 13 nt, Homo sapiens
auguuaugcauaa

SEQ ID NO: 28049 - RNA, 18 nt, Homo sapiens
aauauuugcaagacauag

SEQ ID NO: 28050 - RNA, 19 nt, Homo sapiens
acauccagauagguuacca

SEQ ID NO: 28051 - RNA, 20 nt, Homo sapiens
guacuccagccugggugaca

SEQ ID NO: 28052 - RNA, 19 nt, Homo sapiens
cauuugcgaaugguuccau

SEQ ID NO: 28053 - RNA, 22 nt, Homo sapiens
agcauauguuuuuguaaguuua

SEQ ID NO: 28054 - RNA, 15 nt, Homo sapiens
ugacccugaugaaaa

SEQ ID NO: 28055 - RNA, 20 nt, Homo sapiens
uaaguugcaccaacuuugaa

SEQ ID NO: 28056 - RNA, 17 nt, Homo sapiens
uguaaguuuaugcauac

SEQ ID NO: 28057 - RNA, 18 nt, Homo sapiens
cugcuggauucaagugau

SEQ ID NO: 28058 - RNA, 23 nt, Homo sapiens
aaauauuguugacaacugugacu

SEQ ID NO: 28059 - RNA, 15 nt, Homo sapiens
gcuuaaaauguaauu

SEQ ID NO: 28060 - RNA, 19 nt, Homo sapiens
caaacgaaaaacauuucaa

SEQ ID NO: 28061 - RNA, 20 nt, Homo sapiens
gaaaccuuauuguaccucuc

SEQ ID NO: 28062 - RNA, 13 nt, Homo sapiens
aaucugagccagu

SEQ ID NO: 28063 - RNA, 23 nt, Homo sapiens
uagaguucugucuggacuuucca

SEQ ID NO: 28064 - RNA, 16 nt, Homo sapiens
uuauuacaucuuucac

SEQ ID NO: 28065 - RNA, 16 nt, Homo sapiens
ggagaaucacuugaac

SEQ ID NO: 28066 - RNA, 19 nt, Homo sapiens
uuuguagccacuucacuuu

SEQ ID NO: 28067 - RNA, 15 nt, Homo sapiens
aagugcugggaauua

SEQ ID NO: 28068 - RNA, 22 nt, Homo sapiens
aauagaaggauguacauuucca

SEQ ID NO: 28069 - RNA, 16 nt, Homo sapiens
cagagaccaguauucc

SEQ ID NO: 28070 - RNA, 22 nt, Homo sapiens
agacuaugaggaauauuugcaa

SEQ ID NO: 28071 - RNA, 18 nt, Homo sapiens
ugggucucaguguccuca

SEQ ID NO: 28072 - RNA, 21 nt, Homo sapiens
aagggucucccucuguugcca

SEQ ID NO: 28073 - RNA, 17 nt, Homo sapiens
aaucuucagaccuagaa

SEQ ID NO: 28074 - RNA, 23 nt, Homo sapiens
gugauucccuccugcuacucugu

SEQ ID NO: 28075 - RNA, 21 nt, Homo sapiens
gagacaccaccacccuugcca

SEQ ID NO: 28076 - RNA, 20 nt, Homo sapiens
ccuggaucucacaagcacuu

SEQ ID NO: 28077 - RNA, 21 nt, Homo sapiens
uauguaaauagaaacguguau

SEQ ID NO: 28078 - RNA, 21 nt, Homo sapiens
accuguugauagcaagugaau

SEQ ID NO: 28079 - RNA, 21 nt, Homo sapiens
uucuucuuggucucaguguca

SEQ ID NO: 28080 - RNA, 20 nt, Homo sapiens
auauauguguuuuucacauu

SEQ ID NO: 28081 - RNA, 21 nt, Homo sapiens
gugguuauuuagggaacugcu

SEQ ID NO: 28082 - RNA, 16 nt, Homo sapiens
ugccccagggaccuuu

SEQ ID NO: 28083 - RNA, 10 nt, Homo sapiens
acgugcaaua

SEQ ID NO: 28084 - RNA, 15 nt, Homo sapiens
caucuguaaaaugga

SEQ ID NO: 28085 - RNA, 16 nt, Homo sapiens
ccuucauguacaucca

SEQ ID NO: 28086 - RNA, 14 nt, Homo sapiens
ccucuguugccaag

SEQ ID NO: 28087 - RNA, 21 nt, Homo sapiens
cagagacgggguuugccaugc

SEQ ID NO: 28088 - RNA, 19 nt, Homo sapiens
gaggcggguggaucacuug

SEQ ID NO: 28089 - RNA, 16 nt, Homo sapiens
ugagugccuguaauca

SEQ ID NO: 28090 - RNA, 21 nt, Homo sapiens
gaccacgcuuucuagcuguug

SEQ ID NO: 28091 - RNA, 14 nt, Homo sapiens
aagaaauucugcaa

SEQ ID NO: 28092 - RNA, 22 nt, Homo sapiens
cuauguucuaagaagugaaaau

SEQ ID NO: 28093 - RNA, 19 nt, Homo sapiens
cugucuggacuuuccagag

SEQ ID NO: 28094 - RNA, 14 nt, Homo sapiens
uuuaugauuccacc

SEQ ID NO: 28095 - RNA, 17 nt, Homo sapiens
gaacgguaaauuucugu

SEQ ID NO: 28096 - RNA, 18 nt, Homo sapiens
auaaaguguaaguucaca

SEQ ID NO: 28097 - RNA, 23 nt, Homo sapiens
aguuuuccuucucaucugugauu

SEQ ID NO: 28098 - RNA, 13 nt, Homo sapiens
cccaaaaggcaga

SEQ ID NO: 28099 - RNA, 16 nt, Homo sapiens
uuguaccgcaauguga

SEQ ID NO: 28100 - RNA, 13 nt, Homo sapiens
gcgcagccaugug

SEQ ID NO: 28101 - RNA, 22 nt, Homo sapiens
uccuagcgcagccaugugauua

SEQ ID NO: 28102 - RNA, 20 nt, Homo sapiens
uaaauggacaaaugcuuaug

SEQ ID NO: 28103 - RNA, 20 nt, Homo sapiens
acaugauccugcaauuccac

SEQ ID NO: 28104 - RNA, 14 nt, Homo sapiens
uggaacucaaggaa

SEQ ID NO: 28105 - RNA, 14 nt, Homo sapiens
uacaaggcuuuauc

SEQ ID NO: 28106 - RNA, 17 nt, Homo sapiens
caagugauccgcccauc

SEQ ID NO: 28107 - RNA, 11 nt, Homo sapiens
uuaaucaccaa

SEQ ID NO: 28108 - RNA, 17 nt, Homo sapiens
uggcgcgcgccaccacg

SEQ ID NO: 28109 - RNA, 22 nt, Homo sapiens
aaugacacuagcuaauaucaau

SEQ ID NO: 28110 - RNA, 19 nt, Homo sapiens
auuuucaaaaucaaauucc

SEQ ID NO: 28111 - RNA, 14 nt, Homo sapiens
aacauguucacuua

SEQ ID NO: 28112 - RNA, 12 nt, Homo sapiens
aaguacucauac

SEQ ID NO: 28113 - RNA, 20 nt, Homo sapiens
ucuggacuuuccagagacca

SEQ ID NO: 28114 - RNA, 18 nt, Homo sapiens
auuagccgggcauggugg

SEQ ID NO: 28115 - RNA, 21 nt, Homo sapiens
ccaacagaagcuuccauucca

SEQ ID NO: 28116 - RNA, 17 nt, Homo sapiens
uuguaacuuaugaaccu

SEQ ID NO: 28117 - RNA, 21 nt, Homo sapiens
agcacuuuaacacagugucug

SEQ ID NO: 28118 - RNA, 18 nt, Homo sapiens
guguuuuucacauuugcg

SEQ ID NO: 28119 - RNA, 12 nt, Homo sapiens
gacuugaaccca

SEQ ID NO: 28120 - RNA, 18 nt, Homo sapiens
aagccaucggagcugcua

SEQ ID NO: 28121 - RNA, 15 nt, Homo sapiens
ucucugccuugguau

SEQ ID NO: 28122 - RNA, 13 nt, Homo sapiens
ggagaaacuggaa

SEQ ID NO: 28123 - RNA, 20 nt, Homo sapiens
uccuuccuuaucacugacac

SEQ ID NO: 28124 - RNA, 15 nt, Homo sapiens
aagauuaugaucuca

SEQ ID NO: 28125 - RNA, 23 nt, Homo sapiens
auguuucgugaaguauacuguau

SEQ ID NO: 28126 - RNA, 16 nt, Homo sapiens
gugccuguaaucacag

SEQ ID NO: 28127 - RNA, 18 nt, Homo sapiens
gagcuugaaauagugucu

SEQ ID NO: 28128 - RNA, 18 nt, Homo sapiens
guaaguuuaugcauacag

SEQ ID NO: 28129 - RNA, 14 nt, Homo sapiens
ccaaggcuggagug

SEQ ID NO: 28130 - RNA, 14 nt, Homo sapiens
aacagaacuaugga

SEQ ID NO: 28131 - RNA, 19 nt, Homo sapiens
uugaaucccuuaaacucag

SEQ ID NO: 28132 - RNA, 15 nt, Homo sapiens
caaggcuuuaucuca

SEQ ID NO: 28133 - RNA, 15 nt, Homo sapiens
guggcauuuucacuu

SEQ ID NO: 28134 - RNA, 14 nt, Homo sapiens
ugagaagaaugacu

SEQ ID NO: 28135 - RNA, 17 nt, Homo sapiens
auugaaaggcauucucu

SEQ ID NO: 28136 - RNA, 21 nt, Homo sapiens
agaaaccuuauuguaccucuc

SEQ ID NO: 28137 - RNA, 13 nt, Homo sapiens
cccuuuuacauac

SEQ ID NO: 28138 - RNA, 17 nt, Homo sapiens
gaaaccuuauuguaccu

SEQ ID NO: 28139 - RNA, 17 nt, Homo sapiens
acaaaccucaagccagc

SEQ ID NO: 28140 - RNA, 16 nt, Homo sapiens
guaacuggcaguuuuc

SEQ ID NO: 28141 - RNA, 13 nt, Homo sapiens
cuaauuaggcaag

SEQ ID NO: 28142 - RNA, 20 nt, Homo sapiens
augaaaagauuaugaucuca

SEQ ID NO: 28143 - RNA, 16 nt, Homo sapiens
ucaugcaaaugcugua

SEQ ID NO: 28144 - RNA, 21 nt, Homo sapiens
gaacucaaggaaaucuguguc

SEQ ID NO: 28145 - RNA, 13 nt, Homo sapiens
ugagcgacaguga

SEQ ID NO: 28146 - RNA, 20 nt, Homo sapiens
gauacaaugaacacuuauaa

SEQ ID NO: 28147 - RNA, 22 nt, Homo sapiens
ugauucccuccugcuacucugu

SEQ ID NO: 28148 - RNA, 17 nt, Homo sapiens
gagguacugagagugaa

SEQ ID NO: 28149 - RNA, 17 nt, Homo sapiens
ugacaacugugacugua

SEQ ID NO: 28150 - RNA, 23 nt, Homo sapiens
auuuuuccccaaaaagaauggga

SEQ ID NO: 28151 - RNA, 14 nt, Homo sapiens
uggagacaccacca

SEQ ID NO: 28152 - RNA, 20 nt, Homo sapiens
cauuaaauauaauaugcaca

SEQ ID NO: 28153 - RNA, 16 nt, Homo sapiens
agcccauggcacucua

SEQ ID NO: 28154 - RNA, 14 nt, Homo sapiens
accaguauucccuu

SEQ ID NO: 28155 - RNA, 15 nt, Homo sapiens
ucagggagcauuuau

SEQ ID NO: 28156 - RNA, 16 nt, Homo sapiens
uccccaaccacuucau

SEQ ID NO: 28157 - RNA, 19 nt, Homo sapiens
guuuuccuucucaucugug

SEQ ID NO: 28158 - RNA, 22 nt, Homo sapiens
gauagagugggacaguuccuga

SEQ ID NO: 28159 - RNA, 22 nt, Homo sapiens
auaagugaagugauacuaucca

SEQ ID NO: 28160 - RNA, 17 nt, Homo sapiens
uaaaguacagacuuuuu

SEQ ID NO: 28161 - RNA, 15 nt, Homo sapiens
acauagcaucucagg

SEQ ID NO: 28162 - RNA, 17 nt, Homo sapiens
auccaaagcugaauaca

SEQ ID NO: 28163 - RNA, 22 nt, Homo sapiens
gaaagaaaaucaggcuggccaa

SEQ ID NO: 28164 - RNA, 20 nt, Homo sapiens
ggaggcagagguugcaguga

SEQ ID NO: 28165 - RNA, 14 nt, Homo sapiens
ugauuuuacaauug

SEQ ID NO: 28166 - RNA, 14 nt, Homo sapiens
uuccacuacugcua

SEQ ID NO: 28167 - RNA, 23 nt, Homo sapiens
auaguguuggaaaaugugcaaua

SEQ ID NO: 28168 - RNA, 13 nt, Homo sapiens
ccuuuuacauacu

SEQ ID NO: 28169 - RNA, 21 nt, Homo sapiens
guuuucccugaccucccucua

SEQ ID NO: 28170 - RNA, 16 nt, Homo sapiens
cuggagugcaguggcg

SEQ ID NO: 28171 - RNA, 23 nt, Homo sapiens
uguauuuuauuacaucuuucaca

SEQ ID NO: 28172 - RNA, 23 nt, Homo sapiens
cacuccagccugagcgacaguga

SEQ ID NO: 28173 - RNA, 17 nt, Homo sapiens
uuuaaugggcacagggu

SEQ ID NO: 28174 - RNA, 19 nt, Homo sapiens
uuaaaauuaucaauaucua

SEQ ID NO: 28175 - RNA, 19 nt, Homo sapiens
acuuuaacacagugucugg

SEQ ID NO: 28176 - RNA, 17 nt, Homo sapiens
agaaggauguacauuuc

SEQ ID NO: 28177 - RNA, 18 nt, Homo sapiens
uacauuuccaaauucaca

SEQ ID NO: 28178 - RNA, 17 nt, Homo sapiens
ccaugugauuacccucu

SEQ ID NO: 28179 - RNA, 16 nt, Homo sapiens
ugaaacauuacaguua

SEQ ID NO: 28180 - RNA, 19 nt, Homo sapiens
acauaagcaaagacuauga

SEQ ID NO: 28181 - RNA, 19 nt, Homo sapiens
acaaauuuacagagacaga

SEQ ID NO: 28182 - RNA, 21 nt, Homo sapiens
auauuugaauuuuaaaucuaa

SEQ ID NO: 28183 - RNA, 17 nt, Homo sapiens
uuauuuuuuuacuuccu

SEQ ID NO: 28184 - RNA, 16 nt, Homo sapiens
gcugaggcaagagaau

SEQ ID NO: 28185 - RNA, 21 nt, Homo sapiens
auaccucaacccccauuucua

SEQ ID NO: 28186 - RNA, 13 nt, Homo sapiens
aagaaauucugca

SEQ ID NO: 28187 - RNA, 19 nt, Homo sapiens
gcuguuuuuauauauguga

SEQ ID NO: 28188 - RNA, 23 nt, Homo sapiens
aaucugaggccuccucucucagu

SEQ ID NO: 28189 - RNA, 15 nt, Homo sapiens
uuuuaaguaauuuca

SEQ ID NO: 28190 - RNA, 14 nt, Homo sapiens
cuguuccuucacau

SEQ ID NO: 28191 - RNA, 17 nt, Homo sapiens
cuaaccagccuggucaa

SEQ ID NO: 28192 - RNA, 17 nt, Homo sapiens
aauucuuacauguuuuc

SEQ ID NO: 28193 - RNA, 17 nt, Homo sapiens
aaauauaauaugcacac

SEQ ID NO: 28194 - RNA, 20 nt, Homo sapiens
uugacacuuaaaaaugguuu

SEQ ID NO: 28195 - RNA, 22 nt, Homo sapiens
aauuuucaaaaucaaauuccag

SEQ ID NO: 28196 - RNA, 18 nt, Homo sapiens
cagaaagcagaacaguga

SEQ ID NO: 28197 - RNA, 13 nt, Homo sapiens
gaaauaagccaga

SEQ ID NO: 28198 - RNA, 19 nt, Homo sapiens
caaccugggggcuuuaggg

SEQ ID NO: 28199 - RNA, 16 nt, Homo sapiens
uguaaaauggagacac

SEQ ID NO: 28200 - RNA, 18 nt, Homo sapiens
cuaauagaauuaauggaa

SEQ ID NO: 28201 - RNA, 15 nt, Homo sapiens
gagguuaagcacuuu

SEQ ID NO: 28202 - RNA, 22 nt, Homo sapiens
augaaaagauuaugaucucaga

SEQ ID NO: 28203 - RNA, 19 nt, Homo sapiens
augggagaaucacuugaac

SEQ ID NO: 28204 - RNA, 23 nt, Homo sapiens
aauaaaagauuguauagugcaug

SEQ ID NO: 28205 - RNA, 19 nt, Homo sapiens
auacaauuauuuuuacagu

SEQ ID NO: 28206 - RNA, 18 nt, Homo sapiens
ucucgaacugcuggauuc

SEQ ID NO: 28207 - RNA, 15 nt, Homo sapiens
aagcagaacagugau

SEQ ID NO: 28208 - RNA, 17 nt, Homo sapiens
acuuaaaaucuaauuca

SEQ ID NO: 28209 - RNA, 21 nt, Homo sapiens
aaaaaugguuuaaauggucaa

SEQ ID NO: 28210 - RNA, 19 nt, Homo sapiens
ugaacaaauuuacagagac

SEQ ID NO: 28211 - RNA, 12 nt, Homo sapiens
uaaaagcacuua

SEQ ID NO: 28212 - RNA, 13 nt, Homo sapiens
auaaaagcacuua

SEQ ID NO: 28213 - RNA, 14 nt, Homo sapiens
aagccucaugucca

SEQ ID NO: 28214 - RNA, 13 nt, Homo sapiens
cauagagacuuug

SEQ ID NO: 28215 - RNA, 20 nt, Homo sapiens
augguggcgcgcaccuguaa

SEQ ID NO: 28216 - RNA, 15 nt, Homo sapiens
cugguaacauagguu

SEQ ID NO: 28217 - RNA, 15 nt, Homo sapiens
agagaaaagacauaa

SEQ ID NO: 28218 - RNA, 22 nt, Homo sapiens
accagccuggucaacaugguga

SEQ ID NO: 28219 - RNA, 18 nt, Homo sapiens
ccaagaaugagaagaaug

SEQ ID NO: 28220 - RNA, 20 nt, Homo sapiens
ggccuccucucucaguuuuu

SEQ ID NO: 28221 - RNA, 14 nt, Homo sapiens
gaaagaggaaugaa

SEQ ID NO: 28222 - RNA, 12 nt, Homo sapiens
auauuagcuuua

SEQ ID NO: 28223 - RNA, 15 nt, Homo sapiens
uucuauuuauuuacu

SEQ ID NO: 28224 - RNA, 15 nt, Homo sapiens
cgugagccaccaaac

SEQ ID NO: 28225 - RNA, 15 nt, Homo sapiens
agcaugggaagugac

SEQ ID NO: 28226 - RNA, 22 nt, Homo sapiens
auguucacuuauugacuauuau

SEQ ID NO: 28227 - RNA, 13 nt, Homo sapiens
ccugcaauuccac

SEQ ID NO: 28228 - RNA, 23 nt, Homo sapiens
auaauagguuugugacuuuccua

SEQ ID NO: 28229 - RNA, 20 nt, Homo sapiens
ugcacuccagccugagcgac

SEQ ID NO: 28230 - RNA, 23 nt, Homo sapiens
uaugcaaccuuuggaugcacuuu

SEQ ID NO: 28231 - RNA, 18 nt, Homo sapiens
uuuuaugaaacauuacag

SEQ ID NO: 28232 - RNA, 19 nt, Homo sapiens
ugagagacagcaggucuca

SEQ ID NO: 28233 - RNA, 16 nt, Homo sapiens
aucucacaagcacuuu

SEQ ID NO: 28234 - RNA, 13 nt, Homo sapiens
aaucugcacugug

SEQ ID NO: 28235 - RNA, 19 nt, Homo sapiens
cagugagccgagauugugc

SEQ ID NO: 28236 - RNA, 17 nt, Homo sapiens
uguagccacuucacuuu

SEQ ID NO: 28237 - RNA, 14 nt, Homo sapiens
uggucacauacaau

SEQ ID NO: 28238 - RNA, 14 nt, Homo sapiens
gcagcuuauucaca

SEQ ID NO: 28239 - RNA, 17 nt, Homo sapiens
uagugucugaugaaugu

SEQ ID NO: 28240 - RNA, 22 nt, Homo sapiens
aauaguguuggaaaaugugcaa

SEQ ID NO: 28241 - RNA, 23 nt, Homo sapiens
uuacuauuuauugcugaaugacu

SEQ ID NO: 28242 - RNA, 17 nt, Homo sapiens
uuccucaaaacuucaga

SEQ ID NO: 28243 - RNA, 16 nt, Homo sapiens
aauugacccacaagaa

SEQ ID NO: 28244 - RNA, 14 nt, Homo sapiens
auuucacuugauga

SEQ ID NO: 28245 - RNA, 15 nt, Homo sapiens
acagucacauuccaa

SEQ ID NO: 28246 - RNA, 21 nt, Homo sapiens
acgccuguaaucccagcacuu

SEQ ID NO: 28247 - RNA, 14 nt, Homo sapiens
ggccaacuaggcag

SEQ ID NO: 28248 - RNA, 21 nt, Homo sapiens
ucuagcaaauguuaugcauaa

SEQ ID NO: 28249 - RNA, 16 nt, Homo sapiens
uuuauaaauggacaaa

SEQ ID NO: 28250 - RNA, 20 nt, Homo sapiens
gaacugcuggauucaaguga

SEQ ID NO: 28251 - RNA, 19 nt, Homo sapiens
ccaaguuuauauacaauua

SEQ ID NO: 28252 - RNA, 16 nt, Homo sapiens
uuccuauguaacugca

SEQ ID NO: 28253 - RNA, 23 nt, Homo sapiens
aaauucgcugcaaccuguugaua

SEQ ID NO: 28254 - RNA, 23 nt, Homo sapiens
acuccagccugagcgacagugag

SEQ ID NO: 28255 - RNA, 18 nt, Homo sapiens
guuugaaaauaugccugc

SEQ ID NO: 28256 - RNA, 20 nt, Homo sapiens
gaggcagagguugcagugag

SEQ ID NO: 28257 - RNA, 21 nt, Homo sapiens
uuuaacuagaauuuauucaau

SEQ ID NO: 28258 - RNA, 20 nt, Homo sapiens
gcuaaguugcaccaacuuug

SEQ ID NO: 28259 - RNA, 20 nt, Homo sapiens
uaaauguaucuuauucacau

SEQ ID NO: 28260 - RNA, 18 nt, Homo sapiens
ccugaugaaaacauagca

SEQ ID NO: 28261 - RNA, 13 nt, Homo sapiens
ucuucacagucac

SEQ ID NO: 28262 - RNA, 19 nt, Homo sapiens
aauauuuuuaugugcaaua

SEQ ID NO: 28263 - RNA, 17 nt, Homo sapiens
uagagacuuugugaaaa

SEQ ID NO: 28264 - RNA, 15 nt, Homo sapiens
ugugauuacaaggcu

SEQ ID NO: 28265 - RNA, 21 nt, Homo sapiens
ccugucccugcagacaugaga

SEQ ID NO: 28266 - RNA, 18 nt, Homo sapiens
acacuaaaaaggcaugua

SEQ ID NO: 28267 - RNA, 16 nt, Homo sapiens
aaguugcaccaacuuu

SEQ ID NO: 28268 - RNA, 18 nt, Homo sapiens
caggauagagugggacag

SEQ ID NO: 28269 - RNA, 13 nt, Homo sapiens
gaaaaacauuuca

SEQ ID NO: 28270 - RNA, 17 nt, Homo sapiens
augaaguacucauacau

SEQ ID NO: 28271 - RNA, 19 nt, Homo sapiens
uuccaggaaaaucugcacu

SEQ ID NO: 28272 - RNA, 18 nt, Homo sapiens
auucccuuuugcugccuc

SEQ ID NO: 28273 - RNA, 22 nt, Homo sapiens
aauauuguugacaacugugacu

SEQ ID NO: 28274 - RNA, 19 nt, Homo sapiens
accuguuuuuaagcuguuu

SEQ ID NO: 28275 - RNA, 13 nt, Homo sapiens
ugcagacaugaga

SEQ ID NO: 28276 - RNA, 22 nt, Homo sapiens
cugcauacucauuaggauggcu

SEQ ID NO: 28277 - RNA, 19 nt, Homo sapiens
acacuaaaaaggcauguaa

SEQ ID NO: 28278 - RNA, 13 nt, Homo sapiens
cuuugaagucuga

SEQ ID NO: 28279 - RNA, 21 nt, Homo sapiens
uggcuaagcaaaaugugauau

SEQ ID NO: 28280 - RNA, 23 nt, Homo sapiens
aucuuguuuuuccacuacugcua

SEQ ID NO: 28281 - RNA, 19 nt, Homo sapiens
ccuuuggaugcacuuuaua

SEQ ID NO: 28282 - RNA, 16 nt, Homo sapiens
uauuacaucuuucaca

SEQ ID NO: 28283 - RNA, 16 nt, Homo sapiens
uuguuuuuaaacugga

SEQ ID NO: 28284 - RNA, 21 nt, Homo sapiens
ugaggcggguggaucacuuga

SEQ ID NO: 28285 - RNA, 18 nt, Homo sapiens
uuauaauuccuauauccu

SEQ ID NO: 28286 - RNA, 19 nt, Homo sapiens
agagacagcaggucucaug

SEQ ID NO: 28287 - RNA, 22 nt, Homo sapiens
gaaguacucauacauguuacaa

SEQ ID NO: 28288 - RNA, 21 nt, Homo sapiens
gagccaccaaacccggccuga

SEQ ID NO: 28289 - RNA, 15 nt, Homo sapiens
agacgggguuugcca

SEQ ID NO: 28290 - RNA, 23 nt, Homo sapiens
ugaaauaagccagacaucaacag

SEQ ID NO: 28291 - RNA, 17 nt, Homo sapiens
gaucucacaagcacuuu

SEQ ID NO: 28292 - RNA, 20 nt, Homo sapiens
agugaaaaucuacacuccag

SEQ ID NO: 28293 - RNA, 23 nt, Homo sapiens
auuucaaaacucauuuccuaugu

SEQ ID NO: 28294 - RNA, 22 nt, Homo sapiens
cuuuaauuucaugaaaagauua

SEQ ID NO: 28295 - RNA, 12 nt, Homo sapiens
uuauuaccucug

SEQ ID NO: 28296 - RNA, 16 nt, Homo sapiens
gagacucugucucagu

SEQ ID NO: 28297 - RNA, 15 nt, Homo sapiens
uugcaccaacuuuga

SEQ ID NO: 28298 - RNA, 17 nt, Homo sapiens
caucuuggucacauaca

SEQ ID NO: 28299 - RNA, 15 nt, Homo sapiens
aaauggagugacuua

SEQ ID NO: 28300 - RNA, 16 nt, Homo sapiens
guaccgcaaugugacu

SEQ ID NO: 28301 - RNA, 23 nt, Homo sapiens
aaacugauacccuuugaaaaagu

SEQ ID NO: 28302 - RNA, 18 nt, Homo sapiens
augcuuguauuuuacuuu

SEQ ID NO: 28303 - RNA, 14 nt, Homo sapiens
auggagugacuuag

SEQ ID NO: 28304 - RNA, 16 nt, Homo sapiens
uuuauuaccucugaua

SEQ ID NO: 28305 - RNA, 14 nt, Homo sapiens
auuugagacaggga

SEQ ID NO: 28306 - RNA, 19 nt, Homo sapiens
uggaucucacaagcacuuu

SEQ ID NO: 28307 - RNA, 15 nt, Homo sapiens
gaauuaacacaugau

SEQ ID NO: 28308 - RNA, 18 nt, Homo sapiens
cuucuggguucaagcgau

SEQ ID NO: 28309 - RNA, 16 nt, Homo sapiens
agaagaaugacuaugc

SEQ ID NO: 28310 - RNA, 15 nt, Homo sapiens
cuuugaagucugauu

SEQ ID NO: 28311 - RNA, 13 nt, Homo sapiens
aauuuucuuccaa

SEQ ID NO: 28312 - RNA, 12 nt, Homo sapiens
gaaaauaugccu

SEQ ID NO: 28313 - RNA, 19 nt, Homo sapiens
uguaaucacagcuacuugg

SEQ ID NO: 28314 - RNA, 13 nt, Homo sapiens
gacaacugugacu

SEQ ID NO: 28315 - RNA, 20 nt, Homo sapiens
cugcauugagaacugcauau

SEQ ID NO: 28316 - RNA, 22 nt, Homo sapiens
cugaggcaagagaauugcuuga

SEQ ID NO: 28317 - RNA, 14 nt, Homo sapiens
ucucaucugugauu

SEQ ID NO: 28318 - RNA, 16 nt, Homo sapiens
gaggagaaacuggaac

SEQ ID NO: 28319 - RNA, 15 nt, Homo sapiens
guuuuuaagcuguuu

SEQ ID NO: 28320 - RNA, 14 nt, Homo sapiens
gggucucagugucc

SEQ ID NO: 28321 - RNA, 13 nt, Homo sapiens
cuugaugauacaa

SEQ ID NO: 28322 - RNA, 16 nt, Homo sapiens
uaagcaaagacuauga

SEQ ID NO: 28323 - RNA, 14 nt, Homo sapiens
acugcauacaaucu

SEQ ID NO: 28324 - RNA, 18 nt, Homo sapiens
ccacugcagaagacagua

SEQ ID NO: 28325 - RNA, 13 nt, Homo sapiens
uguuuuuaagcug

SEQ ID NO: 28326 - RNA, 20 nt, Homo sapiens
gaaaaucuacacuccaguga

SEQ ID NO: 28327 - RNA, 16 nt, Homo sapiens
gaguggguuucacaag

SEQ ID NO: 28328 - RNA, 18 nt, Homo sapiens
cagccaggcggcuggaau

SEQ ID NO: 28329 - RNA, 21 nt, Homo sapiens
accagcccuacaccauuccuu

SEQ ID NO: 28330 - RNA, 14 nt, Homo sapiens
ccucaugcugccaa

SEQ ID NO: 28331 - RNA, 13 nt, Homo sapiens
cagcuuauucaca

SEQ ID NO: 28332 - RNA, 13 nt, Homo sapiens
cuuaugaaccuuu

SEQ ID NO: 28333 - RNA, 23 nt, Homo sapiens
agauuaagagauggguuugacaa

SEQ ID NO: 28334 - RNA, 22 nt, Homo sapiens
aagucuuccauagagacuuugu

SEQ ID NO: 28335 - RNA, 16 nt, Homo sapiens
ucugcuuuaauuucau

SEQ ID NO: 28336 - RNA, 21 nt, Homo sapiens
uguaaugaaaaugaauaucua

SEQ ID NO: 28337 - RNA, 18 nt, Homo sapiens
cagugucuggcacuuggg

SEQ ID NO: 28338 - RNA, 23 nt, Homo sapiens
gagaaaccagggagccccuuuga

SEQ ID NO: 28339 - RNA, 20 nt, Homo sapiens
aguuuucugcuuuaauuuca

SEQ ID NO: 28340 - RNA, 15 nt, Homo sapiens
aucucacaagcacuu

SEQ ID NO: 28341 - RNA, 15 nt, Homo sapiens
cuggggccuguugaa

SEQ ID NO: 28342 - RNA, 22 nt, Homo sapiens
uucucugccuugguauagcaua

SEQ ID NO: 28343 - RNA, 17 nt, Homo sapiens
ugcuggauucaagugau

SEQ ID NO: 28344 - RNA, 17 nt, Homo sapiens
augugauauguaccuaa

SEQ ID NO: 28345 - RNA, 18 nt, Homo sapiens
auuuaaaaaaaaaccuga

SEQ ID NO: 28346 - RNA, 14 nt, Homo sapiens
ucauacauguuaca

SEQ ID NO: 28347 - RNA, 16 nt, Homo sapiens
agaauucuuacauguu

SEQ ID NO: 28348 - RNA, 17 nt, Homo sapiens
uaugauuccaccuacau

SEQ ID NO: 28349 - RNA, 19 nt, Homo sapiens
accaccacccuugccaugg

SEQ ID NO: 28350 - RNA, 10 nt, Homo sapiens
augugcaaua

SEQ ID NO: 28351 - RNA, 15 nt, Homo sapiens
gacaguuuucugcuu

SEQ ID NO: 28352 - RNA, 19 nt, Homo sapiens
cugccuugguauagcauau

SEQ ID NO: 28353 - RNA, 15 nt, Homo sapiens
aaccucauuccccaa

SEQ ID NO: 28354 - RNA, 16 nt, Homo sapiens
gacaacugugacugua

SEQ ID NO: 28355 - RNA, 20 nt, Homo sapiens
ucugggcuuggggcuuccua

SEQ ID NO: 28356 - RNA, 22 nt, Homo sapiens
ucccauggguuguguguuuauu

SEQ ID NO: 28357 - RNA, 22 nt, Homo sapiens
auaacuaggcguggacuuacua

SEQ ID NO: 28358 - RNA, 20 nt, Homo sapiens
gugcugggaauuacaggcgu

SEQ ID NO: 28359 - RNA, 15 nt, Homo sapiens
agcccauggcacucu

SEQ ID NO: 28360 - RNA, 14 nt, Homo sapiens
uuaacacagugucu

SEQ ID NO: 28361 - RNA, 21 nt, Homo sapiens
uuucaccuguuuuuaagcugu

SEQ ID NO: 28362 - RNA, 16 nt, Homo sapiens
gagauuucaugccugg

SEQ ID NO: 28363 - RNA, 18 nt, Homo sapiens
cuucucuucacagucaca

SEQ ID NO: 28364 - RNA, 23 nt, Homo sapiens
cuauuauagaauggaacucaagg

SEQ ID NO: 28365 - RNA, 15 nt, Homo sapiens
aguguaaguucacaa

SEQ ID NO: 28366 - RNA, 20 nt, Homo sapiens
gugaaauaaaaguagaauaa

SEQ ID NO: 28367 - RNA, 21 nt, Homo sapiens
uuguguguuuauuucacuuga

SEQ ID NO: 28368 - RNA, 20 nt, Homo sapiens
uccguggcacugcauacaau

SEQ ID NO: 28369 - RNA, 21 nt, Homo sapiens
aagcaaagacuaugaggaaua

SEQ ID NO: 28370 - RNA, 23 nt, Homo sapiens
acaccgaguggcccuucauguac

SEQ ID NO: 28371 - RNA, 13 nt, Homo sapiens
agcaaaaugugau

SEQ ID NO: 28372 - RNA, 22 nt, Homo sapiens
uacaauuauuuuuacaguucuc

SEQ ID NO: 28373 - RNA, 14 nt, Homo sapiens
uguaauugcuuguu

SEQ ID NO: 28374 - RNA, 22 nt, Homo sapiens
cuuuuggcuuguaaaguacaga

SEQ ID NO: 28375 - RNA, 22 nt, Homo sapiens
gagaaaccuuauuguaccucuc

SEQ ID NO: 28376 - RNA, 17 nt, Homo sapiens
acagagaaaagacauaa

SEQ ID NO: 28377 - RNA, 15 nt, Homo sapiens
uaaugaaaaugaaua

SEQ ID NO: 28378 - RNA, 14 nt, Homo sapiens
uguauagugcaugu

SEQ ID NO: 28379 - RNA, 20 nt, Homo sapiens
uccuagcgcagccaugugau

SEQ ID NO: 28380 - RNA, 18 nt, Homo sapiens
uuuguuauuuuuccccaa

SEQ ID NO: 28381 - RNA, 19 nt, Homo sapiens
aauuauuuuuacaguucuc

SEQ ID NO: 28382 - RNA, 24 nt, Homo sapiens
aucuuguuuuuccacuacugcuac

SEQ ID NO: 28383 - RNA, 17 nt, Homo sapiens
uacaauugaaaugacua

SEQ ID NO: 28384 - RNA, 16 nt, Homo sapiens
uucagccugaaagagg

SEQ ID NO: 28385 - RNA, 15 nt, Homo sapiens
acagaggaucugcuu

SEQ ID NO: 28386 - RNA, 14 nt, Homo sapiens
agaaucacuugaac

SEQ ID NO: 28387 - RNA, 18 nt, Homo sapiens
ugucuucauagcagauuu

SEQ ID NO: 28388 - RNA, 14 nt, Homo sapiens
uccacuacugcuac

SEQ ID NO: 28389 - RNA, 21 nt, Homo sapiens
aauuuuucucuaacucagaaa

SEQ ID NO: 28390 - RNA, 23 nt, Homo sapiens
caaacaaacgaaaaacauuucaa

SEQ ID NO: 28391 - RNA, 20 nt, Homo sapiens
aguaauuuuaaguaauuuca

SEQ ID NO: 28392 - RNA, 22 nt, Homo sapiens
uaauggaauauguaaauagaaa

SEQ ID NO: 28393 - RNA, 14 nt, Homo sapiens
ucaugcauuugcac

SEQ ID NO: 28394 - RNA, 17 nt, Homo sapiens
uagagaaauuugccaau

SEQ ID NO: 28395 - RNA, 15 nt, Homo sapiens
uggaacucaaggaaa

SEQ ID NO: 28396 - RNA, 22 nt, Homo sapiens
aagcagggacuugaacccauau

SEQ ID NO: 28397 - RNA, 13 nt, Homo sapiens
acagaacuaugga

SEQ ID NO: 28398 - RNA, 14 nt, Homo sapiens
ggcacuugggacaa

SEQ ID NO: 28399 - RNA, 20 nt, Homo sapiens
ggucaauuuuguuauguaua

SEQ ID NO: 28400 - RNA, 20 nt, Homo sapiens
caaccaaauggagugacuua

SEQ ID NO: 28401 - RNA, 14 nt, Homo sapiens
auauaauaugcaca

SEQ ID NO: 28402 - RNA, 16 nt, Homo sapiens
gaaaauaaaagcacuu

SEQ ID NO: 28403 - RNA, 20 nt, Homo sapiens
ugcugggaauuacaggcgug

SEQ ID NO: 28404 - RNA, 12 nt, Homo sapiens
uacaucuuucac

SEQ ID NO: 28405 - RNA, 15 nt, Homo sapiens
ugcagcugugccaua

SEQ ID NO: 28406 - RNA, 13 nt, Homo sapiens
cagggacuugaac

SEQ ID NO: 28407 - RNA, 17 nt, Homo sapiens
aguuuauauacaauuau

SEQ ID NO: 28408 - RNA, 17 nt, Homo sapiens
ccuuuuacauacugcug

SEQ ID NO: 28409 - RNA, 16 nt, Homo sapiens
uggcacuugggacaaa

SEQ ID NO: 28410 - RNA, 19 nt, Homo sapiens
caaucuuaacucauugcaa

SEQ ID NO: 28411 - RNA, 23 nt, Homo sapiens
agaaauuccaggaaaaucugcac

SEQ ID NO: 28412 - RNA, 20 nt, Homo sapiens
gcuguuuccauagggugaca

SEQ ID NO: 28413 - RNA, 15 nt, Homo sapiens
agaauuaacacauga

SEQ ID NO: 28414 - RNA, 16 nt, Homo sapiens
cacagaggaucugcuu

SEQ ID NO: 28415 - RNA, 17 nt, Homo sapiens
ugccaugcuggccaggc

SEQ ID NO: 28416 - RNA, 15 nt, Homo sapiens
aacauagcaucucag

SEQ ID NO: 28417 - RNA, 19 nt, Homo sapiens
uugaugauuaauucaccuu

SEQ ID NO: 28418 - RNA, 17 nt, Homo sapiens
aaaucaaauuccagaau

SEQ ID NO: 28419 - RNA, 22 nt, Homo sapiens
ggaauauuugcaagacauagaa

SEQ ID NO: 28420 - RNA, 15 nt, Homo sapiens
ucaucaaucaaauaa

SEQ ID NO: 28421 - RNA, 21 nt, Homo sapiens
uugccaaggcuggagugcagu

SEQ ID NO: 28422 - RNA, 22 nt, Homo sapiens
gaccuuuguagccacuucacuu

SEQ ID NO: 28423 - RNA, 17 nt, Homo sapiens
uccuguacuuuuuccag

SEQ ID NO: 28424 - RNA, 22 nt, Homo sapiens
agaaauuccaggaaaaucugca

SEQ ID NO: 28425 - RNA, 16 nt, Homo sapiens
ugucucaguccaugaa

SEQ ID NO: 28426 - RNA, 19 nt, Homo sapiens
uguuggaaaaugugcaaua

SEQ ID NO: 28427 - RNA, 16 nt, Homo sapiens
ccucucuuauagaaua

SEQ ID NO: 28428 - RNA, 22 nt, Homo sapiens
gugugaccacugcagaagacag

SEQ ID NO: 28429 - RNA, 20 nt, Homo sapiens
uccagccugagcgacaguga

SEQ ID NO: 28430 - RNA, 21 nt, Homo sapiens
uuguguaaugaaaaugaauau

SEQ ID NO: 28431 - RNA, 15 nt, Homo sapiens
aacccaaauguucau

SEQ ID NO: 28432 - RNA, 15 nt, Homo sapiens
gauuacccucugggu

SEQ ID NO: 28433 - RNA, 17 nt, Homo sapiens
aaauagugucugaugaa

SEQ ID NO: 28434 - RNA, 22 nt, Homo sapiens
agcaagaucccauggguugugu

SEQ ID NO: 28435 - RNA, 13 nt, Homo sapiens
gcacucuauguuc

SEQ ID NO: 28436 - RNA, 20 nt, Homo sapiens
cagagcaagacucugucuca

SEQ ID NO: 28437 - RNA, 23 nt, Homo sapiens
uauaagugaagugauacuaucca

SEQ ID NO: 28438 - RNA, 17 nt, Homo sapiens
auaugccugcaaucuga

SEQ ID NO: 28439 - RNA, 22 nt, Homo sapiens
auuacaaggcuuuaucucaggg

SEQ ID NO: 28440 - RNA, 15 nt, Homo sapiens
uagaauuaauggaau

SEQ ID NO: 28441 - RNA, 14 nt, Homo sapiens
ugaaugugucaggu

SEQ ID NO: 28442 - RNA, 14 nt, Homo sapiens
ggcuuuuauugcca

SEQ ID NO: 28443 - RNA, 10 nt, Homo sapiens
aggcugcaaa

SEQ ID NO: 28444 - RNA, 12 nt, Homo sapiens
uacauacugcug

SEQ ID NO: 28445 - RNA, 15 nt, Homo sapiens
cuauuacgugcaaua

SEQ ID NO: 28446 - RNA, 22 nt, Homo sapiens
auguugaaaaaguucugcagau

SEQ ID NO: 28447 - RNA, 13 nt, Homo sapiens
uccacuacugcua

SEQ ID NO: 28448 - RNA, 18 nt, Homo sapiens
aguugauuuuacaauuga

SEQ ID NO: 28449 - RNA, 21 nt, Homo sapiens
gauagguuaccaguaacggaa

SEQ ID NO: 28450 - RNA, 18 nt, Homo sapiens
cucugucucaguccauga

SEQ ID NO: 28451 - RNA, 17 nt, Homo sapiens
aaagcauuguaacuuau

SEQ ID NO: 28452 - RNA, 16 nt, Homo sapiens
uuaugcauaaagucag

SEQ ID NO: 28453 - RNA, 23 nt, Homo sapiens
ugaaaaucuacacuccagugaga

SEQ ID NO: 28454 - RNA, 20 nt, Homo sapiens
ucccuuuuacauacugcugu

SEQ ID NO: 28455 - RNA, 17 nt, Homo sapiens
gguggcucacgccugua

SEQ ID NO: 28456 - RNA, 21 nt, Homo sapiens
agacccucaugcugccaauau

SEQ ID NO: 28457 - RNA, 21 nt, Homo sapiens
cuucuuggucucagugucaau

SEQ ID NO: 28458 - RNA, 22 nt, Homo sapiens
agcuugaaauagugucugauga

SEQ ID NO: 28459 - RNA, 15 nt, Homo sapiens
cucaguguccucauc

SEQ ID NO: 28460 - RNA, 13 nt, Homo sapiens
augauccugcaau

SEQ ID NO: 28461 - RNA, 12 nt, Homo sapiens
acagaacuugaa

SEQ ID NO: 28462 - RNA, 21 nt, Homo sapiens
cuuagacccucaugcugccaa

SEQ ID NO: 28463 - RNA, 16 nt, Homo sapiens
agaguggguuucacaa

SEQ ID NO: 28464 - RNA, 21 nt, Homo sapiens
agaguucugucuggacuuucc

SEQ ID NO: 28465 - RNA, 23 nt, Homo sapiens
caagccagccuugcuccuggcug

SEQ ID NO: 28466 - RNA, 15 nt, Homo sapiens
aguucugucuggacu

SEQ ID NO: 28467 - RNA, 16 nt, Homo sapiens
cugucuggacuuucca

SEQ ID NO: 28468 - RNA, 23 nt, Homo sapiens
cuuguuuuuccacuacugcuacc

SEQ ID NO: 28469 - RNA, 23 nt, Homo sapiens
acucauugcaaccuccaccuucu

SEQ ID NO: 28470 - RNA, 15 nt, Homo sapiens
ucacuuaauccuuug

SEQ ID NO: 28471 - RNA, 18 nt, Homo sapiens
uguuacugccuaucagca

SEQ ID NO: 28472 - RNA, 19 nt, Homo sapiens
cacuuugggaggcugaggc

SEQ ID NO: 28473 - RNA, 13 nt, Homo sapiens
auuuucacuuuug

SEQ ID NO: 28474 - RNA, 12 nt, Homo sapiens
auugagcaccug

SEQ ID NO: 28475 - RNA, 22 nt, Homo sapiens
cucugaagaguggguuucacaa

SEQ ID NO: 28476 - RNA, 14 nt, Homo sapiens
aguugauuuuacaa

SEQ ID NO: 28477 - RNA, 17 nt, Homo sapiens
agaaucagaucauuuca

SEQ ID NO: 28478 - RNA, 12 nt, Homo sapiens
uuauaaucuuuu

SEQ ID NO: 28479 - RNA, 17 nt, Homo sapiens
caaguuguguuugauau

SEQ ID NO: 28480 - RNA, 15 nt, Homo sapiens
auacuauccaguuac

SEQ ID NO: 28481 - RNA, 15 nt, Homo sapiens
ggcuuuaucucaggg

SEQ ID NO: 28482 - RNA, 17 nt, Homo sapiens
aaagcagggacuugaac

SEQ ID NO: 28483 - RNA, 14 nt, Homo sapiens
caguccucuuucaa

SEQ ID NO: 28484 - RNA, 13 nt, Homo sapiens
uuuaugugcaaua

SEQ ID NO: 28485 - RNA, 23 nt, Homo sapiens
acuaauuaggcaaggcuauguga

SEQ ID NO: 28486 - RNA, 16 nt, Homo sapiens
acuauccaguuacugc

SEQ ID NO: 28487 - RNA, 21 nt, Homo sapiens
cuggauguggagggggcgcgu

SEQ ID NO: 28488 - RNA, 13 nt, Homo sapiens
agguuaagcacuu

SEQ ID NO: 28489 - RNA, 19 nt, Homo sapiens
auuacaaggcuuuaucuca

SEQ ID NO: 28490 - RNA, 14 nt, Homo sapiens
uggaaaaugugcaa

SEQ ID NO: 28491 - RNA, 12 nt, Homo sapiens
gugucaggugac

SEQ ID NO: 28492 - RNA, 19 nt, Homo sapiens
uucaaaaucaaauuccaga

SEQ ID NO: 28493 - RNA, 14 nt, Homo sapiens
cuuaaacacuaaaa

SEQ ID NO: 28494 - RNA, 23 nt, Homo sapiens
ucagaaauuuaauucauguuucu

SEQ ID NO: 28495 - RNA, 16 nt, Homo sapiens
ugcaccaacuuugaag

SEQ ID NO: 28496 - RNA, 13 nt, Homo sapiens
augauacaaugaa

SEQ ID NO: 28497 - RNA, 20 nt, Homo sapiens
augaacacuuauaagugaag

SEQ ID NO: 28498 - RNA, 17 nt, Homo sapiens
uuuauuauuuucaccug

SEQ ID NO: 28499 - RNA, 15 nt, Homo sapiens
cuauguggcuguauc

SEQ ID NO: 28500 - RNA, 16 nt, Homo sapiens
augcauuugcacuauu

SEQ ID NO: 28501 - RNA, 15 nt, Homo sapiens
caaucuuaacucauu

SEQ ID NO: 28502 - RNA, 16 nt, Homo sapiens
cuuaaagaauuuucaa

SEQ ID NO: 28503 - RNA, 15 nt, Homo sapiens
augguuccauucucu

SEQ ID NO: 28504 - RNA, 19 nt, Homo sapiens
guuauuuagggaacugcuu

SEQ ID NO: 28505 - RNA, 14 nt, Homo sapiens
uuccaaauucacaa

SEQ ID NO: 28506 - RNA, 16 nt, Homo sapiens
gccuugguauagcaua

SEQ ID NO: 28507 - RNA, 17 nt, Homo sapiens
auagcagcuuauucaca

SEQ ID NO: 28508 - RNA, 21 nt, Homo sapiens
ugugacuuaaugccacuaaau

SEQ ID NO: 28509 - RNA, 13 nt, Homo sapiens
ggcgacaguuuuc

SEQ ID NO: 28510 - RNA, 22 nt, Homo sapiens
ccuggacaguuuucugcuuuaa

SEQ ID NO: 28511 - RNA, 20 nt, Homo sapiens
uagagugggacaguuccuga

SEQ ID NO: 28512 - RNA, 13 nt, Homo sapiens
ccugcagacauga

SEQ ID NO: 28513 - RNA, 21 nt, Homo sapiens
acaauuauuuuuacaguucuc

SEQ ID NO: 28514 - RNA, 20 nt, Homo sapiens
ucuuuuuuuuaauaaaccau

SEQ ID NO: 28515 - RNA, 22 nt, Homo sapiens
caggauagagugggacaguucc

SEQ ID NO: 28516 - RNA, 17 nt, Homo sapiens
cuguaaucccagcacuu

SEQ ID NO: 28517 - RNA, 12 nt, Homo sapiens
cucauucaaaag

SEQ ID NO: 28518 - RNA, 18 nt, Homo sapiens
gaaaagauuaugaucuca

SEQ ID NO: 28519 - RNA, 13 nt, Homo sapiens
ccucuguugccaa

SEQ ID NO: 28520 - RNA, 11 nt, Homo sapiens
augcuggccag

SEQ ID NO: 28521 - RNA, 16 nt, Homo sapiens
uuugugacuuuccuaa

SEQ ID NO: 28522 - RNA, 18 nt, Homo sapiens
auuuauugagcaccugca

SEQ ID NO: 28523 - RNA, 21 nt, Homo sapiens
aaauaacuaggcguggacuua

SEQ ID NO: 28524 - RNA, 15 nt, Homo sapiens
agugacauguuuaca

SEQ ID NO: 28525 - RNA, 22 nt, Homo sapiens
ccgcaaugugacuuaaugccac

SEQ ID NO: 28526 - RNA, 14 nt, Homo sapiens
ucuauguggcugua

SEQ ID NO: 28527 - RNA, 19 nt, Homo sapiens
caacccaaauguucaucaa

SEQ ID NO: 28528 - RNA, 14 nt, Homo sapiens
gaaugagaagaaug

SEQ ID NO: 28529 - RNA, 21 nt, Homo sapiens
cuugaaauagugucugaugaa

SEQ ID NO: 28530 - RNA, 13 nt, Homo sapiens
ggaugauguuucg

SEQ ID NO: 28531 - RNA, 13 nt, Homo sapiens
uggccugcuggau

SEQ ID NO: 28532 - RNA, 17 nt, Homo sapiens
uacugcuaccacaacua

SEQ ID NO: 28533 - RNA, 13 nt, Homo sapiens
uuuaugcauacag

SEQ ID NO: 28534 - RNA, 22 nt, Homo sapiens
ccuggcugggaguggcauguau

SEQ ID NO: 28535 - RNA, 16 nt, Homo sapiens
uggaaaaugugcaaua

SEQ ID NO: 28536 - RNA, 12 nt, Homo sapiens
uggucucagugu

SEQ ID NO: 28537 - RNA, 13 nt, Homo sapiens
cugauuaaaccaa

SEQ ID NO: 28538 - RNA, 20 nt, Homo sapiens
aguguuggaaaaugugcaau

SEQ ID NO: 28539 - RNA, 13 nt, Homo sapiens
aaaaugugcaaua

SEQ ID NO: 28540 - RNA, 20 nt, Homo sapiens
gacuauuauagaauggaacu

SEQ ID NO: 28541 - RNA, 20 nt, Homo sapiens
auauaauaugcacacagugc

SEQ ID NO: 28542 - RNA, 16 nt, Homo sapiens
uagauaaacucagaaa

SEQ ID NO: 28543 - RNA, 16 nt, Homo sapiens
cacagucacauuccaa

SEQ ID NO: 28544 - RNA, 16 nt, Homo sapiens
uucacaagacccaaaa

SEQ ID NO: 28545 - RNA, 15 nt, Homo sapiens
cagaaauuguaucuu

SEQ ID NO: 28546 - RNA, 14 nt, Homo sapiens
aauauuguugacaa

SEQ ID NO: 28547 - RNA, 21 nt, Homo sapiens
ccacaacuauauuaucaugca

SEQ ID NO: 28548 - RNA, 15 nt, Homo sapiens
agacaucaacagaua

SEQ ID NO: 28549 - RNA, 14 nt, Homo sapiens
acaugauccugcaa

SEQ ID NO: 28550 - RNA, 19 nt, Homo sapiens
uauaucaguccucuuucaa

SEQ ID NO: 28551 - RNA, 14 nt, Homo sapiens
uaggcuauucacaa

SEQ ID NO: 28552 - RNA, 23 nt, Homo sapiens
uuaaguguaacuggcaguuuucc

SEQ ID NO: 28553 - RNA, 16 nt, Homo sapiens
aaugguuccauucucu

SEQ ID NO: 28554 - RNA, 14 nt, Homo sapiens
agacagaaagcaga

SEQ ID NO: 28555 - RNA, 22 nt, Homo sapiens
gagacagaaagcagaacaguga

SEQ ID NO: 28556 - RNA, 15 nt, Homo sapiens
cuuuccagagaccag

SEQ ID NO: 28557 - RNA, 16 nt, Homo sapiens
aacccggccugauuaa

SEQ ID NO: 28558 - RNA, 17 nt, Homo sapiens
caagugaaaaacaucca

SEQ ID NO: 28559 - RNA, 15 nt, Homo sapiens
uccgaagucuuccau

SEQ ID NO: 28560 - RNA, 13 nt, Homo sapiens
agauguagaggag

SEQ ID NO: 28561 - RNA, 23 nt, Homo sapiens
auggaaguugcagugagcugaua

SEQ ID NO: 28562 - RNA, 19 nt, Homo sapiens
uguaaucccagcacuuugg

SEQ ID NO: 28563 - RNA, 21 nt, Homo sapiens
uuuuuaaacaaaaaaagcauu

SEQ ID NO: 28564 - RNA, 17 nt, Homo sapiens
caguggcgcaaucuuaa

SEQ ID NO: 28565 - RNA, 17 nt, Homo sapiens
ucuuggucucaguguca

SEQ ID NO: 28566 - RNA, 17 nt, Homo sapiens
ucugucuggacuuucca

SEQ ID NO: 28567 - RNA, 15 nt, Homo sapiens
uuccauuccaagccu

SEQ ID NO: 28568 - RNA, 22 nt, Homo sapiens
ugugauauguaccuaacgaagu

SEQ ID NO: 28569 - RNA, 14 nt, Homo sapiens
acuuuaacacagug

SEQ ID NO: 28570 - RNA, 16 nt, Homo sapiens
aauaauacaccagaga

SEQ ID NO: 28571 - RNA, 15 nt, Homo sapiens
uaucuuaguugguau

SEQ ID NO: 28572 - RNA, 15 nt, Homo sapiens
ucccagcuacuuggg

SEQ ID NO: 28573 - RNA, 19 nt, Homo sapiens
acaaggcuuuaucucaggg

SEQ ID NO: 28574 - RNA, 17 nt, Homo sapiens
uguuggaaaaugugcaa

SEQ ID NO: 28575 - RNA, 20 nt, Homo sapiens
caccagagauaauaugagaa

SEQ ID NO: 28576 - RNA, 16 nt, Homo sapiens
aacagaagcuuccauu

SEQ ID NO: 28577 - RNA, 21 nt, Homo sapiens
ugucucggagggauuccccua

SEQ ID NO: 28578 - RNA, 22 nt, Homo sapiens
guuaccaguaacggaacaguau

SEQ ID NO: 28579 - RNA, 18 nt, Homo sapiens
aagcaacccaaauguuca

SEQ ID NO: 28580 - RNA, 20 nt, Homo sapiens
ccaaaguaucaggacgagaa

SEQ ID NO: 28581 - RNA, 20 nt, Homo sapiens
agagacgggguuugccaugc

SEQ ID NO: 28582 - RNA, 20 nt, Homo sapiens
cgaguggcccuucauguaca

SEQ ID NO: 28583 - RNA, 23 nt, Homo sapiens
ucacauuggcuauuuaaagacaa

SEQ ID NO: 28584 - RNA, 11 nt, Homo sapiens
acuuuuuccag

SEQ ID NO: 28585 - RNA, 15 nt, Homo sapiens
gacccaaaaggcaga

SEQ ID NO: 28586 - RNA, 23 nt, Homo sapiens
ucacaggaaguagaggaggccac

SEQ ID NO: 28587 - RNA, 15 nt, Homo sapiens
uuuaauggcauguca

SEQ ID NO: 28588 - RNA, 16 nt, Homo sapiens
ucuauuacgugcaaua

SEQ ID NO: 28589 - RNA, 15 nt, Homo sapiens
uggcauuuucacuuu

SEQ ID NO: 28590 - RNA, 15 nt, Homo sapiens
ucuuggucacauaca

SEQ ID NO: 28591 - RNA, 21 nt, Homo sapiens
uauagugucuugggaauuuuc

SEQ ID NO: 28592 - RNA, 14 nt, Homo sapiens
gaagaaauucugca

SEQ ID NO: 28593 - RNA, 16 nt, Homo sapiens
guauuuuacuuuucca

SEQ ID NO: 28594 - RNA, 11 nt, Homo sapiens
acauacugcug

SEQ ID NO: 28595 - RNA, 20 nt, Homo sapiens
aaaugggcuacuuuguccuu

SEQ ID NO: 28596 - RNA, 14 nt, Homo sapiens
ugagaacugcauau

SEQ ID NO: 28597 - RNA, 19 nt, Homo sapiens
aauucuauuacgugcaaua

SEQ ID NO: 28598 - RNA, 17 nt, Homo sapiens
gcagaagcaacccaaau

SEQ ID NO: 28599 - RNA, 13 nt, Homo sapiens
ucaguuacucuga

SEQ ID NO: 28600 - RNA, 20 nt, Homo sapiens
aagauuguauagugcauguu

SEQ ID NO: 28601 - RNA, 19 nt, Homo sapiens
aaauugaaaggcauucucu

SEQ ID NO: 28602 - RNA, 15 nt, Homo sapiens
uacucauacauguua

SEQ ID NO: 28603 - RNA, 17 nt, Homo sapiens
cugaagggcaucaugca

SEQ ID NO: 28604 - RNA, 17 nt, Homo sapiens
agacagcaggucucaug

SEQ ID NO: 28605 - RNA, 23 nt, Homo sapiens
aaaucggaucuggggcucuggga

SEQ ID NO: 28606 - RNA, 13 nt, Homo sapiens
cagcuaaguugca

SEQ ID NO: 28607 - RNA, 15 nt, Homo sapiens
cccauuucuauuuau

SEQ ID NO: 28608 - RNA, 16 nt, Homo sapiens
ugauucccuccugcua

SEQ ID NO: 28609 - RNA, 15 nt, Homo sapiens
cuuaugaaacuaaga

SEQ ID NO: 28610 - RNA, 23 nt, Homo sapiens
auuucacuugaugauacaaugaa

SEQ ID NO: 28611 - RNA, 12 nt, Homo sapiens
aggcauguaauu

SEQ ID NO: 28612 - RNA, 18 nt, Homo sapiens
augaaaagauuaugaucu

SEQ ID NO: 28613 - RNA, 18 nt, Homo sapiens
cacaggcuccaaacugga

SEQ ID NO: 28614 - RNA, 12 nt, Homo sapiens
uugaauccagaa

SEQ ID NO: 28615 - RNA, 22 nt, Homo sapiens
aaagggucucccucuguugcca

SEQ ID NO: 28616 - RNA, 18 nt, Homo sapiens
acuaaauugacacuuaaa

SEQ ID NO: 28617 - RNA, 16 nt, Homo sapiens
guuggaaaaugugcaa

SEQ ID NO: 28618 - RNA, 12 nt, Homo sapiens
gaagucuuccau

SEQ ID NO: 28619 - RNA, 16 nt, Homo sapiens
aacacuaaaaaggcau

SEQ ID NO: 28620 - RNA, 20 nt, Homo sapiens
gaugggagaaucacuugaac

SEQ ID NO: 28621 - RNA, 22 nt, Homo sapiens
agaagugaaaaucuacacucca

SEQ ID NO: 28622 - RNA, 19 nt, Homo sapiens
auauuuuuaugugcaauaa

SEQ ID NO: 28623 - RNA, 14 nt, Homo sapiens
ggcuggagugcagu

SEQ ID NO: 28624 - RNA, 22 nt, Homo sapiens
ggaaaaugugcaauaugugaug

SEQ ID NO: 28625 - RNA, 21 nt, Homo sapiens
aauuuucaaaaucaaauucca

SEQ ID NO: 28626 - RNA, 18 nt, Homo sapiens
uauuguugacaacuguga

SEQ ID NO: 28627 - RNA, 17 nt, Homo sapiens
aaauaagccagacauca

SEQ ID NO: 28628 - RNA, 23 nt, Homo sapiens
acaccauuccuucugcccugcuu

SEQ ID NO: 28629 - RNA, 17 nt, Homo sapiens
auucugcaagcuuuuca

SEQ ID NO: 28630 - RNA, 12 nt, Homo sapiens
aaauuggacuua

SEQ ID NO: 28631 - RNA, 23 nt, Homo sapiens
uaaaauauuuuuaugugcaauaa

SEQ ID NO: 28632 - RNA, 15 nt, Homo sapiens
gcauuuucacuuuug

SEQ ID NO: 28633 - RNA, 15 nt, Homo sapiens
uugcaagacauagaa

SEQ ID NO: 28634 - RNA, 13 nt, Homo sapiens
uccugugacuguc

SEQ ID NO: 28635 - RNA, 11 nt, Homo sapiens
ucucagugucc

SEQ ID NO: 28636 - RNA, 20 nt, Homo sapiens
aauauuuauuauuuucaccu

SEQ ID NO: 28637 - RNA, 17 nt, Homo sapiens
agugcccaacuguuaua

SEQ ID NO: 28638 - RNA, 13 nt, Homo sapiens
cucaucugugauu

SEQ ID NO: 28639 - RNA, 20 nt, Homo sapiens
gaggcaagagaauugcuuga

SEQ ID NO: 28640 - RNA, 23 nt, Homo sapiens
uggacuuuccagagaccaguauu

SEQ ID NO: 28641 - RNA, 19 nt, Homo sapiens
guuuucugcuuuaauuuca

SEQ ID NO: 28642 - RNA, 22 nt, Homo sapiens
cacgccuguaaucccagcacuu

SEQ ID NO: 28643 - RNA, 22 nt, Homo sapiens
cuggagcuugaaauagugucug

SEQ ID NO: 28644 - RNA, 21 nt, Homo sapiens
uccuguacuuuuuccagacac

SEQ ID NO: 28645 - RNA, 16 nt, Homo sapiens
auaguguuggaaaaug

SEQ ID NO: 28646 - RNA, 19 nt, Homo sapiens
agaaauuugccaauuuacu

SEQ ID NO: 28647 - RNA, 14 nt, Homo sapiens
acaucuuucacauu

SEQ ID NO: 28648 - RNA, 16 nt, Homo sapiens
uaaaguacagacuuuu

SEQ ID NO: 28649 - RNA, 15 nt, Homo sapiens
auguguuuuucacau

SEQ ID NO: 28650 - RNA, 16 nt, Homo sapiens
uauucccuuuugcugc

SEQ ID NO: 28651 - RNA, 18 nt, Homo sapiens
uguuggaaaaugugcaau

SEQ ID NO: 28652 - RNA, 15 nt, Homo sapiens
uaauucaaacuaaua

SEQ ID NO: 28653 - RNA, 12 nt, Homo sapiens
aaaaaaagccaa

SEQ ID NO: 28654 - RNA, 16 nt, Homo sapiens
ggacacaggcuccaaa

SEQ ID NO: 28655 - RNA, 20 nt, Homo sapiens
agaaaccuuauuguaccucu

SEQ ID NO: 28656 - RNA, 22 nt, Homo sapiens
cauuucaaaagguauuuauuga

SEQ ID NO: 28657 - RNA, 9 nt, Homo sapiens
cgugcaaua

SEQ ID NO: 28658 - RNA, 23 nt, Homo sapiens
uaguguuggaaaaugugcaauau

SEQ ID NO: 28659 - RNA, 21 nt, Homo sapiens
agacaccaccacccuugccau

SEQ ID NO: 28660 - RNA, 15 nt, Homo sapiens
cagaaauuuaauuca

SEQ ID NO: 28661 - RNA, 17 nt, Homo sapiens
ugaguggaugauguuuc

SEQ ID NO: 28662 - RNA, 15 nt, Homo sapiens
uaucaauaucuaaua

SEQ ID NO: 28663 - RNA, 19 nt, Homo sapiens
uggaaauaaaagauuguau

SEQ ID NO: 28664 - RNA, 19 nt, Homo sapiens
aaccuccaccuucuggguu

SEQ ID NO: 28665 - RNA, 13 nt, Homo sapiens
aauugacacuuaa

SEQ ID NO: 28666 - RNA, 13 nt, Homo sapiens
cugaauacauucu

SEQ ID NO: 28667 - RNA, 17 nt, Homo sapiens
cuucucuucacagucac

SEQ ID NO: 28668 - RNA, 15 nt, Homo sapiens
uagaagcaucacagg

SEQ ID NO: 28669 - RNA, 18 nt, Homo sapiens
agcaagacucugucucaa

SEQ ID NO: 28670 - RNA, 22 nt, Homo sapiens
caguaacggaacaguauccagu

SEQ ID NO: 28671 - RNA, 16 nt, Homo sapiens
cacugugggcuuuuau

SEQ ID NO: 28672 - RNA, 19 nt, Homo sapiens
accagagauaauaugagaa

SEQ ID NO: 28673 - RNA, 18 nt, Homo sapiens
auuuuaaguaauuucaga

SEQ ID NO: 28674 - RNA, 21 nt, Homo sapiens
auucgcugcaaccuguugaua

SEQ ID NO: 28675 - RNA, 12 nt, Homo sapiens
uuaugugcaaua

SEQ ID NO: 28676 - RNA, 20 nt, Homo sapiens
ucaaaacuucagacauagaa

SEQ ID NO: 28677 - RNA, 21 nt, Homo sapiens
gacacaggcuccaaacuggag

SEQ ID NO: 28678 - RNA, 15 nt, Homo sapiens
acuugaugauacaau

SEQ ID NO: 28679 - RNA, 23 nt, Homo sapiens
ugaaaaaguauaaauaaaaugag

SEQ ID NO: 28680 - RNA, 19 nt, Homo sapiens
ggacuugggcgggacacag

SEQ ID NO: 28681 - RNA, 14 nt, Homo sapiens
auuacaucuuucac

SEQ ID NO: 28682 - RNA, 18 nt, Homo sapiens
agcaaauguuaugcauaa

SEQ ID NO: 28683 - RNA, 13 nt, Homo sapiens
uauuuauuuacug

SEQ ID NO: 28684 - RNA, 16 nt, Homo sapiens
caaauguuaugcauaa

SEQ ID NO: 28685 - RNA, 16 nt, Homo sapiens
uccaagccucaugucc

SEQ ID NO: 28686 - RNA, 19 nt, Homo sapiens
ugucuggcacuugggacaa

SEQ ID NO: 28687 - RNA, 22 nt, Homo sapiens
ugagaugggagaaucacuugaa

SEQ ID NO: 28688 - RNA, 23 nt, Homo sapiens
cuccuggcuggggccuguugaag

SEQ ID NO: 28689 - RNA, 13 nt, Homo sapiens
cacuggcucccug

SEQ ID NO: 28690 - RNA, 23 nt, Homo sapiens
uccuagcgcagccaugugauuac

SEQ ID NO: 28691 - RNA, 16 nt, Homo sapiens
cuggcacuugggacaa

SEQ ID NO: 28692 - RNA, 16 nt, Homo sapiens
auaauaugagaaucag

SEQ ID NO: 28693 - RNA, 20 nt, Homo sapiens
ccucaucuguaaaauggaga

SEQ ID NO: 28694 - RNA, 18 nt, Homo sapiens
gcccuucauguacaucca

SEQ ID NO: 28695 - RNA, 17 nt, Homo sapiens
uuguaccgcaaugugac

SEQ ID NO: 28696 - RNA, 13 nt, Homo sapiens
uagcaucucagga

SEQ ID NO: 28697 - RNA, 19 nt, Homo sapiens
caucuuggucacauacaau

SEQ ID NO: 28698 - RNA, 22 nt, Homo sapiens
ggcagcaggauagagugggaca

SEQ ID NO: 28699 - RNA, 20 nt, Homo sapiens
acggagauaucccaggaaaa

SEQ ID NO: 28700 - RNA, 17 nt, Homo sapiens
aucaaauuccagaauga

SEQ ID NO: 28701 - RNA, 13 nt, Homo sapiens
auuauagaaugga

SEQ ID NO: 28702 - RNA, 16 nt, Homo sapiens
uuccuuaucacugaca

SEQ ID NO: 28703 - RNA, 13 nt, Homo sapiens
augcauacaguaa

SEQ ID NO: 28704 - RNA, 13 nt, Homo sapiens
uuaaaauguaauu

SEQ ID NO: 28705 - RNA, 16 nt, Homo sapiens
ggacuuacuauuuauu

SEQ ID NO: 28706 - RNA, 20 nt, Homo sapiens
cugucuggacuuuccagaga

SEQ ID NO: 28707 - RNA, 15 nt, Homo sapiens
uggaaaaugugcaau

SEQ ID NO: 28708 - RNA, 13 nt, Homo sapiens
aagcaacaucuag

SEQ ID NO: 28709 - RNA, 14 nt, Homo sapiens
cuaugugauuacaa

SEQ ID NO: 28710 - RNA, 15 nt, Homo sapiens
gcgugagccaccaaa

SEQ ID NO: 28711 - RNA, 15 nt, Homo sapiens
cuugggcgggacaca

SEQ ID NO: 28712 - RNA, 16 nt, Homo sapiens
auucccuccugcuacu

SEQ ID NO: 28713 - RNA, 17 nt, Homo sapiens
acacaggcuccaaacug

SEQ ID NO: 28714 - RNA, 16 nt, Homo sapiens
uucaaaauuggacuua

SEQ ID NO: 28715 - RNA, 16 nt, Homo sapiens
uaaaugauuucauuca

SEQ ID NO: 28716 - RNA, 14 nt, Homo sapiens
aagacaaauucugu

SEQ ID NO: 28717 - RNA, 17 nt, Homo sapiens
ugggaauuuucuuccaa

SEQ ID NO: 28718 - RNA, 14 nt, Homo sapiens
ugcauacaguaauu

SEQ ID NO: 28719 - RNA, 14 nt, Homo sapiens
cgggguuugccaug

SEQ ID NO: 28720 - RNA, 16 nt, Homo sapiens
aaauggaaaguaacuc

SEQ ID NO: 28721 - RNA, 19 nt, Homo sapiens
agugaacaaauuuacagag

SEQ ID NO: 28722 - RNA, 19 nt, Homo sapiens
aauauaauaugcacacagu

SEQ ID NO: 28723 - RNA, 14 nt, Homo sapiens
aaaccaaggcuaga

SEQ ID NO: 28724 - RNA, 14 nt, Homo sapiens
aaacauagcaucuc

SEQ ID NO: 28725 - RNA, 12 nt, Homo sapiens
acauacaauuau

SEQ ID NO: 28726 - RNA, 19 nt, Homo sapiens
gaaaaucugcacugugggc

SEQ ID NO: 28727 - RNA, 20 nt, Homo sapiens
cgcgcaccuguaaucccagc

SEQ ID NO: 28728 - RNA, 20 nt, Homo sapiens
uuugaugauuaauucaccuu

SEQ ID NO: 28729 - RNA, 21 nt, Homo sapiens
uaaacaguagugauaguugua

SEQ ID NO: 28730 - RNA, 13 nt, Homo sapiens
agaauggaacuca

SEQ ID NO: 28731 - RNA, 23 nt, Homo sapiens
aauauguaaauagaaacguguau

SEQ ID NO: 28732 - RNA, 17 nt, Homo sapiens
uucugcaagcuuuucaa

SEQ ID NO: 28733 - RNA, 17 nt, Homo sapiens
gaaaauaaaagcacuua

SEQ ID NO: 28734 - RNA, 17 nt, Homo sapiens
uauugcugaaugacuac

SEQ ID NO: 28735 - RNA, 16 nt, Homo sapiens
ucuccgucucccaaag

SEQ ID NO: 28736 - RNA, 15 nt, Homo sapiens
gggucucaguguccu

SEQ ID NO: 28737 - RNA, 19 nt, Homo sapiens
guaauuuuaaguaauuuca

SEQ ID NO: 28738 - RNA, 17 nt, Homo sapiens
uucaaaauuggacuuaa

SEQ ID NO: 28739 - RNA, 13 nt, Homo sapiens
augacacaucucu

SEQ ID NO: 28740 - RNA, 21 nt, Homo sapiens
gugauuacccucugggucuca

SEQ ID NO: 28741 - RNA, 15 nt, Homo sapiens
agguuaagcacuuua

SEQ ID NO: 28742 - RNA, 21 nt, Homo sapiens
cagaacuugaaugugucaggu

SEQ ID NO: 28743 - RNA, 23 nt, Homo sapiens
uaaugaaaaugaauaucuauuaa

SEQ ID NO: 28744 - RNA, 15 nt, Homo sapiens
aagagaucaagccau

SEQ ID NO: 28745 - RNA, 17 nt, Homo sapiens
aacauagcaucucagga

SEQ ID NO: 28746 - RNA, 15 nt, Homo sapiens
ccucuguugccaagg

SEQ ID NO: 28747 - RNA, 19 nt, Homo sapiens
uuaucaugcaaaugcugua

SEQ ID NO: 28748 - RNA, 16 nt, Homo sapiens
caccagggccuggcug

SEQ ID NO: 28749 - RNA, 11 nt, Homo sapiens
uaaaagcacuu

SEQ ID NO: 28750 - RNA, 18 nt, Homo sapiens
agccaaguuuauauacaa

SEQ ID NO: 28751 - RNA, 14 nt, Homo sapiens
gaaagggucucccu

SEQ ID NO: 28752 - RNA, 16 nt, Homo sapiens
uaggaacgguaaauuu

SEQ ID NO: 28753 - RNA, 17 nt, Homo sapiens
uaaacaaaggaauuaug

SEQ ID NO: 28754 - RNA, 17 nt, Homo sapiens
cuaaaucaauucuauua

SEQ ID NO: 28755 - RNA, 15 nt, Homo sapiens
aaccuuuacauccag

SEQ ID NO: 28756 - RNA, 21 nt, Homo sapiens
caucacagcugaacuuguuga

SEQ ID NO: 28757 - RNA, 18 nt, Homo sapiens
guauuuauugagcaccug

SEQ ID NO: 28758 - RNA, 22 nt, Homo sapiens
cugcaagcuuuucaaaauugga

SEQ ID NO: 28759 - RNA, 14 nt, Homo sapiens
acccaaaaggcaga

SEQ ID NO: 28760 - RNA, 18 nt, Homo sapiens
auaaacaguagugauagu

SEQ ID NO: 28761 - RNA, 13 nt, Homo sapiens
guuuucugacuaa

SEQ ID NO: 28762 - RNA, 13 nt, Homo sapiens
uaacacagugucu

SEQ ID NO: 28763 - RNA, 18 nt, Homo sapiens
uuguacaccaauauucau

SEQ ID NO: 28764 - RNA, 14 nt, Homo sapiens
ugaccugacagccc

SEQ ID NO: 28765 - RNA, 18 nt, Homo sapiens
acuuaugaaccuuuacau

SEQ ID NO: 28766 - RNA, 19 nt, Homo sapiens
agguauuuauugagcaccu

SEQ ID NO: 28767 - RNA, 18 nt, Homo sapiens
agcaggauagagugggac

SEQ ID NO: 28768 - RNA, 16 nt, Homo sapiens
ucugcaagcuuuucaa

SEQ ID NO: 28769 - RNA, 13 nt, Homo sapiens
acaucuuucacau

SEQ ID NO: 28770 - RNA, 16 nt, Homo sapiens
guagccacuucacuuu

SEQ ID NO: 28771 - RNA, 23 nt, Homo sapiens
agagcccuucaugcauuugcacu

SEQ ID NO: 28772 - RNA, 16 nt, Homo sapiens
caccaaacccggccug

SEQ ID NO: 28773 - RNA, 19 nt, Homo sapiens
uaaauguaucuuauucaca

SEQ ID NO: 28774 - RNA, 10 nt, Homo sapiens
aaaauaugcc

SEQ ID NO: 28775 - RNA, 18 nt, Homo sapiens
acaauuauaucaguccuc

SEQ ID NO: 28776 - RNA, 14 nt, Homo sapiens
caccuguaauccca

SEQ ID NO: 28777 - RNA, 13 nt, Homo sapiens
acuagauacugaa

SEQ ID NO: 28778 - RNA, 23 nt, Homo sapiens
uacauuguuugucugucuucaua

SEQ ID NO: 28779 - RNA, 15 nt, Homo sapiens
cugcaagcuuuucaa

SEQ ID NO: 28780 - RNA, 15 nt, Homo sapiens
auuguaacuuaugaa

SEQ ID NO: 28781 - RNA, 13 nt, Homo sapiens
ucuugaaagcugu

SEQ ID NO: 28782 - RNA, 13 nt, Homo sapiens
gaauuaauggaau

SEQ ID NO: 28783 - RNA, 21 nt, Homo sapiens
ccaggagauggaaguugcagu

SEQ ID NO: 28784 - RNA, 22 nt, Homo sapiens
uuacuauuuauugcugaaugac

SEQ ID NO: 28785 - RNA, 17 nt, Homo sapiens
auuacaggcgugagcca

SEQ ID NO: 28786 - RNA, 17 nt, Homo sapiens
aauauuuuuaugugcaa

SEQ ID NO: 28787 - RNA, 20 nt, Homo sapiens
uaguuucccuugcaugguuu

SEQ ID NO: 28788 - RNA, 15 nt, Homo sapiens
cuguacuuuuuccag

SEQ ID NO: 28789 - RNA, 21 nt, Homo sapiens
ucaauuuaaaaaaaaaccuga

SEQ ID NO: 28790 - RNA, 20 nt, Homo sapiens
gcuggucucgaacugcugga

SEQ ID NO: 28791 - RNA, 15 nt, Homo sapiens
ugacugucucacuua

SEQ ID NO: 28792 - RNA, 20 nt, Homo sapiens
ggcuggagugcaguggcgca

SEQ ID NO: 28793 - RNA, 23 nt, Homo sapiens
ucuucccuuuuacauacugcugu

SEQ ID NO: 28794 - RNA, 14 nt, Homo sapiens
cacaaaauugggaa

SEQ ID NO: 28795 - RNA, 17 nt, Homo sapiens
cuuaaaaucuaauucaa

SEQ ID NO: 28796 - RNA, 14 nt, Homo sapiens
uauuacgugcaaua

SEQ ID NO: 28797 - RNA, 17 nt, Homo sapiens
aguacucauacauguua

SEQ ID NO: 28798 - RNA, 16 nt, Homo sapiens
gugacuuaguguacau

SEQ ID NO: 28799 - RNA, 13 nt, Homo sapiens
uaauuucaugaaa

SEQ ID NO: 28800 - RNA, 20 nt, Homo sapiens
uacaaggcuuuaucucaggg

SEQ ID NO: 28801 - RNA, 19 nt, Homo sapiens
ccugcaggcgugaccugac

SEQ ID NO: 28802 - RNA, 23 nt, Homo sapiens
aaaaggccugucccugcagacau

SEQ ID NO: 28803 - RNA, 18 nt, Homo sapiens
gauggaaguugcagugag

SEQ ID NO: 28804 - RNA, 16 nt, Homo sapiens
uccuucucaucuguga

SEQ ID NO: 28805 - RNA, 18 nt, Homo sapiens
uaugacgugacuggccug

SEQ ID NO: 28806 - RNA, 15 nt, Homo sapiens
aauucugcaagcuuu

SEQ ID NO: 28807 - RNA, 19 nt, Homo sapiens
cacuaaaaaggcauguaau

SEQ ID NO: 28808 - RNA, 14 nt, Homo sapiens
gaaauagugucuga

SEQ ID NO: 28809 - RNA, 11 nt, Homo sapiens
acagcucugca

SEQ ID NO: 28810 - RNA, 23 nt, Homo sapiens
uauaaauuuucccaaaacugaua

SEQ ID NO: 28811 - RNA, 15 nt, Homo sapiens
uuuauugcugaauga

SEQ ID NO: 28812 - RNA, 21 nt, Homo sapiens
gauaccucaacccccauuucu

SEQ ID NO: 28813 - RNA, 13 nt, Homo sapiens
ugcauuugcacua

SEQ ID NO: 28814 - RNA, 20 nt, Homo sapiens
auuuuguguucaguacaauu

SEQ ID NO: 28815 - RNA, 15 nt, Homo sapiens
auaugacacaucucu

SEQ ID NO: 28816 - RNA, 17 nt, Homo sapiens
gaacugcauauguuucg

SEQ ID NO: 28817 - RNA, 22 nt, Homo sapiens
aaaggccugucccugcagacau

SEQ ID NO: 28818 - RNA, 13 nt, Homo sapiens
accaaauuuguau

SEQ ID NO: 28819 - RNA, 20 nt, Homo sapiens
aggccgggcgcgguggcuca

SEQ ID NO: 28820 - RNA, 21 nt, Homo sapiens
uaaaauggagacaccaccacc

SEQ ID NO: 28821 - RNA, 16 nt, Homo sapiens
auacauucugcuuuca

SEQ ID NO: 28822 - RNA, 16 nt, Homo sapiens
aacggaacaguaucca

SEQ ID NO: 28823 - RNA, 18 nt, Homo sapiens
auggcuaguaucaaaaga

SEQ ID NO: 28824 - RNA, 14 nt, Homo sapiens
ccacccuugccaug

SEQ ID NO: 28825 - RNA, 21 nt, Homo sapiens
guuucgugaaguauacuguau

SEQ ID NO: 28826 - RNA, 13 nt, Homo sapiens
caugaaagcguaa

SEQ ID NO: 28827 - RNA, 12 nt, Homo sapiens
gcuuccuaacug

SEQ ID NO: 28828 - RNA, 15 nt, Homo sapiens
gaccugacagcccaa

SEQ ID NO: 28829 - RNA, 13 nt, Homo sapiens
ccaagccugacca

SEQ ID NO: 28830 - RNA, 23 nt, Homo sapiens
acagaagagugacauguuuacaa

SEQ ID NO: 28831 - RNA, 16 nt, Homo sapiens
auucacaagacccaaa

SEQ ID NO: 28832 - RNA, 18 nt, Homo sapiens
acaucaguuacucugaag

SEQ ID NO: 28833 - RNA, 18 nt, Homo sapiens
uaaguugcaccaacuuug

SEQ ID NO: 28834 - RNA, 14 nt, Homo sapiens
aaaaugagcaaaag

SEQ ID NO: 28835 - RNA, 13 nt, Homo sapiens
ucaccaaggcuga

SEQ ID NO: 28836 - RNA, 11 nt, Homo sapiens
ccuugagaaac

SEQ ID NO: 28837 - RNA, 18 nt, Homo sapiens
ucugccuugguauagcau

SEQ ID NO: 28838 - RNA, 14 nt, Homo sapiens
agagaaauuugcca

SEQ ID NO: 28839 - RNA, 16 nt, Homo sapiens
gcgcagccaugugauu

SEQ ID NO: 28840 - RNA, 23 nt, Homo sapiens
aaagcagggacuugaacccauau

SEQ ID NO: 28841 - RNA, 13 nt, Homo sapiens
ucugauaccucaa

SEQ ID NO: 28842 - RNA, 17 nt, Homo sapiens
cugggucucaguguccu

SEQ ID NO: 28843 - RNA, 16 nt, Homo sapiens
cugccccugagcccau

SEQ ID NO: 28844 - RNA, 12 nt, Homo sapiens
cgacaguuuucc

SEQ ID NO: 28845 - RNA, 18 nt, Homo sapiens
gaauauuuauuaccucug

SEQ ID NO: 28846 - RNA, 19 nt, Homo sapiens
uuccagagaccaguauucc

SEQ ID NO: 28847 - RNA, 15 nt, Homo sapiens
gaggagaaacuggaa

SEQ ID NO: 28848 - RNA, 16 nt, Homo sapiens
agugucugaugaaugu

SEQ ID NO: 28849 - RNA, 14 nt, Homo sapiens
acuaauuaggcaag

SEQ ID NO: 28850 - RNA, 13 nt, Homo sapiens
gauaaacucagaa

SEQ ID NO: 28851 - RNA, 16 nt, Homo sapiens
acaucaguuacucuga

SEQ ID NO: 28852 - RNA, 21 nt, Homo sapiens
aauggcuaagcaaaaugugau

SEQ ID NO: 28853 - RNA, 23 nt, Homo sapiens
ucucuuuuuagagaaauuugcca

SEQ ID NO: 28854 - RNA, 15 nt, Homo sapiens
ucugcuuuaauuuca

SEQ ID NO: 28855 - RNA, 22 nt, Homo sapiens
ugcagauaaacaguagugauag

SEQ ID NO: 28856 - RNA, 14 nt, Homo sapiens
aacuggcaguuuuc

SEQ ID NO: 28857 - RNA, 20 nt, Homo sapiens
uucugucuggacuuuccaga

SEQ ID NO: 28858 - RNA, 16 nt, Homo sapiens
aauguucaucaaugaa

SEQ ID NO: 28859 - RNA, 15 nt, Homo sapiens
auguuucgcugauau

SEQ ID NO: 28860 - RNA, 11 nt, Homo sapiens
cuuuucucugc

SEQ ID NO: 28861 - RNA, 19 nt, Homo sapiens
gguaucaaccaaauggagu

SEQ ID NO: 28862 - RNA, 18 nt, Homo sapiens
gccauaauuacuauguca

SEQ ID NO: 28863 - RNA, 21 nt, Homo sapiens
auaaauaguuuaugauuccac

SEQ ID NO: 28864 - RNA, 21 nt, Homo sapiens
aacacuaaaaaggcauguaau

SEQ ID NO: 28865 - RNA, 23 nt, Homo sapiens
aaggcuucucuuaaacacuaaaa

SEQ ID NO: 28866 - RNA, 16 nt, Homo sapiens
gugaaguauacuguau

SEQ ID NO: 28867 - RNA, 11 nt, Homo sapiens
ccugugacugu

SEQ ID NO: 28868 - RNA, 18 nt, Homo sapiens
acuugaugauacaaugaa

SEQ ID NO: 28869 - RNA, 21 nt, Homo sapiens
gagaugggagaaucacuugaa

SEQ ID NO: 28870 - RNA, 23 nt, Homo sapiens
ugagaaaccuuauuguaccucuc

SEQ ID NO: 28871 - RNA, 18 nt, Homo sapiens
cugccaauauccuaauaa

SEQ ID NO: 28872 - RNA, 19 nt, Homo sapiens
aaguugcaccaacuuugaa

SEQ ID NO: 28873 - RNA, 19 nt, Homo sapiens
gcauguaugacgugacugg

SEQ ID NO: 28874 - RNA, 19 nt, Homo sapiens
ucacaaccacucauucaaa

SEQ ID NO: 28875 - RNA, 17 nt, Homo sapiens
ggcuuuagggaccugcu

SEQ ID NO: 28876 - RNA, 15 nt, Homo sapiens
cacgcccagcuaauu

SEQ ID NO: 28877 - RNA, 19 nt, Homo sapiens
auuuguuaaaauuaucaau

SEQ ID NO: 28878 - RNA, 14 nt, Homo sapiens
guggcgacucuaua

SEQ ID NO: 28879 - RNA, 20 nt, Homo sapiens
gcccaucuccgucucccaaa

SEQ ID NO: 28880 - RNA, 21 nt, Homo sapiens
aaccucauuccccaaccacuu

SEQ ID NO: 28881 - RNA, 21 nt, Homo sapiens
cacauuccaagccucaugucc

SEQ ID NO: 28882 - RNA, 12 nt, Homo sapiens
aaaugugcaaua

SEQ ID NO: 28883 - RNA, 13 nt, Homo sapiens
ugcugggaauuac

SEQ ID NO: 28884 - RNA, 12 nt, Homo sapiens
ccugugacuguc

SEQ ID NO: 28885 - RNA, 18 nt, Homo sapiens
uaaaauuaucaauaucua

SEQ ID NO: 28886 - RNA, 21 nt, Homo sapiens
ccaaaagguauuuuaaucacc

SEQ ID NO: 28887 - RNA, 18 nt, Homo sapiens
auaucuaauauauaugaa

SEQ ID NO: 28888 - RNA, 17 nt, Homo sapiens
auuguugacaacuguga

SEQ ID NO: 28889 - RNA, 17 nt, Homo sapiens
aacuggcaguuuuccau

SEQ ID NO: 28890 - RNA, 19 nt, Homo sapiens
accuuuggaugcacuuuau

SEQ ID NO: 28891 - RNA, 17 nt, Homo sapiens
ugaggaauauuugcaag

SEQ ID NO: 28892 - RNA, 20 nt, Homo sapiens
acuaauagaauuaauggaau

SEQ ID NO: 28893 - RNA, 19 nt, Homo sapiens
guuuuuccacuacugcuac

SEQ ID NO: 28894 - RNA, 17 nt, Homo sapiens
auuuccaaauucacaag

SEQ ID NO: 28895 - RNA, 18 nt, Homo sapiens
ugccuugguauagcauau

SEQ ID NO: 28896 - RNA, 23 nt, Homo sapiens
gcaaaugcuguauucuucuuugg

SEQ ID NO: 28897 - RNA, 20 nt, Homo sapiens
ggcgacaguuuuccuucuca

SEQ ID NO: 28898 - RNA, 18 nt, Homo sapiens
gagaaucagaucauuuca

SEQ ID NO: 28899 - RNA, 17 nt, Homo sapiens
cuuguuagcaaaaugga

SEQ ID NO: 28900 - RNA, 19 nt, Homo sapiens
gucacagaggaucugcuug

SEQ ID NO: 28901 - RNA, 21 nt, Homo sapiens
auugaaaggcauucucugaag

SEQ ID NO: 28902 - RNA, 19 nt, Homo sapiens
agcuugaaauagugucuga

SEQ ID NO: 28903 - RNA, 13 nt, Homo sapiens
agauaaacaguag

SEQ ID NO: 28904 - RNA, 20 nt, Homo sapiens
augagaaucagaucauuuca

SEQ ID NO: 28905 - RNA, 21 nt, Homo sapiens
ugaaaacauagcaucucagga

SEQ ID NO: 28906 - RNA, 18 nt, Homo sapiens
aguagauaugaggcauuu

SEQ ID NO: 28907 - RNA, 11 nt, Homo sapiens
uuaugugcaau

SEQ ID NO: 28908 - RNA, 17 nt, Homo sapiens
gagauggguuugacaag

SEQ ID NO: 28909 - RNA, 23 nt, Homo sapiens
aagauguagaggagaaacuggaa

SEQ ID NO: 28910 - RNA, 21 nt, Homo sapiens
aagcacuuuaacacagugucu

SEQ ID NO: 28911 - RNA, 16 nt, Homo sapiens
cacugcagaagacagu

SEQ ID NO: 28912 - RNA, 19 nt, Homo sapiens
aaauaguuuaugauuccac

SEQ ID NO: 28913 - RNA, 21 nt, Homo sapiens
uacauauuucuuugccuuuau

SEQ ID NO: 28914 - RNA, 11 nt, Homo sapiens
augugcaauaa

SEQ ID NO: 28915 - RNA, 22 nt, Homo sapiens
uauuuuuuaugaaacauuacag

SEQ ID NO: 28916 - RNA, 20 nt, Homo sapiens
uaaucccagcuacuugggag

SEQ ID NO: 28917 - RNA, 16 nt, Homo sapiens
gaauuaacacaugauc

SEQ ID NO: 28918 - RNA, 23 nt, Homo sapiens
aucacuugaacccgggaggcaga

SEQ ID NO: 28919 - RNA, 22 nt, Homo sapiens
uaaaauauuuuuaugugcaaua

SEQ ID NO: 28920 - RNA, 14 nt, Homo sapiens
auuuauuaccucug

SEQ ID NO: 28921 - RNA, 19 nt, Homo sapiens
auucacaagacccaaaagg

SEQ ID NO: 28922 - RNA, 15 nt, Homo sapiens
uggauucaagugauc

SEQ ID NO: 28923 - RNA, 19 nt, Homo sapiens
uggagcuugaaauaguguc

SEQ ID NO: 28924 - RNA, 14 nt, Homo sapiens
ccuuauuguaccuc

SEQ ID NO: 28925 - RNA, 18 nt, Homo sapiens
gaauaaauaaauguaucu

SEQ ID NO: 28926 - RNA, 19 nt, Homo sapiens
aaguuuaugcauacaguaa

SEQ ID NO: 28927 - RNA, 20 nt, Homo sapiens
cuuguugagauccccguguu

SEQ ID NO: 28928 - RNA, 16 nt, Homo sapiens
gaucucacaagcacuu

SEQ ID NO: 28929 - RNA, 19 nt, Homo sapiens
ggcuaagcaaaaugugaua

SEQ ID NO: 28930 - RNA, 18 nt, Homo sapiens
ucaguccaugaagaugua

SEQ ID NO: 28931 - RNA, 19 nt, Homo sapiens
aaguauccuucagccugaa

SEQ ID NO: 28932 - RNA, 19 nt, Homo sapiens
cuacuugggaggcugaggc

SEQ ID NO: 28933 - RNA, 22 nt, Homo sapiens
uccugagaccagccaaccuggg

SEQ ID NO: 28934 - RNA, 23 nt, Homo sapiens
gagcuugaaauagugucugauga

SEQ ID NO: 28935 - RNA, 19 nt, Homo sapiens
cugagcagucagaagaccu

SEQ ID NO: 28936 - RNA, 14 nt, Homo sapiens
acagucacauucca

SEQ ID NO: 28937 - RNA, 23 nt, Homo sapiens
aagaaauucugcaagcuuuucaa

SEQ ID NO: 28938 - RNA, 22 nt, Homo sapiens
aaauauuuuuaugugcaauaaa

SEQ ID NO: 28939 - RNA, 23 nt, Homo sapiens
uuaaaauauuuuuaugugcaaua

SEQ ID NO: 28940 - RNA, 21 nt, Homo sapiens
uuauuaccucugauaccucaa

SEQ ID NO: 28941 - RNA, 12 nt, Homo sapiens
gcagaacaguga

SEQ ID NO: 28942 - RNA, 15 nt, Homo sapiens
caggaaaaucugcac

SEQ ID NO: 28943 - RNA, 22 nt, Homo sapiens
uacucugaagggcaucaugcau

SEQ ID NO: 28944 - RNA, 15 nt, Homo sapiens
auuaaggcuucucuu

SEQ ID NO: 28945 - RNA, 18 nt, Homo sapiens
gagaagaaugacuaugca

SEQ ID NO: 28946 - RNA, 18 nt, Homo sapiens
uguucacuuauugacuau

SEQ ID NO: 28947 - RNA, 13 nt, Homo sapiens
ccuuaaacucagg

SEQ ID NO: 28948 - RNA, 22 nt, Homo sapiens
cuuagacccucaugcugccaau

SEQ ID NO: 28949 - RNA, 21 nt, Homo sapiens
uaagcacuuuaacacaguguc

SEQ ID NO: 28950 - RNA, 20 nt, Homo sapiens
cuggagugcaguggcgcaau

SEQ ID NO: 28951 - RNA, 23 nt, Homo sapiens
cuguaaucccagcacuuugggag

SEQ ID NO: 28952 - RNA, 12 nt, Homo sapiens
ccacuacugcua

SEQ ID NO: 28953 - RNA, 14 nt, Homo sapiens
uaugugauguggca

SEQ ID NO: 28954 - RNA, 12 nt, Homo sapiens
auacagugucuu

SEQ ID NO: 28955 - RNA, 22 nt, Homo sapiens
agacagaaagcagaacagugau

SEQ ID NO: 28956 - RNA, 20 nt, Homo sapiens
ugagagcccuucaugcauuu

SEQ ID NO: 28957 - RNA, 21 nt, Homo sapiens
guuauuuagggaacugcuuga

SEQ ID NO: 28958 - RNA, 16 nt, Homo sapiens
acagugucuggcacuu

SEQ ID NO: 28959 - RNA, 16 nt, Homo sapiens
ugcuaucgccaucaca

SEQ ID NO: 28960 - RNA, 17 nt, Homo sapiens
cuggcacuugggacaaa

SEQ ID NO: 28961 - RNA, 23 nt, Homo sapiens
agaauuuucaaaaucaaauucca

SEQ ID NO: 28962 - RNA, 22 nt, Homo sapiens
augaaaacauagcaucucagga

SEQ ID NO: 28963 - RNA, 13 nt, Homo sapiens
uuacaucuuucac

SEQ ID NO: 28964 - RNA, 17 nt, Homo sapiens
gccugcuggauguggag

SEQ ID NO: 28965 - RNA, 22 nt, Homo sapiens
augugucaggugacccugauga

SEQ ID NO: 28966 - RNA, 18 nt, Homo sapiens
aagguauuuauugagcac

SEQ ID NO: 28967 - RNA, 16 nt, Homo sapiens
caguggcgcaaucuua

SEQ ID NO: 28968 - RNA, 22 nt, Homo sapiens
uuaauaaaccauuuuuacuugg

SEQ ID NO: 28969 - RNA, 17 nt, Homo sapiens
auucacaagacccaaaa

SEQ ID NO: 28970 - RNA, 16 nt, Homo sapiens
cuuuuacauacugcug

SEQ ID NO: 28971 - RNA, 14 nt, Homo sapiens
ugacuggccugcug

SEQ ID NO: 28972 - RNA, 15 nt, Homo sapiens
aucuuguuuuuccac

SEQ ID NO: 28973 - RNA, 18 nt, Homo sapiens
gguauauaaauuuuccca

SEQ ID NO: 28974 - RNA, 17 nt, Homo sapiens
aauauuugcaagacaua

SEQ ID NO: 28975 - RNA, 20 nt, Homo sapiens
cagagaaaauaaaagcacuu

SEQ ID NO: 28976 - RNA, 14 nt, Homo sapiens
ugagcgacagugag

SEQ ID NO: 28977 - RNA, 14 nt, Homo sapiens
aauuaacacaugau

SEQ ID NO: 28978 - RNA, 23 nt, Homo sapiens
cuacucuguuccuucacauccug

SEQ ID NO: 28979 - RNA, 19 nt, Homo sapiens
uccauugguuuaccuguga

SEQ ID NO: 28980 - RNA, 20 nt, Homo sapiens
aggcuggagugcaguggcgc

SEQ ID NO: 28981 - RNA, 14 nt, Homo sapiens
cucuucacagucac

SEQ ID NO: 28982 - RNA, 13 nt, Homo sapiens
aaugaauggcuaa

SEQ ID NO: 28983 - RNA, 22 nt, Homo sapiens
uguuagcaaaauggauaugaca

SEQ ID NO: 28984 - RNA, 22 nt, Homo sapiens
cccccauuguggucacaggaag

SEQ ID NO: 28985 - RNA, 13 nt, Homo sapiens
gcgugcaggcagc

SEQ ID NO: 28986 - RNA, 18 nt, Homo sapiens
uucugucuggacuuucca

SEQ ID NO: 28987 - RNA, 21 nt, Homo sapiens
uuauaagugaagugauacuau

SEQ ID NO: 28988 - RNA, 15 nt, Homo sapiens
uauuacgugcaauac

SEQ ID NO: 28989 - RNA, 12 nt, Homo sapiens
gggcgcgguggc

SEQ ID NO: 28990 - RNA, 19 nt, Homo sapiens
acaagacccaaaaggcaga

SEQ ID NO: 28991 - RNA, 18 nt, Homo sapiens
uucccugaccucccucua

SEQ ID NO: 28992 - RNA, 13 nt, Homo sapiens
uccaaauucacaa

SEQ ID NO: 28993 - RNA, 20 nt, Homo sapiens
aaaacucauuuccuauguaa

SEQ ID NO: 28994 - RNA, 15 nt, Homo sapiens
uuuccaaauucacaa

SEQ ID NO: 28995 - RNA, 14 nt, Homo sapiens
uaaaguacagacuu

SEQ ID NO: 28996 - RNA, 20 nt, Homo sapiens
uucugcccugcuuuugcuag

SEQ ID NO: 28997 - RNA, 21 nt, Homo sapiens
ugaauaaaguguaaguucaca

SEQ ID NO: 28998 - RNA, 17 nt, Homo sapiens
uaucuuguuuuuccacu

SEQ ID NO: 28999 - RNA, 16 nt, Homo sapiens
cugacuaauuaggcaa

SEQ ID NO: 29000 - RNA, 12 nt, Homo sapiens
cagccaaccugg

SEQ ID NO: 29001 - RNA, 21 nt, Homo sapiens
ccucaguuuccugaccuauga

SEQ ID NO: 29002 - RNA, 17 nt, Homo sapiens
uggguuguguguuuauu

SEQ ID NO: 29003 - RNA, 15 nt, Homo sapiens
gaagcuuccauucca

SEQ ID NO: 29004 - RNA, 22 nt, Homo sapiens
acaguuuucugcuuuaauuuca

SEQ ID NO: 29005 - RNA, 20 nt, Homo sapiens
aguuaggcuauucacaacca

SEQ ID NO: 29006 - RNA, 16 nt, Homo sapiens
aaagcagaacagugau

SEQ ID NO: 29007 - RNA, 21 nt, Homo sapiens
acaaaaaaagcauuguaacuu

SEQ ID NO: 29008 - RNA, 15 nt, Homo sapiens
auaagcuguuuuuau

SEQ ID NO: 29009 - RNA, 21 nt, Homo sapiens
agaaugauuuuacggagauau

SEQ ID NO: 29010 - RNA, 19 nt, Homo sapiens
cacuuuaacacagugucug

SEQ ID NO: 29011 - RNA, 21 nt, Homo sapiens
ucaauucuauuacgugcaaua

SEQ ID NO: 29012 - RNA, 16 nt, Homo sapiens
gaggcugaggcaagag

SEQ ID NO: 29013 - RNA, 14 nt, Homo sapiens
uauauccugugacu

SEQ ID NO: 29014 - RNA, 12 nt, Homo sapiens
aaagccaaaaac

SEQ ID NO: 29015 - RNA, 17 nt, Homo sapiens
gacgggguuugccaugc

SEQ ID NO: 29016 - RNA, 16 nt, Homo sapiens
uccugagaccagccaa

SEQ ID NO: 29017 - RNA, 17 nt, Homo sapiens
gcucugggauagcugac

SEQ ID NO: 29018 - RNA, 16 nt, Homo sapiens
auggcuaguaucaaaa

SEQ ID NO: 29019 - RNA, 14 nt, Homo sapiens
caucuuggucacau

SEQ ID NO: 29020 - RNA, 16 nt, Homo sapiens
aucuaauauauaugaa

SEQ ID NO: 29021 - RNA, 19 nt, Homo sapiens
agaauugcuugaacccagg

SEQ ID NO: 29022 - RNA, 21 nt, Homo sapiens
uuaaacucagggagcauuuau

SEQ ID NO: 29023 - RNA, 16 nt, Homo sapiens
uuaugaaacauuacag

SEQ ID NO: 29024 - RNA, 14 nt, Homo sapiens
aucaccaaggcuga

SEQ ID NO: 29025 - RNA, 14 nt, Homo sapiens
ugcagaagacagua

SEQ ID NO: 29026 - RNA, 20 nt, Homo sapiens
agacaccaccacccuugcca

SEQ ID NO: 29027 - RNA, 21 nt, Homo sapiens
cuaagaagugaaaaucuacac

SEQ ID NO: 29028 - RNA, 16 nt, Homo sapiens
uuauuuuuacaguucu

SEQ ID NO: 29029 - RNA, 14 nt, Homo sapiens
auaaauggacaaau

SEQ ID NO: 29030 - RNA, 13 nt, Homo sapiens
caaaucucuauua

SEQ ID NO: 29031 - RNA, 16 nt, Homo sapiens
gucucaguccaugaag

SEQ ID NO: 29032 - RNA, 17 nt, Homo sapiens
cucuggcgacaguuuuc

SEQ ID NO: 29033 - RNA, 22 nt, Homo sapiens
gaagaguggguuucacaaguga

SEQ ID NO: 29034 - RNA, 16 nt, Homo sapiens
caaaauggauaugaca

SEQ ID NO: 29035 - RNA, 19 nt, Homo sapiens
uaagugaaauaagccagac

SEQ ID NO: 29036 - RNA, 19 nt, Homo sapiens
acagccaggcggcuggaau

SEQ ID NO: 29037 - RNA, 21 nt, Homo sapiens
cuugagaaaccuuauuguacc

SEQ ID NO: 29038 - RNA, 16 nt, Homo sapiens
gaaucccuuaaacuca

SEQ ID NO: 29039 - RNA, 18 nt, Homo sapiens
acugaauguaaacaaagg

SEQ ID NO: 29040 - RNA, 14 nt, Homo sapiens
cucacaagcacuuu

SEQ ID NO: 29041 - RNA, 15 nt, Homo sapiens
auauccugugacugu

SEQ ID NO: 29042 - RNA, 17 nt, Homo sapiens
gaaugagaagaaugacu

SEQ ID NO: 29043 - RNA, 14 nt, Homo sapiens
uacaucuuucacau

SEQ ID NO: 29044 - RNA, 20 nt, Homo sapiens
aggaaauauucuguaaucuu

SEQ ID NO: 29045 - RNA, 14 nt, Homo sapiens
gcagggacuugaac

SEQ ID NO: 29046 - RNA, 17 nt, Homo sapiens
aggauagagugggacag

SEQ ID NO: 29047 - RNA, 22 nt, Homo sapiens
gagacaccaccacccuugccau

SEQ ID NO: 29048 - RNA, 19 nt, Homo sapiens
gaagaaauuccaggaaaau

SEQ ID NO: 29049 - RNA, 17 nt, Homo sapiens
agaggagaaacuggaac

SEQ ID NO: 29050 - RNA, 21 nt, Homo sapiens
uccugguuccuaggugagcag

SEQ ID NO: 29051 - RNA, 12 nt, Homo sapiens
uuucugcuuuaa

SEQ ID NO: 29052 - RNA, 19 nt, Homo sapiens
uaguuguaccgcaauguga

SEQ ID NO: 29053 - RNA, 18 nt, Homo sapiens
guucuucuuggucucagu

SEQ ID NO: 29054 - RNA, 20 nt, Homo sapiens
cuagcaaauguuaugcauaa

SEQ ID NO: 29055 - RNA, 17 nt, Homo sapiens
ucacauuccaagccuca

SEQ ID NO: 29056 - RNA, 17 nt, Homo sapiens
cuguaaaauggagacac

SEQ ID NO: 29057 - RNA, 21 nt, Homo sapiens
gugaccugacagcccaagggu

SEQ ID NO: 29058 - RNA, 22 nt, Homo sapiens
gccuggaucucacaagcacuuu

SEQ ID NO: 29059 - RNA, 17 nt, Homo sapiens
augaggaauauuugcaa

SEQ ID NO: 29060 - RNA, 13 nt, Homo sapiens
uagaauuuauuca

SEQ ID NO: 29061 - RNA, 15 nt, Homo sapiens
gacuggccugcugga

SEQ ID NO: 29062 - RNA, 19 nt, Homo sapiens
acagugagacucugucuca

SEQ ID NO: 29063 - RNA, 17 nt, Homo sapiens
caaggcuggagugcagu

SEQ ID NO: 29064 - RNA, 18 nt, Homo sapiens
uauuuaaagacaaagaca

SEQ ID NO: 29065 - RNA, 14 nt, Homo sapiens
cacccuugccaugg

SEQ ID NO: 29066 - RNA, 21 nt, Homo sapiens
gaggcauuugcagcugugcca

SEQ ID NO: 29067 - RNA, 13 nt, Homo sapiens
uaaguaauuucag

SEQ ID NO: 29068 - RNA, 19 nt, Homo sapiens
cuuuucaaaauuggacuua

SEQ ID NO: 29069 - RNA, 14 nt, Homo sapiens
cuuauuguaccucu

SEQ ID NO: 29070 - RNA, 15 nt, Homo sapiens
acaaugaacacuuau

SEQ ID NO: 29071 - RNA, 16 nt, Homo sapiens
aauagugucugaugaa

SEQ ID NO: 29072 - RNA, 16 nt, Homo sapiens
cuucaugcauuugcac

SEQ ID NO: 29073 - RNA, 11 nt, Homo sapiens
aaaagacauaa

SEQ ID NO: 29074 - RNA, 20 nt, Homo sapiens
cauauguuuuuguaaguuua

SEQ ID NO: 29075 - RNA, 12 nt, Homo sapiens
agcgacagugag

SEQ ID NO: 29076 - RNA, 18 nt, Homo sapiens
ugauuccaccuacaugag

SEQ ID NO: 29077 - RNA, 12 nt, Homo sapiens
cggaacaguauc

SEQ ID NO: 29078 - RNA, 18 nt, Homo sapiens
accaccacccuugccaug

SEQ ID NO: 29079 - RNA, 16 nt, Homo sapiens
aguuaagcaacaucua

SEQ ID NO: 29080 - RNA, 22 nt, Homo sapiens
gagcaagacucugucucaaaaa

SEQ ID NO: 29081 - RNA, 12 nt, Homo sapiens
ugacaacuguga

SEQ ID NO: 29082 - RNA, 19 nt, Homo sapiens
ugaaaagauuaugaucuca

SEQ ID NO: 29083 - RNA, 19 nt, Homo sapiens
ccagugagacagcucugca

SEQ ID NO: 29084 - RNA, 23 nt, Homo sapiens
aauauuguugacaacugugacug

SEQ ID NO: 29085 - RNA, 16 nt, Homo sapiens
cacagcugaacuuguu

SEQ ID NO: 29086 - RNA, 15 nt, Homo sapiens
agcagaacagugauu

SEQ ID NO: 29087 - RNA, 18 nt, Homo sapiens
cucugggucucagugucc

SEQ ID NO: 29088 - RNA, 12 nt, Homo sapiens
uaacuagaauuu

SEQ ID NO: 29089 - RNA, 21 nt, Homo sapiens
ucaucuguaaaauggagacac

SEQ ID NO: 29090 - RNA, 20 nt, Homo sapiens
aaucugagccagugcuuuaa

SEQ ID NO: 29091 - RNA, 14 nt, Homo sapiens
accagccaaccugg

SEQ ID NO: 29092 - RNA, 17 nt, Homo sapiens
aguaacggaacaguauc

SEQ ID NO: 29093 - RNA, 21 nt, Homo sapiens
gccuggaucucacaagcacuu

SEQ ID NO: 29094 - RNA, 12 nt, Homo sapiens
aacccugucucu

SEQ ID NO: 29095 - RNA, 18 nt, Homo sapiens
caagugaaaaacauccag

SEQ ID NO: 29096 - RNA, 15 nt, Homo sapiens
cuugggcaggucaca

SEQ ID NO: 29097 - RNA, 17 nt, Homo sapiens
gaaauagugucugauga

SEQ ID NO: 29098 - RNA, 22 nt, Homo sapiens
gaccaauaaccaugcccaagaa

SEQ ID NO: 29099 - RNA, 22 nt, Homo sapiens
auucaccuuccagugucucgga

SEQ ID NO: 29100 - RNA, 15 nt, Homo sapiens
ucagacagaacuuga

SEQ ID NO: 29101 - RNA, 22 nt, Homo sapiens
aagagaauauuagcuuuacugu

SEQ ID NO: 29102 - RNA, 15 nt, Homo sapiens
cuucauguacaucca

SEQ ID NO: 29103 - RNA, 12 nt, Homo sapiens
ucccuuuuacau

SEQ ID NO: 29104 - RNA, 13 nt, Homo sapiens
aguacagacuuuu

SEQ ID NO: 29105 - RNA, 17 nt, Homo sapiens
auccugugacugucuca

SEQ ID NO: 29106 - RNA, 13 nt, Homo sapiens
uccuucagccuga

SEQ ID NO: 29107 - RNA, 23 nt, Homo sapiens
gaggauguguggcauuuucacuu

SEQ ID NO: 29108 - RNA, 18 nt, Homo sapiens
cgaaugguuccauucucu

SEQ ID NO: 29109 - RNA, 18 nt, Homo sapiens
gcaggauagagugggaca

SEQ ID NO: 29110 - RNA, 14 nt, Homo sapiens
aaacaguagugaua

SEQ ID NO: 29111 - RNA, 16 nt, Homo sapiens
auuuuucucuaacuca

SEQ ID NO: 29112 - RNA, 15 nt, Homo sapiens
ggagaaucacuugaa

SEQ ID NO: 29113 - RNA, 16 nt, Homo sapiens
ggaguggcauguauga

SEQ ID NO: 29114 - RNA, 10 nt, Homo sapiens
cauacugcug

SEQ ID NO: 29115 - RNA, 17 nt, Homo sapiens
cuggacuuuccagagac

SEQ ID NO: 29116 - RNA, 21 nt, Homo sapiens
gaugccccagggaccuuugua

SEQ ID NO: 29117 - RNA, 15 nt, Homo sapiens
aaucccagcuacuug

SEQ ID NO: 29118 - RNA, 21 nt, Homo sapiens
gugcuuuccguggcacugcau

SEQ ID NO: 29119 - RNA, 15 nt, Homo sapiens
uauccugugacuguc

SEQ ID NO: 29120 - RNA, 21 nt, Homo sapiens
uaaauaaauguaucuuauuca

SEQ ID NO: 29121 - RNA, 18 nt, Homo sapiens
ggaguuaggcuauucaca

SEQ ID NO: 29122 - RNA, 11 nt, Homo sapiens
aaugugcaaua

SEQ ID NO: 29123 - RNA, 15 nt, Homo sapiens
auaguuguaccgcaa

SEQ ID NO: 29124 - RNA, 17 nt, Homo sapiens
auuuauuaccucugaua

SEQ ID NO: 29125 - RNA, 23 nt, Homo sapiens
aggcuggucucgaacugcuggau

SEQ ID NO: 29126 - RNA, 16 nt, Homo sapiens
uuuuuaugugcaauaa

SEQ ID NO: 29127 - RNA, 15 nt, Homo sapiens
ucucacaagcacuuu

SEQ ID NO: 29128 - RNA, 20 nt, Homo sapiens
gugauuacccucugggucuc

SEQ ID NO: 29129 - RNA, 23 nt, Homo sapiens
gaugaaaacauagcaucucagga

SEQ ID NO: 29130 - RNA, 14 nt, Homo sapiens
gugaaauaagccag

SEQ ID NO: 29131 - RNA, 18 nt, Homo sapiens
caagugauccgcccaucu

SEQ ID NO: 29132 - RNA, 14 nt, Homo sapiens
aaauaaaagcacuu

SEQ ID NO: 29133 - RNA, 20 nt, Homo sapiens
cuggaucucacaagcacuuu

SEQ ID NO: 29134 - RNA, 22 nt, Homo sapiens
gaaagcuguggccagcuuguua

SEQ ID NO: 29135 - RNA, 15 nt, Homo sapiens
agccaccaaacccgg

SEQ ID NO: 29136 - RNA, 14 nt, Homo sapiens
acccaaaguaucag

SEQ ID NO: 29137 - RNA, 16 nt, Homo sapiens
auuuuaaguaauuuca

SEQ ID NO: 29138 - RNA, 13 nt, Homo sapiens
aggucuccaaaau

SEQ ID NO: 29139 - RNA, 14 nt, Homo sapiens
auuuauugagcacc

SEQ ID NO: 29140 - RNA, 21 nt, Homo sapiens
gaacugcuggauucaagugau

SEQ ID NO: 29141 - RNA, 15 nt, Homo sapiens
caggcuccaaacugg

SEQ ID NO: 29142 - RNA, 15 nt, Homo sapiens
gcaggcgugaccuga

SEQ ID NO: 29143 - RNA, 14 nt, Homo sapiens
gcugcucugugguc

SEQ ID NO: 29144 - RNA, 19 nt, Homo sapiens
gguauuuauugagcaccug

SEQ ID NO: 29145 - RNA, 18 nt, Homo sapiens
guuuaaugggcacagggu

SEQ ID NO: 29146 - RNA, 18 nt, Homo sapiens
ccaaacuggagcuugaaa

SEQ ID NO: 29147 - RNA, 18 nt, Homo sapiens
uaauuuuaaguaauuuca

SEQ ID NO: 29148 - RNA, 16 nt, Homo sapiens
uuccuuaucacugaca

SEQ ID NO: 29149 - RNA, 13 nt, Homo sapiens
uuuaaagggaugg

SEQ ID NO: 29150 - RNA, 20 nt, Homo sapiens
uuguucccaaauuucauacc

SEQ ID NO: 29151 - RNA, 16 nt, Homo sapiens
uuguuuaaaaucauuu

SEQ ID NO: 29152 - RNA, 14 nt, Homo sapiens
uuguuuucauuauc

SEQ ID NO: 29153 - RNA, 18 nt, Homo sapiens
uggaauauguaaauagaa

SEQ ID NO: 29154 - RNA, 16 nt, Homo sapiens
uggacuuaaaaucuaa

SEQ ID NO: 29155 - RNA, 21 nt, Homo sapiens
uguuaaaagaugaaaauauuu

SEQ ID NO: 29156 - RNA, 17 nt, Homo sapiens
uguacauuuccaaauuc

SEQ ID NO: 29157 - RNA, 18 nt, Homo sapiens
uguacauuuccaaauuca

SEQ ID NO: 29158 - RNA, 23 nt, Homo sapiens
uggggguaauaagagcaguagca

SEQ ID NO: 29159 - RNA, 21 nt, Homo sapiens
ucuggaaaccacauggcuuca

SEQ ID NO: 29160 - RNA, 23 nt, Homo sapiens
ucugcccugcuuuugcuagguca

SEQ ID NO: 29161 - RNA, 22 nt, Homo sapiens
ucugaagaguggguuucacaag

SEQ ID NO: 29162 - RNA, 15 nt, Homo sapiens
ucuaaguaaaaccac

SEQ ID NO: 29163 - RNA, 13 nt, Homo sapiens
ucucuaacucaga

SEQ ID NO: 29164 - RNA, 13 nt, Homo sapiens
uccuuccuuauca

SEQ ID NO: 29165 - RNA, 15 nt, Homo sapiens
uccuucugcccugcu

SEQ ID NO: 29166 - RNA, 16 nt, Homo sapiens
uccuucugcccugcuu

SEQ ID NO: 29167 - RNA, 12 nt, Homo sapiens
ucccugagcagg

SEQ ID NO: 29168 - RNA, 13 nt, Homo sapiens
ucccugagcagga

SEQ ID NO: 29169 - RNA, 16 nt, Homo sapiens
ugcuacaaaaacacag

SEQ ID NO: 29170 - RNA, 17 nt, Homo sapiens
ugaacacaucagcuugc

SEQ ID NO: 29171 - RNA, 22 nt, Homo sapiens
uccaaagcugaauacauucugc

SEQ ID NO: 29172 - RNA, 14 nt, Homo sapiens
uccaaauucacaag

SEQ ID NO: 29173 - RNA, 17 nt, Homo sapiens
ucaguccucuuucaaag

SEQ ID NO: 29174 - RNA, 18 nt, Homo sapiens
ucaguccucuuucaaagg

SEQ ID NO: 29175 - RNA, 17 nt, Homo sapiens
ucccaaauuucauaccu

SEQ ID NO: 29176 - RNA, 17 nt, Homo sapiens
ucagaucauuucaaaac

SEQ ID NO: 29177 - RNA, 21 nt, Homo sapiens
uaaaaaaaaaaaaaaagccaa

SEQ ID NO: 29178 - RNA, 15 nt, Homo sapiens
guuuaaaaucauuuc

SEQ ID NO: 29179 - RNA, 20 nt, Homo sapiens
uaucuuguuuuuccacuacu

SEQ ID NO: 29180 - RNA, 17 nt, Homo sapiens
uacucuguuccuucaca

SEQ ID NO: 29181 - RNA, 21 nt, Homo sapiens
uaccugugaaauaguucaaag

SEQ ID NO: 29182 - RNA, 16 nt, Homo sapiens
gugggagaauucuuac

SEQ ID NO: 29183 - RNA, 15 nt, Homo sapiens
gucacuagggcaggg

SEQ ID NO: 29184 - RNA, 15 nt, Homo sapiens
guccaagcauaccaa

SEQ ID NO: 29185 - RNA, 15 nt, Homo sapiens
gugaacacaucagcu

SEQ ID NO: 29186 - RNA, 22 nt, Homo sapiens
gucugaaauuuucuagaauacu

SEQ ID NO: 29187 - RNA, 21 nt, Homo sapiens
gucuuaauuaaaagaauauuu

SEQ ID NO: 29188 - RNA, 13 nt, Homo sapiens
ggucggguuuuau

SEQ ID NO: 29189 - RNA, 20 nt, Homo sapiens
gcuacucuguuccuucacau

SEQ ID NO: 29190 - RNA, 13 nt, Homo sapiens
gcucccuggaaga

SEQ ID NO: 29191 - RNA, 14 nt, Homo sapiens
gcucaacauaacau

SEQ ID NO: 29192 - RNA, 12 nt, Homo sapiens
gcuguauucuuc

SEQ ID NO: 29193 - RNA, 19 nt, Homo sapiens
gcugauugucugaaauuuu

SEQ ID NO: 29194 - RNA, 10 nt, Homo sapiens
ggcaucaugc

SEQ ID NO: 29195 - RNA, 21 nt, Homo sapiens
ggcaguuuuccauugguuuac

SEQ ID NO: 29196 - RNA, 15 nt, Homo sapiens
ggaacauaaaauaca

SEQ ID NO: 29197 - RNA, 16 nt, Homo sapiens
ggauaugagauguagc

SEQ ID NO: 29198 - RNA, 16 nt, Homo sapiens
gcaucucugaacauuu

SEQ ID NO: 29199 - RNA, 13 nt, Homo sapiens
gcauaaagucagu

SEQ ID NO: 29200 - RNA, 13 nt, Homo sapiens
gcaguagcagcag

SEQ ID NO: 29201 - RNA, 12 nt, Homo sapiens
gccagcaaauuc

SEQ ID NO: 29202 - RNA, 13 nt, Homo sapiens
gccagcaaauucg

SEQ ID NO: 29203 - RNA, 17 nt, Homo sapiens
gccuugguauagcauau

SEQ ID NO: 29204 - RNA, 17 nt, Homo sapiens
gccuugcuccuggcugg

SEQ ID NO: 29205 - RNA, 16 nt, Homo sapiens
gccuagcccacuggcu

SEQ ID NO: 29206 - RNA, 19 nt, Homo sapiens
gccuagcccacuggcuccc

SEQ ID NO: 29207 - RNA, 18 nt, Homo sapiens
gaucauuucaaaacucau

SEQ ID NO: 29208 - RNA, 21 nt, Homo sapiens
gauccccguguuacugccuau

SEQ ID NO: 29209 - RNA, 14 nt, Homo sapiens
gauaucccaggaaa

SEQ ID NO: 29210 - RNA, 10 nt, Homo sapiens
gagcaaaagu

SEQ ID NO: 29211 - RNA, 12 nt, Homo sapiens
gagcaguagcag

SEQ ID NO: 29212 - RNA, 14 nt, Homo sapiens
gcaaaugagccgga

SEQ ID NO: 29213 - RNA, 19 nt, Homo sapiens
gcaaaugagccggagcccc

SEQ ID NO: 29214 - RNA, 17 nt, Homo sapiens
gcaaauuccaauacauu

SEQ ID NO: 29215 - RNA, 22 nt, Homo sapiens
gauucccugagcaggauuuuaa

SEQ ID NO: 29216 - RNA, 23 nt, Homo sapiens
gauggguuugacaagguucuucc

SEQ ID NO: 29217 - RNA, 15 nt, Homo sapiens
gcacacagugcuuuc

SEQ ID NO: 29218 - RNA, 16 nt, Homo sapiens
gcacacagugcuuucc

SEQ ID NO: 29219 - RNA, 16 nt, Homo sapiens
gcacuaaucaauacuu

SEQ ID NO: 29220 - RNA, 13 nt, Homo sapiens
gaacacaucagcu

SEQ ID NO: 29221 - RNA, 14 nt, Homo sapiens
gaacacaucagcuu

SEQ ID NO: 29222 - RNA, 21 nt, Homo sapiens
gaaaugacuaaaaaacaaaga

SEQ ID NO: 29223 - RNA, 20 nt, Homo sapiens
gaauuuuucucuaacucaga

SEQ ID NO: 29224 - RNA, 14 nt, Homo sapiens
gagacagcaggucu

SEQ ID NO: 29225 - RNA, 15 nt, Homo sapiens
gacccccaucccaug

SEQ ID NO: 29226 - RNA, 16 nt, Homo sapiens
gacccccaucccaugg

SEQ ID NO: 29227 - RNA, 22 nt, Homo sapiens
gacauguuuacaaaccucaagc

SEQ ID NO: 29228 - RNA, 18 nt, Homo sapiens
auguagauaaacucagaa

SEQ ID NO: 29229 - RNA, 19 nt, Homo sapiens
auguagauaaacucagaaa

SEQ ID NO: 29230 - RNA, 14 nt, Homo sapiens
auucaaaaguugaa

SEQ ID NO: 29231 - RNA, 18 nt, Homo sapiens
auucaaacuaauagaauu

SEQ ID NO: 29232 - RNA, 23 nt, Homo sapiens
auggggguaauaagagcaguagc

SEQ ID NO: 29233 - RNA, 16 nt, Homo sapiens
caaaugacccccaucc

SEQ ID NO: 29234 - RNA, 13 nt, Homo sapiens
caacacgagcagg

SEQ ID NO: 29235 - RNA, 14 nt, Homo sapiens
caacacgagcaggc

SEQ ID NO: 29236 - RNA, 16 nt, Homo sapiens
caacauuaaaacaaua

SEQ ID NO: 29237 - RNA, 18 nt, Homo sapiens
caaccacucauucaaaag

SEQ ID NO: 29238 - RNA, 13 nt, Homo sapiens
caaucaucaaccc

SEQ ID NO: 29239 - RNA, 14 nt, Homo sapiens
caaagacaaauucu

SEQ ID NO: 29240 - RNA, 19 nt, Homo sapiens
auuuuccuggacaguuuuc

SEQ ID NO: 29241 - RNA, 22 nt, Homo sapiens
caaaaacacagcaagggugaug

SEQ ID NO: 29242 - RNA, 23 nt, Homo sapiens
caaaaacacagcaagggugaugg

SEQ ID NO: 29243 - RNA, 24 nt, Homo sapiens
caaaaacacagcaagggugauggg

SEQ ID NO: 29244 - RNA, 13 nt, Homo sapiens
cacaucagcuugc

SEQ ID NO: 29245 - RNA, 20 nt, Homo sapiens
cacuagcuaauaucaauaga

SEQ ID NO: 29246 - RNA, 13 nt, Homo sapiens
cacuagggcaggg

SEQ ID NO: 29247 - RNA, 13 nt, Homo sapiens
auacuaauaaaau

SEQ ID NO: 29248 - RNA, 12 nt, Homo sapiens
auacaaucauca

SEQ ID NO: 29249 - RNA, 13 nt, Homo sapiens
auaaauuuuccca

SEQ ID NO: 29250 - RNA, 13 nt, Homo sapiens
auacaaucaucaa

SEQ ID NO: 29251 - RNA, 13 nt, Homo sapiens
auccaaagcugaa

SEQ ID NO: 29252 - RNA, 20 nt, Homo sapiens
auccccguguuacugccuau

SEQ ID NO: 29253 - RNA, 13 nt, Homo sapiens
aucauaugggaua

SEQ ID NO: 29254 - RNA, 19 nt, Homo sapiens
agcuugaaacugagaugug

SEQ ID NO: 29255 - RNA, 20 nt, Homo sapiens
agcuugaaacugagauguga

SEQ ID NO: 29256 - RNA, 20 nt, Homo sapiens
aggucacagaggaucugcuu

SEQ ID NO: 29257 - RNA, 17 nt, Homo sapiens
agggauggcaagaugug

SEQ ID NO: 29258 - RNA, 19 nt, Homo sapiens
agggauggcaagauguggg

SEQ ID NO: 29259 - RNA, 14 nt, Homo sapiens
aguagauuaagaga

SEQ ID NO: 29260 - RNA, 12 nt, Homo sapiens
aguagcagcagc

SEQ ID NO: 29261 - RNA, 15 nt, Homo sapiens
aguagcagcagcauc

SEQ ID NO: 29262 - RNA, 15 nt, Homo sapiens
acugcacugucaaga

SEQ ID NO: 29263 - RNA, 20 nt, Homo sapiens
acugcacugucaagaugaug

SEQ ID NO: 29264 - RNA, 18 nt, Homo sapiens
uuuaaaauuaaagcuaaa

SEQ ID NO: 29265 - RNA, 11 nt, Homo sapiens
agauagcaggg

SEQ ID NO: 29266 - RNA, 22 nt, Homo sapiens
agcauuguaaaugugcuuuuaa

SEQ ID NO: 29267 - RNA, 12 nt, Homo sapiens
agccaaaaacca

SEQ ID NO: 29268 - RNA, 15 nt, Homo sapiens
agcaucucugaacau

SEQ ID NO: 29269 - RNA, 17 nt, Homo sapiens
agcaugggccuagccca

SEQ ID NO: 29270 - RNA, 12 nt, Homo sapiens
agaagagaauau

SEQ ID NO: 29271 - RNA, 19 nt, Homo sapiens
acuguuuggauaugagaug

SEQ ID NO: 29272 - RNA, 12 nt, Homo sapiens
agaggcagcuug

SEQ ID NO: 29273 - RNA, 12 nt, Homo sapiens
acacgagcaggc

SEQ ID NO: 29274 - RNA, 16 nt, Homo sapiens
acacucaaaucaagaa

SEQ ID NO: 29275 - RNA, 12 nt, Homo sapiens
uugcaaccccau

SEQ ID NO: 29276 - RNA, 15 nt, Homo sapiens
acagaagagugacau

SEQ ID NO: 29277 - RNA, 14 nt, Homo sapiens
accccaucauccuc

SEQ ID NO: 29278 - RNA, 14 nt, Homo sapiens
acauuggcuauuua

SEQ ID NO: 29279 - RNA, 20 nt, Homo sapiens
accacagcaguugaaaagac

SEQ ID NO: 29280 - RNA, 19 nt, Homo sapiens
uguacauuuccaaauucac

SEQ ID NO: 29281 - RNA, 20 nt, Homo sapiens
uguuaaaagaugaaaauauu

SEQ ID NO: 29282 - RNA, 21 nt, Homo sapiens
uggcgacaguuuuccuucuca

SEQ ID NO: 29283 - RNA, 20 nt, Homo sapiens
cgcaggcccccaggugccag

SEQ ID NO: 29284 - RNA, 17 nt, Homo sapiens
cuaaaaaacaaagaaga

SEQ ID NO: 29285 - RNA, 11 nt, Homo sapiens
cggagauaucc

SEQ ID NO: 29286 - RNA, 21 nt, Homo sapiens
cggagccccuugggcagguca

SEQ ID NO: 29287 - RNA, 16 nt, Homo sapiens
cuacucuguuccuuca

SEQ ID NO: 29288 - RNA, 13 nt, Homo sapiens
cuauauuaucaug

SEQ ID NO: 29289 - RNA, 19 nt, Homo sapiens
cuaauaaaauacauacuau

SEQ ID NO: 29290 - RNA, 16 nt, Homo sapiens
cuacaaaaacacagca

SEQ ID NO: 29291 - RNA, 11 nt, Homo sapiens
cucaaaacugc

SEQ ID NO: 29292 - RNA, 18 nt, Homo sapiens
cucaaaauaccaugccau

SEQ ID NO: 29293 - RNA, 17 nt, Homo sapiens
cucagaaacaucaguua

SEQ ID NO: 29294 - RNA, 17 nt, Homo sapiens
cuuccauuuggaaucau

SEQ ID NO: 29295 - RNA, 15 nt, Homo sapiens
cuuggacucauuuua

SEQ ID NO: 29296 - RNA, 13 nt, Homo sapiens
cuuauuucauuuc

SEQ ID NO: 29297 - RNA, 16 nt, Homo sapiens
cuuccuuaucacugac

SEQ ID NO: 29298 - RNA, 21 nt, Homo sapiens
cuucuaaguaaaaccacagca

SEQ ID NO: 29299 - RNA, 19 nt, Homo sapiens
cugucccugcagacaugag

SEQ ID NO: 29300 - RNA, 15 nt, Homo sapiens
cugugaaauaguuca

SEQ ID NO: 29301 - RNA, 14 nt, Homo sapiens
cuguuaaaagauga

SEQ ID NO: 29302 - RNA, 15 nt, Homo sapiens
cuguuaaaagaugaa

SEQ ID NO: 29303 - RNA, 23 nt, Homo sapiens
cugucccagcgagggacaccgag

SEQ ID NO: 29304 - RNA, 16 nt, Homo sapiens
cuggauuugcaacccc

SEQ ID NO: 29305 - RNA, 20 nt, Homo sapiens
cuggauuugcaaccccauca

SEQ ID NO: 29306 - RNA, 21 nt, Homo sapiens
cuggcucccuggaagagauca

SEQ ID NO: 29307 - RNA, 17 nt, Homo sapiens
cugcacugucaagauga

SEQ ID NO: 29308 - RNA, 18 nt, Homo sapiens
cugcacugucaagaugau

SEQ ID NO: 29309 - RNA, 16 nt, Homo sapiens
cugauuuuccuggaca

SEQ ID NO: 29310 - RNA, 11 nt, Homo sapiens
cugcaucagcu

SEQ ID NO: 29311 - RNA, 12 nt, Homo sapiens
cugcaucagcug

SEQ ID NO: 29312 - RNA, 21 nt, Homo sapiens
cugcuacucuguuccuucaca

SEQ ID NO: 29313 - RNA, 14 nt, Homo sapiens
cugcuuucaucuug

SEQ ID NO: 29314 - RNA, 11 nt, Homo sapiens
cucgaaucacu

SEQ ID NO: 29315 - RNA, 21 nt, Homo sapiens
cucauuuuuguuuucauuauc

SEQ ID NO: 29316 - RNA, 21 nt, Homo sapiens
ccuguuaaaagaugaaaauau

SEQ ID NO: 29317 - RNA, 22 nt, Homo sapiens
ccguguuacugccuaucagcau

SEQ ID NO: 29318 - RNA, 16 nt, Homo sapiens
ccuaaguuucaguuga

SEQ ID NO: 29319 - RNA, 11 nt, Homo sapiens
ccacucauuca

SEQ ID NO: 29320 - RNA, 15 nt, Homo sapiens
ccagccuugcuccug

SEQ ID NO: 29321 - RNA, 16 nt, Homo sapiens
ccagccuugcuccugg

SEQ ID NO: 29322 - RNA, 21 nt, Homo sapiens
ccauggggguaauaagagcag

SEQ ID NO: 29323 - RNA, 22 nt, Homo sapiens
cccaagggaguuaggcuauuca

SEQ ID NO: 29324 - RNA, 11 nt, Homo sapiens
cccucaagaca

SEQ ID NO: 29325 - RNA, 12 nt, Homo sapiens
cccucaagacaa

SEQ ID NO: 29326 - RNA, 14 nt, Homo sapiens
ccgaaacuaccagc

SEQ ID NO: 29327 - RNA, 15 nt, Homo sapiens
ccgaaacuaccagcc

SEQ ID NO: 29328 - RNA, 19 nt, Homo sapiens
cauguuuucuuugcuuuaa

SEQ ID NO: 29329 - RNA, 13 nt, Homo sapiens
cauuccauuugcu

SEQ ID NO: 29330 - RNA, 21 nt, Homo sapiens
cauuauuggacuuccauuugg

SEQ ID NO: 29331 - RNA, 20 nt, Homo sapiens
cauuugcgaaugguuccauu

SEQ ID NO: 29332 - RNA, 20 nt, Homo sapiens
ccacaacuauauuaucaugc

SEQ ID NO: 29333 - RNA, 23 nt, Homo sapiens
cauggggguaauaagagcaguag

SEQ ID NO: 29334 - RNA, 12 nt, Homo sapiens
caucuuucacau

SEQ ID NO: 29335 - RNA, 19 nt, Homo sapiens
cauccagauacacccaaag

SEQ ID NO: 29336 - RNA, 13 nt, Homo sapiens
caguugaaaagac

SEQ ID NO: 29337 - RNA, 19 nt, Homo sapiens
cauagauucccugagcagg

SEQ ID NO: 29338 - RNA, 19 nt, Homo sapiens
caguuuuccuucucaucug

SEQ ID NO: 29339 - RNA, 23 nt, Homo sapiens
caguuacucugaagggcaucaug

SEQ ID NO: 29340 - RNA, 12 nt, Homo sapiens
caggucacacaa

SEQ ID NO: 29341 - RNA, 14 nt, Homo sapiens
cagcuugaaacuga

SEQ ID NO: 29342 - RNA, 19 nt, Homo sapiens
guuuugugaagaaacauuu

SEQ ID NO: 29343 - RNA, 11 nt, Homo sapiens
guuuuucacau

SEQ ID NO: 29344 - RNA, 12 nt, Homo sapiens
guuuuucacauu

SEQ ID NO: 29345 - RNA, 13 nt, Homo sapiens
guuuuucacauuu

SEQ ID NO: 29346 - RNA, 22 nt, Homo sapiens
uaaaaaaaaaaaaaaagccaaa

SEQ ID NO: 29347 - RNA, 23 nt, Homo sapiens
uaaaaaaaaaaaaaaagccaaaa

SEQ ID NO: 29348 - RNA, 15 nt, Homo sapiens
guuauggcuuaauga

SEQ ID NO: 29349 - RNA, 12 nt, Homo sapiens
guugaaaagacu

SEQ ID NO: 29350 - RNA, 12 nt, Homo sapiens
guucaaauguug

SEQ ID NO: 29351 - RNA, 21 nt, Homo sapiens
gugcuuuuaaaaaaaaauacu

SEQ ID NO: 29352 - RNA, 22 nt, Homo sapiens
gucuucacaacagauuauuacc

SEQ ID NO: 29353 - RNA, 23 nt, Homo sapiens
uaggugcuacaaaaacacagcaa

SEQ ID NO: 29354 - RNA, 18 nt, Homo sapiens
uagauucccugagcagga

SEQ ID NO: 29355 - RNA, 19 nt, Homo sapiens
uagauucccugagcaggau

SEQ ID NO: 29356 - RNA, 15 nt, Homo sapiens
uaccuuuuuccuucc

SEQ ID NO: 29357 - RNA, 16 nt, Homo sapiens
uacaccagagauaaua

SEQ ID NO: 29358 - RNA, 20 nt, Homo sapiens
uaaguuuaugcauacaguaa

SEQ ID NO: 29359 - RNA, 16 nt, Homo sapiens
uaugagaaucagauca

SEQ ID NO: 29360 - RNA, 21 nt, Homo sapiens
uaugagaaucagaucauuuca

SEQ ID NO: 29361 - RNA, 16 nt, Homo sapiens
ucacaaacucauccau

SEQ ID NO: 29362 - RNA, 19 nt, Homo sapiens
ucccaaauuucauaccuau

SEQ ID NO: 29363 - RNA, 23 nt, Homo sapiens
uccuagugaaagaggcagcuuga

SEQ ID NO: 29364 - RNA, 12 nt, Homo sapiens
ucuacauacuau

SEQ ID NO: 29365 - RNA, 19 nt, Homo sapiens
ugauauccaaagcugaaua

SEQ ID NO: 29366 - RNA, 14 nt, Homo sapiens
ugcauacaaucuga

SEQ ID NO: 29367 - RNA, 14 nt, Homo sapiens
ucucuaacucagaa

SEQ ID NO: 29368 - RNA, 15 nt, Homo sapiens
ucucuaacucagaaa

SEQ ID NO: 29369 - RNA, 14 nt, Homo sapiens
ucuggaaaccacau

SEQ ID NO: 29370 - RNA, 15 nt, Homo sapiens
ugacacuagcuaaua

SEQ ID NO: 29371 - RNA, 12 nt, Homo sapiens
ggucggguuuua

SEQ ID NO: 29372 - RNA, 15 nt, Homo sapiens
ggguaauaagagcag

SEQ ID NO: 29373 - RNA, 22 nt, Homo sapiens
ggguaauaagagcaguagcagc

SEQ ID NO: 29374 - RNA, 13 nt, Homo sapiens
guagcagcagcau

SEQ ID NO: 29375 - RNA, 15 nt, Homo sapiens
guagauaaacucaga

SEQ ID NO: 29376 - RNA, 10 nt, Homo sapiens
gggaaacugc

SEQ ID NO: 29377 - RNA, 11 nt, Homo sapiens
gggaaacugcc

SEQ ID NO: 29378 - RNA, 12 nt, Homo sapiens
ggcuacugucag

SEQ ID NO: 29379 - RNA, 13 nt, Homo sapiens
ggcagggacagga

SEQ ID NO: 29380 - RNA, 17 nt, Homo sapiens
ggcagggacaggauaag

SEQ ID NO: 29381 - RNA, 21 nt, Homo sapiens
gcuacucuguuccuucacauc

SEQ ID NO: 29382 - RNA, 13 nt, Homo sapiens
ggaacugcuugac

SEQ ID NO: 29383 - RNA, 13 nt, Homo sapiens
gcuguauucuucu

SEQ ID NO: 29384 - RNA, 17 nt, Homo sapiens
ggagaagagcuguucac

SEQ ID NO: 29385 - RNA, 18 nt, Homo sapiens
ggagagaagauagcaggg

SEQ ID NO: 29386 - RNA, 12 nt, Homo sapiens
ggauuugcaacc

SEQ ID NO: 29387 - RNA, 13 nt, Homo sapiens
ggauuugcaaccc

SEQ ID NO: 29388 - RNA, 14 nt, Homo sapiens
ggauuugcaacccc

SEQ ID NO: 29389 - RNA, 21 nt, Homo sapiens
gaaaucaaauaugcaaagcac

SEQ ID NO: 29390 - RNA, 19 nt, Homo sapiens
gaaaugacuaaaaaacaaa

SEQ ID NO: 29391 - RNA, 23 nt, Homo sapiens
cuuuaaaaaaaaaaaaaaagcca

SEQ ID NO: 29392 - RNA, 24 nt, Homo sapiens
cuuuaaaaaaaaaaaaaaagccaa

SEQ ID NO: 29393 - RNA, 19 nt, Homo sapiens
gaaacugccagcaacgcag

SEQ ID NO: 29394 - RNA, 16 nt, Homo sapiens
cuguuaaaagaugaaa

SEQ ID NO: 29395 - RNA, 19 nt, Homo sapiens
cuuauuaaaacucauuuuu

SEQ ID NO: 29396 - RNA, 19 nt, Homo sapiens
cuucccuuuuacauacugc

SEQ ID NO: 29397 - RNA, 11 nt, Homo sapiens
cuuccuuauca

SEQ ID NO: 29398 - RNA, 15 nt, Homo sapiens
cuuccuuaucacuga

SEQ ID NO: 29399 - RNA, 23 nt, Homo sapiens
cugagaugugaacacaucagcuu

SEQ ID NO: 29400 - RNA, 15 nt, Homo sapiens
cuggauuugcaaccc

SEQ ID NO: 29401 - RNA, 20 nt, Homo sapiens
cuggcgacaguuuuccuucu

SEQ ID NO: 29402 - RNA, 22 nt, Homo sapiens
cuggcgacaguuuuccuucuca

SEQ ID NO: 29403 - RNA, 16 nt, Homo sapiens
cuauuuaaagacaaag

SEQ ID NO: 29404 - RNA, 16 nt, Homo sapiens
cuaccagcccuacacc

SEQ ID NO: 29405 - RNA, 17 nt, Homo sapiens
gaauacauucugcuuuc

SEQ ID NO: 29406 - RNA, 19 nt, Homo sapiens
gaauacuaauaaaauacau

SEQ ID NO: 29407 - RNA, 20 nt, Homo sapiens
gaauuguuuuuauggaggcu

SEQ ID NO: 29408 - RNA, 15 nt, Homo sapiens
gacaaagacaaauuc

SEQ ID NO: 29409 - RNA, 16 nt, Homo sapiens
gacaaagacaaauucu

SEQ ID NO: 29410 - RNA, 16 nt, Homo sapiens
gacaaaugacccccau

SEQ ID NO: 29411 - RNA, 23 nt, Homo sapiens
gacauguuuacaaaccucaagcc

SEQ ID NO: 29412 - RNA, 20 nt, Homo sapiens
gacaggauaagagggauuag

SEQ ID NO: 29413 - RNA, 21 nt, Homo sapiens
gacaggauaagagggauuagg

SEQ ID NO: 29414 - RNA, 18 nt, Homo sapiens
acaacauuaaaacaauau

SEQ ID NO: 29415 - RNA, 17 nt, Homo sapiens
aauugcuaucgccauca

SEQ ID NO: 29416 - RNA, 14 nt, Homo sapiens
aauuaaagcuaaag

SEQ ID NO: 29417 - RNA, 20 nt, Homo sapiens
gaagagaauauuagcuuuac

SEQ ID NO: 29418 - RNA, 11 nt, Homo sapiens
gagcaaaaguu

SEQ ID NO: 29419 - RNA, 14 nt, Homo sapiens
gagcaguagcagca

SEQ ID NO: 29420 - RNA, 15 nt, Homo sapiens
gagcaguagcagcag

SEQ ID NO: 29421 - RNA, 17 nt, Homo sapiens
gagcaguagcagcagca

SEQ ID NO: 29422 - RNA, 14 nt, Homo sapiens
gagcagucagaaga

SEQ ID NO: 29423 - RNA, 19 nt, Homo sapiens
gaucauuucaaaacucauu

SEQ ID NO: 29424 - RNA, 15 nt, Homo sapiens
gaucuuuaaaauaca

SEQ ID NO: 29425 - RNA, 20 nt, Homo sapiens
gauaauaaaauucauuccau

SEQ ID NO: 29426 - RNA, 17 nt, Homo sapiens
gauagcagggcauggcu

SEQ ID NO: 29427 - RNA, 15 nt, Homo sapiens
gauaucccaggaaaa

SEQ ID NO: 29428 - RNA, 11 nt, Homo sapiens
gauaaaucagu

SEQ ID NO: 29429 - RNA, 13 nt, Homo sapiens
gccuccucucuca

SEQ ID NO: 29430 - RNA, 13 nt, Homo sapiens
gccggagccccuu

SEQ ID NO: 29431 - RNA, 14 nt, Homo sapiens
gccggagccccuug

SEQ ID NO: 29432 - RNA, 16 nt, Homo sapiens
gccuugcuccuggcug

SEQ ID NO: 29433 - RNA, 15 nt, Homo sapiens
gccuugguauagcau

SEQ ID NO: 29434 - RNA, 16 nt, Homo sapiens
gccuugguauagcaua

SEQ ID NO: 29435 - RNA, 13 nt, Homo sapiens
gcaguuuuccauu

SEQ ID NO: 29436 - RNA, 19 nt, Homo sapiens
gcaugggccuagcccacug

SEQ ID NO: 29437 - RNA, 15 nt, Homo sapiens
gcaucucugaacauu

SEQ ID NO: 29438 - RNA, 14 nt, Homo sapiens
gccagcaaauucgc

SEQ ID NO: 29439 - RNA, 23 nt, Homo sapiens
gcagauuucuuuccauugugggc

SEQ ID NO: 29440 - RNA, 16 nt, Homo sapiens
gauucccugagcagga

SEQ ID NO: 29441 - RNA, 15 nt, Homo sapiens
gcacuaaucaauacu

SEQ ID NO: 29442 - RNA, 16 nt, Homo sapiens
gcaaauuccaauacau

SEQ ID NO: 29443 - RNA, 21 nt, Homo sapiens
agcauaccaacacgagcaggc

SEQ ID NO: 29444 - RNA, 22 nt, Homo sapiens
agcauaccaacacgagcaggcu

SEQ ID NO: 29445 - RNA, 16 nt, Homo sapiens
agcaucucugaacauu

SEQ ID NO: 29446 - RNA, 12 nt, Homo sapiens
agcccuacacca

SEQ ID NO: 29447 - RNA, 13 nt, Homo sapiens
agaggcagcuuga

SEQ ID NO: 29448 - RNA, 23 nt, Homo sapiens
agcuaaaguaucuguauugcauu

SEQ ID NO: 29449 - RNA, 22 nt, Homo sapiens
agcugaauacauucugcuuuca

SEQ ID NO: 29450 - RNA, 12 nt, Homo sapiens
acuucacuuuuu

SEQ ID NO: 29451 - RNA, 17 nt, Homo sapiens
acuuaugaaccuuuaca

SEQ ID NO: 29452 - RNA, 9 nt, Homo sapiens
acuuuucca

SEQ ID NO: 29453 - RNA, 21 nt, Homo sapiens
acucauccauuaauguagaua

SEQ ID NO: 29454 - RNA, 14 nt, Homo sapiens
acugccuaucagca

SEQ ID NO: 29455 - RNA, 15 nt, Homo sapiens
acugccuaucagcau

SEQ ID NO: 29456 - RNA, 16 nt, Homo sapiens
acugcacugucaagau

SEQ ID NO: 29457 - RNA, 14 nt, Homo sapiens
acaaaaaaagcauu

SEQ ID NO: 29458 - RNA, 23 nt, Homo sapiens
aaugauuuuacggagauauccca

SEQ ID NO: 29459 - RNA, 17 nt, Homo sapiens
aauaguucaaagccaag

SEQ ID NO: 29460 - RNA, 12 nt, Homo sapiens
aaguccaagcau

SEQ ID NO: 29461 - RNA, 19 nt, Homo sapiens
acaguuuucugagaaagac

SEQ ID NO: 29462 - RNA, 16 nt, Homo sapiens
acaaagaagacaacau

SEQ ID NO: 29463 - RNA, 12 nt, Homo sapiens
acaaagacaaau

SEQ ID NO: 29464 - RNA, 11 nt, Homo sapiens
aagagcaguag

SEQ ID NO: 29465 - RNA, 16 nt, Homo sapiens
aacuggaaauaaaaga

SEQ ID NO: 29466 - RNA, 21 nt, Homo sapiens
aagaggauguguggcauuuuc

SEQ ID NO: 29467 - RNA, 17 nt, Homo sapiens
aaguaaaaccacagcag

SEQ ID NO: 29468 - RNA, 18 nt, Homo sapiens
aaguaaaaccacagcagu

SEQ ID NO: 29469 - RNA, 15 nt, Homo sapiens
aagccuguguuacug

SEQ ID NO: 29470 - RNA, 16 nt, Homo sapiens
aaggccagcaaauucg

SEQ ID NO: 29471 - RNA, 23 nt, Homo sapiens
aagcuagaaaaauuagaugacug

SEQ ID NO: 29472 - RNA, 20 nt, Homo sapiens
aagguaaaauugaaaggcau

SEQ ID NO: 29473 - RNA, 17 nt, Homo sapiens
aacucagaaacaucagu

SEQ ID NO: 29474 - RNA, 16 nt, Homo sapiens
aaagccaaaaaccaaa

SEQ ID NO: 29475 - RNA, 17 nt, Homo sapiens
aaagccaaaaaccaaau

SEQ ID NO: 29476 - RNA, 20 nt, Homo sapiens
aaacacuaaaaaggcaugua

SEQ ID NO: 29477 - RNA, 18 nt, Homo sapiens
aaaucacaaacucaucca

SEQ ID NO: 29478 - RNA, 17 nt, Homo sapiens
aaauggauaugacacau

SEQ ID NO: 29479 - RNA, 12 nt, Homo sapiens
aaagggauggca

SEQ ID NO: 29480 - RNA, 20 nt, Homo sapiens
aaaauucauuccauuugcug

SEQ ID NO: 29481 - RNA, 16 nt, Homo sapiens
aaagccuguguuacug

SEQ ID NO: 29482 - RNA, 16 nt, Homo sapiens
aucaaauaugcaaagc

SEQ ID NO: 29483 - RNA, 18 nt, Homo sapiens
aucaaauaugcaaagcac

SEQ ID NO: 29484 - RNA, 16 nt, Homo sapiens
auauugauaauaaaau

SEQ ID NO: 29485 - RNA, 19 nt, Homo sapiens
auccaaagcugaauacauu

SEQ ID NO: 29486 - RNA, 15 nt, Homo sapiens
aucaguuacucugaa

SEQ ID NO: 29487 - RNA, 21 nt, Homo sapiens
aucaguuacucugaagggcau

SEQ ID NO: 29488 - RNA, 17 nt, Homo sapiens
auccugucccuccucca

SEQ ID NO: 29489 - RNA, 17 nt, Homo sapiens
augugaacacaucagcu

SEQ ID NO: 29490 - RNA, 17 nt, Homo sapiens
auguagauaaacucaga

SEQ ID NO: 29491 - RNA, 13 nt, Homo sapiens
auggcaagaugug

SEQ ID NO: 29492 - RNA, 14 nt, Homo sapiens
auggcaagaugugg

SEQ ID NO: 29493 - RNA, 14 nt, Homo sapiens
auaaauuuucccaa

SEQ ID NO: 29494 - RNA, 15 nt, Homo sapiens
auagguuaccaguaa

SEQ ID NO: 29495 - RNA, 18 nt, Homo sapiens
auacaccagagauaauau

SEQ ID NO: 29496 - RNA, 19 nt, Homo sapiens
aggucacagaggaucugcu

SEQ ID NO: 29497 - RNA, 14 nt, Homo sapiens
agguagccaucaug

SEQ ID NO: 29498 - RNA, 18 nt, Homo sapiens
agggauggcaagaugugg

SEQ ID NO: 29499 - RNA, 12 nt, Homo sapiens
caaucaucaacc

SEQ ID NO: 29500 - RNA, 12 nt, Homo sapiens
cacaucagcuug

SEQ ID NO: 29501 - RNA, 19 nt, Homo sapiens
cacauuggcuauuuaaaga

SEQ ID NO: 29502 - RNA, 13 nt, Homo sapiens
auuuucacuuuug

SEQ ID NO: 29503 - RNA, 19 nt, Homo sapiens
caagccaucggagcugcua

SEQ ID NO: 29504 - RNA, 23 nt, Homo sapiens
caaguuguguuugauauccaaag

SEQ ID NO: 29505 - RNA, 14 nt, Homo sapiens
caaucaucaacccc

SEQ ID NO: 29506 - RNA, 16 nt, Homo sapiens
auugucugaaauuuuc

SEQ ID NO: 29507 - RNA, 11 nt, Homo sapiens
auuaauuugua

SEQ ID NO: 29508 - RNA, 13 nt, Homo sapiens
cauuaauguagau

SEQ ID NO: 29509 - RNA, 19 nt, Homo sapiens
caugcugccaauauccuaa

SEQ ID NO: 29510 - RNA, 13 nt, Homo sapiens
caucuuucacauu

SEQ ID NO: 29511 - RNA, 20 nt, Homo sapiens
cauagauucccugagcagga

SEQ ID NO: 29512 - RNA, 18 nt, Homo sapiens
caguuuucugagaaagac

SEQ ID NO: 29513 - RNA, 15 nt, Homo sapiens
caguuuuuauauaga

SEQ ID NO: 29514 - RNA, 19 nt, Homo sapiens
caggauuuuaaucuuuuuc

SEQ ID NO: 29515 - RNA, 14 nt, Homo sapiens
ccaacacgagcagg

SEQ ID NO: 29516 - RNA, 15 nt, Homo sapiens
ccaacacgagcaggc

SEQ ID NO: 29517 - RNA, 14 nt, Homo sapiens
cauuuccaaauuca

SEQ ID NO: 29518 - RNA, 14 nt, Homo sapiens
cauuccauuugcug

SEQ ID NO: 29519 - RNA, 16 nt, Homo sapiens
cauuucugcaucagcu

SEQ ID NO: 29520 - RNA, 15 nt, Homo sapiens
ccacauggcuucacc

SEQ ID NO: 29521 - RNA, 23 nt, Homo sapiens
ccguguuacugccuaucagcauu

SEQ ID NO: 29522 - RNA, 11 nt, Homo sapiens
ccuucauuuuu

SEQ ID NO: 29523 - RNA, 22 nt, Homo sapiens
ccuguuaaaagaugaaaauauu

SEQ ID NO: 29524 - RNA, 19 nt, Homo sapiens
uucacagccagacuggcac

SEQ ID NO: 29525 - RNA, 20 nt, Homo sapiens
gagcaggcuacugucagcuc

SEQ ID NO: 29526 - RNA, 22 nt, Homo sapiens
uuucaugaaaagauuaugaucu

SEQ ID NO: 29527 - RNA, 16 nt, Homo sapiens
acaguuuucugagaaa

SEQ ID NO: 29528 - RNA, 20 nt, Homo sapiens
caccagagauaauaugagaa

SEQ ID NO: 29529 - RNA, 16 nt, Homo sapiens
uuaucucaaaacugca

SEQ ID NO: 29530 - RNA, 13 nt, Homo sapiens
auguaacugcauu

SEQ ID NO: 29531 - RNA, 20 nt, Homo sapiens
ggccuccucucucaguuuuu

SEQ ID NO: 29532 - RNA, 21 nt, Homo sapiens
ccugucccugcagacaugaga

SEQ ID NO: 29533 - RNA, 21 nt, Homo sapiens
cuuugcuuuaaguguaacugg

SEQ ID NO: 29534 - RNA, 13 nt, Homo sapiens
uggcacugcauac

SEQ ID NO: 29535 - RNA, 17 nt, Homo sapiens
agcauuguaaaugugcu

SEQ ID NO: 29536 - RNA, 19 nt, Homo sapiens
gguaucaaccaaauggagu

SEQ ID NO: 29537 - RNA, 14 nt, Homo sapiens
aacugcacugucaa

SEQ ID NO: 29538 - RNA, 19 nt, Homo sapiens
uaaaaucauuucugcauca

SEQ ID NO: 29539 - RNA, 16 nt, Homo sapiens
auucccuccugcuacu

SEQ ID NO: 29540 - RNA, 20 nt, Homo sapiens
acagccagacuggcacaguu

SEQ ID NO: 29541 - RNA, 14 nt, Homo sapiens
aacuggcaguuuuc

SEQ ID NO: 29542 - RNA, 23 nt, Homo sapiens
auucccuuuugcugccucuaaaa

SEQ ID NO: 29543 - RNA, 19 nt, Homo sapiens
aaguugcaccaacuuugaa

SEQ ID NO: 29544 - RNA, 21 nt, Homo sapiens
agcaaauuccaauacauuauu

SEQ ID NO: 29545 - RNA, 20 nt, Homo sapiens
agcaaauuccaauacauuau

SEQ ID NO: 29546 - RNA, 18 nt, Homo sapiens
guaaguuuaugcauacag

SEQ ID NO: 29547 - RNA, 19 nt, Homo sapiens
cauuugcgaaugguuccau

SEQ ID NO: 29548 - RNA, 22 nt, Homo sapiens
auacaauuauuuuuacaguucu

SEQ ID NO: 29549 - RNA, 22 nt, Homo sapiens
aauucgcugcaaccuguugaua

SEQ ID NO: 29550 - RNA, 18 nt, Homo sapiens
uacauuuccaaauucaca

SEQ ID NO: 29551 - RNA, 22 nt, Homo sapiens
aaacugagaugugaacacauca

SEQ ID NO: 29552 - RNA, 16 nt, Homo sapiens
aacaaaaaaagcauug

SEQ ID NO: 29553 - RNA, 14 nt, Homo sapiens
ugaacacaucagcu

SEQ ID NO: 29554 - RNA, 17 nt, Homo sapiens
acucauuuuuguuuuca

SEQ ID NO: 29555 - RNA, 19 nt, Homo sapiens
aaaucaaauaugcaaagca

SEQ ID NO: 29556 - RNA, 14 nt, Homo sapiens
acuaaaaaggcaug

SEQ ID NO: 29557 - RNA, 21 nt, Homo sapiens
auuuaauaaaugugccuucau

SEQ ID NO: 29558 - RNA, 14 nt, Homo sapiens
agaagagcuguuca

SEQ ID NO: 29559 - RNA, 17 nt, Homo sapiens
uguauuuuauuacaucu

SEQ ID NO: 29560 - RNA, 14 nt, Homo sapiens
uguauagugcaugu

SEQ ID NO: 29561 - RNA, 22 nt, Homo sapiens
gagaagagcuguucacagccag

SEQ ID NO: 29562 - RNA, 17 nt, Homo sapiens
auauaaauuuucccaaa

SEQ ID NO: 29563 - RNA, 19 nt, Homo sapiens
aaaaucacaaacucaucca

SEQ ID NO: 29564 - RNA, 21 nt, Homo sapiens
uugaagaugcuuguauuuuac

SEQ ID NO: 29565 - RNA, 17 nt, Homo sapiens
gagauggguuugacaag

SEQ ID NO: 29566 - RNA, 13 nt, Homo sapiens
gauaauaugagaa

SEQ ID NO: 29567 - RNA, 14 nt, Homo sapiens
auaugcaaagcacu

SEQ ID NO: 29568 - RNA, 15 nt, Homo sapiens
ugcugaaacaacaaa

SEQ ID NO: 29569 - RNA, 15 nt, Homo sapiens
acuucugucuucaca

SEQ ID NO: 29570 - RNA, 16 nt, Homo sapiens
auaaaauucauuccau

SEQ ID NO: 29571 - RNA, 19 nt, Homo sapiens
uagugaaguaugcacuaau

SEQ ID NO: 29572 - RNA, 20 nt, Homo sapiens
acacgagcaggcuacuguca

SEQ ID NO: 29573 - RNA, 21 nt, Homo sapiens
uccugguuccuaggugagcag

SEQ ID NO: 29574 - RNA, 16 nt, Homo sapiens
acaacucgaaucacuc

SEQ ID NO: 29575 - RNA, 18 nt, Homo sapiens
ucuaacucagaaacauca

SEQ ID NO: 29576 - RNA, 16 nt, Homo sapiens
agaauucuuacauguu

SEQ ID NO: 29577 - RNA, 16 nt, Homo sapiens
ugaaacauuacaguua

SEQ ID NO: 29578 - RNA, 15 nt, Homo sapiens
cuguacuuuuuccag

SEQ ID NO: 29579 - RNA, 18 nt, Homo sapiens
aggcauguaauugcuugu

SEQ ID NO: 29580 - RNA, 20 nt, Homo sapiens
uccuuccuuaucacugacac

SEQ ID NO: 29581 - RNA, 13 nt, Homo sapiens
gcuuuaauuucau

SEQ ID NO: 29582 - RNA, 23 nt, Homo sapiens
uuaaguguaacuggcaguuuucc

SEQ ID NO: 29583 - RNA, 18 nt, Homo sapiens
aaaaccacagcaguugaa

SEQ ID NO: 29584 - RNA, 14 nt, Homo sapiens
agauaauaugagaa

SEQ ID NO: 29585 - RNA, 20 nt, Homo sapiens
cugaagggcaucaugcaucu

SEQ ID NO: 29586 - RNA, 19 nt, Homo sapiens
aagcaccuuuagaauauua

SEQ ID NO: 29587 - RNA, 20 nt, Homo sapiens
ccuggcuggggccuguugaa

SEQ ID NO: 29588 - RNA, 21 nt, Homo sapiens
uucauuaucucaaaacugcac

SEQ ID NO: 29589 - RNA, 18 nt, Homo sapiens
guaucaaccaaauggagu

SEQ ID NO: 29590 - RNA, 22 nt, Homo sapiens
cugcaagcuuuucaaaauugga

SEQ ID NO: 29591 - RNA, 23 nt, Homo sapiens
gagcaguagcagcagcaucucug

SEQ ID NO: 29592 - RNA, 14 nt, Homo sapiens
uaugcauacaguaa

SEQ ID NO: 29593 - RNA, 14 nt, Homo sapiens
caucuuggucacau

SEQ ID NO: 29594 - RNA, 19 nt, Homo sapiens
auuuuuacaguucucccaa

SEQ ID NO: 29595 - RNA, 17 nt, Homo sapiens
uucaaaauuggacuuaa

SEQ ID NO: 29596 - RNA, 17 nt, Homo sapiens
auuguaacuuaugaacc

SEQ ID NO: 29597 - RNA, 17 nt, Homo sapiens
uucugcaagcuuuucaa

SEQ ID NO: 29598 - RNA, 21 nt, Homo sapiens
uccuguacuuuuuccagacac

SEQ ID NO: 29599 - RNA, 19 nt, Homo sapiens
auacauuauuggacuucca

SEQ ID NO: 29600 - RNA, 22 nt, Homo sapiens
cccaaaacugauacccuuugaa

SEQ ID NO: 29601 - RNA, 18 nt, Homo sapiens
cuauauuaucaugcaaau

SEQ ID NO: 29602 - RNA, 23 nt, Homo sapiens
augugcuuuuaaaaaaaaauacu

SEQ ID NO: 29603 - RNA, 12 nt, Homo sapiens
cggaacaguauc

SEQ ID NO: 29604 - RNA, 22 nt, Homo sapiens
uguuagcaaaauggauaugaca

SEQ ID NO: 29605 - RNA, 13 nt, Homo sapiens
guaaaauugaaag

SEQ ID NO: 29606 - RNA, 14 nt, Homo sapiens
uaagggaaacugcc

SEQ ID NO: 29607 - RNA, 15 nt, Homo sapiens
aaaucuuaacuugaa

SEQ ID NO: 29608 - RNA, 19 nt, Homo sapiens
caucuuggucacauacaau

SEQ ID NO: 29609 - RNA, 13 nt, Homo sapiens
cauuuucacuuuu

SEQ ID NO: 29610 - RNA, 14 nt, Homo sapiens
aagaaauucugcaa

SEQ ID NO: 29611 - RNA, 23 nt, Homo sapiens
uuuaaaaaaaaaaaaaaagccaa

SEQ ID NO: 29612 - RNA, 19 nt, Homo sapiens
augcacuaaucaauacuuu

SEQ ID NO: 29613 - RNA, 20 nt, Homo sapiens
uugaaggaguccuugcauca

SEQ ID NO: 29614 - RNA, 14 nt, Homo sapiens
aaaccucaagccag

SEQ ID NO: 29615 - RNA, 17 nt, Homo sapiens
uguggcauuuucacuuu

SEQ ID NO: 29616 - RNA, 20 nt, Homo sapiens
ucccuuuuacauacugcugu

SEQ ID NO: 29617 - RNA, 14 nt, Homo sapiens
accaguauucccuu

SEQ ID NO: 29618 - RNA, 13 nt, Homo sapiens
uaaaaaauggaac

SEQ ID NO: 29619 - RNA, 20 nt, Homo sapiens
uuaugaaccuuuacauccag

SEQ ID NO: 29620 - RNA, 15 nt, Homo sapiens
aaauggagugacuua

SEQ ID NO: 29621 - RNA, 16 nt, Homo sapiens
cacagaggaucugcuu

SEQ ID NO: 29622 - RNA, 15 nt, Homo sapiens
gagaaagacuauuca

SEQ ID NO: 29623 - RNA, 21 nt, Homo sapiens
agauguagcaaauuccaauac

SEQ ID NO: 29624 - RNA, 21 nt, Homo sapiens
uuuaaaaaaaaauacugaugu

SEQ ID NO: 29625 - RNA, 19 nt, Homo sapiens
guuuuccuucucaucugug

SEQ ID NO: 29626 - RNA, 23 nt, Homo sapiens
uccucuuucaaagguagccauca

SEQ ID NO: 29627 - RNA, 16 nt, Homo sapiens
cucaaaacugcacugu

SEQ ID NO: 29628 - RNA, 14 nt, Homo sapiens
auacuccuaguaau

SEQ ID NO: 29629 - RNA, 22 nt, Homo sapiens
augaaaagauuaugaucucaga

SEQ ID NO: 29630 - RNA, 11 nt, Homo sapiens
aauacugaugu

SEQ ID NO: 29631 - RNA, 23 nt, Homo sapiens
gguuaccaguaacggaacaguau

SEQ ID NO: 29632 - RNA, 11 nt, Homo sapiens
acaucuuucac

SEQ ID NO: 29633 - RNA, 16 nt, Homo sapiens
aacaacucgaaucacu

SEQ ID NO: 29634 - RNA, 17 nt, Homo sapiens
aucagcauuuuacuacu

SEQ ID NO: 29635 - RNA, 15 nt, Homo sapiens
ugcaucagcugcuga

SEQ ID NO: 29636 - RNA, 21 nt, Homo sapiens
gcuacucuguuccuucacauc

SEQ ID NO: 29637 - RNA, 22 nt, Homo sapiens
aaaauauuuguaucacaaaucu

SEQ ID NO: 29638 - RNA, 15 nt, Homo sapiens
caaauaugcaaagca

SEQ ID NO: 29639 - RNA, 22 nt, Homo sapiens
aauacugauguuccuagugaaa

SEQ ID NO: 29640 - RNA, 20 nt, Homo sapiens
auauaauaugcacacagugc

SEQ ID NO: 29641 - RNA, 23 nt, Homo sapiens
ucacauuggcuauuuaaagacaa

SEQ ID NO: 29642 - RNA, 18 nt, Homo sapiens
cagaaauuuaauucaugu

SEQ ID NO: 29643 - RNA, 17 nt, Homo sapiens
caaaacugcacugucaa

SEQ ID NO: 29644 - RNA, 16 nt, Homo sapiens
uuauuacaucuuucac

SEQ ID NO: 29645 - RNA, 12 nt, Homo sapiens
cauuuucacuuu

SEQ ID NO: 29646 - RNA, 16 nt, Homo sapiens
uaaaguacagacuuuu

SEQ ID NO: 29647 - RNA, 14 nt, Homo sapiens
cuguuccuucacau

SEQ ID NO: 29648 - RNA, 12 nt, Homo sapiens
caggaaaauuaa

SEQ ID NO: 29649 - RNA, 18 nt, Homo sapiens
auaaaauucauuccauuu

SEQ ID NO: 29650 - RNA, 16 nt, Homo sapiens
caaaucuuaacuugaa

SEQ ID NO: 29651 - RNA, 14 nt, Homo sapiens
ucuauguggcugua

SEQ ID NO: 29652 - RNA, 14 nt, Homo sapiens
aagacaaauucugu

SEQ ID NO: 29653 - RNA, 20 nt, Homo sapiens
uccguggcacugcauacaau

SEQ ID NO: 29654 - RNA, 15 nt, Homo sapiens
aggcauucucugaag

SEQ ID NO: 29655 - RNA, 20 nt, Homo sapiens
caaaaauuauauuuugaaca

SEQ ID NO: 29656 - RNA, 16 nt, Homo sapiens
guggcauuuucacuuu

SEQ ID NO: 29657 - RNA, 22 nt, Homo sapiens
auuuuuguuuucauuaucucaa

SEQ ID NO: 29658 - RNA, 18 nt, Homo sapiens
acuuaaaaucuaauucaa

SEQ ID NO: 29659 - RNA, 19 nt, Homo sapiens
ugacacuagcuaauaucaa

SEQ ID NO: 29660 - RNA, 19 nt, Homo sapiens
ucccagcgagggacaccga

SEQ ID NO: 29661 - RNA, 15 nt, Homo sapiens
guaagggaaacugcc

SEQ ID NO: 29662 - RNA, 20 nt, Homo sapiens
ccaacuuugaagucugauuu

SEQ ID NO: 29663 - RNA, 16 nt, Homo sapiens
agccagccuugcuccu

SEQ ID NO: 29664 - RNA, 19 nt, Homo sapiens
uuaucaugcaaaugcugua

SEQ ID NO: 29665 - RNA, 17 nt, Homo sapiens
aacuggaaauaaaagau

SEQ ID NO: 29666 - RNA, 19 nt, Homo sapiens
uucgugaaguauacuguau

SEQ ID NO: 29667 - RNA, 16 nt, Homo sapiens
aucacaaacucaucca

SEQ ID NO: 29668 - RNA, 15 nt, Homo sapiens
ucucugccuugguau

SEQ ID NO: 29669 - RNA, 17 nt, Homo sapiens
uuacaaaccucaagcca

SEQ ID NO: 29670 - RNA, 19 nt, Homo sapiens
uuuguagccacuucacuuu

SEQ ID NO: 29671 - RNA, 13 nt, Homo sapiens
cucaucugugauu

SEQ ID NO: 29672 - RNA, 11 nt, Homo sapiens
ucauuaucuca

SEQ ID NO: 29673 - RNA, 12 nt, Homo sapiens
auuagaugacug

SEQ ID NO: 29674 - RNA, 16 nt, Homo sapiens
auaaaauacauacuau

SEQ ID NO: 29675 - RNA, 16 nt, Homo sapiens
uuaugaaccuuuacau

SEQ ID NO: 29676 - RNA, 20 nt, Homo sapiens
cucuaacucagaaacaucag

SEQ ID NO: 29677 - RNA, 19 nt, Homo sapiens
uuccagagaccaguauucc

SEQ ID NO: 29678 - RNA, 21 nt, Homo sapiens
guauauaaauuuucccaaaac

SEQ ID NO: 29679 - RNA, 24 nt, Homo sapiens
uuucaaaaucaaauuccagaauga

SEQ ID NO: 29680 - RNA, 19 nt, Homo sapiens
augaugaucuuuaaaauac

SEQ ID NO: 29681 - RNA, 21 nt, Homo sapiens
cuuguuuuuccacuacugcua

SEQ ID NO: 29682 - RNA, 12 nt, Homo sapiens
cauguacaucca

SEQ ID NO: 29683 - RNA, 18 nt, Homo sapiens
caaguccaagcauaccaa

SEQ ID NO: 29684 - RNA, 17 nt, Homo sapiens
gacuucugucuucacaa

SEQ ID NO: 29685 - RNA, 18 nt, Homo sapiens
ggacaggauaagagggau

SEQ ID NO: 29686 - RNA, 14 nt, Homo sapiens
uucauuccauuugc

SEQ ID NO: 29687 - RNA, 19 nt, Homo sapiens
ugaaggaguccuugcauca

SEQ ID NO: 29688 - RNA, 22 nt, Homo sapiens
uugcuccuggcuggggccuguu

SEQ ID NO: 29689 - RNA, 17 nt, Homo sapiens
aaggaguccuugcauca

SEQ ID NO: 29690 - RNA, 20 nt, Homo sapiens
ucacaaacucauccauuaau

SEQ ID NO: 29691 - RNA, 15 nt, Homo sapiens
auguuucgcugauau

SEQ ID NO: 29692 - RNA, 20 nt, Homo sapiens
uguucacagccagacuggca

SEQ ID NO: 29693 - RNA, 12 nt, Homo sapiens
cacuucacuuuu

SEQ ID NO: 29694 - RNA, 14 nt, Homo sapiens
guuuucauuaucuc

SEQ ID NO: 29695 - RNA, 14 nt, Homo sapiens
aucucaaaacugca

SEQ ID NO: 29696 - RNA, 18 nt, Homo sapiens
uauauguguuuuucacau

SEQ ID NO: 29697 - RNA, 20 nt, Homo sapiens
uaaaaucacaaacucaucca

SEQ ID NO: 29698 - RNA, 16 nt, Homo sapiens
agcaggcuacugucag

SEQ ID NO: 29699 - RNA, 22 nt, Homo sapiens
aagucagugcccaacuguuaua

SEQ ID NO: 29700 - RNA, 21 nt, Homo sapiens
cuuaguguacaugaaagcgua

SEQ ID NO: 29701 - RNA, 16 nt, Homo sapiens
cacucauuuauuucca

SEQ ID NO: 29702 - RNA, 15 nt, Homo sapiens
gccacuucacuuuuu

SEQ ID NO: 29703 - RNA, 22 nt, Homo sapiens
agaguucugucuggacuuucca

SEQ ID NO: 29704 - RNA, 16 nt, Homo sapiens
ugccccagggaccuuu

SEQ ID NO: 29705 - RNA, 14 nt, Homo sapiens
aaauacauacuaua

SEQ ID NO: 29706 - RNA, 13 nt, Homo sapiens
uccccucggagaa

SEQ ID NO: 29707 - RNA, 15 nt, Homo sapiens
ucacaaacucaucca

SEQ ID NO: 29708 - RNA, 17 nt, Homo sapiens
acuaaucaauacuuuga

SEQ ID NO: 29709 - RNA, 16 nt, Homo sapiens
aaugguuccauucucu

SEQ ID NO: 29710 - RNA, 20 nt, Homo sapiens
ccagguagagagaccacaag

SEQ ID NO: 29711 - RNA, 21 nt, Homo sapiens
ggccuguugaagaugcuugua

SEQ ID NO: 29712 - RNA, 15 nt, Homo sapiens
agaauucuuacaugu

SEQ ID NO: 29713 - RNA, 16 nt, Homo sapiens
caaacagucucaggaa

SEQ ID NO: 29714 - RNA, 23 nt, Homo sapiens
caauuauaucaguccucuuucaa

SEQ ID NO: 29715 - RNA, 23 nt, Homo sapiens
ucacaaaucuuaacuugaaggag

SEQ ID NO: 29716 - RNA, 20 nt, Homo sapiens
caucagcuugcccuguuaaa

SEQ ID NO: 29717 - RNA, 19 nt, Homo sapiens
uguguggcauuuucacuuu

SEQ ID NO: 29718 - RNA, 20 nt, Homo sapiens
ccuggacaguuuucugcuuu

SEQ ID NO: 29719 - RNA, 19 nt, Homo sapiens
uucaaacagucucaggaaa

SEQ ID NO: 29720 - RNA, 16 nt, Homo sapiens
acaucaguuacucuga

SEQ ID NO: 29721 - RNA, 20 nt, Homo sapiens
ggcgacaguuuuccuucuca

SEQ ID NO: 29722 - RNA, 20 nt, Homo sapiens
uuaaagcuuauuaaaacuca

SEQ ID NO: 29723 - RNA, 14 nt, Homo sapiens
cuagaauacuaaua

SEQ ID NO: 29724 - RNA, 20 nt, Homo sapiens
gagugacuuaguguacauga

SEQ ID NO: 29725 - RNA, 14 nt, Homo sapiens
uucccaaaacugau

SEQ ID NO: 29726 - RNA, 15 nt, Homo sapiens
ccuguguuacugauu

SEQ ID NO: 29727 - RNA, 13 nt, Homo sapiens
aagacuccaaaga

SEQ ID NO: 29728 - RNA, 12 nt, Homo sapiens
aaaaaagccaaa

SEQ ID NO: 29729 - RNA, 17 nt, Homo sapiens
ccuggacaguuuucugc

SEQ ID NO: 29730 - RNA, 20 nt, Homo sapiens
cugucuggacuuuccagaga

SEQ ID NO: 29731 - RNA, 13 nt, Homo sapiens
aagaaauucugca

SEQ ID NO: 29732 - RNA, 17 nt, Homo sapiens
uaaaguacagacuuuuu

SEQ ID NO: 29733 - RNA, 20 nt, Homo sapiens
cauuaaauauaauaugcaca

SEQ ID NO: 29734 - RNA, 19 nt, Homo sapiens
gagaacugcauauguuucg

SEQ ID NO: 29735 - RNA, 20 nt, Homo sapiens
uucugucuggacuuuccaga

SEQ ID NO: 29736 - RNA, 19 nt, Homo sapiens
guuuucugcuuuaauuuca

SEQ ID NO: 29737 - RNA, 20 nt, Homo sapiens
aggugcuacaaaaacacagc

SEQ ID NO: 29738 - RNA, 13 nt, Homo sapiens
cccuuuuacauac

SEQ ID NO: 29739 - RNA, 14 nt, Homo sapiens
uguguuuuucacau

SEQ ID NO: 29740 - RNA, 13 nt, Homo sapiens
ucauuuauuucca

SEQ ID NO: 29741 - RNA, 15 nt, Homo sapiens
gaaucauaugggaua

SEQ ID NO: 29742 - RNA, 13 nt, Homo sapiens
uuuuucauuauug

SEQ ID NO: 29743 - RNA, 22 nt, Homo sapiens
aucuuguuuuuccacuacugcu

SEQ ID NO: 29744 - RNA, 15 nt, Homo sapiens
aaagaggcagcuuga

SEQ ID NO: 29745 - RNA, 23 nt, Homo sapiens
guaaaauugaaaggcauucucug

SEQ ID NO: 29746 - RNA, 18 nt, Homo sapiens
acaucagcuugcccuguu

SEQ ID NO: 29747 - RNA, 15 nt, Homo sapiens
agugaaaaacaucca

SEQ ID NO: 29748 - RNA, 21 nt, Homo sapiens
gacaaaugacccccaucccau

SEQ ID NO: 29749 - RNA, 16 nt, Homo sapiens
auaaacucagaaauuu

SEQ ID NO: 29750 - RNA, 17 nt, Homo sapiens
uucugagaaagacuauu

SEQ ID NO: 29751 - RNA, 18 nt, Homo sapiens
cucaacauaacauaagcu

SEQ ID NO: 29752 - RNA, 19 nt, Homo sapiens
uggaaauaaaagauuguau

SEQ ID NO: 29753 - RNA, 20 nt, Homo sapiens
gacuucugucuucacaacag

SEQ ID NO: 29754 - RNA, 19 nt, Homo sapiens
augaauuuuuuucaucuuc

SEQ ID NO: 29755 - RNA, 20 nt, Homo sapiens
auuuucacuuuuggcuugua

SEQ ID NO: 29756 - RNA, 18 nt, Homo sapiens
auuauuggacuuccauuu

SEQ ID NO: 29757 - RNA, 11 nt, Homo sapiens
aagcauuguaa

SEQ ID NO: 29758 - RNA, 15 nt, Homo sapiens
ccuuuuuguuauuag

SEQ ID NO: 29759 - RNA, 14 nt, Homo sapiens
uauuuguaucacaa

SEQ ID NO: 29760 - RNA, 23 nt, Homo sapiens
aaagucagugcccaacuguuaua

SEQ ID NO: 29761 - RNA, 15 nt, Homo sapiens
auuucugcaucagcu

SEQ ID NO: 29762 - RNA, 23 nt, Homo sapiens
guagaaaaagcaguaacugacaa

SEQ ID NO: 29763 - RNA, 16 nt, Homo sapiens
aagaugaugaugaucu

SEQ ID NO: 29764 - RNA, 18 nt, Homo sapiens
uacucuguuccuucacau

SEQ ID NO: 29765 - RNA, 17 nt, Homo sapiens
acccucaagacaaauga

SEQ ID NO: 29766 - RNA, 14 nt, Homo sapiens
gcaccaacuuugaa

SEQ ID NO: 29767 - RNA, 14 nt, Homo sapiens
aacugcauugagaa

SEQ ID NO: 29768 - RNA, 21 nt, Homo sapiens
ccauucuacauacuauggaau

SEQ ID NO: 29769 - RNA, 13 nt, Homo sapiens
auuaucaugcaaa

SEQ ID NO: 29770 - RNA, 13 nt, Homo sapiens
auuauuuuuacag

SEQ ID NO: 29771 - RNA, 20 nt, Homo sapiens
auauauguguuuuucacauu

SEQ ID NO: 29772 - RNA, 20 nt, Homo sapiens
aaauugggaaaggaguagaa

SEQ ID NO: 29773 - RNA, 19 nt, Homo sapiens
aacaacucgaaucacucau

SEQ ID NO: 29774 - RNA, 20 nt, Homo sapiens
uuaaaaucuaauucaaacua

SEQ ID NO: 29775 - RNA, 15 nt, Homo sapiens
gccaguuauggcuau

SEQ ID NO: 29776 - RNA, 20 nt, Homo sapiens
agaaggauguacauuuccaa

SEQ ID NO: 29777 - RNA, 13 nt, Homo sapiens
auguuaugcauaa

SEQ ID NO: 29778 - RNA, 17 nt, Homo sapiens
aaagcuaaaguaucugu

SEQ ID NO: 29779 - RNA, 13 nt, Homo sapiens
uucacagccagac

SEQ ID NO: 29780 - RNA, 20 nt, Homo sapiens
aauuucucccagucauuuaa

SEQ ID NO: 29781 - RNA, 16 nt, Homo sapiens
acuccuaguaauuuaa

SEQ ID NO: 29782 - RNA, 22 nt, Homo sapiens
agaccuggucgucgucuugacu

SEQ ID NO: 29783 - RNA, 16 nt, Homo sapiens
caggcucaacauaaca

SEQ ID NO: 29784 - RNA, 21 nt, Homo sapiens
ccacaacuauauuaucaugca

SEQ ID NO: 29785 - RNA, 22 nt, Homo sapiens
aguauaaauaaaaugagcaaaa

SEQ ID NO: 29786 - RNA, 20 nt, Homo sapiens
augagaaucagaucauuuca

SEQ ID NO: 29787 - RNA, 18 nt, Homo sapiens
agaauacuaauaaaauac

SEQ ID NO: 29788 - RNA, 21 nt, Homo sapiens
aucauuucaaaacucauuucc

SEQ ID NO: 29789 - RNA, 16 nt, Homo sapiens
aacacuaaaaaggcau

SEQ ID NO: 29790 - RNA, 21 nt, Homo sapiens
uuuacauacugcugucuaugu

SEQ ID NO: 29791 - RNA, 18 nt, Homo sapiens
cuguuccuucacauccug

SEQ ID NO: 29792 - RNA, 14 nt, Homo sapiens
ugauuuuacaauug

SEQ ID NO: 29793 - RNA, 23 nt, Homo sapiens
acuuaagguuaccuuuguuccca

SEQ ID NO: 29794 - RNA, 19 nt, Homo sapiens
uaaacacuaaaaaggcaug

SEQ ID NO: 29795 - RNA, 15 nt, Homo sapiens
acucauuuauuucca

SEQ ID NO: 29796 - RNA, 21 nt, Homo sapiens
ucaaauaugcaaagcacugac

SEQ ID NO: 29797 - RNA, 22 nt, Homo sapiens
ucaaaauaccaugccauuuaaa

SEQ ID NO: 29798 - RNA, 23 nt, Homo sapiens
gcaucagcugcugaaacaacaaa

SEQ ID NO: 29799 - RNA, 16 nt, Homo sapiens
aagaggcagcuugaaa

SEQ ID NO: 29800 - RNA, 14 nt, Homo sapiens
uauguggcuguauc

SEQ ID NO: 29801 - RNA, 23 nt, Homo sapiens
aaucugaggccuccucucucagu

SEQ ID NO: 29802 - RNA, 21 nt, Homo sapiens
auugcuuguuagcaaaaugga

SEQ ID NO: 29803 - RNA, 15 nt, Homo sapiens
aauucugcaagcuuu

SEQ ID NO: 29804 - RNA, 23 nt, Homo sapiens
auauuuuuuaugaaacauuacag

SEQ ID NO: 29805 - RNA, 19 nt, Homo sapiens
agaugugggcagugauguc

SEQ ID NO: 29806 - RNA, 14 nt, Homo sapiens
ggcauucucugaag

SEQ ID NO: 29807 - RNA, 17 nt, Homo sapiens
cauuauuggacuuccau

SEQ ID NO: 29808 - RNA, 23 nt, Homo sapiens
auguuucgugaaguauacuguau

SEQ ID NO: 29809 - RNA, 21 nt, Homo sapiens
cugugauucccuccugcuacu

SEQ ID NO: 29810 - RNA, 23 nt, Homo sapiens
ucaacaagagacuggaaggacca

SEQ ID NO: 29811 - RNA, 13 nt, Homo sapiens
acaaaaacacagc

SEQ ID NO: 29812 - RNA, 22 nt, Homo sapiens
caauacauuauuggacuuccau

SEQ ID NO: 29813 - RNA, 19 nt, Homo sapiens
accagagauaauaugagaa

SEQ ID NO: 29814 - RNA, 20 nt, Homo sapiens
aauuauauuuugaacaacuc

SEQ ID NO: 29815 - RNA, 13 nt, Homo sapiens
aaaacucauuucc

SEQ ID NO: 29816 - RNA, 15 nt, Homo sapiens
gugaaagaggcagcu

SEQ ID NO: 29817 - RNA, 21 nt, Homo sapiens
ucauuuccuauguaacugcau

SEQ ID NO: 29818 - RNA, 14 nt, Homo sapiens
cucgaaucacucau

SEQ ID NO: 29819 - RNA, 20 nt, Homo sapiens
aguucugucuggacuuucca

SEQ ID NO: 29820 - RNA, 23 nt, Homo sapiens
ucuucccuuuuacauacugcugu

SEQ ID NO: 29821 - RNA, 14 nt, Homo sapiens
aaaaugagcaaaag

SEQ ID NO: 29822 - RNA, 18 nt, Homo sapiens
guguuuuucacauuugcg

SEQ ID NO: 29823 - RNA, 19 nt, Homo sapiens
ucauuaucucaaaacugca

SEQ ID NO: 29824 - RNA, 16 nt, Homo sapiens
aacucagaaacaucag

SEQ ID NO: 29825 - RNA, 14 nt, Homo sapiens
ucacauccuguguu

SEQ ID NO: 29826 - RNA, 17 nt, Homo sapiens
gaacgguaaauuucugu

SEQ ID NO: 29827 - RNA, 15 nt, Homo sapiens
aucagcauuuuacua

SEQ ID NO: 29828 - RNA, 19 nt, Homo sapiens
guaauuuuaaguaauuuca

SEQ ID NO: 29829 - RNA, 23 nt, Homo sapiens
cuaucagcauuuuacuacuuuaa

SEQ ID NO: 29830 - RNA, 20 nt, Homo sapiens
ucuggacuuuccagagacca

SEQ ID NO: 29831 - RNA, 14 nt, Homo sapiens
agccacuucacuuu

SEQ ID NO: 29832 - RNA, 13 nt, Homo sapiens
uagauucuuuauu

SEQ ID NO: 29833 - RNA, 14 nt, Homo sapiens
gaacacaucagcuu

SEQ ID NO: 29834 - RNA, 16 nt, Homo sapiens
ggcauuuucacuuuug

SEQ ID NO: 29835 - RNA, 22 nt, Homo sapiens
aauuuucaaaaucaaauuccag

SEQ ID NO: 29836 - RNA, 16 nt, Homo sapiens
ucauaccuaucaucuu

SEQ ID NO: 29837 - RNA, 16 nt, Homo sapiens
uaagggaaacugccag

SEQ ID NO: 29838 - RNA, 20 nt, Homo sapiens
cuuuaaagggauggcaagau

SEQ ID NO: 29839 - RNA, 17 nt, Homo sapiens
gugccaguuauggcuau

SEQ ID NO: 29840 - RNA, 19 nt, Homo sapiens
auaggugcuacaaaaacac

SEQ ID NO: 29841 - RNA, 16 nt, Homo sapiens
guaaaaccacagcagu

SEQ ID NO: 29842 - RNA, 14 nt, Homo sapiens
gcaaaugcuguauu

SEQ ID NO: 29843 - RNA, 21 nt, Homo sapiens
uagaaaaauuagaugacugaa

SEQ ID NO: 29844 - RNA, 20 nt, Homo sapiens
auaauaugcacacagugcuu

SEQ ID NO: 29845 - RNA, 22 nt, Homo sapiens
aguaugcacuaaucaauacuuu

SEQ ID NO: 29846 - RNA, 13 nt, Homo sapiens
agaucaagccauc

SEQ ID NO: 29847 - RNA, 15 nt, Homo sapiens
agcugaauacauucu

SEQ ID NO: 29848 - RNA, 19 nt, Homo sapiens
acuucuaaguaaaaccaca

SEQ ID NO: 29849 - RNA, 15 nt, Homo sapiens
aaugguuccauucuc

SEQ ID NO: 29850 - RNA, 12 nt, Homo sapiens
uauuuugaacaa

SEQ ID NO: 29851 - RNA, 18 nt, Homo sapiens
aaguagggacuucugucu

SEQ ID NO: 29852 - RNA, 13 nt, Homo sapiens
uaagcaacaucua

SEQ ID NO: 29853 - RNA, 19 nt, Homo sapiens
caggaaaucaaauaugcaa

SEQ ID NO: 29854 - RNA, 15 nt, Homo sapiens
caaaaucaaauucca

SEQ ID NO: 29855 - RNA, 21 nt, Homo sapiens
uggacaguuuucugcuuuaau

SEQ ID NO: 29856 - RNA, 9 nt, Homo sapiens
agagaagau

SEQ ID NO: 29857 - RNA, 23 nt, Homo sapiens
ugaaacugagaugugaacacauc

SEQ ID NO: 29858 - RNA, 17 nt, Homo sapiens
aauucuuacauguuuuc

SEQ ID NO: 29859 - RNA, 20 nt, Homo sapiens
ugcaaccccaucauccucag

SEQ ID NO: 29860 - RNA, 15 nt, Homo sapiens
auucugcaagcuuuu

SEQ ID NO: 29861 - RNA, 17 nt, Homo sapiens
aguuuauauacaauuau

SEQ ID NO: 29862 - RNA, 15 nt, Homo sapiens
cuauguggcuguauc

SEQ ID NO: 29863 - RNA, 20 nt, Homo sapiens
caaaacugauacccuuugaa

SEQ ID NO: 29864 - RNA, 19 nt, Homo sapiens
aauagaaggauguacauuu

SEQ ID NO: 29865 - RNA, 19 nt, Homo sapiens
auacaauuauuuuuacagu

SEQ ID NO: 29866 - RNA, 19 nt, Homo sapiens
auaauaaaauucauuccau

SEQ ID NO: 29867 - RNA, 19 nt, Homo sapiens
caaaauaccaugccauuua

SEQ ID NO: 29868 - RNA, 12 nt, Homo sapiens
aaauuggacuua

SEQ ID NO: 29869 - RNA, 17 nt, Homo sapiens
caaguuguguuugauau

SEQ ID NO: 29870 - RNA, 12 nt, Homo sapiens
ggauaugagaug

SEQ ID NO: 29871 - RNA, 23 nt, Homo sapiens
gaauucuuacauguuuucuuugc

SEQ ID NO: 29872 - RNA, 19 nt, Homo sapiens
ccaaagaaauguaagggaa

SEQ ID NO: 29873 - RNA, 18 nt, Homo sapiens
cuaaaaaggcauguaauu

SEQ ID NO: 29874 - RNA, 13 nt, Homo sapiens
augacacaucucu

SEQ ID NO: 29875 - RNA, 14 nt, Homo sapiens
uaaaaucuaauuca

SEQ ID NO: 29876 - RNA, 15 nt, Homo sapiens
uguagauaaagcacu

SEQ ID NO: 29877 - RNA, 21 nt, Homo sapiens
agcugcugaaacaacaaauag

SEQ ID NO: 29878 - RNA, 17 nt, Homo sapiens
uacugcuaccacaacua

SEQ ID NO: 29879 - RNA, 13 nt, Homo sapiens
aauuccaauacau

SEQ ID NO: 29880 - RNA, 20 nt, Homo sapiens
acuaauagaauuaauggaau

SEQ ID NO: 29881 - RNA, 23 nt, Homo sapiens
aauauguaaauagaaacguguau

SEQ ID NO: 29882 - RNA, 12 nt, Homo sapiens
cucauucaaaag

SEQ ID NO: 29883 - RNA, 16 nt, Homo sapiens
ucugcuuuaauuucau

SEQ ID NO: 29884 - RNA, 22 nt, Homo sapiens
cauuaucucaaaacugcacugu

SEQ ID NO: 29885 - RNA, 15 nt, Homo sapiens
aagagaucaagccau

SEQ ID NO: 29886 - RNA, 22 nt, Homo sapiens
aaugacacuagcuaauaucaau

SEQ ID NO: 29887 - RNA, 19 nt, Homo sapiens
cuguaucuuguuuuuccac

SEQ ID NO: 29888 - RNA, 18 nt, Homo sapiens
agcauuguaaaugugcuu

SEQ ID NO: 29889 - RNA, 23 nt, Homo sapiens
ccacagcaguugaaaagacucca

SEQ ID NO: 29890 - RNA, 14 nt, Homo sapiens
uguaauugcuuguu

SEQ ID NO: 29891 - RNA, 20 nt, Homo sapiens
uuugcugccucuaaaaggcc

SEQ ID NO: 29892 - RNA, 15 nt, Homo sapiens
ucugcuuuaauuuca

SEQ ID NO: 29893 - RNA, 14 nt, Homo sapiens
cacaaaauugggaa

SEQ ID NO: 29894 - RNA, 15 nt, Homo sapiens
aaguaaaaccacagc

SEQ ID NO: 29895 - RNA, 22 nt, Homo sapiens
ucaggaaaucaaauaugcaaag

SEQ ID NO: 29896 - RNA, 13 nt, Homo sapiens
auggaacauaaaa

SEQ ID NO: 29897 - RNA, 17 nt, Homo sapiens
gaacugcauauguuucg

SEQ ID NO: 29898 - RNA, 19 nt, Homo sapiens
uaauaaaauacauacuaua

SEQ ID NO: 29899 - RNA, 21 nt, Homo sapiens
ugucuuaauuaaaagaauauu

SEQ ID NO: 29900 - RNA, 14 nt, Homo sapiens
ugcauacaguaauu

SEQ ID NO: 29901 - RNA, 14 nt, Homo sapiens
aacagucucaggaa

SEQ ID NO: 29902 - RNA, 20 nt, Homo sapiens
cggagaagagcuguucacag

SEQ ID NO: 29903 - RNA, 21 nt, Homo sapiens
ucuagcaaauguuaugcauaa

SEQ ID NO: 29904 - RNA, 14 nt, Homo sapiens
aaaauacauacuau

SEQ ID NO: 29905 - RNA, 16 nt, Homo sapiens
uacauuuccaaauuca

SEQ ID NO: 29906 - RNA, 16 nt, Homo sapiens
ccagacuggcacaguu

SEQ ID NO: 29907 - RNA, 18 nt, Homo sapiens
ugacuuaguguacaugaa

SEQ ID NO: 29908 - RNA, 13 nt, Homo sapiens
uuuaaaaaaugga

SEQ ID NO: 29909 - RNA, 12 nt, Homo sapiens
ccacagcaguug

SEQ ID NO: 29910 - RNA, 15 nt, Homo sapiens
aguucugucuggacu

SEQ ID NO: 29911 - RNA, 14 nt, Homo sapiens
gaagaaauucugca

SEQ ID NO: 29912 - RNA, 13 nt, Homo sapiens
aauguuguucucu

SEQ ID NO: 29913 - RNA, 16 nt, Homo sapiens
guagccacuucacuuu

SEQ ID NO: 29914 - RNA, 22 nt, Homo sapiens
auguacauccauggugugcugg

SEQ ID NO: 29915 - RNA, 16 nt, Homo sapiens
auuggacuuccauuug

SEQ ID NO: 29916 - RNA, 17 nt, Homo sapiens
cuuaaaaucuaauucaa

SEQ ID NO: 29917 - RNA, 15 nt, Homo sapiens
aauaaaauacauacu

SEQ ID NO: 29918 - RNA, 18 nt, Homo sapiens
augaaaagauuaugaucu

SEQ ID NO: 29919 - RNA, 15 nt, Homo sapiens
uuuccacuacugcua

SEQ ID NO: 29920 - RNA, 21 nt, Homo sapiens
guuucgugaaguauacuguau

SEQ ID NO: 29921 - RNA, 20 nt, Homo sapiens
gaaauuuaauucauguuucu

SEQ ID NO: 29922 - RNA, 22 nt, Homo sapiens
caguaacggaacaguauccagu

SEQ ID NO: 29923 - RNA, 16 nt, Homo sapiens
agaguggguuucacaa

SEQ ID NO: 29924 - RNA, 16 nt, Homo sapiens
acuggcaguuuuccau

SEQ ID NO: 29925 - RNA, 15 nt, Homo sapiens
cagaaauuguaucuu

SEQ ID NO: 29926 - RNA, 19 nt, Homo sapiens
guuauuuagggaacugcuu

SEQ ID NO: 29927 - RNA, 13 nt, Homo sapiens
uaauuucaugaaa

SEQ ID NO: 29928 - RNA, 13 nt, Homo sapiens
uacauuuccaaau

SEQ ID NO: 29929 - RNA, 17 nt, Homo sapiens
uguagauaaagcacugu

SEQ ID NO: 29930 - RNA, 15 nt, Homo sapiens
uagaauuaauggaau

SEQ ID NO: 29931 - RNA, 14 nt, Homo sapiens
ucucuucuuuaaag

SEQ ID NO: 29932 - RNA, 18 nt, Homo sapiens
aacaacucgaaucacuca

SEQ ID NO: 29933 - RNA, 14 nt, Homo sapiens
uccacuacugcuac

SEQ ID NO: 29934 - RNA, 23 nt, Homo sapiens
auuucaaaacucauuuccuaugu

SEQ ID NO: 29935 - RNA, 18 nt, Homo sapiens
aguuuaugcauacaguaa

SEQ ID NO: 29936 - RNA, 18 nt, Homo sapiens
ugcauugagaacugcaua

SEQ ID NO: 29937 - RNA, 14 nt, Homo sapiens
aaaauucauuccau

SEQ ID NO: 29938 - RNA, 14 nt, Homo sapiens
ccuuuagaauauua

SEQ ID NO: 29939 - RNA, 17 nt, Homo sapiens
aaagcauuguaacuuau

SEQ ID NO: 29940 - RNA, 23 nt, Homo sapiens
aaacauuuaucuuuguacguucu

SEQ ID NO: 29941 - RNA, 13 nt, Homo sapiens
ggaugauguuucg

SEQ ID NO: 29942 - RNA, 19 nt, Homo sapiens
cacucauuuauuuccauau

SEQ ID NO: 29943 - RNA, 13 nt, Homo sapiens
caugaaagcguaa

SEQ ID NO: 29944 - RNA, 15 nt, Homo sapiens
auuuaaagacaaaga

SEQ ID NO: 29945 - RNA, 22 nt, Homo sapiens
uuugaacaacucgaaucacuca

SEQ ID NO: 29946 - RNA, 19 nt, Homo sapiens
uucaaaaucaaauuccaga

SEQ ID NO: 29947 - RNA, 20 nt, Homo sapiens
aucaaauaugcaaagcacug

SEQ ID NO: 29948 - RNA, 11 nt, Homo sapiens
cuuuucucugc

SEQ ID NO: 29949 - RNA, 11 nt, Homo sapiens
aggcauucucu

SEQ ID NO: 29950 - RNA, 16 nt, Homo sapiens
aacggaacaguaucca

SEQ ID NO: 29951 - RNA, 15 nt, Homo sapiens
ucuuggucacauaca

SEQ ID NO: 29952 - RNA, 23 nt, Homo sapiens
gaauacuaauaaaauacauacua

SEQ ID NO: 29953 - RNA, 16 nt, Homo sapiens
uuuuacauacugcugu

SEQ ID NO: 29954 - RNA, 18 nt, Homo sapiens
auuuuauuacaucuuuca

SEQ ID NO: 29955 - RNA, 22 nt, Homo sapiens
uagaauacuaauaaaauacaua

SEQ ID NO: 29956 - RNA, 16 nt, Homo sapiens
uagauaaacucagaaa

SEQ ID NO: 29957 - RNA, 23 nt, Homo sapiens
cuauaggugcuacaaaaacacag

SEQ ID NO: 29958 - RNA, 21 nt, Homo sapiens
uuuuuaaacaaaaaaagcauu

SEQ ID NO: 29959 - RNA, 13 nt, Homo sapiens
ucaguuacucuga

SEQ ID NO: 29960 - RNA, 16 nt, Homo sapiens
acuggcucccuggaag

SEQ ID NO: 29961 - RNA, 20 nt, Homo sapiens
aauguaagggaaacugccag

SEQ ID NO: 29962 - RNA, 14 nt, Homo sapiens
uuaguguacaugaa

SEQ ID NO: 29963 - RNA, 16 nt, Homo sapiens
agcuuauuaaaacuca

SEQ ID NO: 29964 - RNA, 16 nt, Homo sapiens
cccaaauuucauaccu

SEQ ID NO: 29965 - RNA, 17 nt, Homo sapiens
cugaagggcaucaugca

SEQ ID NO: 29966 - RNA, 13 nt, Homo sapiens
uugaaaaaguaua

SEQ ID NO: 29967 - RNA, 15 nt, Homo sapiens
cuggcacaguuuucu

SEQ ID NO: 29968 - RNA, 18 nt, Homo sapiens
gccagacuggcacaguuu

SEQ ID NO: 29969 - RNA, 13 nt, Homo sapiens
gauaaagcacugu

SEQ ID NO: 29970 - RNA, 13 nt, Homo sapiens
uuaaaauguaauu

SEQ ID NO: 29971 - RNA, 20 nt, Homo sapiens
ccaaaguaucaggacgagaa

SEQ ID NO: 29972 - RNA, 14 nt, Homo sapiens
uagauaaagcacug

SEQ ID NO: 29973 - RNA, 16 nt, Homo sapiens
ucaugcaaaugcugua

SEQ ID NO: 29974 - RNA, 19 nt, Homo sapiens
aaucacucauuuauuucca

SEQ ID NO: 29975 - RNA, 17 nt, Homo sapiens
cccuucauguacaucca

SEQ ID NO: 29976 - RNA, 23 nt, Homo sapiens
uucaaaaauuauauuuugaacaa

SEQ ID NO: 29977 - RNA, 16 nt, Homo sapiens
uucaaaauuggacuua

SEQ ID NO: 29978 - RNA, 16 nt, Homo sapiens
uccuucucaucuguga

SEQ ID NO: 29979 - RNA, 21 nt, Homo sapiens
aauuuucaaaaucaaauucca

SEQ ID NO: 29980 - RNA, 23 nt, Homo sapiens
auuaucucaaaacugcacuguca

SEQ ID NO: 29981 - RNA, 18 nt, Homo sapiens
ggagaagagcuguucaca

SEQ ID NO: 29982 - RNA, 13 nt, Homo sapiens
uaauuucagaaga

SEQ ID NO: 29983 - RNA, 22 nt, Homo sapiens
gaccuuuguagccacuucacuu

SEQ ID NO: 29984 - RNA, 12 nt, Homo sapiens
uguguuacugau

SEQ ID NO: 29985 - RNA, 15 nt, Homo sapiens
aaagcacugacuucu

SEQ ID NO: 29986 - RNA, 23 nt, Homo sapiens
aaacugauacccuuugaaaaagu

SEQ ID NO: 29987 - RNA, 12 nt, Homo sapiens
acauacaauuau

SEQ ID NO: 29988 - RNA, 17 nt, Homo sapiens
agacagcaggucucaug

SEQ ID NO: 29989 - RNA, 15 nt, Homo sapiens
ugcuuucuaucuaau

SEQ ID NO: 29990 - RNA, 17 nt, Homo sapiens
acuuaaaaucuaauuca

SEQ ID NO: 29991 - RNA, 15 nt, Homo sapiens
uaaaauacacacuca

SEQ ID NO: 29992 - RNA, 16 nt, Homo sapiens
auuuccaaauucacaa

SEQ ID NO: 29993 - RNA, 23 nt, Homo sapiens
aaccaaauuuguauuuaagguau

SEQ ID NO: 29994 - RNA, 21 nt, Homo sapiens
caucacagcugaacuuguuga

SEQ ID NO: 29995 - RNA, 18 nt, Homo sapiens
agccaaguuuauauacaa

SEQ ID NO: 29996 - RNA, 17 nt, Homo sapiens
ucuggacuuuccagaga

SEQ ID NO: 29997 - RNA, 21 nt, Homo sapiens
cuggcucccuggaagagauca

SEQ ID NO: 29998 - RNA, 15 nt, Homo sapiens
cuuuccagagaccag

SEQ ID NO: 29999 - RNA, 15 nt, Homo sapiens
gcaggcuacugucag

SEQ ID NO: 30000 - RNA, 11 nt, Homo sapiens
acuuuuuccag

SEQ ID NO: 30001 - RNA, 18 nt, Homo sapiens
gaguuaggcuauucacaa

SEQ ID NO: 30002 - RNA, 12 nt, Homo sapiens
cauuccauuugc

SEQ ID NO: 30003 - RNA, 17 nt, Homo sapiens
uaaaauacacacucaaa

SEQ ID NO: 30004 - RNA, 17 nt, Homo sapiens
ucuauggcauauugaua

SEQ ID NO: 30005 - RNA, 23 nt, Homo sapiens
gugaauuuuucucuaacucagaa

SEQ ID NO: 30006 - RNA, 14 nt, Homo sapiens
uaggcuauucacaa

SEQ ID NO: 30007 - RNA, 22 nt, Homo sapiens
cuuuaauuucaugaaaagauua

SEQ ID NO: 30008 - RNA, 15 nt, Homo sapiens
gacaguuuucugcuu

SEQ ID NO: 30009 - RNA, 17 nt, Homo sapiens
ugcuacaaaaacacagc

SEQ ID NO: 30010 - RNA, 14 nt, Homo sapiens
agagaccacaagca

SEQ ID NO: 30011 - RNA, 16 nt, Homo sapiens
gugacuuaguguacau

SEQ ID NO: 30012 - RNA, 19 nt, Homo sapiens
aucacucauuuauuuccau

SEQ ID NO: 30013 - RNA, 15 nt, Homo sapiens
auguguuuuucacau

SEQ ID NO: 30014 - RNA, 13 nt, Homo sapiens
ucaaauuccagaa

SEQ ID NO: 30015 - RNA, 17 nt, Homo sapiens
acaacucgaaucacuca

SEQ ID NO: 30016 - RNA, 15 nt, Homo sapiens
agcaaauuccaauac

SEQ ID NO: 30017 - RNA, 21 nt, Homo sapiens
acaauuauuuuuacaguucuc

SEQ ID NO: 30018 - RNA, 19 nt, Homo sapiens
ucuucccuuuuacauacug

SEQ ID NO: 30019 - RNA, 14 nt, Homo sapiens
uuccacuacugcua

SEQ ID NO: 30020 - RNA, 13 nt, Homo sapiens
cacuggcucccug

SEQ ID NO: 30021 - RNA, 22 nt, Homo sapiens
uaugagauguagcaaauuccaa

SEQ ID NO: 30022 - RNA, 15 nt, Homo sapiens
acuauucaaacaguc

SEQ ID NO: 30023 - RNA, 22 nt, Homo sapiens
aauagaaggauguacauuucca

SEQ ID NO: 30024 - RNA, 23 nt, Homo sapiens
uaacucagaaacaucaguuacuc

SEQ ID NO: 30025 - RNA, 15 nt, Homo sapiens
uacaaaaacacagca

SEQ ID NO: 30026 - RNA, 23 nt, Homo sapiens
ccaauacauuauuggacuuccau

SEQ ID NO: 30027 - RNA, 10 nt, Homo sapiens
aaagggaugg

SEQ ID NO: 30028 - RNA, 14 nt, Homo sapiens
uacaaaaacacagc

SEQ ID NO: 30029 - RNA, 18 nt, Homo sapiens
acuuaugaaccuuuacau

SEQ ID NO: 30030 - RNA, 18 nt, Homo sapiens
auuuuaaguaauuucaga

SEQ ID NO: 30031 - RNA, 21 nt, Homo sapiens
uuaucaugcaaaugcuguauu

SEQ ID NO: 30032 - RNA, 13 nt, Homo sapiens
augcauacaguaa

SEQ ID NO: 30033 - RNA, 23 nt, Homo sapiens
ugaaaaaguauaaauaaaaugag

SEQ ID NO: 30034 - RNA, 15 nt, Homo sapiens
guacuuuuuccagac

SEQ ID NO: 30035 - RNA, 20 nt, Homo sapiens
aaucauuucugcaucagcug

SEQ ID NO: 30036 - RNA, 14 nt, Homo sapiens
cuuaaacacuaaaa

SEQ ID NO: 30037 - RNA, 16 nt, Homo sapiens
aauaaaugugccuuca

SEQ ID NO: 30038 - RNA, 20 nt, Homo sapiens
aaaugggcuacuuuguccuu

SEQ ID NO: 30039 - RNA, 14 nt, Homo sapiens
uuccaaauucacaa

SEQ ID NO: 30040 - RNA, 21 nt, Homo sapiens
accuguugauagcaagugaau

SEQ ID NO: 30041 - RNA, 14 nt, Homo sapiens
augaugaugaucuu

SEQ ID NO: 30042 - RNA, 22 nt, Homo sapiens
cuuuuggcuuguaaaguacaga

SEQ ID NO: 30043 - RNA, 16 nt, Homo sapiens
ucuaaguaaaaccaca

SEQ ID NO: 30044 - RNA, 19 nt, Homo sapiens
ugugaacacaucagcuugc

SEQ ID NO: 30045 - RNA, 23 nt, Homo sapiens
uggacuuuccagagaccaguauu

SEQ ID NO: 30046 - RNA, 17 nt, Homo sapiens
ugaguggaugauguuuc

SEQ ID NO: 30047 - RNA, 22 nt, Homo sapiens
uugaacaacucgaaucacucau

SEQ ID NO: 30048 - RNA, 15 nt, Homo sapiens
uaccuaucaucuuaa

SEQ ID NO: 30049 - RNA, 19 nt, Homo sapiens
aauuucauaccuaucaucu

SEQ ID NO: 30050 - RNA, 21 nt, Homo sapiens
agaguucugucuggacuuucc

SEQ ID NO: 30051 - RNA, 17 nt, Homo sapiens
ccuuuuacauacugcug

SEQ ID NO: 30052 - RNA, 13 nt, Homo sapiens
ggcgacaguuuuc

SEQ ID NO: 30053 - RNA, 14 nt, Homo sapiens
gagcaggcuacugu

SEQ ID NO: 30054 - RNA, 18 nt, Homo sapiens
augcuuguauuuuacuuu

SEQ ID NO: 30055 - RNA, 19 nt, Homo sapiens
acacuaaaaaggcauguaa

SEQ ID NO: 30056 - RNA, 13 nt, Homo sapiens
accaaauuuguau

SEQ ID NO: 30057 - RNA, 13 nt, Homo sapiens
cugaauacauucu

SEQ ID NO: 30058 - RNA, 23 nt, Homo sapiens
caagccagccuugcuccuggcug

SEQ ID NO: 30059 - RNA, 17 nt, Homo sapiens
ugaaaauauuuguauca

SEQ ID NO: 30060 - RNA, 21 nt, Homo sapiens
gugguuauuuagggaacugcu

SEQ ID NO: 30061 - RNA, 16 nt, Homo sapiens
aaucauuucugcauca

SEQ ID NO: 30062 - RNA, 16 nt, Homo sapiens
auaauaugagaaucag

SEQ ID NO: 30063 - RNA, 15 nt, Homo sapiens
ucccugcagacauga

SEQ ID NO: 30064 - RNA, 14 nt, Homo sapiens
uaacugcauugaga

SEQ ID NO: 30065 - RNA, 14 nt, Homo sapiens
agaaagacuauuca

SEQ ID NO: 30066 - RNA, 21 nt, Homo sapiens
caaauaugcaaagcacugacu

SEQ ID NO: 30067 - RNA, 17 nt, Homo sapiens
caagugaaaaacaucca

SEQ ID NO: 30068 - RNA, 20 nt, Homo sapiens
aagauuguauagugcauguu

SEQ ID NO: 30069 - RNA, 13 nt, Homo sapiens
gugcuacaaaaac

SEQ ID NO: 30070 - RNA, 14 nt, Homo sapiens
cagccagacuggca

SEQ ID NO: 30071 - RNA, 18 nt, Homo sapiens
gcccuucauguacaucca

SEQ ID NO: 30072 - RNA, 14 nt, Homo sapiens
auucuuuaucacau

SEQ ID NO: 30073 - RNA, 22 nt, Homo sapiens
ugcuggcuuaaaauguaauuaa

SEQ ID NO: 30074 - RNA, 17 nt, Homo sapiens
caacuauauuaucaugc

SEQ ID NO: 30075 - RNA, 20 nt, Homo sapiens
aauacauuauuggacuucca

SEQ ID NO: 30076 - RNA, 22 nt, Homo sapiens
ccguuuugugaagaaacauuua

SEQ ID NO: 30077 - RNA, 22 nt, Homo sapiens
ccuggacaguuuucugcuuuaa

SEQ ID NO: 30078 - RNA, 18 nt, Homo sapiens
aguugauuuuacaauuga

SEQ ID NO: 30079 - RNA, 20 nt, Homo sapiens
aguuuucugcuuuaauuuca

SEQ ID NO: 30080 - RNA, 21 nt, Homo sapiens
uacuuugaacacaaagccugu

SEQ ID NO: 30081 - RNA, 23 nt, Homo sapiens
aagaaauguaagggaaacugcca

SEQ ID NO: 30082 - RNA, 23 nt, Homo sapiens
cuuguuuuuccacuacugcuacc

SEQ ID NO: 30083 - RNA, 12 nt, Homo sapiens
uacauacugcug

SEQ ID NO: 30084 - RNA, 18 nt, Homo sapiens
acacuaaaaaggcaugua

SEQ ID NO: 30085 - RNA, 17 nt, Homo sapiens
aagugaaaaacauccag

SEQ ID NO: 30086 - RNA, 18 nt, Homo sapiens
auuucauaccuaucaucu

SEQ ID NO: 30087 - RNA, 16 nt, Homo sapiens
cauuuccaaauucaca

SEQ ID NO: 30088 - RNA, 23 nt, Homo sapiens
cacugacuucuaaguaaaaccac

SEQ ID NO: 30089 - RNA, 13 nt, Homo sapiens
uauuggacuucca

SEQ ID NO: 30090 - RNA, 17 nt, Homo sapiens
uccuguacuuuuuccag

SEQ ID NO: 30091 - RNA, 22 nt, Homo sapiens
cuagugaaagaggcagcuugaa

SEQ ID NO: 30092 - RNA, 11 nt, Homo sapiens
uuaaaaucaca

SEQ ID NO: 30093 - RNA, 17 nt, Homo sapiens
guaagggaaacugccag

SEQ ID NO: 30094 - RNA, 18 nt, Homo sapiens
cuaauaaaauacauacua

SEQ ID NO: 30095 - RNA, 18 nt, Homo sapiens
cugcugaaacaacaaaua

SEQ ID NO: 30096 - RNA, 16 nt, Homo sapiens
gccuugguauagcaua

SEQ ID NO: 30097 - RNA, 14 nt, Homo sapiens
uggucacauacaau

SEQ ID NO: 30098 - RNA, 16 nt, Homo sapiens
uuguuuuuaaacugga

SEQ ID NO: 30099 - RNA, 20 nt, Homo sapiens
gcuaaguugcaccaacuuug

SEQ ID NO: 30100 - RNA, 20 nt, Homo sapiens
ugaacaacucgaaucacuca

SEQ ID NO: 30101 - RNA, 17 nt, Homo sapiens
uugaaauuaaccauaga

SEQ ID NO: 30102 - RNA, 21 nt, Homo sapiens
guucucuucuuuaaagggaug

SEQ ID NO: 30103 - RNA, 17 nt, Homo sapiens
gagcaggcuacugucag

SEQ ID NO: 30104 - RNA, 13 nt, Homo sapiens
cuuugaagucuga

SEQ ID NO: 30105 - RNA, 17 nt, Homo sapiens
gcagcuugaaacugaga

SEQ ID NO: 30106 - RNA, 18 nt, Homo sapiens
gaaaagauuaugaucuca

SEQ ID NO: 30107 - RNA, 15 nt, Homo sapiens
aaaaucauuucugca

SEQ ID NO: 30108 - RNA, 22 nt, Homo sapiens
aacuuccuuggacucauuuuaa

SEQ ID NO: 30109 - RNA, 22 nt, Homo sapiens
uaauggaauauguaaauagaaa

SEQ ID NO: 30110 - RNA, 15 nt, Homo sapiens
augguuccauucucu

SEQ ID NO: 30111 - RNA, 16 nt, Homo sapiens
guauuuuacuuuucca

SEQ ID NO: 30112 - RNA, 19 nt, Homo sapiens
cugccuugguauagcauau

SEQ ID NO: 30113 - RNA, 14 nt, Homo sapiens
ucucaucugugauu

SEQ ID NO: 30114 - RNA, 13 nt, Homo sapiens
aauuagaugacug

SEQ ID NO: 30115 - RNA, 22 nt, Homo sapiens
uucucugccuugguauagcaua

SEQ ID NO: 30116 - RNA, 21 nt, Homo sapiens
cagcaguugaaaagacuccaa

SEQ ID NO: 30117 - RNA, 23 nt, Homo sapiens
agauuaagagauggguuugacaa

SEQ ID NO: 30118 - RNA, 20 nt, Homo sapiens
agcaaaauggauaugacaca

SEQ ID NO: 30119 - RNA, 13 nt, Homo sapiens
cuuaugaaccuuu

SEQ ID NO: 30120 - RNA, 15 nt, Homo sapiens
gcauuuucacuuuug

SEQ ID NO: 30121 - RNA, 21 nt, Homo sapiens
auuauucccauucuacauacu

SEQ ID NO: 30122 - RNA, 13 nt, Homo sapiens
aagcaacaucuag

SEQ ID NO: 30123 - RNA, 17 nt, Homo sapiens
agaaucagaucauuuca

SEQ ID NO: 30124 - RNA, 16 nt, Homo sapiens
uuccuauguaacugca

SEQ ID NO: 30125 - RNA, 16 nt, Homo sapiens
uauggcuuaaugacac

SEQ ID NO: 30126 - RNA, 17 nt, Homo sapiens
guaaaguacagacuuuu

SEQ ID NO: 30127 - RNA, 20 nt, Homo sapiens
auaggugcuacaaaaacaca

SEQ ID NO: 30128 - RNA, 16 nt, Homo sapiens
uuaccuuuguucccaa

SEQ ID NO: 30129 - RNA, 14 nt, Homo sapiens
ugagaacugcauau

SEQ ID NO: 30130 - RNA, 14 nt, Homo sapiens
uccuagugaaagag

SEQ ID NO: 30131 - RNA, 23 nt, Homo sapiens
uguauuuuauuacaucuuucaca

SEQ ID NO: 30132 - RNA, 22 nt, Homo sapiens
agaugugggcagugaugucacu

SEQ ID NO: 30133 - RNA, 22 nt, Homo sapiens
aggaaaucaaauaugcaaagca

SEQ ID NO: 30134 - RNA, 22 nt, Homo sapiens
aauguaagggaaacugccagca

SEQ ID NO: 30135 - RNA, 15 nt, Homo sapiens
aaaagacuccaaaga

SEQ ID NO: 30136 - RNA, 12 nt, Homo sapiens
ucgaaucacuca

SEQ ID NO: 30137 - RNA, 21 nt, Homo sapiens
auuucauaccuaucaucuuaa

SEQ ID NO: 30138 - RNA, 18 nt, Homo sapiens
acaauuauaucaguccuc

SEQ ID NO: 30139 - RNA, 19 nt, Homo sapiens
ugagagacagcaggucuca

SEQ ID NO: 30140 - RNA, 19 nt, Homo sapiens
acugagaugugaacacauc

SEQ ID NO: 30141 - RNA, 13 nt, Homo sapiens
acaaacucaucca

SEQ ID NO: 30142 - RNA, 14 nt, Homo sapiens
uuauuggacuucca

SEQ ID NO: 30143 - RNA, 15 nt, Homo sapiens
cuuugaagucugauu

SEQ ID NO: 30144 - RNA, 21 nt, Homo sapiens
accagcccuacaccauuccuu

SEQ ID NO: 30145 - RNA, 14 nt, Homo sapiens
acugcauacaaucu

SEQ ID NO: 30146 - RNA, 20 nt, Homo sapiens
cugcauugagaacugcauau

SEQ ID NO: 30147 - RNA, 23 nt, Homo sapiens
aaauucgcugcaaccuguugaua

SEQ ID NO: 30148 - RNA, 21 nt, Homo sapiens
ucucaaaacugcacugucaag

SEQ ID NO: 30149 - RNA, 19 nt, Homo sapiens
agagacagcaggucucaug

SEQ ID NO: 30150 - RNA, 22 nt, Homo sapiens
cucugaagaguggguuucacaa

SEQ ID NO: 30151 - RNA, 13 nt, Homo sapiens
uuuaugcauacag

SEQ ID NO: 30152 - RNA, 21 nt, Homo sapiens
uauggcuauaggugcuacaaa

SEQ ID NO: 30153 - RNA, 22 nt, Homo sapiens
agggacuucugucuucacaaca

SEQ ID NO: 30154 - RNA, 18 nt, Homo sapiens
uuuuaugaaacauuacag

SEQ ID NO: 30155 - RNA, 20 nt, Homo sapiens
uaauguagauaaagcacugu

SEQ ID NO: 30156 - RNA, 18 nt, Homo sapiens
uguuacugccuaucagca

SEQ ID NO: 30157 - RNA, 17 nt, Homo sapiens
aauugaaaggcauucuc

SEQ ID NO: 30158 - RNA, 16 nt, Homo sapiens
ugcaccaacuuugaag

SEQ ID NO: 30159 - RNA, 16 nt, Homo sapiens
uaaaauacacacucaa

SEQ ID NO: 30160 - RNA, 21 nt, Homo sapiens
gauagguuaccaguaacggaa

SEQ ID NO: 30161 - RNA, 16 nt, Homo sapiens
uuaugcauaaagucag

SEQ ID NO: 30162 - RNA, 20 nt, Homo sapiens
aaucaaauaugcaaagcacu

SEQ ID NO: 30163 - RNA, 12 nt, Homo sapiens
uacaucuuucac

SEQ ID NO: 30164 - RNA, 19 nt, Homo sapiens
cacuaaaaaggcauguaau

SEQ ID NO: 30165 - RNA, 19 nt, Homo sapiens
aauaauacaccagagauaa

SEQ ID NO: 30166 - RNA, 17 nt, Homo sapiens
ucaaaacugcacuguca

SEQ ID NO: 30167 - RNA, 18 nt, Homo sapiens
auucccuuuugcugccuc

SEQ ID NO: 30168 - RNA, 14 nt, Homo sapiens
auauaauaugcaca

SEQ ID NO: 30169 - RNA, 22 nt, Homo sapiens
cuaaguaaaaccacagcaguug

SEQ ID NO: 30170 - RNA, 13 nt, Homo sapiens
ugcagacaugaga

SEQ ID NO: 30171 - RNA, 15 nt, Homo sapiens
uaauucaaacuaaua

SEQ ID NO: 30172 - RNA, 14 nt, Homo sapiens
ccagacuggcacag

SEQ ID NO: 30173 - RNA, 16 nt, Homo sapiens
uaggaacgguaaauuu

SEQ ID NO: 30174 - RNA, 18 nt, Homo sapiens
gcaggcccccaggugcca

SEQ ID NO: 30175 - RNA, 16 nt, Homo sapiens
cuuaaagaauuuucaa

SEQ ID NO: 30176 - RNA, 21 nt, Homo sapiens
acauacuauagauucuuuauu

SEQ ID NO: 30177 - RNA, 15 nt, Homo sapiens
gugaacacaucagcu

SEQ ID NO: 30178 - RNA, 12 nt, Homo sapiens
aaacucauccau

SEQ ID NO: 30179 - RNA, 12 nt, Homo sapiens
cgacaguuuucc

SEQ ID NO: 30180 - RNA, 18 nt, Homo sapiens
aaguuuaugcauacagua

SEQ ID NO: 30181 - RNA, 14 nt, Homo sapiens
uaaguaaaaccaca

SEQ ID NO: 30182 - RNA, 14 nt, Homo sapiens
cuuaaaaucuaauu

SEQ ID NO: 30183 - RNA, 19 nt, Homo sapiens
uuucauaccuaucaucuua

SEQ ID NO: 30184 - RNA, 15 nt, Homo sapiens
aauucgcugcaaccu

SEQ ID NO: 30185 - RNA, 16 nt, Homo sapiens
uacauacuauggaauu

SEQ ID NO: 30186 - RNA, 16 nt, Homo sapiens
gcaaauguuaugcaua

SEQ ID NO: 30187 - RNA, 24 nt, Homo sapiens
aucuuguuuuuccacuacugcuac

SEQ ID NO: 30188 - RNA, 13 nt, Homo sapiens
acaucuuucacau

SEQ ID NO: 30189 - RNA, 16 nt, Homo sapiens
uauuacaucuuucaca

SEQ ID NO: 30190 - RNA, 13 nt, Homo sapiens
auuuucacuuuug

SEQ ID NO: 30191 - RNA, 11 nt, Homo sapiens
uuugaacacaa

SEQ ID NO: 30192 - RNA, 14 nt, Homo sapiens
caggaaaucaaaua

SEQ ID NO: 30193 - RNA, 22 nt, Homo sapiens
uccaagcauaccaacacgagca

SEQ ID NO: 30194 - RNA, 18 nt, Homo sapiens
gugcuacaaaaacacagc

SEQ ID NO: 30195 - RNA, 18 nt, Homo sapiens
caaaucuuaacuugaagg

SEQ ID NO: 30196 - RNA, 13 nt, Homo sapiens
gaauuaauggaau

SEQ ID NO: 30197 - RNA, 14 nt, Homo sapiens
cuucacaacagauu

SEQ ID NO: 30198 - RNA, 20 nt, Homo sapiens
gugcuuuuaaaaaaaaauac

SEQ ID NO: 30199 - RNA, 14 nt, Homo sapiens
aaguagggacuucu

SEQ ID NO: 30200 - RNA, 19 nt, Homo sapiens
aauauaauaugcacacagu

SEQ ID NO: 30201 - RNA, 20 nt, Homo sapiens
aguaauuuuaaguaauuuca

SEQ ID NO: 30202 - RNA, 19 nt, Homo sapiens
aaacugcacugucaagaug

SEQ ID NO: 30203 - RNA, 21 nt, Homo sapiens
uuaaaaucacaaacucaucca

SEQ ID NO: 30204 - RNA, 18 nt, Homo sapiens
uacauuauuggacuucca

SEQ ID NO: 30205 - RNA, 21 nt, Homo sapiens
cucauuuauuuccauauuaaa

SEQ ID NO: 30206 - RNA, 15 nt, Homo sapiens
uugcaccaacuuuga

SEQ ID NO: 30207 - RNA, 19 nt, Homo sapiens
uuaaauggagaaaggaccc

SEQ ID NO: 30208 - RNA, 19 nt, Homo sapiens
ccaaguuuauauacaauua

SEQ ID NO: 30209 - RNA, 14 nt, Homo sapiens
ugaagaaacauuua

SEQ ID NO: 30210 - RNA, 15 nt, Homo sapiens
auuguaacuuaugaa

SEQ ID NO: 30211 - RNA, 23 nt, Homo sapiens
acaccgaguggcccuucauguac

SEQ ID NO: 30212 - RNA, 16 nt, Homo sapiens
aaguugcaccaacuuu

SEQ ID NO: 30213 - RNA, 18 nt, Homo sapiens
uagcaaauuccaauacau

SEQ ID NO: 30214 - RNA, 23 nt, Homo sapiens
ucagaaauuuaauucauguuucu

SEQ ID NO: 30215 - RNA, 17 nt, Homo sapiens
auccaaagcugaauaca

SEQ ID NO: 30216 - RNA, 15 nt, Homo sapiens
acagaggaucugcuu

SEQ ID NO: 30217 - RNA, 17 nt, Homo sapiens
aaugacccccaucccau

SEQ ID NO: 30218 - RNA, 14 nt, Homo sapiens
caguccucuuucaa

SEQ ID NO: 30219 - RNA, 21 nt, Homo sapiens
uauguaaauagaaacguguau

SEQ ID NO: 30220 - RNA, 22 nt, Homo sapiens
uacaauuauuuuuacaguucuc

SEQ ID NO: 30221 - RNA, 13 nt, Homo sapiens
uacauacugcugu

SEQ ID NO: 30222 - RNA, 15 nt, Homo sapiens
aaccuuuacauccag

SEQ ID NO: 30223 - RNA, 18 nt, Homo sapiens
uacaguuagagauuuuua

SEQ ID NO: 30224 - RNA, 16 nt, Homo sapiens
uaauucuuuaucacau

SEQ ID NO: 30225 - RNA, 12 nt, Homo sapiens
aaaaagccaaaa

SEQ ID NO: 30226 - RNA, 22 nt, Homo sapiens
agcuuuucaaaauuggacuuaa

SEQ ID NO: 30227 - RNA, 17 nt, Homo sapiens
auuaaaaucacaaacuc

SEQ ID NO: 30228 - RNA, 13 nt, Homo sapiens
aaguaaaaccaca

SEQ ID NO: 30229 - RNA, 15 nt, Homo sapiens
auaugacacaucucu

SEQ ID NO: 30230 - RNA, 15 nt, Homo sapiens
uaaaaccacagcagu

SEQ ID NO: 30231 - RNA, 20 nt, Homo sapiens
agguauauaaauuuucccaa

SEQ ID NO: 30232 - RNA, 16 nt, Homo sapiens
gagcaggcuacuguca

SEQ ID NO: 30233 - RNA, 20 nt, Homo sapiens
uuugaacaacucgaaucacu

SEQ ID NO: 30234 - RNA, 16 nt, Homo sapiens
auacauucugcuuuca

SEQ ID NO: 30235 - RNA, 21 nt, Homo sapiens
uaaaaucacaaacucauccau

SEQ ID NO: 30236 - RNA, 18 nt, Homo sapiens
ugagaaagacuauucaaa

SEQ ID NO: 30237 - RNA, 20 nt, Homo sapiens
aagacuauucaaacagucuc

SEQ ID NO: 30238 - RNA, 13 nt, Homo sapiens
uguaaaugugcuu

SEQ ID NO: 30239 - RNA, 14 nt, Homo sapiens
uugugaagaaacau

SEQ ID NO: 30240 - RNA, 20 nt, Homo sapiens
cuuuccagagaccaguauuc

SEQ ID NO: 30241 - RNA, 19 nt, Homo sapiens
cucauuuauuuccauauua

SEQ ID NO: 30242 - RNA, 12 nt, Homo sapiens
caaguccaagca

SEQ ID NO: 30243 - RNA, 18 nt, Homo sapiens
ugaaagaggcagcuugaa

SEQ ID NO: 30244 - RNA, 21 nt, Homo sapiens
uuuaaagcuuauuaaaacuca

SEQ ID NO: 30245 - RNA, 15 nt, Homo sapiens
ugaacacaucagcuu

SEQ ID NO: 30246 - RNA, 19 nt, Homo sapiens
ucaucuuggucacauacaa

SEQ ID NO: 30247 - RNA, 15 nt, Homo sapiens
cacaaacucauccau

SEQ ID NO: 30248 - RNA, 13 nt, Homo sapiens
cugagcaggauuu

SEQ ID NO: 30249 - RNA, 18 nt, Homo sapiens
agcaaauguuaugcauaa

SEQ ID NO: 30250 - RNA, 23 nt, Homo sapiens
uauugauaauaaaauucauucca

SEQ ID NO: 30251 - RNA, 21 nt, Homo sapiens
aaacugagaugugaacacauc

SEQ ID NO: 30252 - RNA, 22 nt, Homo sapiens
uacucugaagggcaucaugcau

SEQ ID NO: 30253 - RNA, 22 nt, Homo sapiens
aagaugugggcagugaugucac

SEQ ID NO: 30254 - RNA, 14 nt, Homo sapiens
aaagacuccaaaga

SEQ ID NO: 30255 - RNA, 20 nt, Homo sapiens
cgaguggcccuucauguaca

SEQ ID NO: 30256 - RNA, 18 nt, Homo sapiens
guuccuucacauccugug

SEQ ID NO: 30257 - RNA, 19 nt, Homo sapiens
guuuuuccacuacugcuac

SEQ ID NO: 30258 - RNA, 21 nt, Homo sapiens
ucacaagugaaaaacauccag

SEQ ID NO: 30259 - RNA, 13 nt, Homo sapiens
cagcuaaguugca

SEQ ID NO: 30260 - RNA, 13 nt, Homo sapiens
caaccaaauggag

SEQ ID NO: 30261 - RNA, 13 nt, Homo sapiens
augcacacagugc

SEQ ID NO: 30262 - RNA, 16 nt, Homo sapiens
ucugcaagcuuuucaa

SEQ ID NO: 30263 - RNA, 16 nt, Homo sapiens
gaguggguuucacaag

SEQ ID NO: 30264 - RNA, 20 nt, Homo sapiens
caagcuuuucaaaauuggac

SEQ ID NO: 30265 - RNA, 23 nt, Homo sapiens
gacuccaaagaaauguaagggaa

SEQ ID NO: 30266 - RNA, 16 nt, Homo sapiens
cuugaaacugagaugu

SEQ ID NO: 30267 - RNA, 22 nt, Homo sapiens
uucugugggagaauucuuacau

SEQ ID NO: 30268 - RNA, 21 nt, Homo sapiens
acuucugucuucacaacagau

SEQ ID NO: 30269 - RNA, 15 nt, Homo sapiens
cugcaagcuuuucaa

SEQ ID NO: 30270 - RNA, 23 nt, Homo sapiens
aucuuguuuuuccacuacugcua

SEQ ID NO: 30271 - RNA, 15 nt, Homo sapiens
cagaaauuuaauuca

SEQ ID NO: 30272 - RNA, 18 nt, Homo sapiens
aggugagcaggugaugcc

SEQ ID NO: 30273 - RNA, 22 nt, Homo sapiens
caacacgagcaggcuacuguca

SEQ ID NO: 30274 - RNA, 16 nt, Homo sapiens
ucuacauacuauggaa

SEQ ID NO: 30275 - RNA, 21 nt, Homo sapiens
aauuuuucucuaacucagaaa

SEQ ID NO: 30276 - RNA, 20 nt, Homo sapiens
caaaugagccggagccccuu

SEQ ID NO: 30277 - RNA, 11 nt, Homo sapiens
augauguuucg

SEQ ID NO: 30278 - RNA, 17 nt, Homo sapiens
uguagccacuucacuuu

SEQ ID NO: 30279 - RNA, 16 nt, Homo sapiens
caaauguuaugcauaa

SEQ ID NO: 30280 - RNA, 16 nt, Homo sapiens
acacacucaaaucaag

SEQ ID NO: 30281 - RNA, 13 nt, Homo sapiens
uccacuacugcua

SEQ ID NO: 30282 - RNA, 23 nt, Homo sapiens
caacacgagcaggcuacugucag

SEQ ID NO: 30283 - RNA, 13 nt, Homo sapiens
ucauguacaucca

SEQ ID NO: 30284 - RNA, 20 nt, Homo sapiens
cuaaucaauacuuugaacac

SEQ ID NO: 30285 - RNA, 15 nt, Homo sapiens
cuggggccuguugaa

SEQ ID NO: 30286 - RNA, 15 nt, Homo sapiens
uuaaagaauuuucaa

SEQ ID NO: 30287 - RNA, 23 nt, Homo sapiens
uccugcuacucuguuccuucaca

SEQ ID NO: 30288 - RNA, 22 nt, Homo sapiens
acgagcaggcuacugucagcuc

SEQ ID NO: 30289 - RNA, 13 nt, Homo sapiens
cacugcauacaau

SEQ ID NO: 30290 - RNA, 19 nt, Homo sapiens
gguuaccuuuguucccaaa

SEQ ID NO: 30291 - RNA, 17 nt, Homo sapiens
acacucaaaucaagaaa

SEQ ID NO: 30292 - RNA, 15 nt, Homo sapiens
auuauucccauucua

SEQ ID NO: 30293 - RNA, 14 nt, Homo sapiens
auucauuccauuug

SEQ ID NO: 30294 - RNA, 23 nt, Homo sapiens
gcuguucacagccagacuggcac

SEQ ID NO: 30295 - RNA, 19 nt, Homo sapiens
uuaaaaaaaaauacugaug

SEQ ID NO: 30296 - RNA, 13 nt, Homo sapiens
gcagugaugucac

SEQ ID NO: 30297 - RNA, 22 nt, Homo sapiens
guuaccaguaacggaacaguau

SEQ ID NO: 30298 - RNA, 15 nt, Homo sapiens
uugaaacugagaugu

SEQ ID NO: 30299 - RNA, 15 nt, Homo sapiens
agaagacaacauuaa

SEQ ID NO: 30300 - RNA, 18 nt, Homo sapiens
ucacuuuuuuucuuuucu

SEQ ID NO: 30301 - RNA, 20 nt, Homo sapiens
acauuacaguuagagauuuu

SEQ ID NO: 30302 - RNA, 15 nt, Homo sapiens
uuuccaaauucacaa

SEQ ID NO: 30303 - RNA, 17 nt, Homo sapiens
uacaaaaacacagcaag

SEQ ID NO: 30304 - RNA, 22 nt, Homo sapiens
acuccaaagaaauguaagggaa

SEQ ID NO: 30305 - RNA, 16 nt, Homo sapiens
ugaaaagacuccaaag

SEQ ID NO: 30306 - RNA, 20 nt, Homo sapiens
acggagauaucccaggaaaa

SEQ ID NO: 30307 - RNA, 19 nt, Homo sapiens
gcucccuggaagagaucaa

SEQ ID NO: 30308 - RNA, 13 nt, Homo sapiens
gcuauaggugcua

SEQ ID NO: 30309 - RNA, 18 nt, Homo sapiens
cauuuuaaaaaauggaac

SEQ ID NO: 30310 - RNA, 15 nt, Homo sapiens
agugacauguuuaca

SEQ ID NO: 30311 - RNA, 11 nt, Homo sapiens
ucacauuugcg

SEQ ID NO: 30312 - RNA, 13 nt, Homo sapiens
uauaucaguccuc

SEQ ID NO: 30313 - RNA, 19 nt, Homo sapiens
aauuauuuuuacaguucuc

SEQ ID NO: 30314 - RNA, 19 nt, Homo sapiens
gucagugcccaacuguuau

SEQ ID NO: 30315 - RNA, 18 nt, Homo sapiens
auaucaguccucuuucaa

SEQ ID NO: 30316 - RNA, 15 nt, Homo sapiens
uuuuaaguaauuuca

SEQ ID NO: 30317 - RNA, 14 nt, Homo sapiens
aagggauggcaaga

SEQ ID NO: 30318 - RNA, 17 nt, Homo sapiens
ucugucuggacuuucca

SEQ ID NO: 30319 - RNA, 18 nt, Homo sapiens
cuaaguaaaaccacagca

SEQ ID NO: 30320 - RNA, 19 nt, Homo sapiens
aaauugaaaggcauucucu

SEQ ID NO: 30321 - RNA, 18 nt, Homo sapiens
aaaagcaguaacugacaa

SEQ ID NO: 30322 - RNA, 17 nt, Homo sapiens
uacaauugaaaugacua

SEQ ID NO: 30323 - RNA, 18 nt, Homo sapiens
uucccaaauuucauaccu

SEQ ID NO: 30324 - RNA, 22 nt, Homo sapiens
uuucugagaaagacuauucaaa

SEQ ID NO: 30325 - RNA, 16 nt, Homo sapiens
aauaauacaccagaga

SEQ ID NO: 30326 - RNA, 16 nt, Homo sapiens
uacaaaaacacagcaa

SEQ ID NO: 30327 - RNA, 23 nt, Homo sapiens
gugauucccuccugcuacucugu

SEQ ID NO: 30328 - RNA, 18 nt, Homo sapiens
ucuucacaacagauuauu

SEQ ID NO: 30329 - RNA, 16 nt, Homo sapiens
auaauaaaauucauuc

SEQ ID NO: 30330 - RNA, 20 nt, Homo sapiens
gcugucuauguggcuguauc

SEQ ID NO: 30331 - RNA, 18 nt, Homo sapiens
accauaaauuuaaaugga

SEQ ID NO: 30332 - RNA, 14 nt, Homo sapiens
ucaaauaugcaaag

SEQ ID NO: 30333 - RNA, 20 nt, Homo sapiens
ucuuauuucauuucuuugag

SEQ ID NO: 30334 - RNA, 12 nt, Homo sapiens
aacugccagcaa

SEQ ID NO: 30335 - RNA, 16 nt, Homo sapiens
ucagaagaaauucugc

SEQ ID NO: 30336 - RNA, 20 nt, Homo sapiens
cugaauacauucugcuuuca

SEQ ID NO: 30337 - RNA, 20 nt, Homo sapiens
ucaggaaaucaaauaugcaa

SEQ ID NO: 30338 - RNA, 16 nt, Homo sapiens
aauuucauaccuauca

SEQ ID NO: 30339 - RNA, 15 nt, Homo sapiens
ccccucggagaagag

SEQ ID NO: 30340 - RNA, 18 nt, Homo sapiens
aagaaaggccagcaaauu

SEQ ID NO: 30341 - RNA, 14 nt, Homo sapiens
acaucuuucacauu

SEQ ID NO: 30342 - RNA, 13 nt, Homo sapiens
ucuucacaacaga

SEQ ID NO: 30343 - RNA, 16 nt, Homo sapiens
cugucuggacuuucca

SEQ ID NO: 30344 - RNA, 19 nt, Homo sapiens
uucuacauacuauggaauu

SEQ ID NO: 30345 - RNA, 17 nt, Homo sapiens
aaaucaaauuccagaau

SEQ ID NO: 30346 - RNA, 17 nt, Homo sapiens
agugcccaacuguuaua

SEQ ID NO: 30347 - RNA, 13 nt, Homo sapiens
ggacuuccauuug

SEQ ID NO: 30348 - RNA, 17 nt, Homo sapiens
uuguaacuuaugaaccu

SEQ ID NO: 30349 - RNA, 15 nt, Homo sapiens
cucccagucauuuaa

SEQ ID NO: 30350 - RNA, 13 nt, Homo sapiens
ucuuaacuugaag

SEQ ID NO: 30351 - RNA, 17 nt, Homo sapiens
auucugcaagcuuuuca

SEQ ID NO: 30352 - RNA, 14 nt, Homo sapiens
guagcaaauuccaa

SEQ ID NO: 30353 - RNA, 13 nt, Homo sapiens
uaaguaaaaccac

SEQ ID NO: 30354 - RNA, 21 nt, Homo sapiens
aggugcuacaaaaacacagca

SEQ ID NO: 30355 - RNA, 20 nt, Homo sapiens
caaccaaauggagugacuua

SEQ ID NO: 30356 - RNA, 14 nt, Homo sapiens
aaaauaccaugcca

SEQ ID NO: 30357 - RNA, 19 nt, Homo sapiens
ucuaaguaaaaccacagca

SEQ ID NO: 30358 - RNA, 19 nt, Homo sapiens
aguaugcacuaaucaauac

SEQ ID NO: 30359 - RNA, 19 nt, Homo sapiens
uggcacaguuuucugagaa

SEQ ID NO: 30360 - RNA, 14 nt, Homo sapiens
aguugauuuuacaa

SEQ ID NO: 30361 - RNA, 13 nt, Homo sapiens
uuuuccuucucau

SEQ ID NO: 30362 - RNA, 20 nt, Homo sapiens
aagcaacaucuagcaaaugu

SEQ ID NO: 30363 - RNA, 15 nt, Homo sapiens
aaucagaucauuuca

SEQ ID NO: 30364 - RNA, 12 nt, Homo sapiens
uaauucuuuauc

SEQ ID NO: 30365 - RNA, 19 nt, Homo sapiens
auuagugaaguaugcacua

SEQ ID NO: 30366 - RNA, 16 nt, Homo sapiens
gaaaggcauucucuga

SEQ ID NO: 30367 - RNA, 14 nt, Homo sapiens
caugaaaagauuau

SEQ ID NO: 30368 - RNA, 14 nt, Homo sapiens
acauaacauaagcu

SEQ ID NO: 30369 - RNA, 22 nt, Homo sapiens
auuuuguuuuuaaacuggaaau

SEQ ID NO: 30370 - RNA, 19 nt, Homo sapiens
uacauuauuggacuuccau

SEQ ID NO: 30371 - RNA, 16 nt, Homo sapiens
aaacauuuaucuuugu

SEQ ID NO: 30372 - RNA, 17 nt, Homo sapiens
uuccguggcacugcaua

SEQ ID NO: 30373 - RNA, 18 nt, Homo sapiens
agauuguauagugcaugu

SEQ ID NO: 30374 - RNA, 21 nt, Homo sapiens
auucgcugcaaccuguugaua

SEQ ID NO: 30375 - RNA, 15 nt, Homo sapiens
acuuuuggcuuguaa

SEQ ID NO: 30376 - RNA, 18 nt, Homo sapiens
uuguagccacuucacuuu

SEQ ID NO: 30377 - RNA, 21 nt, Homo sapiens
uuuaaaaucauuucugcauca

SEQ ID NO: 30378 - RNA, 23 nt, Homo sapiens
agauuuuguuuuuaaacuggaaa

SEQ ID NO: 30379 - RNA, 16 nt, Homo sapiens
guaacuggcaguuuuc

SEQ ID NO: 30380 - RNA, 17 nt, Homo sapiens
uuguaaguuuaugcaua

SEQ ID NO: 30381 - RNA, 20 nt, Homo sapiens
aaaagauuguauagugcaug

SEQ ID NO: 30382 - RNA, 19 nt, Homo sapiens
aguuauggcuauaggugcu

SEQ ID NO: 30383 - RNA, 20 nt, Homo sapiens
guaugcacuaaucaauacuu

SEQ ID NO: 30384 - RNA, 12 nt, Homo sapiens
uaugcacuaauc

SEQ ID NO: 30385 - RNA, 19 nt, Homo sapiens
ggagaaaggacccucaaga

SEQ ID NO: 30386 - RNA, 17 nt, Homo sapiens
gguuaccuuuguuccca

SEQ ID NO: 30387 - RNA, 19 nt, Homo sapiens
aaguuuaugcauacaguaa

SEQ ID NO: 30388 - RNA, 14 nt, Homo sapiens
cugcuuuaauuuca

SEQ ID NO: 30389 - RNA, 15 nt, Homo sapiens
guggcauuuucacuu

SEQ ID NO: 30390 - RNA, 17 nt, Homo sapiens
aaauauaauaugcacac

SEQ ID NO: 30391 - RNA, 14 nt, Homo sapiens
uaaaaccacagcag

SEQ ID NO: 30392 - RNA, 15 nt, Homo sapiens
uguuuuuaaacugga

SEQ ID NO: 30393 - RNA, 21 nt, Homo sapiens
aacacgagcaggcuacuguca

SEQ ID NO: 30394 - RNA, 12 nt, Homo sapiens
aggcauguaauu

SEQ ID NO: 30395 - RNA, 13 nt, Homo sapiens
ccugcagacauga

SEQ ID NO: 30396 - RNA, 14 nt, Homo sapiens
uccuuccuuaucac

SEQ ID NO: 30397 - RNA, 18 nt, Homo sapiens
ucugccuugguauagcau

SEQ ID NO: 30398 - RNA, 18 nt, Homo sapiens
uacuauagauucuuuauu

SEQ ID NO: 30399 - RNA, 20 nt, Homo sapiens
guucucuucuuuaaagggau

SEQ ID NO: 30400 - RNA, 13 nt, Homo sapiens
uucugcaagcuuu

SEQ ID NO: 30401 - RNA, 20 nt, Homo sapiens
auaaagcacuguuuggauau

SEQ ID NO: 30402 - RNA, 18 nt, Homo sapiens
cuggcuggggccuguuga

SEQ ID NO: 30403 - RNA, 16 nt, Homo sapiens
gcuacaaaaacacagc

SEQ ID NO: 30404 - RNA, 15 nt, Homo sapiens
uuccuggacaguuuu

SEQ ID NO: 30405 - RNA, 16 nt, Homo sapiens
ugauucccuccugcua

SEQ ID NO: 30406 - RNA, 20 nt, Homo sapiens
acuucuaaguaaaaccacag

SEQ ID NO: 30407 - RNA, 19 nt, Homo sapiens
uauaucaguccucuuucaa

SEQ ID NO: 30408 - RNA, 19 nt, Homo sapiens
aaugacuaaaaaacaaaga

SEQ ID NO: 30409 - RNA, 17 nt, Homo sapiens
uggaaucauaugggaua

SEQ ID NO: 30410 - RNA, 20 nt, Homo sapiens
uaaguugcaccaacuuugaa

SEQ ID NO: 30411 - RNA, 18 nt, Homo sapiens
cuggcuuaaaauguaauu

SEQ ID NO: 30412 - RNA, 18 nt, Homo sapiens
cacaaacucauccauuaa

SEQ ID NO: 30413 - RNA, 13 nt, Homo sapiens
uguugauagcaag

SEQ ID NO: 30414 - RNA, 21 nt, Homo sapiens
cacagcaagggugaugggaaa

SEQ ID NO: 30415 - RNA, 17 nt, Homo sapiens
uguagauaaacucagaa

SEQ ID NO: 30416 - RNA, 23 nt, Homo sapiens
guauuuuauuacaucuuucacau

SEQ ID NO: 30417 - RNA, 13 nt, Homo sapiens
gacaaauucuguu

SEQ ID NO: 30418 - RNA, 17 nt, Homo sapiens
ugaaaggcauucucuga

SEQ ID NO: 30419 - RNA, 15 nt, Homo sapiens
uggcauuuucacuuu

SEQ ID NO: 30420 - RNA, 17 nt, Homo sapiens
agacuauucaaacaguc

SEQ ID NO: 30421 - RNA, 18 nt, Homo sapiens
uaaguugcaccaacuuug

SEQ ID NO: 30422 - RNA, 17 nt, Homo sapiens
gcauuguaacuuaugaa

SEQ ID NO: 30423 - RNA, 19 nt, Homo sapiens
aucaugcaaaugcuguauu

SEQ ID NO: 30424 - RNA, 16 nt, Homo sapiens
aauaaaaugagcaaaa

SEQ ID NO: 30425 - RNA, 16 nt, Homo sapiens
ucucuaacucagaaac

SEQ ID NO: 30426 - RNA, 15 nt, Homo sapiens
uggacuuccauuugg

SEQ ID NO: 30427 - RNA, 21 nt, Homo sapiens
uauucacaaccacucauucaa

SEQ ID NO: 30428 - RNA, 20 nt, Homo sapiens
ucauuaucucaaaacugcac

SEQ ID NO: 30429 - RNA, 14 nt, Homo sapiens
aaaucauuucugca

SEQ ID NO: 30430 - RNA, 15 nt, Homo sapiens
guagccacuucacuu

SEQ ID NO: 30431 - RNA, 23 nt, Homo sapiens
agcuaaguugcaccaacuuugaa

SEQ ID NO: 30432 - RNA, 12 nt, Homo sapiens
aaaaaaagccaa

SEQ ID NO: 30433 - RNA, 21 nt, Homo sapiens
ucuuaaacacuaaaaaggcau

SEQ ID NO: 30434 - RNA, 19 nt, Homo sapiens
accaguaacggaacaguau

SEQ ID NO: 30435 - RNA, 15 nt, Homo sapiens
uccuauguaacugca

SEQ ID NO: 30436 - RNA, 20 nt, Homo sapiens
gcuacucuguuccuucacau

SEQ ID NO: 30437 - RNA, 20 nt, Homo sapiens
cugucccugcagacaugaga

SEQ ID NO: 30438 - RNA, 15 nt, Homo sapiens
uaucuuaguugguau

SEQ ID NO: 30439 - RNA, 20 nt, Homo sapiens
cuuguugagauccccguguu

SEQ ID NO: 30440 - RNA, 24 nt, Homo sapiens
aaugauuuuacggagauaucccag

SEQ ID NO: 30441 - RNA, 19 nt, Homo sapiens
aaguaugcacuaaucaaua

SEQ ID NO: 30442 - RNA, 20 nt, Homo sapiens
caagcauaccaacacgagca

SEQ ID NO: 30443 - RNA, 14 nt, Homo sapiens
gugaacacaucagc

SEQ ID NO: 30444 - RNA, 22 nt, Homo sapiens
uauuuccauauuaaaaucacaa

SEQ ID NO: 30445 - RNA, 17 nt, Homo sapiens
uucccauucuacauacu

SEQ ID NO: 30446 - RNA, 15 nt, Homo sapiens
cucuggcgacaguuu

SEQ ID NO: 30447 - RNA, 13 nt, Homo sapiens
cuuaaaauguaau

SEQ ID NO: 30448 - RNA, 20 nt, Homo sapiens
gccuguugaagaugcuugua

SEQ ID NO: 30449 - RNA, 23 nt, Homo sapiens
ucacuuuuuuucuuuucucugcc

SEQ ID NO: 30450 - RNA, 14 nt, Homo sapiens
aucaaccaaaugga

SEQ ID NO: 30451 - RNA, 19 nt, Homo sapiens
gucacagaggaucugcuug

SEQ ID NO: 30452 - RNA, 19 nt, Homo sapiens
gcuuuccguggcacugcau

SEQ ID NO: 30453 - RNA, 18 nt, Homo sapiens
cugagaaagacuauucaa

SEQ ID NO: 30454 - RNA, 16 nt, Homo sapiens
auguagauaaagcacu

SEQ ID NO: 30455 - RNA, 22 nt, Homo sapiens
gaccuggucgucgucuugacuu

SEQ ID NO: 30456 - RNA, 22 nt, Homo sapiens
cggagaagagcuguucacagcc

SEQ ID NO: 30457 - RNA, 16 nt, Homo sapiens
gcaaauuccaauacau

SEQ ID NO: 30458 - RNA, 14 nt, Homo sapiens
aaucagaucauuuc

SEQ ID NO: 30459 - RNA, 22 nt, Homo sapiens
caaauucgcugcaaccuguuga

SEQ ID NO: 30460 - RNA, 22 nt, Homo sapiens
aaaggccugucccugcagacau

SEQ ID NO: 30461 - RNA, 19 nt, Homo sapiens
ugcuuguuagcaaaaugga

SEQ ID NO: 30462 - RNA, 19 nt, Homo sapiens
caagcuuuucaaaauugga

SEQ ID NO: 30463 - RNA, 14 nt, Homo sapiens
auuacaucuuucac

SEQ ID NO: 30464 - RNA, 23 nt, Homo sapiens
gcaacgcaggcccccaggugcca

SEQ ID NO: 30465 - RNA, 19 nt, Homo sapiens
ucacaaaucuuaacuugaa

SEQ ID NO: 30466 - RNA, 16 nt, Homo sapiens
uauucccuuuugcugc

SEQ ID NO: 30467 - RNA, 17 nt, Homo sapiens
auuuccaaauucacaag

SEQ ID NO: 30468 - RNA, 23 nt, Homo sapiens
acagaagagugacauguuuacaa

SEQ ID NO: 30469 - RNA, 19 nt, Homo sapiens
uucucuggcgacaguuuuc

SEQ ID NO: 30470 - RNA, 18 nt, Homo sapiens
ugccuugguauagcauau

SEQ ID NO: 30471 - RNA, 11 nt, Homo sapiens
guauauucaaa

SEQ ID NO: 30472 - RNA, 15 nt, Homo sapiens
uagccacuucacuuu

SEQ ID NO: 30473 - RNA, 16 nt, Homo sapiens
ucacaaacucauccau

SEQ ID NO: 30474 - RNA, 21 nt, Homo sapiens
uucaaaaucaaauuccagaau

SEQ ID NO: 30475 - RNA, 16 nt, Homo sapiens
uacauucugcuuucau

SEQ ID NO: 30476 - RNA, 14 nt, Homo sapiens
aguacagacuuuuu

SEQ ID NO: 30477 - RNA, 18 nt, Homo sapiens
cucaaaauaccaugccau

SEQ ID NO: 30478 - RNA, 19 nt, Homo sapiens
ugauacuuuuuucauuauu

SEQ ID NO: 30479 - RNA, 16 nt, Homo sapiens
uuccuuaucacugaca

SEQ ID NO: 30480 - RNA, 13 nt, Homo sapiens
gcugagcagucag

SEQ ID NO: 30481 - RNA, 15 nt, Homo sapiens
caguauccaguacuc

SEQ ID NO: 30482 - RNA, 21 nt, Homo sapiens
aucuuuaaaauacacacucaa

SEQ ID NO: 30483 - RNA, 11 nt, Homo sapiens
acauacugcug

SEQ ID NO: 30484 - RNA, 16 nt, Homo sapiens
gugaaguauacuguau

SEQ ID NO: 30485 - RNA, 21 nt, Homo sapiens
aacacuaaaaaggcauguaau

SEQ ID NO: 30486 - RNA, 21 nt, Homo sapiens
auugaaaggcauucucugaag

SEQ ID NO: 30487 - RNA, 21 nt, Homo sapiens
ucccaaauuucauaccuauca

SEQ ID NO: 30488 - RNA, 18 nt, Homo sapiens
gagaaucagaucauuuca

SEQ ID NO: 30489 - RNA, 19 nt, Homo sapiens
ucaagaugaugaugaucuu

SEQ ID NO: 30490 - RNA, 17 nt, Homo sapiens
cuuguuagcaaaaugga

SEQ ID NO: 30491 - RNA, 23 nt, Homo sapiens
uuuuuccuuccuuaucacugaca

SEQ ID NO: 30492 - RNA, 18 nt, Homo sapiens
aaguccaagcauaccaac

SEQ ID NO: 30493 - RNA, 23 nt, Homo sapiens
uauaaauuuucccaaaacugaua

SEQ ID NO: 30494 - RNA, 23 nt, Homo sapiens
auuggacuuaaaaucuaauucaa

SEQ ID NO: 30495 - RNA, 23 nt, Homo sapiens
aaaaggccugucccugcagacau

SEQ ID NO: 30496 - RNA, 21 nt, Homo sapiens
gcaucaauuuuucuuauuuca

SEQ ID NO: 30497 - RNA, 23 nt, Homo sapiens
gcaaaugcuguauucuucuuugg

SEQ ID NO: 30498 - RNA, 17 nt, Homo sapiens
uaaaaaggcauguaauu

SEQ ID NO: 30499 - RNA, 15 nt, Homo sapiens
ucuacauacuaugga

SEQ ID NO: 30500 - RNA, 19 nt, Homo sapiens
uauuagugaaguaugcacu

SEQ ID NO: 30501 - RNA, 20 nt, Homo sapiens
caacuugaauaauacaccag

SEQ ID NO: 30502 - RNA, 19 nt, Homo sapiens
ccaaauuucauaccuauca

SEQ ID NO: 30503 - RNA, 18 nt, Homo sapiens
acaacuugaauaauacac

SEQ ID NO: 30504 - RNA, 17 nt, Homo sapiens
caaagcugaauacauuc

SEQ ID NO: 30505 - RNA, 17 nt, Homo sapiens
aacuggcaguuuuccau

SEQ ID NO: 30506 - RNA, 12 nt, Homo sapiens
auacacacucaa

SEQ ID NO: 30507 - RNA, 19 nt, Homo sapiens
aaucaaauuccagaaugau

SEQ ID NO: 30508 - RNA, 15 nt, Homo sapiens
guggaugauguuucg

SEQ ID NO: 30509 - RNA, 23 nt, Homo sapiens
acaccauuccuucugcccugcuu

SEQ ID NO: 30510 - RNA, 15 nt, Homo sapiens
gcuuaaaauguaauu

SEQ ID NO: 30511 - RNA, 21 nt, Homo sapiens
uuguuuuaaaauuaaagcuaa

SEQ ID NO: 30512 - RNA, 14 nt, Homo sapiens
agccagacuggcac

SEQ ID NO: 30513 - RNA, 17 nt, Homo sapiens
acauuauuggacuucca

SEQ ID NO: 30514 - RNA, 13 nt, Homo sapiens
gauaaacucagaa

SEQ ID NO: 30515 - RNA, 14 nt, Homo sapiens
ucaguccucuuuca

SEQ ID NO: 30516 - RNA, 19 nt, Homo sapiens
uacauuuccaaauucacaa

SEQ ID NO: 30517 - RNA, 23 nt, Homo sapiens
cucauuuuuguuuucauuaucuc

SEQ ID NO: 30518 - RNA, 17 nt, Homo sapiens
auacauacuauagauuc

SEQ ID NO: 30519 - RNA, 16 nt, Homo sapiens
caacagauuauuaccu

SEQ ID NO: 30520 - RNA, 18 nt, Homo sapiens
aaauuauauuuugaacaa

SEQ ID NO: 30521 - RNA, 19 nt, Homo sapiens
ucacaaccacucauucaaa

SEQ ID NO: 30522 - RNA, 16 nt, Homo sapiens
uuccguggcacugcau

SEQ ID NO: 30523 - RNA, 21 nt, Homo sapiens
ucugauuuuccuggacaguuu

SEQ ID NO: 30524 - RNA, 23 nt, Homo sapiens
aaggcuucucuuaaacacuaaaa

SEQ ID NO: 30525 - RNA, 11 nt, Homo sapiens
aaaagccaaaa

SEQ ID NO: 30526 - RNA, 12 nt, Homo sapiens
aauucauguuuc

SEQ ID NO: 30527 - RNA, 13 nt, Homo sapiens
agacuccaaagaa

SEQ ID NO: 30528 - RNA, 19 nt, Homo sapiens
uguagauaaacucagaaau

SEQ ID NO: 30529 - RNA, 17 nt, Homo sapiens
agaugugggcagugaug

SEQ ID NO: 30530 - RNA, 18 nt, Homo sapiens
uauuuaaagacaaagaca

SEQ ID NO: 30531 - RNA, 20 nt, Homo sapiens
gaaucacucauuuauuucca

SEQ ID NO: 30532 - RNA, 13 nt, Homo sapiens
uccuggacaguuu

SEQ ID NO: 30533 - RNA, 14 nt, Homo sapiens
uuuucauuaucuca

SEQ ID NO: 30534 - RNA, 16 nt, Homo sapiens
auacuguauuuuuacc

SEQ ID NO: 30535 - RNA, 19 nt, Homo sapiens
cugucuggacuuuccagag

SEQ ID NO: 30536 - RNA, 21 nt, Homo sapiens
agcaagugaauuuuucucuaa

SEQ ID NO: 30537 - RNA, 20 nt, Homo sapiens
aauuucauaccuaucaucuu

SEQ ID NO: 30538 - RNA, 21 nt, Homo sapiens
acaaaaaaagcauuguaacuu

SEQ ID NO: 30539 - RNA, 19 nt, Homo sapiens
agaugugaacacaucagcu

SEQ ID NO: 30540 - RNA, 17 nt, Homo sapiens
gaguucugucuggacuu

SEQ ID NO: 30541 - RNA, 23 nt, Homo sapiens
auguagcaaauuccaauacauua

SEQ ID NO: 30542 - RNA, 17 nt, Homo sapiens
ucauguacauccauggu

SEQ ID NO: 30543 - RNA, 23 nt, Homo sapiens
agaaagacuauucaaacagucuc

SEQ ID NO: 30544 - RNA, 17 nt, Homo sapiens
uguaaguuuaugcauac

SEQ ID NO: 30545 - RNA, 22 nt, Homo sapiens
gcacuaaucaauacuuugaaca

SEQ ID NO: 30546 - RNA, 15 nt, Homo sapiens
cauaaagucagugcc

SEQ ID NO: 30547 - RNA, 16 nt, Homo sapiens
ccuucauguacaucca

SEQ ID NO: 30548 - RNA, 16 nt, Homo sapiens
aaaaucacaaacucau

SEQ ID NO: 30549 - RNA, 15 nt, Homo sapiens
augacacaucucuga

SEQ ID NO: 30550 - RNA, 23 nt, Homo sapiens
aauaaaagauuguauagugcaug

SEQ ID NO: 30551 - RNA, 16 nt, Homo sapiens
ucaaauguuguucucu

SEQ ID NO: 30552 - RNA, 21 nt, Homo sapiens
uaacugcauugagaacugcau

SEQ ID NO: 30553 - RNA, 16 nt, Homo sapiens
ugcuaucgccaucaca

SEQ ID NO: 30554 - RNA, 17 nt, Homo sapiens
cuauucaaacagucuca

SEQ ID NO: 30555 - RNA, 20 nt, Homo sapiens
cccaaauuucauaccuauca

SEQ ID NO: 30556 - RNA, 15 nt, Homo sapiens
aagauuaugaucuca

SEQ ID NO: 30557 - RNA, 18 nt, Homo sapiens
cuuggucacauacaauua

SEQ ID NO: 30558 - RNA, 17 nt, Homo sapiens
auugaaaggcauucucu

SEQ ID NO: 30559 - RNA, 14 nt, Homo sapiens
uaguguacaugaaa

SEQ ID NO: 30560 - RNA, 15 nt, Homo sapiens
gacuuaaaaucuaau

SEQ ID NO: 30561 - RNA, 14 nt, Homo sapiens
uuuaaguaauuuca

SEQ ID NO: 30562 - RNA, 22 nt, Homo sapiens
acaagcaggcucaacauaacau

SEQ ID NO: 30563 - RNA, 13 nt, Homo sapiens
aaguacagacuuu

SEQ ID NO: 30564 - RNA, 17 nt, Homo sapiens
gcauuguaaaugugcuu

SEQ ID NO: 30565 - RNA, 17 nt, Homo sapiens
gaauauguaaauagaaa

SEQ ID NO: 30566 - RNA, 15 nt, Homo sapiens
aauucauuccauuug

SEQ ID NO: 30567 - RNA, 18 nt, Homo sapiens
ucaucuuggucacauaca

SEQ ID NO: 30568 - RNA, 23 nt, Homo sapiens
cuccuggcuggggccuguugaag

SEQ ID NO: 30569 - RNA, 15 nt, Homo sapiens
ccuuuacauccagau

SEQ ID NO: 30570 - RNA, 23 nt, Homo sapiens
ucaucugugauucccuccugcua

SEQ ID NO: 30571 - RNA, 18 nt, Homo sapiens
guuuuuccacuacugcua

SEQ ID NO: 30572 - RNA, 17 nt, Homo sapiens
uaacuuaugaaccuuua

SEQ ID NO: 30573 - RNA, 16 nt, Homo sapiens
cuaaaguaucuguauu

SEQ ID NO: 30574 - RNA, 12 nt, Homo sapiens
gauagcaaguga

SEQ ID NO: 30575 - RNA, 12 nt, Homo sapiens
accacauggcuu

SEQ ID NO: 30576 - RNA, 16 nt, Homo sapiens
uucucuaacucagaaa

SEQ ID NO: 30577 - RNA, 18 nt, Homo sapiens
uaauguagauaaagcacu

SEQ ID NO: 30578 - RNA, 19 nt, Homo sapiens
uuauuuagggaacugcuug

SEQ ID NO: 30579 - RNA, 13 nt, Homo sapiens
aucaggacgagaa

SEQ ID NO: 30580 - RNA, 14 nt, Homo sapiens
ugggaaagcauugu

SEQ ID NO: 30581 - RNA, 19 nt, Homo sapiens
acauccagauagguuacca

SEQ ID NO: 30582 - RNA, 14 nt, Homo sapiens
augcaaagcacuga

SEQ ID NO: 30583 - RNA, 19 nt, Homo sapiens
gcuuguuagcaaaauggau

SEQ ID NO: 30584 - RNA, 22 nt, Homo sapiens
acuucuaaguaaaaccacagca

SEQ ID NO: 30585 - RNA, 17 nt, Homo sapiens
caucuuggucacauaca

SEQ ID NO: 30586 - RNA, 16 nt, Homo sapiens
aucaaccaaauggagu

SEQ ID NO: 30587 - RNA, 18 nt, Homo sapiens
cuuuuaaaaaaaaauacu

SEQ ID NO: 30588 - RNA, 18 nt, Homo sapiens
gacaaagacaaauucugu

SEQ ID NO: 30589 - RNA, 12 nt, Homo sapiens
auauuagcuuua

SEQ ID NO: 30590 - RNA, 15 nt, Homo sapiens
auuaaggcuucucuu

SEQ ID NO: 30591 - RNA, 19 nt, Homo sapiens
caggugccaguuauggcua

SEQ ID NO: 30592 - RNA, 15 nt, Homo sapiens
cuugguauagcauau

SEQ ID NO: 30593 - RNA, 20 nt, Homo sapiens
auggaauuucucccagucau

SEQ ID NO: 30594 - RNA, 19 nt, Homo sapiens
ugcuggcuuaaaauguaau

SEQ ID NO: 30595 - RNA, 20 nt, Homo sapiens
cuagcaaauguuaugcauaa

SEQ ID NO: 30596 - RNA, 23 nt, Homo sapiens
gaggauguguggcauuuucacuu

SEQ ID NO: 30597 - RNA, 17 nt, Homo sapiens
caggauaagagggauua

SEQ ID NO: 30598 - RNA, 18 nt, Homo sapiens
cuaauagaauuaauggaa

SEQ ID NO: 30599 - RNA, 20 nt, Homo sapiens
ucauuuuaaaaaauggaaca

SEQ ID NO: 30600 - RNA, 19 nt, Homo sapiens
gcaguugaaaagacuccaa

SEQ ID NO: 30601 - RNA, 20 nt, Homo sapiens
acagcaagggugaugggaaa

SEQ ID NO: 30602 - RNA, 17 nt, Homo sapiens
cucuggcgacaguuuuc

SEQ ID NO: 30603 - RNA, 21 nt, Homo sapiens
agaaaggacccucaagacaaa

SEQ ID NO: 30604 - RNA, 20 nt, Homo sapiens
uucugcccugcuuuugcuag

SEQ ID NO: 30605 - RNA, 22 nt, Homo sapiens
aagaguggguuucacaagugaa

SEQ ID NO: 30606 - RNA, 14 nt, Homo sapiens
aucaguuacucuga

SEQ ID NO: 30607 - RNA, 19 nt, Homo sapiens
augguuccauucucucucc

SEQ ID NO: 30608 - RNA, 13 nt, Homo sapiens
gaaauuaaccaua

SEQ ID NO: 30609 - RNA, 18 nt, Homo sapiens
cccuuuuacauacugcug

SEQ ID NO: 30610 - RNA, 14 nt, Homo sapiens
uaugacacaucucu

SEQ ID NO: 30611 - RNA, 20 nt, Homo sapiens
auuucauaccuaucaucuua

SEQ ID NO: 30612 - RNA, 12 nt, Homo sapiens
caguaacugaca

SEQ ID NO: 30613 - RNA, 22 nt, Homo sapiens
uauuuuuuaugaaacauuacag

SEQ ID NO: 30614 - RNA, 17 nt, Homo sapiens
agaaggauguacauuuc

SEQ ID NO: 30615 - RNA, 12 nt, Homo sapiens
aaaagccaaaaa

SEQ ID NO: 30616 - RNA, 15 nt, Homo sapiens
aucagcuaaguugca

SEQ ID NO: 30617 - RNA, 14 nt, Homo sapiens
aucauaugggauac

SEQ ID NO: 30618 - RNA, 22 nt, Homo sapiens
acacagcaagggugaugggaaa

SEQ ID NO: 30619 - RNA, 20 nt, Homo sapiens
aaagauuucuugaguuuugu

SEQ ID NO: 30620 - RNA, 19 nt, Homo sapiens
auccagauagguuaccagu

SEQ ID NO: 30621 - RNA, 23 nt, Homo sapiens
uuuuauggaggcuuugcauagau

SEQ ID NO: 30622 - RNA, 18 nt, Homo sapiens
ucugauuuuccuggacag

SEQ ID NO: 30623 - RNA, 16 nt, Homo sapiens
auucucucuccuguac

SEQ ID NO: 30624 - RNA, 21 nt, Homo sapiens
aaacuaccagcccuacaccau

SEQ ID NO: 30625 - RNA, 18 nt, Homo sapiens
aucuuuaaaauacacacu

SEQ ID NO: 30626 - RNA, 13 nt, Homo sapiens
uccaaauucacaa

SEQ ID NO: 30627 - RNA, 15 nt, Homo sapiens
aaauauaauaugcac

SEQ ID NO: 30628 - RNA, 19 nt, Homo sapiens
uucuaaguaaaaccacagc

SEQ ID NO: 30629 - RNA, 16 nt, Homo sapiens
auuuuucucuaacuca

SEQ ID NO: 30630 - RNA, 21 nt, Homo sapiens
cuauugugcuuucuaucuaau

SEQ ID NO: 30631 - RNA, 20 nt, Homo sapiens
cacagcugaacuuguugaga

SEQ ID NO: 30632 - RNA, 20 nt, Homo sapiens
caacuauauuaucaugcaaa

SEQ ID NO: 30633 - RNA, 21 nt, Homo sapiens
agaaugauuuuacggagauau

SEQ ID NO: 30634 - RNA, 20 nt, Homo sapiens
agaauauuaaaaauuaauuc

SEQ ID NO: 30635 - RNA, 14 nt, Homo sapiens
aaaugugccuucau

SEQ ID NO: 30636 - RNA, 14 nt, Homo sapiens
acucauccauuaau

SEQ ID NO: 30637 - RNA, 13 nt, Homo sapiens
auucccauucuac

SEQ ID NO: 30638 - RNA, 18 nt, Homo sapiens
aucacucauuuauuucca

SEQ ID NO: 30639 - RNA, 16 nt, Homo sapiens
ucuuaaguagggacuu

SEQ ID NO: 30640 - RNA, 16 nt, Homo sapiens
gcacuuuaaacauuua

SEQ ID NO: 30641 - RNA, 19 nt, Homo sapiens
gcaaccccaucauccucag

SEQ ID NO: 30642 - RNA, 20 nt, Homo sapiens
aaccaaauggagugacuuag

SEQ ID NO: 30643 - RNA, 20 nt, Homo sapiens
uuuuuauggaggcuuugcau

SEQ ID NO: 30644 - RNA, 18 nt, Homo sapiens
aggugcuacaaaaacaca

SEQ ID NO: 30645 - RNA, 19 nt, Homo sapiens
aacaucaguuacucugaag

SEQ ID NO: 30646 - RNA, 14 nt, Homo sapiens
ccaaguuuauauac

SEQ ID NO: 30647 - RNA, 20 nt, Homo sapiens
aaaaccaaauuuguauuuaa

SEQ ID NO: 30648 - RNA, 10 nt, Homo sapiens
cauacugcug

SEQ ID NO: 30649 - RNA, 18 nt, Homo sapiens
gacaggauaagagggauu

SEQ ID NO: 30650 - RNA, 14 nt, Homo sapiens
cacaaaucuuaacu

SEQ ID NO: 30651 - RNA, 20 nt, Homo sapiens
agagaagauagcagggcaug

SEQ ID NO: 30652 - RNA, 14 nt, Homo sapiens
aucuuacugaaggu

SEQ ID NO: 30653 - RNA, 21 nt, Homo sapiens
uucaugaaaagauuaugaucu

SEQ ID NO: 30654 - RNA, 16 nt, Homo sapiens
acuuaguguacaugaa

SEQ ID NO: 30655 - RNA, 15 nt, Homo sapiens
cauccagauagguua

SEQ ID NO: 30656 - RNA, 18 nt, Homo sapiens
ggaguuaggcuauucaca

SEQ ID NO: 30657 - RNA, 22 nt, Homo sapiens
aaacaucaguuacucugaaggg

SEQ ID NO: 30658 - RNA, 22 nt, Homo sapiens
ccagguagagagaccacaagca

SEQ ID NO: 30659 - RNA, 15 nt, Homo sapiens
auugagaacugcaua

SEQ ID NO: 30660 - RNA, 19 nt, Homo sapiens
ucacaaaaguauauucaaa

SEQ ID NO: 30661 - RNA, 16 nt, Homo sapiens
gacuuuggcaaaugag

SEQ ID NO: 30662 - RNA, 22 nt, Homo sapiens
auauuuguaucacaaaucuuaa

SEQ ID NO: 30663 - RNA, 23 nt, Homo sapiens
auuaaaacucauuuuuguuuuca

SEQ ID NO: 30664 - RNA, 15 nt, Homo sapiens
cucaagacaaaugac

SEQ ID NO: 30665 - RNA, 20 nt, Homo sapiens
augaaaagauuaugaucuca

SEQ ID NO: 30666 - RNA, 16 nt, Homo sapiens
aauuccaauacauuau

SEQ ID NO: 30667 - RNA, 23 nt, Homo sapiens
cagaagaaauucugcaagcuuuu

SEQ ID NO: 30668 - RNA, 21 nt, Homo sapiens
caguaauuuuaaguaauuuca

SEQ ID NO: 30669 - RNA, 20 nt, Homo sapiens
aagaccuggucgucgucuug

SEQ ID NO: 30670 - RNA, 20 nt, Homo sapiens
auacauuauuggacuuccau

SEQ ID NO: 30671 - RNA, 15 nt, Homo sapiens
caaccacucauucaa

SEQ ID NO: 30672 - RNA, 16 nt, Homo sapiens
cugauacccuuugaaa

SEQ ID NO: 30673 - RNA, 18 nt, Homo sapiens
acaucaguuacucugaag

SEQ ID NO: 30674 - RNA, 20 nt, Homo sapiens
acagucucaggaaaucaaau

SEQ ID NO: 30675 - RNA, 21 nt, Homo sapiens
caauagaaggauguacauuuc

SEQ ID NO: 30676 - RNA, 16 nt, Homo sapiens
auaugacacaucucug

SEQ ID NO: 30677 - RNA, 13 nt, Homo sapiens
agauuaugaucuc

SEQ ID NO: 30678 - RNA, 12 nt, Homo sapiens
ucccuuuuacau

SEQ ID NO: 30679 - RNA, 16 nt, Homo sapiens
acuaauaaaauacaua

SEQ ID NO: 30680 - RNA, 23 nt, Homo sapiens
gaagagaauauuagcuuuacugu

SEQ ID NO: 30681 - RNA, 17 nt, Homo sapiens
aucaaauuccagaauga

SEQ ID NO: 30682 - RNA, 21 nt, Homo sapiens
agauguagauaaacucagaaa

SEQ ID NO: 30683 - RNA, 17 nt, Homo sapiens
cauuuccaaauucacaa

SEQ ID NO: 30684 - RNA, 18 nt, Homo sapiens
uggaauauguaaauagaa

SEQ ID NO: 30685 - RNA, 20 nt, Homo sapiens
caaucacaaaaguauauuca

SEQ ID NO: 30686 - RNA, 16 nt, Homo sapiens
agauccccguguuacu

SEQ ID NO: 30687 - RNA, 12 nt, Homo sapiens
ugacacaucucu

SEQ ID NO: 30688 - RNA, 18 nt, Homo sapiens
aauuaauggaauauguaa

SEQ ID NO: 30689 - RNA, 22 nt, Homo sapiens
uaaguagggacuucugucuuca

SEQ ID NO: 30690 - RNA, 16 nt, Homo sapiens
auguguggcauuuuca

SEQ ID NO: 30691 - RNA, 22 nt, Homo sapiens
acuucugucuucacaacagauu

SEQ ID NO: 30692 - RNA, 16 nt, Homo sapiens
ucccugcagacaugag

SEQ ID NO: 30693 - RNA, 20 nt, Homo sapiens
aauacugauguuccuaguga

SEQ ID NO: 30694 - RNA, 21 nt, Homo sapiens
uccaaagaaauguaagggaaa

SEQ ID NO: 30695 - RNA, 22 nt, Homo sapiens
aagagaauauuagcuuuacugu

SEQ ID NO: 30696 - RNA, 15 nt, Homo sapiens
cuugggcaggucaca

SEQ ID NO: 30697 - RNA, 21 nt, Homo sapiens
gaugccccagggaccuuugua

SEQ ID NO: 30698 - RNA, 14 nt, Homo sapiens
aauacuuugaacac

SEQ ID NO: 30699 - RNA, 15 nt, Homo sapiens
uaacuggcaguuuuc

SEQ ID NO: 30700 - RNA, 19 nt, Homo sapiens
ugaaaagauuaugaucuca

SEQ ID NO: 30701 - RNA, 23 nt, Homo sapiens
aagaaauucugcaagcuuuucaa

SEQ ID NO: 30702 - RNA, 15 nt, Homo sapiens
aggauaagagggauu

SEQ ID NO: 30703 - RNA, 17 nt, Homo sapiens
cuggacuuuccagagac

SEQ ID NO: 30704 - RNA, 21 nt, Homo sapiens
guuauuuagggaacugcuuga

SEQ ID NO: 30705 - RNA, 14 nt, Homo sapiens
uuucugagaaagac

SEQ ID NO: 30706 - RNA, 19 nt, Homo sapiens
auguuucgcugauauaugu

SEQ ID NO: 30707 - RNA, 12 nt, Homo sapiens
aaguuuaugcau

SEQ ID NO: 30708 - RNA, 18 nt, Homo sapiens
aguaaaaccacagcaguu

SEQ ID NO: 30709 - RNA, 13 nt, Homo sapiens
acagucucaggaa

SEQ ID NO: 30710 - RNA, 15 nt, Homo sapiens
uccuuaucacugaca

SEQ ID NO: 30711 - RNA, 14 nt, Homo sapiens
gaugugaacacauc

SEQ ID NO: 30712 - RNA, 20 nt, Homo sapiens
uuaaaaaaaaauacugaugu

SEQ ID NO: 30713 - RNA, 22 nt, Homo sapiens
uguaaguuuaugcauacaguaa

SEQ ID NO: 30714 - RNA, 21 nt, Homo sapiens
cucggagaagagcuguucaca

SEQ ID NO: 30715 - RNA, 14 nt, Homo sapiens
agaugaugaugauc

SEQ ID NO: 30716 - RNA, 21 nt, Homo sapiens
ugucaagaugaugaugaucuu

SEQ ID NO: 30717 - RNA, 21 nt, Homo sapiens
uauaggugcuacaaaaacaca

SEQ ID NO: 30718 - RNA, 22 nt, Homo sapiens
uagauaaagcacuguuuggaua

SEQ ID NO: 30719 - RNA, 15 nt, Homo sapiens
uuaggcuauucacaa

SEQ ID NO: 30720 - RNA, 15 nt, Homo sapiens
uuccuauguaacugc

SEQ ID NO: 30721 - RNA, 11 nt, Homo sapiens
ugcaagcuuuu

SEQ ID NO: 30722 - RNA, 16 nt, Homo sapiens
aguuaagcaacaucua

SEQ ID NO: 30723 - RNA, 19 nt, Homo sapiens
uaauguagauaaagcacug

SEQ ID NO: 30724 - RNA, 23 nt, Homo sapiens
aguuuuccuucucaucugugauu

SEQ ID NO: 30725 - RNA, 14 nt, Homo sapiens
aaaugagcaaaagu

SEQ ID NO: 30726 - RNA, 14 nt, Homo sapiens
aucacucauuuauu

SEQ ID NO: 30727 - RNA, 16 nt, Homo sapiens
uuguuggauaaaucag

SEQ ID NO: 30728 - RNA, 17 nt, Homo sapiens
auaauaaaauucauucc

SEQ ID NO: 30729 - RNA, 14 nt, Homo sapiens
aagacuauucaaac

SEQ ID NO: 30730 - RNA, 14 nt, Homo sapiens
auaccuaucaucuu

SEQ ID NO: 30731 - RNA, 23 nt, Homo sapiens
cauugagaacugcauauguuucg

SEQ ID NO: 30732 - RNA, 22 nt, Homo sapiens
agcauauguuuuuguaaguuua

SEQ ID NO: 30733 - RNA, 13 nt, Homo sapiens
caagacaaaugac

SEQ ID NO: 30734 - RNA, 18 nt, Homo sapiens
uaauaaaauucauuccau

SEQ ID NO: 30735 - RNA, 18 nt, Homo sapiens
uaauuuuaaguaauuuca

SEQ ID NO: 30736 - RNA, 23 nt, Homo sapiens
guucuucccuuuuacauacugcu

SEQ ID NO: 30737 - RNA, 21 nt, Homo sapiens
auuuuuuaugaaacauuacag

SEQ ID NO: 30738 - RNA, 22 nt, Homo sapiens
aaucugaggccuccucucucag

SEQ ID NO: 30739 - RNA, 21 nt, Homo sapiens
gugcuuuccguggcacugcau

SEQ ID NO: 30740 - RNA, 14 nt, Homo sapiens
auggagugacuuag

SEQ ID NO: 30741 - RNA, 21 nt, Homo sapiens
ucugucuggacuuuccagaga

SEQ ID NO: 30742 - RNA, 20 nt, Homo sapiens
cauauguuuuuguaaguuua

SEQ ID NO: 30743 - RNA, 23 nt, Homo sapiens
guuguucucuucuuuaaagggau

SEQ ID NO: 30744 - RNA, 14 nt, Homo sapiens
gagaaguuaagcaa

SEQ ID NO: 30745 - RNA, 18 nt, Homo sapiens
gggacuucugucuucaca

SEQ ID NO: 30746 - RNA, 19 nt, Homo sapiens
gaagaguggguuucacaag

SEQ ID NO: 30747 - RNA, 21 nt, Homo sapiens
caagguucuucccuuuuacau

SEQ ID NO: 30748 - RNA, 18 nt, Homo sapiens
cgaaugguuccauucucu

SEQ ID NO: 30749 - RNA, 18 nt, Homo sapiens
uuguuuucauuaucucaa

SEQ ID NO: 30750 - RNA, 18 nt, Homo sapiens
gaaagacuauucaaacag

SEQ ID NO: 30751 - RNA, 22 nt, Homo sapiens
ugauucccuccugcuacucugu

SEQ ID NO: 30752 - RNA, 23 nt, Homo sapiens
ucacaacagauuauuaccuuaca

SEQ ID NO: 30753 - RNA, 15 nt, Homo sapiens
auauuaaaaucacaa

SEQ ID NO: 30754 - RNA, 16 nt, Homo sapiens
cuuuuacauacugcug

SEQ ID NO: 30755 - RNA, 15 nt, Homo sapiens
aucuuguuuuuccac

SEQ ID NO: 30756 - RNA, 19 nt, Homo sapiens
uuccuucucaucugugauu

SEQ ID NO: 30757 - RNA, 15 nt, Homo sapiens
uaaucaauacuuuga

SEQ ID NO: 30758 - RNA, 19 nt, Homo sapiens
ucugagaaagacuauucaa

SEQ ID NO: 30759 - RNA, 18 nt, Homo sapiens
uucugucuggacuuucca

SEQ ID NO: 30760 - RNA, 18 nt, Homo sapiens
uuuccacuacugcuacca

SEQ ID NO: 30761 - RNA, 24 nt, Homo sapiens
auauuaaaaucacaaacucaucca

SEQ ID NO: 30762 - RNA, 12 nt, Homo sapiens
aaagccaaaaac

SEQ ID NO: 30763 - RNA, 21 nt, Homo sapiens
uguuuaaaaucauuucugcau

SEQ ID NO: 30764 - RNA, 15 nt, Homo sapiens
aggaauuguuuuuau

SEQ ID NO: 30765 - RNA, 23 nt, Homo sapiens
aagaggcagcuugaaacugagau

SEQ ID NO: 30766 - RNA, 16 nt, Homo sapiens
ucaauacuuugaacac

SEQ ID NO: 30767 - RNA, 18 nt, Homo sapiens
uuaugaaacauuacaguu

SEQ ID NO: 30768 - RNA, 21 nt, Homo sapiens
auucuucuuugguggagauaa

SEQ ID NO: 30769 - RNA, 16 nt, Homo sapiens
aaacauccagauacac

SEQ ID NO: 30770 - RNA, 15 nt, Homo sapiens
cuucauguacaucca

SEQ ID NO: 30771 - RNA, 23 nt, Homo sapiens
cauacaauuauuuuuacaguucu

SEQ ID NO: 30772 - RNA, 18 nt, Homo sapiens
uucaaacuaauagaauua

SEQ ID NO: 30773 - RNA, 22 nt, Homo sapiens
auuuuaacuuccuuggacucau

SEQ ID NO: 30774 - RNA, 23 nt, Homo sapiens
augcuuguauuuuacuuuuccau

SEQ ID NO: 30775 - RNA, 12 nt, Homo sapiens
uuucugcuuuaa

SEQ ID NO: 30776 - RNA, 22 nt, Homo sapiens
acaguuuucugcuuuaauuuca

SEQ ID NO: 30777 - RNA, 21 nt, Homo sapiens
guaaguuuaugcauacaguaa

SEQ ID NO: 30778 - RNA, 16 nt, Homo sapiens
ccaaauuuguauuuaa

SEQ ID NO: 30779 - RNA, 18 nt, Homo sapiens
uuuaaaauacacacucaa

SEQ ID NO: 30780 - RNA, 13 nt, Homo sapiens
aacaaagaagaca

SEQ ID NO: 30781 - RNA, 22 nt, Homo sapiens
acuccugguuccuaggugagca

SEQ ID NO: 30782 - RNA, 23 nt, Homo sapiens
cuacucuguuccuucacauccug

SEQ ID NO: 30783 - RNA, 20 nt, Homo sapiens
aguuaggcuauucacaacca

SEQ ID NO: 30784 - RNA, 12 nt, Homo sapiens
ccaauacauuau

SEQ ID NO: 30785 - RNA, 21 nt, Homo sapiens
gcuugcccuguuaaaagauga

SEQ ID NO: 30786 - RNA, 18 nt, Homo sapiens
caagaugugggcagugau

SEQ ID NO: 30787 - RNA, 16 nt, Homo sapiens
cagagaccaguauucc

SEQ ID NO: 30788 - RNA, 13 nt, Homo sapiens
ccuuuuacauacu

SEQ ID NO: 30789 - RNA, 15 nt, Homo sapiens
aauuucucccaguca

SEQ ID NO: 30790 - RNA, 16 nt, Homo sapiens
cacagcugaacuuguu

SEQ ID NO: 30791 - RNA, 16 nt, Homo sapiens
gcuuuaauuucaugaa

SEQ ID NO: 30792 - RNA, 17 nt, Homo sapiens
aggugcuacaaaaacac

SEQ ID NO: 30793 - RNA, 13 nt, Homo sapiens
accuuuguuccca

SEQ ID NO: 30794 - RNA, 23 nt, Homo sapiens
acucauuuuuguuuucauuaucu

SEQ ID NO: 30795 - RNA, 16 nt, Homo sapiens
auggcuauaggugcua

SEQ ID NO: 30796 - RNA, 13 nt, Homo sapiens
cuguucacagcca

SEQ ID NO: 30797 - RNA, 16 nt, Homo sapiens
agccacuucacuuuuu

SEQ ID NO: 30798 - RNA, 14 nt, Homo sapiens
uacaucuuucacau

SEQ ID NO: 30799 - RNA, 19 nt, Homo sapiens
aucaauagaaggauguaca

SEQ ID NO: 30800 - RNA, 12 nt, Homo sapiens
caucuuucacau

SEQ ID NO: 30801 - RNA, 11 nt, Homo sapiens
aggcauguaau

SEQ ID NO: 30802 - RNA, 14 nt, Homo sapiens
uaaaguacagacuu

SEQ ID NO: 30803 - RNA, 16 nt, Homo sapiens
uuaugaaacauuacag

SEQ ID NO: 30804 - RNA, 16 nt, Homo sapiens
auuuuaaguaauuuca

SEQ ID NO: 30805 - RNA, 20 nt, Homo sapiens
uuuuauggaggcuuugcaua

SEQ ID NO: 30806 - RNA, 19 nt, Homo sapiens
caaauucuguuucuugaga

SEQ ID NO: 30807 - RNA, 20 nt, Homo sapiens
caucagcugcugaaacaaca

SEQ ID NO: 30808 - RNA, 22 nt, Homo sapiens
gaagaguggguuucacaaguga

SEQ ID NO: 30809 - RNA, 15 nt, Homo sapiens
ucuagaauacuaaua

SEQ ID NO: 30810 - RNA, 20 nt, Homo sapiens
uuucacuuuuggcuuguaaa

SEQ ID NO: 30811 - RNA, 14 nt, Homo sapiens
uccaagcauaccaa

SEQ ID NO: 30812 - RNA, 18 nt, Homo sapiens
caagugaaaaacauccag

SEQ ID NO: 30813 - RNA, 17 nt, Homo sapiens
aagaugaugaugaucuu

SEQ ID NO: 30814 - RNA, 12 nt, Homo sapiens
ccacuacugcua

SEQ ID NO: 30815 - RNA, 16 nt, Homo sapiens
uguguggcauuuucac

SEQ ID NO: 30816 - RNA, 17 nt, Homo sapiens
caggcuacugucagcuc

SEQ ID NO: 30817 - RNA, 14 nt, Homo sapiens
accaugccauuuaa

SEQ ID NO: 30818 - RNA, 16 nt, Homo sapiens
cacaaccacucauuca

SEQ ID NO: 30819 - RNA, 21 nt, Homo sapiens
aauuucauaccuaucaucuua

SEQ ID NO: 30820 - RNA, 17 nt, Homo sapiens
cgagcaggcuacuguca

SEQ ID NO: 30821 - RNA, 21 nt, Homo sapiens
ucuuauccugucccuccucca

SEQ ID NO: 30822 - RNA, 24 nt, Homo sapiens
gccggagccccuugggcaggucac

SEQ ID NO: 30823 - RNA, 23 nt, Homo sapiens
aaggaccauaaauuuaaauggag

SEQ ID NO: 30824 - RNA, 20 nt, Homo sapiens
uauuagugaaguaugcacua

SEQ ID NO: 30825 - RNA, 22 nt, Homo sapiens
cuccaaagaaauguaagggaaa

SEQ ID NO: 30826 - RNA, 18 nt, Homo sapiens
aagccaucggagcugcua

SEQ ID NO: 30827 - RNA, 15 nt, Homo sapiens
ugugaacacaucagc

SEQ ID NO: 30828 - RNA, 19 nt, Homo sapiens
auuuucaaaaucaaauucc

SEQ ID NO: 30829 - RNA, 23 nt, Homo sapiens
aaacauuuaaauuauacaaucau

SEQ ID NO: 30830 - RNA, 18 nt, Homo sapiens
cucaaaacugcacuguca

SEQ ID NO: 30831 - RNA, 19 nt, Homo sapiens
cugagcagucagaagaccu

SEQ ID NO: 30832 - RNA, 19 nt, Homo sapiens
cuuuucaaaauuggacuua

SEQ ID NO: 30833 - RNA, 17 nt, Homo sapiens
agauagguuaccaguaa

SEQ ID NO: 30834 - RNA, 21 nt, Homo sapiens
acuuccuuggacucauuuuaa

SEQ ID NO: 30835 - RNA, 14 nt, Homo sapiens
acccaaaguaucag

SEQ ID NO: 30836 - RNA, 12 nt, Homo sapiens
auagcaagugaa

SEQ ID NO: 30837 - RNA, 15 nt, Homo sapiens
ugaacacaaagccug

SEQ ID NO: 30838 - RNA, 17 nt, Homo sapiens
uugaaaagacuccaaag

SEQ ID NO: 30839 - RNA, 21 nt, Homo sapiens
uaagguauauaaauuuuccca

SEQ ID NO: 30840 - RNA, 20 nt, Homo sapiens
cagcauuuuacuacuuuaaa

SEQ ID NO: 30841 - RNA, 17 nt, Homo sapiens
aguaacggaacaguauc

SEQ ID NO: 30842 - RNA, 12 nt, Homo sapiens
aaguaaaaccac

SEQ ID NO: 30843 - RNA, 17 nt, Homo sapiens
augugaacacaucagcu

SEQ ID NO: 30844 - RNA, 12 nt, Homo sapiens
caaauuccagaa

SEQ ID NO: 30845 - RNA, 18 nt, Homo sapiens
cugagaugugaacacauc

SEQ ID NO: 30846 - RNA, 17 nt, Homo sapiens
cucauuuuuguuuucau

SEQ ID NO: 30847 - RNA, 16 nt, Homo sapiens
uuggacuuccauuugg

SEQ ID NO: 30848 - RNA, 17 nt, Homo sapiens
acaaaccucaagccagc

SEQ ID NO: 30849 - RNA, 16 nt, Homo sapiens
uaacugacaacuugaa

SEQ ID NO: 30850 - RNA, 11 nt, Homo sapiens
uuacucugaag

SEQ ID NO: 30851 - RNA, 13 nt, Homo sapiens
aguacagacuuuu

SEQ ID NO: 30852 - RNA, 19 nt, Homo sapiens
uaaaaggccugucccugca

SEQ ID NO: 30853 - RNA, 18 nt, Homo sapiens
gguauauaaauuuuccca

SEQ ID NO: 30854 - RNA, 17 nt, Homo sapiens
aaauucacaaguugugu

SEQ ID NO: 30855 - RNA, 13 nt, Homo sapiens
cuacaaaaacaca

SEQ ID NO: 30856 - RNA, 19 nt, Homo sapiens
aaauacacacucaaaucaa

SEQ ID NO: 30857 - RNA, 13 nt, Homo sapiens
uaaguaauuucag

SEQ ID NO: 30858 - RNA, 22 nt, Homo sapiens
gaugaucuuuaaaauacacacu

SEQ ID NO: 30859 - RNA, 23 nt, Homo sapiens
agaauuuucaaaaucaaauucca

SEQ ID NO: 30860 - RNA, 18 nt, Homo sapiens
agcauaccaacacgagca

SEQ ID NO: 30861 - RNA, 21 nt, Homo sapiens
gacucauuuuaaaaaauggaa

SEQ ID NO: 30862 - RNA, 13 nt, Homo sapiens
ugcaaagcacuga

SEQ ID NO: 30863 - RNA, 13 nt, Homo sapiens
uuacaucuuucac

SEQ ID NO: 30864 - RNA, 15 nt, Homo sapiens
aagauagcagggcau

SEQ ID NO: 30865 - RNA, 16 nt, Homo sapiens
ugaacacaaagccugu

SEQ ID NO: 30866 - RNA, 22 nt, Homo sapiens
cucaaaauaccaugccauuuaa

SEQ ID NO: 30867 - RNA, 19 nt, Homo sapiens
uccauugguuuaccuguga

SEQ ID NO: 30868 - RNA, 16 nt, Homo sapiens
gccuaucagcauuuua

SEQ ID NO: 30869 - RNA, 23 nt, Homo sapiens
uagaguucugucuggacuuucca

SEQ ID NO: 30870 - RNA, 10 nt, Homo sapiens
caguaacuga

SEQ ID NO: 30871 - RNA, 16 nt, Homo sapiens
uuauuuuuacaguucu

SEQ ID NO: 30872 - RNA, 17 nt, Homo sapiens
uaucuuguuuuuccacu

SEQ ID NO: 30873 - RNA, 18 nt, Homo sapiens
aucauuucugcaucagcu

SEQ ID NO: 30874 - RNA, 20 nt, Homo sapiens
aaaacucauuuccuauguaa

SEQ ID NO: 30875 - RNA, 17 nt, Homo sapiens
auguagauaaagcacug

SEQ ID NO: 30876 - RNA, 17 nt, Homo sapiens
gaaucagaucauuucaa

SEQ ID NO: 30877 - RNA, 22 nt, Homo sapiens
acuggcacaguuuucugagaaa

SEQ ID NO: 30878 - RNA, 18 nt, Homo sapiens
ugcuacaaaaacacagca

SEQ ID NO: 30879 - RNA, 21 nt, Homo sapiens
uauagauucuuuauuagugaa

SEQ ID NO: 30880 - RNA, 17 nt, Homo sapiens
aauacacacucaaauca

SEQ ID NO: 30881 - RNA, 16 nt, Homo sapiens
agucucaggaaaucaa

SEQ ID NO: 30882 - RNA, 16 nt, Homo sapiens
caaaauggauaugaca

SEQ ID NO: 30883 - RNA, 23 nt, Homo sapiens
ucucaggaaaucaaauaugcaaa

SEQ ID NO: 30884 - RNA, 16 nt, Homo sapiens
caaguuguguuugaua

SEQ ID NO: 30885 - RNA, 14 nt, Homo sapiens
aaauuuaaauggag

SEQ ID NO: 30886 - RNA, 18 nt, Homo sapiens
uggggcagugcuuggccc

SEQ ID NO: 30887 - RNA, 19 nt, Homo sapiens
uggggcagugcuuggccca

SEQ ID NO: 30888 - RNA, 23 nt, Homo sapiens
ugggacaguuccugagaccagcc

SEQ ID NO: 30889 - RNA, 24 nt, Homo sapiens
ugggacaguuccugagaccagcca

SEQ ID NO: 30890 - RNA, 14 nt, Homo sapiens
ugggagaaucacuu

SEQ ID NO: 30891 - RNA, 17 nt, Homo sapiens
ugggaguggcauguaug

SEQ ID NO: 30892 - RNA, 15 nt, Homo sapiens
uguggcaaaucucua

SEQ ID NO: 30893 - RNA, 23 nt, Homo sapiens
uguggcuguaucuuguuuuucca

SEQ ID NO: 30894 - RNA, 14 nt, Homo sapiens
ugucaaugcagccc

SEQ ID NO: 30895 - RNA, 15 nt, Homo sapiens
ugucaaugcagcccc

SEQ ID NO: 30896 - RNA, 11 nt, Homo sapiens
uggagacacca

SEQ ID NO: 30897 - RNA, 12 nt, Homo sapiens
uggagacaccac

SEQ ID NO: 30898 - RNA, 17 nt, Homo sapiens
uggagacaccaccaccc

SEQ ID NO: 30899 - RNA, 14 nt, Homo sapiens
ugcuuggcccagga

SEQ ID NO: 30900 - RNA, 19 nt, Homo sapiens
ugcuguuuccuagcgcagc

SEQ ID NO: 30901 - RNA, 13 nt, Homo sapiens
uggcaguuuucca

SEQ ID NO: 30902 - RNA, 22 nt, Homo sapiens
uggauguggagggggcgcgugc

SEQ ID NO: 30903 - RNA, 21 nt, Homo sapiens
uggcccaggaguuuggccaga

SEQ ID NO: 30904 - RNA, 14 nt, Homo sapiens
uggccagaagucaa

SEQ ID NO: 30905 - RNA, 15 nt, Homo sapiens
uggcgcgcgccacca

SEQ ID NO: 30906 - RNA, 22 nt, Homo sapiens
uggcccaggaguuuggccagaa

SEQ ID NO: 30907 - RNA, 21 nt, Homo sapiens
uggcgcgcgccaccacgccca

SEQ ID NO: 30908 - RNA, 22 nt, Homo sapiens
uuggcccaggaguuuggccaga

SEQ ID NO: 30909 - RNA, 12 nt, Homo sapiens
uugggcagguca

SEQ ID NO: 30910 - RNA, 21 nt, Homo sapiens
uuuaaaaaaaaaccugagccc

SEQ ID NO: 30911 - RNA, 17 nt, Homo sapiens
uuugguucuaggccggg

SEQ ID NO: 30912 - RNA, 23 nt, Homo sapiens
uugcaugguuuagaaagcuugcc

SEQ ID NO: 30913 - RNA, 17 nt, Homo sapiens
uguugacaugggacauu

SEQ ID NO: 30914 - RNA, 16 nt, Homo sapiens
uguugacaugggacau

SEQ ID NO: 30915 - RNA, 18 nt, Homo sapiens
uguuuccuagcgcagcca

SEQ ID NO: 30916 - RNA, 18 nt, Homo sapiens
uuaaaaaaaaaccugagc

SEQ ID NO: 30917 - RNA, 19 nt, Homo sapiens
uuaaaaaaaaaccugagcc

SEQ ID NO: 30918 - RNA, 20 nt, Homo sapiens
uuaaaaaaaaaccugagccc

SEQ ID NO: 30919 - RNA, 15 nt, Homo sapiens
uuccuagcgcagcca

SEQ ID NO: 30920 - RNA, 17 nt, Homo sapiens
uacucauuaggauggcu

SEQ ID NO: 30921 - RNA, 15 nt, Homo sapiens
uagauaaacucagaa

SEQ ID NO: 30922 - RNA, 16 nt, Homo sapiens
uagauaaacucagaaa

SEQ ID NO: 30923 - RNA, 14 nt, Homo sapiens
uagggaccugcugu

SEQ ID NO: 30924 - RNA, 13 nt, Homo sapiens
uacccaaauggaa

SEQ ID NO: 30925 - RNA, 16 nt, Homo sapiens
guuuagaaagcuugcc

SEQ ID NO: 30926 - RNA, 16 nt, Homo sapiens
guuuccuagcgcagcc

SEQ ID NO: 30927 - RNA, 17 nt, Homo sapiens
guuuccuagcgcagcca

SEQ ID NO: 30928 - RNA, 19 nt, Homo sapiens
guuguuggauaaaucagug

SEQ ID NO: 30929 - RNA, 21 nt, Homo sapiens
uaaccaugcccaagaaugaga

SEQ ID NO: 30930 - RNA, 19 nt, Homo sapiens
ucaaggcuuagacccucau

SEQ ID NO: 30931 - RNA, 17 nt, Homo sapiens
ucaggaguuccuaacca

SEQ ID NO: 30932 - RNA, 15 nt, Homo sapiens
ucagaagaccugguc

SEQ ID NO: 30933 - RNA, 20 nt, Homo sapiens
ucagaccuagaauaauacua

SEQ ID NO: 30934 - RNA, 11 nt, Homo sapiens
ucacuugauga

SEQ ID NO: 30935 - RNA, 10 nt, Homo sapiens
ucaccuguuu

SEQ ID NO: 30936 - RNA, 21 nt, Homo sapiens
ucacauacaauuauuuuuaca

SEQ ID NO: 30937 - RNA, 10 nt, Homo sapiens
ucaagccagc

SEQ ID NO: 30938 - RNA, 11 nt, Homo sapiens
ucaagccagcc

SEQ ID NO: 30939 - RNA, 14 nt, Homo sapiens
uccaagccugacca

SEQ ID NO: 30940 - RNA, 14 nt, Homo sapiens
uccagccugagcga

SEQ ID NO: 30941 - RNA, 18 nt, Homo sapiens
ucagugucaaugcagccc

SEQ ID NO: 30942 - RNA, 16 nt, Homo sapiens
ucauugcaaccuccac

SEQ ID NO: 30943 - RNA, 11 nt, Homo sapiens
ucaggcuggcc

SEQ ID NO: 30944 - RNA, 19 nt, Homo sapiens
ugaaaacuuuaugcuaagu

SEQ ID NO: 30945 - RNA, 19 nt, Homo sapiens
ugaauucccugccuggauc

SEQ ID NO: 30946 - RNA, 18 nt, Homo sapiens
ugagugccuguaaucaca

SEQ ID NO: 30947 - RNA, 21 nt, Homo sapiens
ugagccagugcuuuaauggca

SEQ ID NO: 30948 - RNA, 10 nt, Homo sapiens
ugagcccaug

SEQ ID NO: 30949 - RNA, 11 nt, Homo sapiens
ugagcccaugg

SEQ ID NO: 30950 - RNA, 18 nt, Homo sapiens
ugaccugacagcccaagg

SEQ ID NO: 30951 - RNA, 16 nt, Homo sapiens
ugccuaagugcagccc

SEQ ID NO: 30952 - RNA, 17 nt, Homo sapiens
ugccuaagugcagcccc

SEQ ID NO: 30953 - RNA, 14 nt, Homo sapiens
ugccccugagccca

SEQ ID NO: 30954 - RNA, 12 nt, Homo sapiens
ugcagugagccg

SEQ ID NO: 30955 - RNA, 11 nt, Homo sapiens
ugcaggcguga

SEQ ID NO: 30956 - RNA, 13 nt, Homo sapiens
ugcagugagccga

SEQ ID NO: 30957 - RNA, 12 nt, Homo sapiens
ugccaugcuggc

SEQ ID NO: 30958 - RNA, 14 nt, Homo sapiens
ucccucuuggugcc

SEQ ID NO: 30959 - RNA, 13 nt, Homo sapiens
ucccucuuggugc

SEQ ID NO: 30960 - RNA, 12 nt, Homo sapiens
uccuagcgcagc

SEQ ID NO: 30961 - RNA, 15 nt, Homo sapiens
uccugagaccagcca

SEQ ID NO: 30962 - RNA, 16 nt, Homo sapiens
ucuccgucucccaaag

SEQ ID NO: 30963 - RNA, 13 nt, Homo sapiens
ucuaacucagaaa

SEQ ID NO: 30964 - RNA, 22 nt, Homo sapiens
ucgcugauauauguguuuuuca

SEQ ID NO: 30965 - RNA, 23 nt, Homo sapiens
ucugcccauccugccccugagcc

SEQ ID NO: 30966 - RNA, 16 nt, Homo sapiens
ucugggucucaguguc

SEQ ID NO: 30967 - RNA, 17 nt, Homo sapiens
ucugggucucagugucc

SEQ ID NO: 30968 - RNA, 16 nt, Homo sapiens
gacccucaugcugcca

SEQ ID NO: 30969 - RNA, 17 nt, Homo sapiens
gacccucaugcugccaa

SEQ ID NO: 30970 - RNA, 21 nt, Homo sapiens
gacgggguuugccaugcuggc

SEQ ID NO: 30971 - RNA, 15 nt, Homo sapiens
gagacaccaccaccc

SEQ ID NO: 30972 - RNA, 12 nt, Homo sapiens
gagacaccacca

SEQ ID NO: 30973 - RNA, 16 nt, Homo sapiens
gagacucugucucagu

SEQ ID NO: 30974 - RNA, 22 nt, Homo sapiens
gagacgggguuugccaugcugg

SEQ ID NO: 30975 - RNA, 22 nt, Homo sapiens
gaauuacaggcgugagccacca

SEQ ID NO: 30976 - RNA, 23 nt, Homo sapiens
gaauuacaggcgugagccaccaa

SEQ ID NO: 30977 - RNA, 22 nt, Homo sapiens
gacacaggcuccaaacuggagc

SEQ ID NO: 30978 - RNA, 13 nt, Homo sapiens
gacaccaccaccc

SEQ ID NO: 30979 - RNA, 18 nt, Homo sapiens
gacauguuuacaaaccuc

SEQ ID NO: 30980 - RNA, 19 nt, Homo sapiens
gacagaaagcagaacagug

SEQ ID NO: 30981 - RNA, 22 nt, Homo sapiens
gacaugagagacagcaggucuc

SEQ ID NO: 30982 - RNA, 22 nt, Homo sapiens
gcacagccucuuagaugcaguu

SEQ ID NO: 30983 - RNA, 22 nt, Homo sapiens
gcacuuuaacacagugucuggc

SEQ ID NO: 30984 - RNA, 17 nt, Homo sapiens
gcacuuugggaggcuga

SEQ ID NO: 30985 - RNA, 18 nt, Homo sapiens
gcacuuuaacacaguguc

SEQ ID NO: 30986 - RNA, 12 nt, Homo sapiens
gcaaccuccacc

SEQ ID NO: 30987 - RNA, 15 nt, Homo sapiens
gcaccaaucaugaau

SEQ ID NO: 30988 - RNA, 16 nt, Homo sapiens
gaggacuugggcggga

SEQ ID NO: 30989 - RNA, 15 nt, Homo sapiens
gaggcggguggauca

SEQ ID NO: 30990 - RNA, 18 nt, Homo sapiens
gauaucaugccccuguac

SEQ ID NO: 30991 - RNA, 14 nt, Homo sapiens
gauccuggaaauca

SEQ ID NO: 30992 - RNA, 17 nt, Homo sapiens
gaguggcgcgcgccacc

SEQ ID NO: 30993 - RNA, 18 nt, Homo sapiens
gagugcaguggcgcaauc

SEQ ID NO: 30994 - RNA, 12 nt, Homo sapiens
gccucaguuucc

SEQ ID NO: 30995 - RNA, 18 nt, Homo sapiens
gccugaaagaggaaugaa

SEQ ID NO: 30996 - RNA, 14 nt, Homo sapiens
gccugggugacaga

SEQ ID NO: 30997 - RNA, 20 nt, Homo sapiens
gccuggucaacauggugaaa

SEQ ID NO: 30998 - RNA, 15 nt, Homo sapiens
gccucuuagaugcag

SEQ ID NO: 30999 - RNA, 17 nt, Homo sapiens
gccuggcugggaguggc

SEQ ID NO: 31000 - RNA, 16 nt, Homo sapiens
gcgcagccaugugauu

SEQ ID NO: 31001 - RNA, 15 nt, Homo sapiens
gcgcgcaccuguaau

SEQ ID NO: 31002 - RNA, 18 nt, Homo sapiens
gcgugaccugacagccca

SEQ ID NO: 31003 - RNA, 13 nt, Homo sapiens
gcgugagccacca

SEQ ID NO: 31004 - RNA, 14 nt, Homo sapiens
gcgugagccaccaa

SEQ ID NO: 31005 - RNA, 14 nt, Homo sapiens
gcgcgccaccacgc

SEQ ID NO: 31006 - RNA, 19 nt, Homo sapiens
gccaugcuggccaggcugg

SEQ ID NO: 31007 - RNA, 14 nt, Homo sapiens
gcccaagggugggu

SEQ ID NO: 31008 - RNA, 19 nt, Homo sapiens
gcccaaggguggguggggu

SEQ ID NO: 31009 - RNA, 21 nt, Homo sapiens
gcccaagggugggugggguga

SEQ ID NO: 31010 - RNA, 21 nt, Homo sapiens
gccccugcacuccagccugag

SEQ ID NO: 31011 - RNA, 24 nt, Homo sapiens
gcauuauauuuauuacuguaagaa

SEQ ID NO: 31012 - RNA, 22 nt, Homo sapiens
gccaaggcuggagugcaguggc

SEQ ID NO: 31013 - RNA, 23 nt, Homo sapiens
gccaaggcuggagugcaguggcg

SEQ ID NO: 31014 - RNA, 11 nt, Homo sapiens
gccaaggcugg

SEQ ID NO: 31015 - RNA, 15 nt, Homo sapiens
gccaaccugggggcu

SEQ ID NO: 31016 - RNA, 17 nt, Homo sapiens
ggagcucgugggacagu

SEQ ID NO: 31017 - RNA, 15 nt, Homo sapiens
ggacuugggcgggac

SEQ ID NO: 31018 - RNA, 18 nt, Homo sapiens
ggacauuugcucauggaa

SEQ ID NO: 31019 - RNA, 19 nt, Homo sapiens
ggacauuugcucauggaau

SEQ ID NO: 31020 - RNA, 14 nt, Homo sapiens
ggagacaccaccac

SEQ ID NO: 31021 - RNA, 15 nt, Homo sapiens
ggagacaccaccacc

SEQ ID NO: 31022 - RNA, 15 nt, Homo sapiens
ggaaagggucucccu

SEQ ID NO: 31023 - RNA, 16 nt, Homo sapiens
ggaaagggucucccuc

SEQ ID NO: 31024 - RNA, 19 nt, Homo sapiens
gcuuuugcuaggucacaga

SEQ ID NO: 31025 - RNA, 15 nt, Homo sapiens
ggccagaagucaagg

SEQ ID NO: 31026 - RNA, 16 nt, Homo sapiens
ggccagaagucaaggc

SEQ ID NO: 31027 - RNA, 14 nt, Homo sapiens
ggcgcgcgccacca

SEQ ID NO: 31028 - RNA, 13 nt, Homo sapiens
ggcagugcuuggc

SEQ ID NO: 31029 - RNA, 15 nt, Homo sapiens
ggcagugcuuggccc

SEQ ID NO: 31030 - RNA, 18 nt, Homo sapiens
ggcagugcuuggcccagg

SEQ ID NO: 31031 - RNA, 19 nt, Homo sapiens
ggcagugcuuggcccagga

SEQ ID NO: 31032 - RNA, 13 nt, Homo sapiens
gcuggagcucugc

SEQ ID NO: 31033 - RNA, 14 nt, Homo sapiens
gcuggagcucugcc

SEQ ID NO: 31034 - RNA, 13 nt, Homo sapiens
gcuuagacccuca

SEQ ID NO: 31035 - RNA, 14 nt, Homo sapiens
gcuuagacccucau

SEQ ID NO: 31036 - RNA, 21 nt, Homo sapiens
gcuuagacccucaugcugcca

SEQ ID NO: 31037 - RNA, 22 nt, Homo sapiens
gcuuagacccucaugcugccaa

SEQ ID NO: 31038 - RNA, 19 nt, Homo sapiens
gcuggauucaagugauccg

SEQ ID NO: 31039 - RNA, 20 nt, Homo sapiens
gcugggaauuacaggcguga

SEQ ID NO: 31040 - RNA, 22 nt, Homo sapiens
gcugggaauuacaggcgugagc

SEQ ID NO: 31041 - RNA, 17 nt, Homo sapiens
gcuucaccuguccccga

SEQ ID NO: 31042 - RNA, 22 nt, Homo sapiens
gcuugaggacuugggcgggaca

SEQ ID NO: 31043 - RNA, 13 nt, Homo sapiens
gcuugaacccagg

SEQ ID NO: 31044 - RNA, 16 nt, Homo sapiens
gcucacgccuguaauc

SEQ ID NO: 31045 - RNA, 18 nt, Homo sapiens
gcucccuggaagagauca

SEQ ID NO: 31046 - RNA, 20 nt, Homo sapiens
gcuaucgccaucacagcuga

SEQ ID NO: 31047 - RNA, 14 nt, Homo sapiens
gguggggcagugcu

SEQ ID NO: 31048 - RNA, 19 nt, Homo sapiens
gguucuucuuggucucagu

SEQ ID NO: 31049 - RNA, 16 nt, Homo sapiens
guaacuggcaguuuuc

SEQ ID NO: 31050 - RNA, 21 nt, Homo sapiens
guaaaauugaaaggcauucuc

SEQ ID NO: 31051 - RNA, 15 nt, Homo sapiens
gguggcucacgccug

SEQ ID NO: 31052 - RNA, 15 nt, Homo sapiens
guaaggggaauugag

SEQ ID NO: 31053 - RNA, 15 nt, Homo sapiens
gggucucaguguccu

SEQ ID NO: 31054 - RNA, 13 nt, Homo sapiens
ggguggguggggc

SEQ ID NO: 31055 - RNA, 14 nt, Homo sapiens
ggggcugaugcagu

SEQ ID NO: 31056 - RNA, 22 nt, Homo sapiens
gggcgggacacaggcuccaaac

SEQ ID NO: 31057 - RNA, 15 nt, Homo sapiens
gggcagugcuuggcc

SEQ ID NO: 31058 - RNA, 17 nt, Homo sapiens
ggcgcgcgccaccacgc

SEQ ID NO: 31059 - RNA, 17 nt, Homo sapiens
ggcgcgugcaggcagca

SEQ ID NO: 31060 - RNA, 15 nt, Homo sapiens
ggcuggagugcagug

SEQ ID NO: 31061 - RNA, 15 nt, Homo sapiens
ggcugaggcgggugg

SEQ ID NO: 31062 - RNA, 18 nt, Homo sapiens
gucucccaaagugcuggg

SEQ ID NO: 31063 - RNA, 16 nt, Homo sapiens
gugauuaccagggacu

SEQ ID NO: 31064 - RNA, 13 nt, Homo sapiens
gugggugggguga

SEQ ID NO: 31065 - RNA, 20 nt, Homo sapiens
guggggcagugcuuggccca

SEQ ID NO: 31066 - RNA, 17 nt, Homo sapiens
gugccucaccccuugcc

SEQ ID NO: 31067 - RNA, 21 nt, Homo sapiens
gugcugggaauuacaggcgug

SEQ ID NO: 31068 - RNA, 12 nt, Homo sapiens
guggcgcgcgcc

SEQ ID NO: 31069 - RNA, 13 nt, Homo sapiens
guggcgcgcgcca

SEQ ID NO: 31070 - RNA, 16 nt, Homo sapiens
guggcauuuucacuuu

SEQ ID NO: 31071 - RNA, 17 nt, Homo sapiens
guuccugagaccagcca

SEQ ID NO: 31072 - RNA, 17 nt, Homo sapiens
guucccuugaugaagaa

SEQ ID NO: 31073 - RNA, 21 nt, Homo sapiens
gcaaauugucacaggacagcc

SEQ ID NO: 31074 - RNA, 22 nt, Homo sapiens
gauggaaguugcagugagcuga

SEQ ID NO: 31075 - RNA, 21 nt, Homo sapiens
gcacagccucuuagaugcagu

SEQ ID NO: 31076 - RNA, 16 nt, Homo sapiens
gcaccugcaggcguga

SEQ ID NO: 31077 - RNA, 18 nt, Homo sapiens
gcacuccagccugagcga

SEQ ID NO: 31078 - RNA, 18 nt, Homo sapiens
gccagacaucaacagaua

SEQ ID NO: 31079 - RNA, 18 nt, Homo sapiens
gccagauuuuccugaaaa

SEQ ID NO: 31080 - RNA, 15 nt, Homo sapiens
gccagaagucaaggc

SEQ ID NO: 31081 - RNA, 18 nt, Homo sapiens
gccaugcuggccaggcug

SEQ ID NO: 31082 - RNA, 21 nt, Homo sapiens
gccaaggcuggagugcagugg

SEQ ID NO: 31083 - RNA, 13 nt, Homo sapiens
gccacuucacuuu

SEQ ID NO: 31084 - RNA, 21 nt, Homo sapiens
gcaugaauuuuuuucaucuuc

SEQ ID NO: 31085 - RNA, 20 nt, Homo sapiens
gcaugggccuagcccacugg

SEQ ID NO: 31086 - RNA, 15 nt, Homo sapiens
gcauguaugacguga

SEQ ID NO: 31087 - RNA, 20 nt, Homo sapiens
gcauguaugacgugacuggc

SEQ ID NO: 31088 - RNA, 12 nt, Homo sapiens
gcaucaugcauc

SEQ ID NO: 31089 - RNA, 19 nt, Homo sapiens
gcagugcuuggcccaggag

SEQ ID NO: 31090 - RNA, 13 nt, Homo sapiens
gcaguucugaaga

SEQ ID NO: 31091 - RNA, 14 nt, Homo sapiens
gcaguucugaagaa

SEQ ID NO: 31092 - RNA, 13 nt, Homo sapiens
gcaggcgugaccu

SEQ ID NO: 31093 - RNA, 15 nt, Homo sapiens
gcaggcgugaccuga

SEQ ID NO: 31094 - RNA, 14 nt, Homo sapiens
gcagugcuuggccc

SEQ ID NO: 31095 - RNA, 12 nt, Homo sapiens
gcagugagcuga

SEQ ID NO: 31096 - RNA, 21 nt, Homo sapiens
gcgacaguuuuccuucucauc

SEQ ID NO: 31097 - RNA, 18 nt, Homo sapiens
gccuuggggcugaugcag

SEQ ID NO: 31098 - RNA, 13 nt, Homo sapiens
gccugggugacag

SEQ ID NO: 31099 - RNA, 12 nt, Homo sapiens
gccugggugaca

SEQ ID NO: 31100 - RNA, 15 nt, Homo sapiens
gccggagccccuugg

SEQ ID NO: 31101 - RNA, 18 nt, Homo sapiens
gccgggcgcgguggcuca

SEQ ID NO: 31102 - RNA, 19 nt, Homo sapiens
gccugaaagaggaaugaag

SEQ ID NO: 31103 - RNA, 18 nt, Homo sapiens
gccccuugggcaggucac

SEQ ID NO: 31104 - RNA, 12 nt, Homo sapiens
gccccugagccc

SEQ ID NO: 31105 - RNA, 13 nt, Homo sapiens
gccccugagccca

SEQ ID NO: 31106 - RNA, 11 nt, Homo sapiens
gcccagcuaau

SEQ ID NO: 31107 - RNA, 14 nt, Homo sapiens
gccccgggaguggc

SEQ ID NO: 31108 - RNA, 19 nt, Homo sapiens
gcccaggaguuuggccaga

SEQ ID NO: 31109 - RNA, 22 nt, Homo sapiens
gauccgcccaucuccgucuccc

SEQ ID NO: 31110 - RNA, 23 nt, Homo sapiens
gauccgcccaucuccgucuccca

SEQ ID NO: 31111 - RNA, 16 nt, Homo sapiens
gaucugcuuggucuug

SEQ ID NO: 31112 - RNA, 23 nt, Homo sapiens
gauuccaccuacaugagguacug

SEQ ID NO: 31113 - RNA, 16 nt, Homo sapiens
gaggaaugaaguacuc

SEQ ID NO: 31114 - RNA, 16 nt, Homo sapiens
gagcugcuagaguucu

SEQ ID NO: 31115 - RNA, 20 nt, Homo sapiens
gagcaccugcaggcgugacc

SEQ ID NO: 31116 - RNA, 14 nt, Homo sapiens
gagacaccaccacc

SEQ ID NO: 31117 - RNA, 14 nt, Homo sapiens
gagacagcucugca

SEQ ID NO: 31118 - RNA, 13 nt, Homo sapiens
gagacaccaccac

SEQ ID NO: 31119 - RNA, 11 nt, Homo sapiens
gagacaccacc

SEQ ID NO: 31120 - RNA, 23 nt, Homo sapiens
gagacgggguuugccaugcuggc

SEQ ID NO: 31121 - RNA, 17 nt, Homo sapiens
gagacucugucucaguc

SEQ ID NO: 31122 - RNA, 15 nt, Homo sapiens
gacgugacuggccug

SEQ ID NO: 31123 - RNA, 13 nt, Homo sapiens
gacuugggcggga

SEQ ID NO: 31124 - RNA, 15 nt, Homo sapiens
gacuggccugcugga

SEQ ID NO: 31125 - RNA, 12 nt, Homo sapiens
gacucuuaagaa

SEQ ID NO: 31126 - RNA, 12 nt, Homo sapiens
gaacugcuggau

SEQ ID NO: 31127 - RNA, 14 nt, Homo sapiens
gaacugcuggauuc

SEQ ID NO: 31128 - RNA, 13 nt, Homo sapiens
gaacucucgagcg

SEQ ID NO: 31129 - RNA, 16 nt, Homo sapiens
gaacccgggaggcaga

SEQ ID NO: 31130 - RNA, 13 nt, Homo sapiens
aauugcuaucgcc

SEQ ID NO: 31131 - RNA, 12 nt, Homo sapiens
aauuagccgggc

SEQ ID NO: 31132 - RNA, 17 nt, Homo sapiens
acaaaaauuagccgggc

SEQ ID NO: 31133 - RNA, 19 nt, Homo sapiens
gacaugagagacagcaggu

SEQ ID NO: 31134 - RNA, 12 nt, Homo sapiens
gacaccaccacc

SEQ ID NO: 31135 - RNA, 14 nt, Homo sapiens
gacacacugaagaa

SEQ ID NO: 31136 - RNA, 11 nt, Homo sapiens
gacaccaccac

SEQ ID NO: 31137 - RNA, 19 nt, Homo sapiens
gaccagccaaccugggggc

SEQ ID NO: 31138 - RNA, 13 nt, Homo sapiens
gacacacugaaga

SEQ ID NO: 31139 - RNA, 14 nt, Homo sapiens
gaauuggagcucgu

SEQ ID NO: 31140 - RNA, 20 nt, Homo sapiens
gaaguauccuucagccugaa

SEQ ID NO: 31141 - RNA, 15 nt, Homo sapiens
gaagucaaggcuuag

SEQ ID NO: 31142 - RNA, 11 nt, Homo sapiens
gaagaaugacu

SEQ ID NO: 31143 - RNA, 12 nt, Homo sapiens
gaagaaugacua

SEQ ID NO: 31144 - RNA, 16 nt, Homo sapiens
cuaccaaaaaucucaa

SEQ ID NO: 31145 - RNA, 18 nt, Homo sapiens
cuacagccaggcggcugg

SEQ ID NO: 31146 - RNA, 20 nt, Homo sapiens
cuacacuaagagagaaugag

SEQ ID NO: 31147 - RNA, 14 nt, Homo sapiens
cuacacuccaguga

SEQ ID NO: 31148 - RNA, 24 nt, Homo sapiens
cuaacucagaaacaucaguuacuc

SEQ ID NO: 31149 - RNA, 17 nt, Homo sapiens
cuaaaaggccugucccu

SEQ ID NO: 31150 - RNA, 18 nt, Homo sapiens
cuaaaaggccugucccug

SEQ ID NO: 31151 - RNA, 12 nt, Homo sapiens
cgugagccacca

SEQ ID NO: 31152 - RNA, 19 nt, Homo sapiens
cgucucccaaagugcuggg

SEQ ID NO: 31153 - RNA, 21 nt, Homo sapiens
cgggguuugccaugcuggcca

SEQ ID NO: 31154 - RNA, 16 nt, Homo sapiens
cgcgguggcucacgcc

SEQ ID NO: 31155 - RNA, 13 nt, Homo sapiens
cggguggaucacu

SEQ ID NO: 31156 - RNA, 21 nt, Homo sapiens
cuauuuauugcugaaugacua

SEQ ID NO: 31157 - RNA, 11 nt, Homo sapiens
cucaagccagc

SEQ ID NO: 31158 - RNA, 11 nt, Homo sapiens
cuaggccgggc

SEQ ID NO: 31159 - RNA, 13 nt, Homo sapiens
cuaggccgggcgc

SEQ ID NO: 31160 - RNA, 14 nt, Homo sapiens
cuaucgccaucaca

SEQ ID NO: 31161 - RNA, 13 nt, Homo sapiens
cuccagccugagc

SEQ ID NO: 31162 - RNA, 15 nt, Homo sapiens
cuccagccugagcga

SEQ ID NO: 31163 - RNA, 23 nt, Homo sapiens
cucauuuccuauguaacugcauu

SEQ ID NO: 31164 - RNA, 14 nt, Homo sapiens
cucagaaacaucag

SEQ ID NO: 31165 - RNA, 14 nt, Homo sapiens
cucauggaauugga

SEQ ID NO: 31166 - RNA, 13 nt, Homo sapiens
cgcgcgccaccac

SEQ ID NO: 31167 - RNA, 14 nt, Homo sapiens
cgcgcgccaccacg

SEQ ID NO: 31168 - RNA, 15 nt, Homo sapiens
cgcgccaccacgccc

SEQ ID NO: 31169 - RNA, 19 nt, Homo sapiens
cgcgccaccacgcccagcu

SEQ ID NO: 31170 - RNA, 13 nt, Homo sapiens
cgccuguaauccc

SEQ ID NO: 31171 - RNA, 12 nt, Homo sapiens
cgcgcaccugua

SEQ ID NO: 31172 - RNA, 13 nt, Homo sapiens
cgcgccaccacgc

SEQ ID NO: 31173 - RNA, 13 nt, Homo sapiens
cuggccugcugga

SEQ ID NO: 31174 - RNA, 20 nt, Homo sapiens
cugggaauuacaggcgugag

SEQ ID NO: 31175 - RNA, 19 nt, Homo sapiens
cugggguggguggggcagu

SEQ ID NO: 31176 - RNA, 16 nt, Homo sapiens
cuggaacucucgagcg

SEQ ID NO: 31177 - RNA, 18 nt, Homo sapiens
cuggacuuuccagagacc

SEQ ID NO: 31178 - RNA, 16 nt, Homo sapiens
cuggaaaccacauggc

SEQ ID NO: 31179 - RNA, 18 nt, Homo sapiens
cugcuguuuccuagcgca

SEQ ID NO: 31180 - RNA, 13 nt, Homo sapiens
cugcaauuccacu

SEQ ID NO: 31181 - RNA, 22 nt, Homo sapiens
cugcacaucaaaauaugcccca

SEQ ID NO: 31182 - RNA, 17 nt, Homo sapiens
cugccuaagugcagccc

SEQ ID NO: 31183 - RNA, 12 nt, Homo sapiens
cugccccugagc

SEQ ID NO: 31184 - RNA, 13 nt, Homo sapiens
cugccccugagcc

SEQ ID NO: 31185 - RNA, 13 nt, Homo sapiens
cucguggaacagu

SEQ ID NO: 31186 - RNA, 13 nt, Homo sapiens
cucuaaaugucaa

SEQ ID NO: 31187 - RNA, 13 nt, Homo sapiens
cucgugggacagu

SEQ ID NO: 31188 - RNA, 19 nt, Homo sapiens
cuucucaucugugauuccc

SEQ ID NO: 31189 - RNA, 20 nt, Homo sapiens
cuucucaucugugauucccu

SEQ ID NO: 31190 - RNA, 18 nt, Homo sapiens
cuuccuggcaauagucaa

SEQ ID NO: 31191 - RNA, 13 nt, Homo sapiens
cuuauaauagguu

SEQ ID NO: 31192 - RNA, 19 nt, Homo sapiens
cuucaugcauuugcacuau

SEQ ID NO: 31193 - RNA, 22 nt, Homo sapiens
cuguccccgaaacuaccagccc

SEQ ID NO: 31194 - RNA, 20 nt, Homo sapiens
cuguauuuuaaaagaaugau

SEQ ID NO: 31195 - RNA, 21 nt, Homo sapiens
cuguauuuuaaaagaaugauu

SEQ ID NO: 31196 - RNA, 19 nt, Homo sapiens
cugggauagcugacccagc

SEQ ID NO: 31197 - RNA, 17 nt, Homo sapiens
cuuucacaggggacagg

SEQ ID NO: 31198 - RNA, 22 nt, Homo sapiens
cuugggacaaaaacaaacaaac

SEQ ID NO: 31199 - RNA, 13 nt, Homo sapiens
gaaagcagggacu

SEQ ID NO: 31200 - RNA, 11 nt, Homo sapiens
aaucaggguua

SEQ ID NO: 31201 - RNA, 14 nt, Homo sapiens
ggaguuuggccaga

SEQ ID NO: 31202 - RNA, 15 nt, Homo sapiens
ggaguuuggccagaa

SEQ ID NO: 31203 - RNA, 20 nt, Homo sapiens
ggaguuccuaaccagccugg

SEQ ID NO: 31204 - RNA, 18 nt, Homo sapiens
ggagggggcgcgugcagg

SEQ ID NO: 31205 - RNA, 13 nt, Homo sapiens
ggagacaccacca

SEQ ID NO: 31206 - RNA, 12 nt, Homo sapiens
ggagacaccacc

SEQ ID NO: 31207 - RNA, 16 nt, Homo sapiens
ggagacaccaccaccc

SEQ ID NO: 31208 - RNA, 14 nt, Homo sapiens
gcuguuuucccuga

SEQ ID NO: 31209 - RNA, 15 nt, Homo sapiens
gcuggagcucugccc

SEQ ID NO: 31210 - RNA, 15 nt, Homo sapiens
ggaauugaggacacu

SEQ ID NO: 31211 - RNA, 12 nt, Homo sapiens
ggaaaggcagcu

SEQ ID NO: 31212 - RNA, 14 nt, Homo sapiens
ggaaagggucuccc

SEQ ID NO: 31213 - RNA, 21 nt, Homo sapiens
gcuuggcccaggaguuuggcc

SEQ ID NO: 31214 - RNA, 21 nt, Homo sapiens
gcuacucuguuccuucacauc

SEQ ID NO: 31215 - RNA, 21 nt, Homo sapiens
gcuaucgccaucacagcugaa

SEQ ID NO: 31216 - RNA, 15 nt, Homo sapiens
gcucacgccuguaau

SEQ ID NO: 31217 - RNA, 19 nt, Homo sapiens
gcugagcagucagaagacc

SEQ ID NO: 31218 - RNA, 12 nt, Homo sapiens
gcugaggcgggu

SEQ ID NO: 31219 - RNA, 13 nt, Homo sapiens
gcucuggaaacca

SEQ ID NO: 31220 - RNA, 15 nt, Homo sapiens
gcucuggaaaccaca

SEQ ID NO: 31221 - RNA, 14 nt, Homo sapiens
gcuacucuguuccu

SEQ ID NO: 31222 - RNA, 12 nt, Homo sapiens
gcgcgugcaggc

SEQ ID NO: 31223 - RNA, 14 nt, Homo sapiens
gcgcgcgccaccac

SEQ ID NO: 31224 - RNA, 11 nt, Homo sapiens
gccugcuggau

SEQ ID NO: 31225 - RNA, 16 nt, Homo sapiens
gcgcgcaccuguaauc

SEQ ID NO: 31226 - RNA, 13 nt, Homo sapiens
gcgcgcgccacca

SEQ ID NO: 31227 - RNA, 12 nt, Homo sapiens
gcgcgccaccac

SEQ ID NO: 31228 - RNA, 13 nt, Homo sapiens
gcgcgccaccacg

SEQ ID NO: 31229 - RNA, 13 nt, Homo sapiens
ggaguuuggccag

SEQ ID NO: 31230 - RNA, 19 nt, Homo sapiens
ggcagcaggauagaguggg

SEQ ID NO: 31231 - RNA, 18 nt, Homo sapiens
ggcggguggaucacuuga

SEQ ID NO: 31232 - RNA, 17 nt, Homo sapiens
ggcgugagccaccaaac

SEQ ID NO: 31233 - RNA, 12 nt, Homo sapiens
ggccuggcuggg

SEQ ID NO: 31234 - RNA, 14 nt, Homo sapiens
ggcgugagccacca

SEQ ID NO: 31235 - RNA, 15 nt, Homo sapiens
ggcgugagccaccaa

SEQ ID NO: 31236 - RNA, 18 nt, Homo sapiens
ggcgcgcgccaccacgcc

SEQ ID NO: 31237 - RNA, 16 nt, Homo sapiens
ggcuuagacccucaug

SEQ ID NO: 31238 - RNA, 17 nt, Homo sapiens
ggcuuagacccucaugc

SEQ ID NO: 31239 - RNA, 17 nt, Homo sapiens
gggaguggcgcgcgcca

SEQ ID NO: 31240 - RNA, 17 nt, Homo sapiens
ggcuggagugcaguggc

SEQ ID NO: 31241 - RNA, 23 nt, Homo sapiens
ggcuuagacccucaugcugccaa

SEQ ID NO: 31242 - RNA, 17 nt, Homo sapiens
guaucaaaagaaagaaa

SEQ ID NO: 31243 - RNA, 13 nt, Homo sapiens
gucccagcgaggg

SEQ ID NO: 31244 - RNA, 14 nt, Homo sapiens
guacuccagccugg

SEQ ID NO: 31245 - RNA, 22 nt, Homo sapiens
gguucuaggccgggcgcggugg

SEQ ID NO: 31246 - RNA, 16 nt, Homo sapiens
gguucuaggccgggcg

SEQ ID NO: 31247 - RNA, 14 nt, Homo sapiens
ggugggugggguga

SEQ ID NO: 31248 - RNA, 16 nt, Homo sapiens
gguggcucacgccugu

SEQ ID NO: 31249 - RNA, 15 nt, Homo sapiens
gguggggcagugcuu

SEQ ID NO: 31250 - RNA, 15 nt, Homo sapiens
ggggcugaugcaguu

SEQ ID NO: 31251 - RNA, 21 nt, Homo sapiens
gggcgcgugcaggcagcagga

SEQ ID NO: 31252 - RNA, 20 nt, Homo sapiens
gggcagugcuuggcccagga

SEQ ID NO: 31253 - RNA, 21 nt, Homo sapiens
ggggcagugcuuggcccagga

SEQ ID NO: 31254 - RNA, 19 nt, Homo sapiens
ugaccugacagcccaaggg

SEQ ID NO: 31255 - RNA, 15 nt, Homo sapiens
ugagaagaaugacua

SEQ ID NO: 31256 - RNA, 17 nt, Homo sapiens
ugagacucugucucagu

SEQ ID NO: 31257 - RNA, 16 nt, Homo sapiens
ugagagacagcagguc

SEQ ID NO: 31258 - RNA, 17 nt, Homo sapiens
ugagagacagcaggucu

SEQ ID NO: 31259 - RNA, 18 nt, Homo sapiens
ugaauucccugccuggau

SEQ ID NO: 31260 - RNA, 12 nt, Homo sapiens
ucuaacucagaa

SEQ ID NO: 31261 - RNA, 22 nt, Homo sapiens
ugagccagugcuuuaauggcau

SEQ ID NO: 31262 - RNA, 13 nt, Homo sapiens
ugcugaaugacua

SEQ ID NO: 31263 - RNA, 14 nt, Homo sapiens
ugccauaauuacua

SEQ ID NO: 31264 - RNA, 24 nt, Homo sapiens
ucgcugauauauguguuuuucaca

SEQ ID NO: 31265 - RNA, 13 nt, Homo sapiens
ucgaacugcugga

SEQ ID NO: 31266 - RNA, 17 nt, Homo sapiens
uccugagaccagccaac

SEQ ID NO: 31267 - RNA, 13 nt, Homo sapiens
uccugagaccagc

SEQ ID NO: 31268 - RNA, 20 nt, Homo sapiens
uccuaauaaaaaggugacca

SEQ ID NO: 31269 - RNA, 13 nt, Homo sapiens
uccuagcgcagcc

SEQ ID NO: 31270 - RNA, 14 nt, Homo sapiens
uccuagcgcagcca

SEQ ID NO: 31271 - RNA, 18 nt, Homo sapiens
uccuaggugagcagguga

SEQ ID NO: 31272 - RNA, 22 nt, Homo sapiens
uccagaaauaaugaaauaacua

SEQ ID NO: 31273 - RNA, 12 nt, Homo sapiens
ucaugcugccaa

SEQ ID NO: 31274 - RNA, 12 nt, Homo sapiens
ucaugaauuagu

SEQ ID NO: 31275 - RNA, 21 nt, Homo sapiens
ucaggcuggccaacgggguga

SEQ ID NO: 31276 - RNA, 12 nt, Homo sapiens
ucacuugaugau

SEQ ID NO: 31277 - RNA, 13 nt, Homo sapiens
ucacuugaugaua

SEQ ID NO: 31278 - RNA, 8 nt, Homo sapiens
ucaccugu

SEQ ID NO: 31279 - RNA, 9 nt, Homo sapiens
ucaccuguu

SEQ ID NO: 31280 - RNA, 13 nt, Homo sapiens
uaugccccauuca

SEQ ID NO: 31281 - RNA, 14 nt, Homo sapiens
uaugccccauucaa

SEQ ID NO: 31282 - RNA, 24 nt, Homo sapiens
uaugucauuugcuggagcucugcc

SEQ ID NO: 31283 - RNA, 14 nt, Homo sapiens
uaucgccaucacag

SEQ ID NO: 31284 - RNA, 14 nt, Homo sapiens
uacccaaauggaaa

SEQ ID NO: 31285 - RNA, 12 nt, Homo sapiens
uagggaccugcu

SEQ ID NO: 31286 - RNA, 15 nt, Homo sapiens
gucucgaacugcugg

SEQ ID NO: 31287 - RNA, 16 nt, Homo sapiens
gucucgaacugcugga

SEQ ID NO: 31288 - RNA, 14 nt, Homo sapiens
gugacccugaugaa

SEQ ID NO: 31289 - RNA, 17 nt, Homo sapiens
gucucccaaagugcugg

SEQ ID NO: 31290 - RNA, 16 nt, Homo sapiens
gucucccaaagugcug

SEQ ID NO: 31291 - RNA, 17 nt, Homo sapiens
gugauuaccagggacug

SEQ ID NO: 31292 - RNA, 22 nt, Homo sapiens
gugggacagucaccucauggaa

SEQ ID NO: 31293 - RNA, 23 nt, Homo sapiens
gugggacagucaccucauggaau

SEQ ID NO: 31294 - RNA, 16 nt, Homo sapiens
guggguggggcagugc

SEQ ID NO: 31295 - RNA, 23 nt, Homo sapiens
guguguuuauuucacuugaugau

SEQ ID NO: 31296 - RNA, 19 nt, Homo sapiens
guuaugauuaaguaaugau

SEQ ID NO: 31297 - RNA, 19 nt, Homo sapiens
guuaugcauaaagucagug

SEQ ID NO: 31298 - RNA, 15 nt, Homo sapiens
guuacaacacggacg

SEQ ID NO: 31299 - RNA, 14 nt, Homo sapiens
guuuaaauggucaa

SEQ ID NO: 31300 - RNA, 20 nt, Homo sapiens
guuuagaaagcuugcccugg

SEQ ID NO: 31301 - RNA, 19 nt, Homo sapiens
guugccaaggcuggagugc

SEQ ID NO: 31302 - RNA, 19 nt, Homo sapiens
cagcuacuugggaggcuga

SEQ ID NO: 31303 - RNA, 15 nt, Homo sapiens
cagccaggcggcugg

SEQ ID NO: 31304 - RNA, 16 nt, Homo sapiens
cagccaggcggcugga

SEQ ID NO: 31305 - RNA, 18 nt, Homo sapiens
cagccccuugagaaaccu

SEQ ID NO: 31306 - RNA, 15 nt, Homo sapiens
cagcauuuuacuacu

SEQ ID NO: 31307 - RNA, 16 nt, Homo sapiens
cagcauuuuacuacuu

SEQ ID NO: 31308 - RNA, 17 nt, Homo sapiens
cagcauuuuacuacuuu

SEQ ID NO: 31309 - RNA, 11 nt, Homo sapiens
cagaacaguga

SEQ ID NO: 31310 - RNA, 13 nt, Homo sapiens
cagaagcaaccca

SEQ ID NO: 31311 - RNA, 15 nt, Homo sapiens
cagugcuuuaauggc

SEQ ID NO: 31312 - RNA, 17 nt, Homo sapiens
cagugucaaugcagccc

SEQ ID NO: 31313 - RNA, 14 nt, Homo sapiens
cagugcuuggccca

SEQ ID NO: 31314 - RNA, 15 nt, Homo sapiens
cagugcuuggcccag

SEQ ID NO: 31315 - RNA, 16 nt, Homo sapiens
cagugcuuggcccagg

SEQ ID NO: 31316 - RNA, 11 nt, Homo sapiens
caggcuggcca

SEQ ID NO: 31317 - RNA, 23 nt, Homo sapiens
caggcuggucucgaacugcugga

SEQ ID NO: 31318 - RNA, 18 nt, Homo sapiens
caggaguuccuaaccagc

SEQ ID NO: 31319 - RNA, 19 nt, Homo sapiens
caggcgugagccaccaaac

SEQ ID NO: 31320 - RNA, 15 nt, Homo sapiens
caggcuagauguaug

SEQ ID NO: 31321 - RNA, 18 nt, Homo sapiens
cagugucaaugcagcccc

SEQ ID NO: 31322 - RNA, 13 nt, Homo sapiens
caguguccucauc

SEQ ID NO: 31323 - RNA, 22 nt, Homo sapiens
caguuccugagaccagccaacc

SEQ ID NO: 31324 - RNA, 16 nt, Homo sapiens
caguucugaagaagau

SEQ ID NO: 31325 - RNA, 13 nt, Homo sapiens
cauagaauagugu

SEQ ID NO: 31326 - RNA, 14 nt, Homo sapiens
cauagaauaguguu

SEQ ID NO: 31327 - RNA, 17 nt, Homo sapiens
cauagaauuaacacaug

SEQ ID NO: 31328 - RNA, 14 nt, Homo sapiens
caucaaugaaugaa

SEQ ID NO: 31329 - RNA, 18 nt, Homo sapiens
caugguggcgcgcaccug

SEQ ID NO: 31330 - RNA, 21 nt, Homo sapiens
caugcuggccaggcuggucuc

SEQ ID NO: 31331 - RNA, 13 nt, Homo sapiens
caugcugccaaua

SEQ ID NO: 31332 - RNA, 19 nt, Homo sapiens
ccaccaaacccggccugau

SEQ ID NO: 31333 - RNA, 15 nt, Homo sapiens
ccaccaaacccggcc

SEQ ID NO: 31334 - RNA, 14 nt, Homo sapiens
ccaccaaacccggc

SEQ ID NO: 31335 - RNA, 15 nt, Homo sapiens
cauugcaaccuccac

SEQ ID NO: 31336 - RNA, 22 nt, Homo sapiens
cauggaucugguagggggaaaa

SEQ ID NO: 31337 - RNA, 12 nt, Homo sapiens
cccuacaccauu

SEQ ID NO: 31338 - RNA, 11 nt, Homo sapiens
cccuguacucc

SEQ ID NO: 31339 - RNA, 12 nt, Homo sapiens
cccuguacucca

SEQ ID NO: 31340 - RNA, 22 nt, Homo sapiens
cccucuguugccaaggcuggag

SEQ ID NO: 31341 - RNA, 20 nt, Homo sapiens
ccccugcacuccagccugag

SEQ ID NO: 31342 - RNA, 22 nt, Homo sapiens
ccccugcacuccagccugagcg

SEQ ID NO: 31343 - RNA, 19 nt, Homo sapiens
ccccugcacuccagccuga

SEQ ID NO: 31344 - RNA, 24 nt, Homo sapiens
cccacaccagggccuggcugggag

SEQ ID NO: 31345 - RNA, 16 nt, Homo sapiens
cccaaaacugauaccc

SEQ ID NO: 31346 - RNA, 20 nt, Homo sapiens
cccagcuacuugggaggcug

SEQ ID NO: 31347 - RNA, 20 nt, Homo sapiens
cccagcacuuugggaggcug

SEQ ID NO: 31348 - RNA, 14 nt, Homo sapiens
ccauagggugacac

SEQ ID NO: 31349 - RNA, 23 nt, Homo sapiens
ccaggaguuuggccagaagucaa

SEQ ID NO: 31350 - RNA, 18 nt, Homo sapiens
ccaggaguuuggccagaa

SEQ ID NO: 31351 - RNA, 23 nt, Homo sapiens
ccgggaguggcgcgcgccaccac

SEQ ID NO: 31352 - RNA, 22 nt, Homo sapiens
ccgggaguggcgcgcgccacca

SEQ ID NO: 31353 - RNA, 16 nt, Homo sapiens
ccgggcguggugguga

SEQ ID NO: 31354 - RNA, 18 nt, Homo sapiens
ccgggaguggcgcgcgcc

SEQ ID NO: 31355 - RNA, 21 nt, Homo sapiens
ccuguguuucuagggaaauga

SEQ ID NO: 31356 - RNA, 14 nt, Homo sapiens
ccuuugggaaagga

SEQ ID NO: 31357 - RNA, 22 nt, Homo sapiens
ccugcuguuuccuagcgcagcc

SEQ ID NO: 31358 - RNA, 15 nt, Homo sapiens
ccugccccugagccc

SEQ ID NO: 31359 - RNA, 20 nt, Homo sapiens
ccucaugcugccaauauccu

SEQ ID NO: 31360 - RNA, 21 nt, Homo sapiens
ccucccuucucuucacaguca

SEQ ID NO: 31361 - RNA, 12 nt, Homo sapiens
ccugcaggcgug

SEQ ID NO: 31362 - RNA, 8 nt, Homo sapiens
ccugagcc

SEQ ID NO: 31363 - RNA, 20 nt, Homo sapiens
cuccagugagacagcucugc

SEQ ID NO: 31364 - RNA, 21 nt, Homo sapiens
cuccagugagacagcucugca

SEQ ID NO: 31365 - RNA, 15 nt, Homo sapiens
cuccaccuucugggu

SEQ ID NO: 31366 - RNA, 14 nt, Homo sapiens
cuccagccugagcg

SEQ ID NO: 31367 - RNA, 14 nt, Homo sapiens
cuccgucucccaaa

SEQ ID NO: 31368 - RNA, 22 nt, Homo sapiens
cucggagggauuccccuaaccu

SEQ ID NO: 31369 - RNA, 17 nt, Homo sapiens
cuggaaaccacauggcu

SEQ ID NO: 31370 - RNA, 15 nt, Homo sapiens
cuggaacucucgagc

SEQ ID NO: 31371 - RNA, 18 nt, Homo sapiens
cugccuaagugcagcccc

SEQ ID NO: 31372 - RNA, 15 nt, Homo sapiens
cugccccugagccca

SEQ ID NO: 31373 - RNA, 14 nt, Homo sapiens
cugccccugagccc

SEQ ID NO: 31374 - RNA, 12 nt, Homo sapiens
cugagaccagcc

SEQ ID NO: 31375 - RNA, 13 nt, Homo sapiens
cugagaccagcca

SEQ ID NO: 31376 - RNA, 12 nt, Homo sapiens
cugaggcgggug

SEQ ID NO: 31377 - RNA, 19 nt, Homo sapiens
cuggagugcaguggcgcaa

SEQ ID NO: 31378 - RNA, 18 nt, Homo sapiens
cuggagugcaguggcgca

SEQ ID NO: 31379 - RNA, 15 nt, Homo sapiens
cugucccagcgaggg

SEQ ID NO: 31380 - RNA, 21 nt, Homo sapiens
cuguccccgaaacuaccagcc

SEQ ID NO: 31381 - RNA, 16 nt, Homo sapiens
cuggcugggaguggca

SEQ ID NO: 31382 - RNA, 19 nt, Homo sapiens
cuguaaaauggagacacca

SEQ ID NO: 31383 - RNA, 20 nt, Homo sapiens
cuuagacccucaugcugcca

SEQ ID NO: 31384 - RNA, 17 nt, Homo sapiens
cuuccuggcaauaguca

SEQ ID NO: 31385 - RNA, 20 nt, Homo sapiens
cuuggcccaggaguuuggcc

SEQ ID NO: 31386 - RNA, 15 nt, Homo sapiens
cuugaacccgggagg

SEQ ID NO: 31387 - RNA, 21 nt, Homo sapiens
cuuugggaggcugaggcgggu

SEQ ID NO: 31388 - RNA, 22 nt, Homo sapiens
cucauuuccuauguaacugcau

SEQ ID NO: 31389 - RNA, 20 nt, Homo sapiens
cucauggaauuggagcucgu

SEQ ID NO: 31390 - RNA, 12 nt, Homo sapiens
cucaagccagcc

SEQ ID NO: 31391 - RNA, 20 nt, Homo sapiens
cuauuuauugcugaaugacu

SEQ ID NO: 31392 - RNA, 22 nt, Homo sapiens
cuauuuauugcugaaugacuac

SEQ ID NO: 31393 - RNA, 16 nt, Homo sapiens
cuauuacgugcaauac

SEQ ID NO: 31394 - RNA, 12 nt, Homo sapiens
cuaggccgggcg

SEQ ID NO: 31395 - RNA, 11 nt, Homo sapiens
cgcgccaccac

SEQ ID NO: 31396 - RNA, 15 nt, Homo sapiens
cgcgcgccaccacgc

SEQ ID NO: 31397 - RNA, 21 nt, Homo sapiens
cgggaguggcgcgcgccacca

SEQ ID NO: 31398 - RNA, 16 nt, Homo sapiens
cgggaguggcgcgcgc

SEQ ID NO: 31399 - RNA, 18 nt, Homo sapiens
cgggaguggcgcgcgcca

SEQ ID NO: 31400 - RNA, 20 nt, Homo sapiens
cuaaccucauuccccaacca

SEQ ID NO: 31401 - RNA, 13 nt, Homo sapiens
cgugacuggccug

SEQ ID NO: 31402 - RNA, 14 nt, Homo sapiens
cgugacuggccugc

SEQ ID NO: 31403 - RNA, 18 nt, Homo sapiens
cgucucccaaagugcugg

SEQ ID NO: 31404 - RNA, 16 nt, Homo sapiens
cgguuuaaugggcaca

SEQ ID NO: 31405 - RNA, 14 nt, Homo sapiens
cgcgccaccacgcc

SEQ ID NO: 31406 - RNA, 16 nt, Homo sapiens
cgcgccaccacgccca

SEQ ID NO: 31407 - RNA, 11 nt, Homo sapiens
cgcgcaccugu

SEQ ID NO: 31408 - RNA, 18 nt, Homo sapiens
cgcaccuguaaucccagc

SEQ ID NO: 31409 - RNA, 22 nt, Homo sapiens
cgaacugcuggauucaagugau

SEQ ID NO: 31410 - RNA, 17 nt, Homo sapiens
cgaaugguuccauucuc

SEQ ID NO: 31411 - RNA, 17 nt, Homo sapiens
cgccaccacgcccagcu

SEQ ID NO: 31412 - RNA, 12 nt, Homo sapiens
uggcgcgcgcca

SEQ ID NO: 31413 - RNA, 20 nt, Homo sapiens
ugggaauuacaggcgugagc

SEQ ID NO: 31414 - RNA, 16 nt, Homo sapiens
uggggcagugcuuggc

SEQ ID NO: 31415 - RNA, 17 nt, Homo sapiens
uggccagaagucaaggc

SEQ ID NO: 31416 - RNA, 18 nt, Homo sapiens
uggcgcgcgccaccacgc

SEQ ID NO: 31417 - RNA, 15 nt, Homo sapiens
uggagacaccaccac

SEQ ID NO: 31418 - RNA, 14 nt, Homo sapiens
uggagacaccacca

SEQ ID NO: 31419 - RNA, 16 nt, Homo sapiens
uggagacaccaccacc

SEQ ID NO: 31420 - RNA, 22 nt, Homo sapiens
ugcuguuuccuagcgcagccau

SEQ ID NO: 31421 - RNA, 18 nt, Homo sapiens
uguuaaaacugggacagg

SEQ ID NO: 31422 - RNA, 13 nt, Homo sapiens
uguacuuuuucca

SEQ ID NO: 31423 - RNA, 20 nt, Homo sapiens
ugguucuucuuggucucagu

SEQ ID NO: 31424 - RNA, 15 nt, Homo sapiens
ugggguggguggggc

SEQ ID NO: 31425 - RNA, 20 nt, Homo sapiens
uggggcagugcuuggcccag

SEQ ID NO: 31426 - RNA, 15 nt, Homo sapiens
accacccuugccaug

SEQ ID NO: 31427 - RNA, 11 nt, Homo sapiens
accagccuggu

SEQ ID NO: 31428 - RNA, 12 nt, Homo sapiens
accagccugguc

SEQ ID NO: 31429 - RNA, 15 nt, Homo sapiens
acaugagagacagca

SEQ ID NO: 31430 - RNA, 10 nt, Homo sapiens
acaggcguga

SEQ ID NO: 31431 - RNA, 22 nt, Homo sapiens
acagucacauuccaagccucau

SEQ ID NO: 31432 - RNA, 11 nt, Homo sapiens
uuagccgggcg

SEQ ID NO: 31433 - RNA, 12 nt, Homo sapiens
uuagccgggcgu

SEQ ID NO: 31434 - RNA, 13 nt, Homo sapiens
uuagccgggcgug

SEQ ID NO: 31435 - RNA, 15 nt, Homo sapiens
acuuugggaggcuga

SEQ ID NO: 31436 - RNA, 14 nt, Homo sapiens
acuugggaggcuga

SEQ ID NO: 31437 - RNA, 20 nt, Homo sapiens
agcagucagaagaccugguc

SEQ ID NO: 31438 - RNA, 21 nt, Homo sapiens
agcaccugcaggcgugaccug

SEQ ID NO: 31439 - RNA, 15 nt, Homo sapiens
agccuggucaacaug

SEQ ID NO: 31440 - RNA, 16 nt, Homo sapiens
agccuggucaacaugg

SEQ ID NO: 31441 - RNA, 15 nt, Homo sapiens
agccccgggaguggc

SEQ ID NO: 31442 - RNA, 17 nt, Homo sapiens
uuggugccucaguuucc

SEQ ID NO: 31443 - RNA, 14 nt, Homo sapiens
acccucaugcugcc

SEQ ID NO: 31444 - RNA, 16 nt, Homo sapiens
uuugcuaagcauucca

SEQ ID NO: 31445 - RNA, 9 nt, Homo sapiens
accugagcc

SEQ ID NO: 31446 - RNA, 10 nt, Homo sapiens
accugagccc

SEQ ID NO: 31447 - RNA, 11 nt, Homo sapiens
accugagcccc

SEQ ID NO: 31448 - RNA, 17 nt, Homo sapiens
acugggguggguggggc

SEQ ID NO: 31449 - RNA, 13 nt, Homo sapiens
acuccagccuggg

SEQ ID NO: 31450 - RNA, 19 nt, Homo sapiens
acucuuaggaagagaaacc

SEQ ID NO: 31451 - RNA, 11 nt, Homo sapiens
acgugacuggc

SEQ ID NO: 31452 - RNA, 15 nt, Homo sapiens
accuguccccgaaac

SEQ ID NO: 31453 - RNA, 22 nt, Homo sapiens
agucaaggcuuagacccucaug

SEQ ID NO: 31454 - RNA, 22 nt, Homo sapiens
agggucucccucuguugccaag

SEQ ID NO: 31455 - RNA, 20 nt, Homo sapiens
aggcuuagacccucaugcug

SEQ ID NO: 31456 - RNA, 14 nt, Homo sapiens
agcuguugagcugu

SEQ ID NO: 31457 - RNA, 20 nt, Homo sapiens
aggcgugaccugacagccca

SEQ ID NO: 31458 - RNA, 21 nt, Homo sapiens
agccgggcaugguggcgcgca

SEQ ID NO: 31459 - RNA, 16 nt, Homo sapiens
auccuucagccugaaa

SEQ ID NO: 31460 - RNA, 14 nt, Homo sapiens
aucucaauauuuca

SEQ ID NO: 31461 - RNA, 13 nt, Homo sapiens
auacaaucaucaa

SEQ ID NO: 31462 - RNA, 15 nt, Homo sapiens
auaccacaggaacca

SEQ ID NO: 31463 - RNA, 16 nt, Homo sapiens
aguugcagugagcuga

SEQ ID NO: 31464 - RNA, 16 nt, Homo sapiens
aguggcgcgcgccacc

SEQ ID NO: 31465 - RNA, 17 nt, Homo sapiens
agugcuuggcccaggag

SEQ ID NO: 31466 - RNA, 21 nt, Homo sapiens
caccugcaggcgugaccugac

SEQ ID NO: 31467 - RNA, 13 nt, Homo sapiens
caccuguaauccc

SEQ ID NO: 31468 - RNA, 11 nt, Homo sapiens
caccugcaggc

SEQ ID NO: 31469 - RNA, 17 nt, Homo sapiens
caccaaacccggccuga

SEQ ID NO: 31470 - RNA, 12 nt, Homo sapiens
caccaaggcuga

SEQ ID NO: 31471 - RNA, 20 nt, Homo sapiens
cacaagugaaaaacauccag

SEQ ID NO: 31472 - RNA, 17 nt, Homo sapiens
caauuauaucaguccuc

SEQ ID NO: 31473 - RNA, 15 nt, Homo sapiens
cacaaccugucccag

SEQ ID NO: 31474 - RNA, 15 nt, Homo sapiens
caaaauugggaaagg

SEQ ID NO: 31475 - RNA, 12 nt, Homo sapiens
caaagugcuggg

SEQ ID NO: 31476 - RNA, 13 nt, Homo sapiens
caaagugcuggga

SEQ ID NO: 31477 - RNA, 17 nt, Homo sapiens
caagugauccgcccauc

SEQ ID NO: 31478 - RNA, 18 nt, Homo sapiens
caagugauccgcccaucu

SEQ ID NO: 31479 - RNA, 21 nt, Homo sapiens
caaggcuuagacccucaugcu

SEQ ID NO: 31480 - RNA, 11 nt, Homo sapiens
caagcacuuuc

SEQ ID NO: 31481 - RNA, 13 nt, Homo sapiens
caagcacuuuccc

SEQ ID NO: 31482 - RNA, 15 nt, Homo sapiens
auuacaggcgugagc

SEQ ID NO: 31483 - RNA, 20 nt, Homo sapiens
auuacuguaagaaaauauca

SEQ ID NO: 31484 - RNA, 21 nt, Homo sapiens
auuacuguaagaaaauaucac

SEQ ID NO: 31485 - RNA, 12 nt, Homo sapiens
auuagccgggcg

SEQ ID NO: 31486 - RNA, 21 nt, Homo sapiens
auuccaagccucauguccacu

SEQ ID NO: 31487 - RNA, 14 nt, Homo sapiens
auuccaagccugac

SEQ ID NO: 31488 - RNA, 18 nt, Homo sapiens
auggagacaccaccaccc

SEQ ID NO: 31489 - RNA, 23 nt, Homo sapiens
augugucaggugacccugaugaa

SEQ ID NO: 31490 - RNA, 20 nt, Homo sapiens
augugauuacccucuggguc

SEQ ID NO: 31491 - RNA, 22 nt, Homo sapiens
augacgugacuggccugcugga

SEQ ID NO: 31492 - RNA, 15 nt, Homo sapiens
auggaauuggagcuc

SEQ ID NO: 31493 - RNA, 14 nt, Homo sapiens
auggagacaccacc

SEQ ID NO: 31494 - RNA, 17 nt, Homo sapiens
auggagacaccaccacc

SEQ ID NO: 31495 - RNA, 14 nt, Homo sapiens
augcuggccaggcu

SEQ ID NO: 31496 - RNA, 11 nt, Homo sapiens
cgacaguuuuc

SEQ ID NO: 31497 - RNA, 16 nt, Homo sapiens
cgccuguaaucccagc

SEQ ID NO: 31498 - RNA, 13 nt, Homo sapiens
ccuuugggaaagg

SEQ ID NO: 31499 - RNA, 10 nt, Homo sapiens
ccuuuuuccu

SEQ ID NO: 31500 - RNA, 14 nt, Homo sapiens
ccgggaguggcgcg

SEQ ID NO: 31501 - RNA, 19 nt, Homo sapiens
ccgggcgcgguggcucacg

SEQ ID NO: 31502 - RNA, 14 nt, Homo sapiens
ccucaugcugccaa

SEQ ID NO: 31503 - RNA, 15 nt, Homo sapiens
ccucaugcugccaau

SEQ ID NO: 31504 - RNA, 11 nt, Homo sapiens
ccgggcgcggu

SEQ ID NO: 31505 - RNA, 16 nt, Homo sapiens
ccugccccugagccca

SEQ ID NO: 31506 - RNA, 14 nt, Homo sapiens
ccugcacuccagcc

SEQ ID NO: 31507 - RNA, 14 nt, Homo sapiens
ccugcaggcgugac

SEQ ID NO: 31508 - RNA, 14 nt, Homo sapiens
ccugccccugagcc

SEQ ID NO: 31509 - RNA, 11 nt, Homo sapiens
cccuacaccau

SEQ ID NO: 31510 - RNA, 14 nt, Homo sapiens
cccaggaguuuggc

SEQ ID NO: 31511 - RNA, 14 nt, Homo sapiens
ccccgggaguggcg

SEQ ID NO: 31512 - RNA, 16 nt, Homo sapiens
ccccgggaguggcgcg

SEQ ID NO: 31513 - RNA, 20 nt, Homo sapiens
cccccauuguggucacagga

SEQ ID NO: 31514 - RNA, 15 nt, Homo sapiens
ccacauggcuucacc

SEQ ID NO: 31515 - RNA, 12 nt, Homo sapiens
ccacuucacuuu

SEQ ID NO: 31516 - RNA, 22 nt, Homo sapiens
ccaaggcuggagugcaguggcg

SEQ ID NO: 31517 - RNA, 14 nt, Homo sapiens
ccacauggcuucac

SEQ ID NO: 31518 - RNA, 16 nt, Homo sapiens
cauugcaaccuccacc

SEQ ID NO: 31519 - RNA, 12 nt, Homo sapiens
cauuuucacuuu

SEQ ID NO: 31520 - RNA, 15 nt, Homo sapiens
cauugagaacugcau

SEQ ID NO: 31521 - RNA, 19 nt, Homo sapiens
ccagccugagcgacaguga

SEQ ID NO: 31522 - RNA, 15 nt, Homo sapiens
cccaaaacugauacc

SEQ ID NO: 31523 - RNA, 15 nt, Homo sapiens
cccaaagugcuggga

SEQ ID NO: 31524 - RNA, 16 nt, Homo sapiens
cccacaagaaaugaaa

SEQ ID NO: 31525 - RNA, 19 nt, Homo sapiens
cccagccccuugagaaacc

SEQ ID NO: 31526 - RNA, 20 nt, Homo sapiens
cccagccccuugagaaaccu

SEQ ID NO: 31527 - RNA, 13 nt, Homo sapiens
cccaggaguuugg

SEQ ID NO: 31528 - RNA, 15 nt, Homo sapiens
ccauagggugacaca

SEQ ID NO: 31529 - RNA, 12 nt, Homo sapiens
ccaugcuggcca

SEQ ID NO: 31530 - RNA, 13 nt, Homo sapiens
ccauagggugaca

SEQ ID NO: 31531 - RNA, 14 nt, Homo sapiens
caggcuggucucga

SEQ ID NO: 31532 - RNA, 15 nt, Homo sapiens
cagucacauuccaag

SEQ ID NO: 31533 - RNA, 23 nt, Homo sapiens
cagugcuuuccguggcacugcau

SEQ ID NO: 31534 - RNA, 14 nt, Homo sapiens
caggauagaguggg

SEQ ID NO: 31535 - RNA, 20 nt, Homo sapiens
caggcgugaccugacagccc

SEQ ID NO: 31536 - RNA, 18 nt, Homo sapiens
caggcgugagccaccaaa

SEQ ID NO: 31537 - RNA, 16 nt, Homo sapiens
caggcgugagccacca

SEQ ID NO: 31538 - RNA, 18 nt, Homo sapiens
caucaaugaaugaaugaa

SEQ ID NO: 31539 - RNA, 19 nt, Homo sapiens
caucaaugaaugaaugaau

SEQ ID NO: 31540 - RNA, 15 nt, Homo sapiens
caucaaugaaugaau

SEQ ID NO: 31541 - RNA, 17 nt, Homo sapiens
caugagagacagcaggu

SEQ ID NO: 31542 - RNA, 15 nt, Homo sapiens
cauuauuuauauggg

SEQ ID NO: 31543 - RNA, 18 nt, Homo sapiens
caugugauuacccucugg

SEQ ID NO: 31544 - RNA, 16 nt, Homo sapiens
auuacaggcgugagcc

SEQ ID NO: 31545 - RNA, 17 nt, Homo sapiens
auucccuccugcuacuc

SEQ ID NO: 31546 - RNA, 11 nt, Homo sapiens
augauuccacc

SEQ ID NO: 31547 - RNA, 12 nt, Homo sapiens
auuagccgggca

SEQ ID NO: 31548 - RNA, 13 nt, Homo sapiens
auuagccgggcgu

SEQ ID NO: 31549 - RNA, 14 nt, Homo sapiens
auuagccgggcgug

SEQ ID NO: 31550 - RNA, 22 nt, Homo sapiens
auuguaaaauggugugaccacu

SEQ ID NO: 31551 - RNA, 17 nt, Homo sapiens
auugagcaccugcaggc

SEQ ID NO: 31552 - RNA, 14 nt, Homo sapiens
caaucaugaauuag

SEQ ID NO: 31553 - RNA, 23 nt, Homo sapiens
caauauuuauuauuuucaccugu

SEQ ID NO: 31554 - RNA, 16 nt, Homo sapiens
caaggcuuagacccuc

SEQ ID NO: 31555 - RNA, 15 nt, Homo sapiens
caaggcuggagugca

SEQ ID NO: 31556 - RNA, 16 nt, Homo sapiens
caaaauugggaaagga

SEQ ID NO: 31557 - RNA, 23 nt, Homo sapiens
caaauaaguauuuauaauagcaa

SEQ ID NO: 31558 - RNA, 20 nt, Homo sapiens
caacuugaauaauacaccag

SEQ ID NO: 31559 - RNA, 12 nt, Homo sapiens
caagcacuuucc

SEQ ID NO: 31560 - RNA, 20 nt, Homo sapiens
caauuauuuuuacaguucuc

SEQ ID NO: 31561 - RNA, 21 nt, Homo sapiens
caauuauuuuuacaguucucc

SEQ ID NO: 31562 - RNA, 14 nt, Homo sapiens
cacaaccuguccca

SEQ ID NO: 31563 - RNA, 24 nt, Homo sapiens
cacucuauguucuaagaagugaaa

SEQ ID NO: 31564 - RNA, 21 nt, Homo sapiens
caccuucuggguucaagcgau

SEQ ID NO: 31565 - RNA, 22 nt, Homo sapiens
caccuucuggguucaagcgauu

SEQ ID NO: 31566 - RNA, 19 nt, Homo sapiens
caccagggccuggcuggga

SEQ ID NO: 31567 - RNA, 20 nt, Homo sapiens
cacuugggacaaaaacaaac

SEQ ID NO: 31568 - RNA, 17 nt, Homo sapiens
cacuugaacccgggagg

SEQ ID NO: 31569 - RNA, 21 nt, Homo sapiens
cacugguucuucuuggucuca

SEQ ID NO: 31570 - RNA, 19 nt, Homo sapiens
cagagaaaauaaaagcacu

SEQ ID NO: 31571 - RNA, 18 nt, Homo sapiens
cagagaaaauaaaagcac

SEQ ID NO: 31572 - RNA, 13 nt, Homo sapiens
cagaagucaaggc

SEQ ID NO: 31573 - RNA, 22 nt, Homo sapiens
cagaaaacaaggaugaauuaag

SEQ ID NO: 31574 - RNA, 22 nt, Homo sapiens
cagacauagaauuaacacauga

SEQ ID NO: 31575 - RNA, 20 nt, Homo sapiens
cagaucauuucaaaacucau

SEQ ID NO: 31576 - RNA, 17 nt, Homo sapiens
cagauccuggaaaucag

SEQ ID NO: 31577 - RNA, 20 nt, Homo sapiens
cagcccccauuguggucaca

SEQ ID NO: 31578 - RNA, 15 nt, Homo sapiens
cagcucuaaauguca

SEQ ID NO: 31579 - RNA, 20 nt, Homo sapiens
agggccuggcugggaguggc

SEQ ID NO: 31580 - RNA, 17 nt, Homo sapiens
aggcuuagacccucaug

SEQ ID NO: 31581 - RNA, 17 nt, Homo sapiens
agguauuuuaaucacca

SEQ ID NO: 31582 - RNA, 17 nt, Homo sapiens
aggucacacaaccuguc

SEQ ID NO: 31583 - RNA, 13 nt, Homo sapiens
agugauccgccca

SEQ ID NO: 31584 - RNA, 22 nt, Homo sapiens
agugguuauuuagggaacugcu

SEQ ID NO: 31585 - RNA, 23 nt, Homo sapiens
agugguuauuuagggaacugcuu

SEQ ID NO: 31586 - RNA, 18 nt, Homo sapiens
auaugaggcauuugcagc

SEQ ID NO: 31587 - RNA, 12 nt, Homo sapiens
auacaaucauca

SEQ ID NO: 31588 - RNA, 15 nt, Homo sapiens
aguugcagugagcug

SEQ ID NO: 31589 - RNA, 16 nt, Homo sapiens
auggagacaccaccac

SEQ ID NO: 31590 - RNA, 16 nt, Homo sapiens
auggaauuggagcucg

SEQ ID NO: 31591 - RNA, 18 nt, Homo sapiens
augugacuuaaugccacu

SEQ ID NO: 31592 - RNA, 19 nt, Homo sapiens
auguuagugcaaauuguca

SEQ ID NO: 31593 - RNA, 22 nt, Homo sapiens
aucuguaaaauggagacaccac

SEQ ID NO: 31594 - RNA, 19 nt, Homo sapiens
augacgugacuggccugcu

SEQ ID NO: 31595 - RNA, 21 nt, Homo sapiens
augacgugacuggccugcugg

SEQ ID NO: 31596 - RNA, 19 nt, Homo sapiens
augccacuaaauugacacu

SEQ ID NO: 31597 - RNA, 14 nt, Homo sapiens
auccuucagccuga

SEQ ID NO: 31598 - RNA, 15 nt, Homo sapiens
auccuucagccugaa

SEQ ID NO: 31599 - RNA, 22 nt, Homo sapiens
auccgcccaucuccgucuccca

SEQ ID NO: 31600 - RNA, 15 nt, Homo sapiens
aaauuuuauaguguc

SEQ ID NO: 31601 - RNA, 16 nt, Homo sapiens
aaauuuuauagugucu

SEQ ID NO: 31602 - RNA, 14 nt, Homo sapiens
aaauggagacacca

SEQ ID NO: 31603 - RNA, 14 nt, Homo sapiens
aaauuuuauagugu

SEQ ID NO: 31604 - RNA, 10 nt, Homo sapiens
aacauagguu

SEQ ID NO: 31605 - RNA, 16 nt, Homo sapiens
aaaagccaaaaaccaa

SEQ ID NO: 31606 - RNA, 11 nt, Homo sapiens
aaaaggugacc

SEQ ID NO: 31607 - RNA, 14 nt, Homo sapiens
aacuucagcgguuu

SEQ ID NO: 31608 - RNA, 15 nt, Homo sapiens
aacuucagcgguuua

SEQ ID NO: 31609 - RNA, 18 nt, Homo sapiens
aagggaguuaggcuauuc

SEQ ID NO: 31610 - RNA, 12 nt, Homo sapiens
aaggcuggagug

SEQ ID NO: 31611 - RNA, 13 nt, Homo sapiens
aaggcuggagugc

SEQ ID NO: 31612 - RNA, 13 nt, Homo sapiens
acacagugucugg

SEQ ID NO: 31613 - RNA, 11 nt, Homo sapiens
acagaagcucc

SEQ ID NO: 31614 - RNA, 11 nt, Homo sapiens
acaggcgugag

SEQ ID NO: 31615 - RNA, 18 nt, Homo sapiens
acaggcgugagccaccaa

SEQ ID NO: 31616 - RNA, 12 nt, Homo sapiens
accaaggcugau

SEQ ID NO: 31617 - RNA, 15 nt, Homo sapiens
aagucaaggcuuaga

SEQ ID NO: 31618 - RNA, 23 nt, Homo sapiens
aauacucuuaggaagagaaacca

SEQ ID NO: 31619 - RNA, 24 nt, Homo sapiens
aauacucuuaggaagagaaaccag

SEQ ID NO: 31620 - RNA, 12 nt, Homo sapiens
aaugggcuacuu

SEQ ID NO: 31621 - RNA, 13 nt, Homo sapiens
aauuagccgggca

SEQ ID NO: 31622 - RNA, 21 nt, Homo sapiens
aauuugguucuaggccgggcg

SEQ ID NO: 31623 - RNA, 12 nt, Homo sapiens
aauugcuaucgc

SEQ ID NO: 31624 - RNA, 15 nt, Homo sapiens
acugccuaucagcau

SEQ ID NO: 31625 - RNA, 18 nt, Homo sapiens
acugggguggguggggca

SEQ ID NO: 31626 - RNA, 18 nt, Homo sapiens
acucauugcaaccuccac

SEQ ID NO: 31627 - RNA, 14 nt, Homo sapiens
acuucuuaggguua

SEQ ID NO: 31628 - RNA, 18 nt, Homo sapiens
acgugacuggccugcugg

SEQ ID NO: 31629 - RNA, 15 nt, Homo sapiens
acgggguuugccaug

SEQ ID NO: 31630 - RNA, 13 nt, Homo sapiens
acccucaugcugc

SEQ ID NO: 31631 - RNA, 11 nt, Homo sapiens
acccucugggu

SEQ ID NO: 31632 - RNA, 19 nt, Homo sapiens
agcugauaucaugccccug

SEQ ID NO: 31633 - RNA, 15 nt, Homo sapiens
agcgagggacaccga

SEQ ID NO: 31634 - RNA, 13 nt, Homo sapiens
aggcuggucucga

SEQ ID NO: 31635 - RNA, 13 nt, Homo sapiens
agcuguugagcug

SEQ ID NO: 31636 - RNA, 22 nt, Homo sapiens
agacaccaccacccuugccaug

SEQ ID NO: 31637 - RNA, 13 nt, Homo sapiens
agcaccugcaggc

SEQ ID NO: 31638 - RNA, 22 nt, Homo sapiens
agcagagacgggguuugccaug

SEQ ID NO: 31639 - RNA, 21 nt, Homo sapiens
ucacaagugaaaaacauccag

SEQ ID NO: 31640 - RNA, 18 nt, Homo sapiens
uuguacaccaauauucau

SEQ ID NO: 31641 - RNA, 14 nt, Homo sapiens
ggacuugggcggga

SEQ ID NO: 31642 - RNA, 15 nt, Homo sapiens
uugaacccaggagau

SEQ ID NO: 31643 - RNA, 14 nt, Homo sapiens
agagaaauuugcca

SEQ ID NO: 31644 - RNA, 11 nt, Homo sapiens
augauguuucg

SEQ ID NO: 31645 - RNA, 16 nt, Homo sapiens
uuaugcuaagugaaau

SEQ ID NO: 31646 - RNA, 15 nt, Homo sapiens
acgaaaaacauuuca

SEQ ID NO: 31647 - RNA, 17 nt, Homo sapiens
ucacauuccaagccuca

SEQ ID NO: 31648 - RNA, 21 nt, Homo sapiens
auugcuuguuagcaaaaugga

SEQ ID NO: 31649 - RNA, 21 nt, Homo sapiens
ucugauuuuccuggacaguuu

SEQ ID NO: 31650 - RNA, 15 nt, Homo sapiens
guggaugauguuucg

SEQ ID NO: 31651 - RNA, 18 nt, Homo sapiens
acugaauguaaacaaagg

SEQ ID NO: 31652 - RNA, 21 nt, Homo sapiens
agcccccauuguggucacagg

SEQ ID NO: 31653 - RNA, 20 nt, Homo sapiens
aggaaauauucuguaaucuu

SEQ ID NO: 31654 - RNA, 17 nt, Homo sapiens
caguggcgcaaucuuaa

SEQ ID NO: 31655 - RNA, 12 nt, Homo sapiens
cucugauaccuc

SEQ ID NO: 31656 - RNA, 13 nt, Homo sapiens
aaaacucauuucc

SEQ ID NO: 31657 - RNA, 19 nt, Homo sapiens
cagagacgggguuugccau

SEQ ID NO: 31658 - RNA, 14 nt, Homo sapiens
aaaaugagcaaaag

SEQ ID NO: 31659 - RNA, 18 nt, Homo sapiens
uaaguugcaccaacuuug

SEQ ID NO: 31660 - RNA, 12 nt, Homo sapiens
cugauaccucaa

SEQ ID NO: 31661 - RNA, 12 nt, Homo sapiens
aaaaagccaaaa

SEQ ID NO: 31662 - RNA, 19 nt, Homo sapiens
agagacagcaggucucaug

SEQ ID NO: 31663 - RNA, 23 nt, Homo sapiens
uaguguuggaaaaugugcaauau

SEQ ID NO: 31664 - RNA, 20 nt, Homo sapiens
cuuuccagagaccaguauuc

SEQ ID NO: 31665 - RNA, 14 nt, Homo sapiens
ugcagaagacagua

SEQ ID NO: 31666 - RNA, 14 nt, Homo sapiens
uauauccugugacu

SEQ ID NO: 31667 - RNA, 15 nt, Homo sapiens
aauucgcugcaaccu

SEQ ID NO: 31668 - RNA, 16 nt, Homo sapiens
auacuauccaguuacu

SEQ ID NO: 31669 - RNA, 16 nt, Homo sapiens
cgcaaugugacuuaau

SEQ ID NO: 31670 - RNA, 20 nt, Homo sapiens
guucuucuuggucucagugu

SEQ ID NO: 31671 - RNA, 16 nt, Homo sapiens
guaaaauggagacacc

SEQ ID NO: 31672 - RNA, 21 nt, Homo sapiens
auagcagcuuauucacaagac

SEQ ID NO: 31673 - RNA, 18 nt, Homo sapiens
auuuaaaaaaaaaccuga

SEQ ID NO: 31674 - RNA, 22 nt, Homo sapiens
aaaauauuuuuaugugcaauaa

SEQ ID NO: 31675 - RNA, 20 nt, Homo sapiens
gcuacucuguuccuucacau

SEQ ID NO: 31676 - RNA, 12 nt, Homo sapiens
caggaaaauuaa

SEQ ID NO: 31677 - RNA, 21 nt, Homo sapiens
uuguguaaugaaaaugaauau

SEQ ID NO: 31678 - RNA, 19 nt, Homo sapiens
auccugcaauuccacuuau

SEQ ID NO: 31679 - RNA, 14 nt, Homo sapiens
ccuuauuguaccuc

SEQ ID NO: 31680 - RNA, 15 nt, Homo sapiens
agcaugggaagugac

SEQ ID NO: 31681 - RNA, 15 nt, Homo sapiens
aaccucauuccccaa

SEQ ID NO: 31682 - RNA, 14 nt, Homo sapiens
aaaccaaggcuaga

SEQ ID NO: 31683 - RNA, 16 nt, Homo sapiens
cuuaaagaauuuucaa

SEQ ID NO: 31684 - RNA, 19 nt, Homo sapiens
ucccucuaauuuaucuugu

SEQ ID NO: 31685 - RNA, 23 nt, Homo sapiens
aagauguagaggagaaacuggaa

SEQ ID NO: 31686 - RNA, 13 nt, Homo sapiens
cuuuaucucaggg

SEQ ID NO: 31687 - RNA, 20 nt, Homo sapiens
gugauuacccucugggucuc

SEQ ID NO: 31688 - RNA, 18 nt, Homo sapiens
ucaucuuggucacauaca

SEQ ID NO: 31689 - RNA, 23 nt, Homo sapiens
ugauccugcaauuccacuuauag

SEQ ID NO: 31690 - RNA, 23 nt, Homo sapiens
uaaaauauuuuuaugugcaauaa

SEQ ID NO: 31691 - RNA, 18 nt, Homo sapiens
agauuguauagugcaugu

SEQ ID NO: 31692 - RNA, 20 nt, Homo sapiens
aggccgggcgcgguggcuca

SEQ ID NO: 31693 - RNA, 15 nt, Homo sapiens
ggagaaucacuugaa

SEQ ID NO: 31694 - RNA, 22 nt, Homo sapiens
ugcuggcuuaaaauguaauuaa

SEQ ID NO: 31695 - RNA, 14 nt, Homo sapiens
ucucacaagcacuu

SEQ ID NO: 31696 - RNA, 22 nt, Homo sapiens
aaucugaggccuccucucucag

SEQ ID NO: 31697 - RNA, 12 nt, Homo sapiens
ucuuggugccuc

SEQ ID NO: 31698 - RNA, 18 nt, Homo sapiens
uaauuuuaaguaauuuca

SEQ ID NO: 31699 - RNA, 13 nt, Homo sapiens
uaauuucaugaaa

SEQ ID NO: 31700 - RNA, 20 nt, Homo sapiens
ucucaggggccaacuaggca

SEQ ID NO: 31701 - RNA, 17 nt, Homo sapiens
accuuuggaugcacuuu

SEQ ID NO: 31702 - RNA, 13 nt, Homo sapiens
augcacacagugc

SEQ ID NO: 31703 - RNA, 16 nt, Homo sapiens
aagcagaacagugauu

SEQ ID NO: 31704 - RNA, 17 nt, Homo sapiens
aaaucaaauuccagaau

SEQ ID NO: 31705 - RNA, 21 nt, Homo sapiens
gcaugucagacagaacuugaa

SEQ ID NO: 31706 - RNA, 15 nt, Homo sapiens
acaucaacagauaaa

SEQ ID NO: 31707 - RNA, 19 nt, Homo sapiens
cugugucaguggaugcugc

SEQ ID NO: 31708 - RNA, 16 nt, Homo sapiens
cagacaucaacagaua

SEQ ID NO: 31709 - RNA, 19 nt, Homo sapiens
acagugagacucugucuca

SEQ ID NO: 31710 - RNA, 16 nt, Homo sapiens
auacuguauuuuuacc

SEQ ID NO: 31711 - RNA, 20 nt, Homo sapiens
cauauguuuuuguaaguuua

SEQ ID NO: 31712 - RNA, 19 nt, Homo sapiens
aaguuuaugcauacaguaa

SEQ ID NO: 31713 - RNA, 19 nt, Homo sapiens
auucacaagacccaaaagg

SEQ ID NO: 31714 - RNA, 16 nt, Homo sapiens
aaauggaaaguaacuc

SEQ ID NO: 31715 - RNA, 12 nt, Homo sapiens
gagcgacaguga

SEQ ID NO: 31716 - RNA, 23 nt, Homo sapiens
gagcaccugcaggcgugaccuga

SEQ ID NO: 31717 - RNA, 19 nt, Homo sapiens
gacauaagcaaagacuaug

SEQ ID NO: 31718 - RNA, 21 nt, Homo sapiens
uucaaaaucaaauuccagaau

SEQ ID NO: 31719 - RNA, 21 nt, Homo sapiens
ugaaauaagccagacaucaac

SEQ ID NO: 31720 - RNA, 14 nt, Homo sapiens
auagcaucucagga

SEQ ID NO: 31721 - RNA, 15 nt, Homo sapiens
cuauuacgugcaaua

SEQ ID NO: 31722 - RNA, 23 nt, Homo sapiens
aaucugagccagugcuuuaaugg

SEQ ID NO: 31723 - RNA, 17 nt, Homo sapiens
ccagugcuuuaauggca

SEQ ID NO: 31724 - RNA, 15 nt, Homo sapiens
ccuuuacauccagau

SEQ ID NO: 31725 - RNA, 14 nt, Homo sapiens
agcuucucugugaa

SEQ ID NO: 31726 - RNA, 21 nt, Homo sapiens
gaaguauccuucagccugaaa

SEQ ID NO: 31727 - RNA, 14 nt, Homo sapiens
aguggcauguauga

SEQ ID NO: 31728 - RNA, 12 nt, Homo sapiens
cucauucaaaag

SEQ ID NO: 31729 - RNA, 16 nt, Homo sapiens
aacauuucaaaaggua

SEQ ID NO: 31730 - RNA, 20 nt, Homo sapiens
aagcaacaucuagcaaaugu

SEQ ID NO: 31731 - RNA, 17 nt, Homo sapiens
uuuaauggcaugucaga

SEQ ID NO: 31732 - RNA, 21 nt, Homo sapiens
uauucacaaccacucauucaa

SEQ ID NO: 31733 - RNA, 14 nt, Homo sapiens
gcagaagacaguau

SEQ ID NO: 31734 - RNA, 17 nt, Homo sapiens
gguccgaagucuuccau

SEQ ID NO: 31735 - RNA, 22 nt, Homo sapiens
aacccggccugauuaaaguuaa

SEQ ID NO: 31736 - RNA, 15 nt, Homo sapiens
agguuaagcacuuua

SEQ ID NO: 31737 - RNA, 14 nt, Homo sapiens
ucaguccucuuuca

SEQ ID NO: 31738 - RNA, 23 nt, Homo sapiens
cuaagugaaauaagccagacauc

SEQ ID NO: 31739 - RNA, 15 nt, Homo sapiens
uuccauuccaagccu

SEQ ID NO: 31740 - RNA, 21 nt, Homo sapiens
aaugagaagaaugacuaugca

SEQ ID NO: 31741 - RNA, 19 nt, Homo sapiens
augucagacagaacuugaa

SEQ ID NO: 31742 - RNA, 14 nt, Homo sapiens
uauagacucuagga

SEQ ID NO: 31743 - RNA, 17 nt, Homo sapiens
aaauaagccagacauca

SEQ ID NO: 31744 - RNA, 15 nt, Homo sapiens
caguauccaguacuc

SEQ ID NO: 31745 - RNA, 13 nt, Homo sapiens
gcugagcagucag

SEQ ID NO: 31746 - RNA, 14 nt, Homo sapiens
cgcagccaugugau

SEQ ID NO: 31747 - RNA, 22 nt, Homo sapiens
gaccuggucgucgucuugacuu

SEQ ID NO: 31748 - RNA, 20 nt, Homo sapiens
caauucuauuacgugcaaua

SEQ ID NO: 31749 - RNA, 17 nt, Homo sapiens
gggcuuuagggaccugc

SEQ ID NO: 31750 - RNA, 20 nt, Homo sapiens
guaaucccagcuacuuggga

SEQ ID NO: 31751 - RNA, 20 nt, Homo sapiens
aacccaggagauggaaguug

SEQ ID NO: 31752 - RNA, 17 nt, Homo sapiens
uuugcagcugugccaua

SEQ ID NO: 31753 - RNA, 16 nt, Homo sapiens
cugauacccuuugaaa

SEQ ID NO: 31754 - RNA, 23 nt, Homo sapiens
auuggacuuaaaaucuaauucaa

SEQ ID NO: 31755 - RNA, 21 nt, Homo sapiens
cacauuccaagccucaugucc

SEQ ID NO: 31756 - RNA, 18 nt, Homo sapiens
acaacuugaauaauacac

SEQ ID NO: 31757 - RNA, 19 nt, Homo sapiens
uuauuuagggaacugcuug

SEQ ID NO: 31758 - RNA, 19 nt, Homo sapiens
uacauuuccaaauucacaa

SEQ ID NO: 31759 - RNA, 23 nt, Homo sapiens
auaauuccuauauccugugacug

SEQ ID NO: 31760 - RNA, 14 nt, Homo sapiens
aaacaguagugaua

SEQ ID NO: 31761 - RNA, 20 nt, Homo sapiens
aaccaaauggagugacuuag

SEQ ID NO: 31762 - RNA, 17 nt, Homo sapiens
uaacuuaugaaccuuua

SEQ ID NO: 31763 - RNA, 19 nt, Homo sapiens
guuuucugcuuuaauuuca

SEQ ID NO: 31764 - RNA, 18 nt, Homo sapiens
cugaaagaggaaugaagu

SEQ ID NO: 31765 - RNA, 13 nt, Homo sapiens
cucacaagcacuu

SEQ ID NO: 31766 - RNA, 19 nt, Homo sapiens
aaucaaauuccagaaugau

SEQ ID NO: 31767 - RNA, 16 nt, Homo sapiens
ucucgaacugcuggau

SEQ ID NO: 31768 - RNA, 20 nt, Homo sapiens
uagaauauuuauuaccucug

SEQ ID NO: 31769 - RNA, 15 nt, Homo sapiens
auuuuuaugugcaau

SEQ ID NO: 31770 - RNA, 13 nt, Homo sapiens
aaguacagacuuu

SEQ ID NO: 31771 - RNA, 14 nt, Homo sapiens
caccacgcccagcu

SEQ ID NO: 31772 - RNA, 22 nt, Homo sapiens
acccucugggucucaguguccu

SEQ ID NO: 31773 - RNA, 21 nt, Homo sapiens
cauuucuauuuauuuacugag

SEQ ID NO: 31774 - RNA, 14 nt, Homo sapiens
acuaaaaaggcaug

SEQ ID NO: 31775 - RNA, 22 nt, Homo sapiens
ccucaucuguaaaauggagaca

SEQ ID NO: 31776 - RNA, 18 nt, Homo sapiens
gauggaaguugcagugag

SEQ ID NO: 31777 - RNA, 20 nt, Homo sapiens
ccuggcuggggccuguugaa

SEQ ID NO: 31778 - RNA, 23 nt, Homo sapiens
uccugcuacucuguuccuucaca

SEQ ID NO: 31779 - RNA, 11 nt, Homo sapiens
aaaagccaaaa

SEQ ID NO: 31780 - RNA, 11 nt, Homo sapiens
uaugugcaaua

SEQ ID NO: 31781 - RNA, 9 nt, Homo sapiens
cgugcaaua

SEQ ID NO: 31782 - RNA, 21 nt, Homo sapiens
agggucucccucuguugccaa

SEQ ID NO: 31783 - RNA, 12 nt, Homo sapiens
aaaaaaagccaa

SEQ ID NO: 31784 - RNA, 15 nt, Homo sapiens
acaggcgugagccac

SEQ ID NO: 31785 - RNA, 14 nt, Homo sapiens
agacagaaagcaga

SEQ ID NO: 31786 - RNA, 19 nt, Homo sapiens
cacuaaauugacacuuaaa

SEQ ID NO: 31787 - RNA, 14 nt, Homo sapiens
aaacauagcaucuc

SEQ ID NO: 31788 - RNA, 18 nt, Homo sapiens
cacaggcuccaaacugga

SEQ ID NO: 31789 - RNA, 19 nt, Homo sapiens
accuuuggaugcacuuuau

SEQ ID NO: 31790 - RNA, 21 nt, Homo sapiens
uacauauuucuuugccuuuau

SEQ ID NO: 31791 - RNA, 18 nt, Homo sapiens
gcccaucuccgucuccca

SEQ ID NO: 31792 - RNA, 19 nt, Homo sapiens
aaagcagggacuugaaccc

SEQ ID NO: 31793 - RNA, 21 nt, Homo sapiens
cggaucuggggcucugggaua

SEQ ID NO: 31794 - RNA, 19 nt, Homo sapiens
gagcauuuauaaauggaca

SEQ ID NO: 31795 - RNA, 14 nt, Homo sapiens
uaaauguaucuuau

SEQ ID NO: 31796 - RNA, 15 nt, Homo sapiens
augacacaucucuga

SEQ ID NO: 31797 - RNA, 18 nt, Homo sapiens
cuguuccuucacauccug

SEQ ID NO: 31798 - RNA, 18 nt, Homo sapiens
ucugccuugguauagcau

SEQ ID NO: 31799 - RNA, 14 nt, Homo sapiens
ucaccuuccagugu

SEQ ID NO: 31800 - RNA, 18 nt, Homo sapiens
gaauauuuauuaccucug

SEQ ID NO: 31801 - RNA, 16 nt, Homo sapiens
auucacaagacccaaa

SEQ ID NO: 31802 - RNA, 15 nt, Homo sapiens
auugagaacugcaua

SEQ ID NO: 31803 - RNA, 12 nt, Homo sapiens
gauagcaaguga

SEQ ID NO: 31804 - RNA, 15 nt, Homo sapiens
auaguuguaccgcaa

SEQ ID NO: 31805 - RNA, 17 nt, Homo sapiens
auuguugacaacuguga

SEQ ID NO: 31806 - RNA, 16 nt, Homo sapiens
ccugugacugucucac

SEQ ID NO: 31807 - RNA, 21 nt, Homo sapiens
aauggcuaagcaaaaugugau

SEQ ID NO: 31808 - RNA, 17 nt, Homo sapiens
auuuuuagacucaucaa

SEQ ID NO: 31809 - RNA, 13 nt, Homo sapiens
gaaauuaaccaua

SEQ ID NO: 31810 - RNA, 19 nt, Homo sapiens
gagaaaauaaaagcacuua

SEQ ID NO: 31811 - RNA, 16 nt, Homo sapiens
aauaaaaugagcaaaa

SEQ ID NO: 31812 - RNA, 18 nt, Homo sapiens
uuguagccacuucacuuu

SEQ ID NO: 31813 - RNA, 17 nt, Homo sapiens
caaacagaacuauggaa

SEQ ID NO: 31814 - RNA, 16 nt, Homo sapiens
gaucucacaagcacuu

SEQ ID NO: 31815 - RNA, 23 nt, Homo sapiens
agcuaaguugcaccaacuuugaa

SEQ ID NO: 31816 - RNA, 13 nt, Homo sapiens
uguugauagcaag

SEQ ID NO: 31817 - RNA, 18 nt, Homo sapiens
cagaaauuuaauucaugu

SEQ ID NO: 31818 - RNA, 17 nt, Homo sapiens
uuccguggcacugcaua

SEQ ID NO: 31819 - RNA, 19 nt, Homo sapiens
aaugacuaaaaaacaaaga

SEQ ID NO: 31820 - RNA, 19 nt, Homo sapiens
aucaugcaaaugcuguauu

SEQ ID NO: 31821 - RNA, 14 nt, Homo sapiens
ggugugaccacugc

SEQ ID NO: 31822 - RNA, 18 nt, Homo sapiens
cucugucucaguccauga

SEQ ID NO: 31823 - RNA, 11 nt, Homo sapiens
uuaugugcaau

SEQ ID NO: 31824 - RNA, 20 nt, Homo sapiens
aauauuuauuaccucugaua

SEQ ID NO: 31825 - RNA, 17 nt, Homo sapiens
ccuggucaacaugguga

SEQ ID NO: 31826 - RNA, 17 nt, Homo sapiens
gagauggguuugacaag

SEQ ID NO: 31827 - RNA, 20 nt, Homo sapiens
agagcaagacucugucucaa

SEQ ID NO: 31828 - RNA, 12 nt, Homo sapiens
ugcaauuccacu

SEQ ID NO: 31829 - RNA, 22 nt, Homo sapiens
cauuucaaaagguauuuauuga

SEQ ID NO: 31830 - RNA, 18 nt, Homo sapiens
agacgggguuugccaugc

SEQ ID NO: 31831 - RNA, 14 nt, Homo sapiens
uccuuccuuaucac

SEQ ID NO: 31832 - RNA, 22 nt, Homo sapiens
agcuuuucaaaauuggacuuaa

SEQ ID NO: 31833 - RNA, 18 nt, Homo sapiens
aaccuuauuguaccucuc

SEQ ID NO: 31834 - RNA, 23 nt, Homo sapiens
gguuaccaguaacggaacaguau

SEQ ID NO: 31835 - RNA, 15 nt, Homo sapiens
uagaauuaauggaau

SEQ ID NO: 31836 - RNA, 14 nt, Homo sapiens
acuuuaacacagug

SEQ ID NO: 31837 - RNA, 15 nt, Homo sapiens
uauuuuuaugugcaa

SEQ ID NO: 31838 - RNA, 19 nt, Homo sapiens
gucacagaggaucugcuug

SEQ ID NO: 31839 - RNA, 14 nt, Homo sapiens
ucaugcauuugcac

SEQ ID NO: 31840 - RNA, 20 nt, Homo sapiens
caaccaaauggagugacuua

SEQ ID NO: 31841 - RNA, 17 nt, Homo sapiens
uaaauuugguucuaggc

SEQ ID NO: 31842 - RNA, 13 nt, Homo sapiens
uucugcaagcuuu

SEQ ID NO: 31843 - RNA, 19 nt, Homo sapiens
gcuuguuagcaaaauggau

SEQ ID NO: 31844 - RNA, 17 nt, Homo sapiens
gaauauguaaauagaaa

SEQ ID NO: 31845 - RNA, 14 nt, Homo sapiens
gcaaaugcuguauu

SEQ ID NO: 31846 - RNA, 16 nt, Homo sapiens
uauucccuuuugcugc

SEQ ID NO: 31847 - RNA, 17 nt, Homo sapiens
auucugcaagcuuuuca

SEQ ID NO: 31848 - RNA, 15 nt, Homo sapiens
gacaucaacagauaa

SEQ ID NO: 31849 - RNA, 22 nt, Homo sapiens
aauuccuauauccugugacugu

SEQ ID NO: 31850 - RNA, 17 nt, Homo sapiens
guaaaguacagacuuuu

SEQ ID NO: 31851 - RNA, 11 nt, Homo sapiens
ugcaagcuuuu

SEQ ID NO: 31852 - RNA, 20 nt, Homo sapiens
uuuuagucuaauugaauccc

SEQ ID NO: 31853 - RNA, 22 nt, Homo sapiens
uaguguuggaaaaugugcaaua

SEQ ID NO: 31854 - RNA, 21 nt, Homo sapiens
ccaggagauggaaguugcagu

SEQ ID NO: 31855 - RNA, 14 nt, Homo sapiens
aucaaccaaaugga

SEQ ID NO: 31856 - RNA, 24 nt, Homo sapiens
aaugauuuuacggagauaucccag

SEQ ID NO: 31857 - RNA, 10 nt, Homo sapiens
aaaauaugcc

SEQ ID NO: 31858 - RNA, 15 nt, Homo sapiens
cugcaagcuuuucaa

SEQ ID NO: 31859 - RNA, 20 nt, Homo sapiens
cacuuauaggaauugaccca

SEQ ID NO: 31860 - RNA, 15 nt, Homo sapiens
ucacuuaauccuuug

SEQ ID NO: 31861 - RNA, 21 nt, Homo sapiens
uaaacaguagugauaguugua

SEQ ID NO: 31862 - RNA, 22 nt, Homo sapiens
cugccuaagugcagccccgugg

SEQ ID NO: 31863 - RNA, 14 nt, Homo sapiens
aauaaaagcacuua

SEQ ID NO: 31864 - RNA, 17 nt, Homo sapiens
agaaaauaaaagcacuu

SEQ ID NO: 31865 - RNA, 21 nt, Homo sapiens
ccuuauuguaccucucuuaua

SEQ ID NO: 31866 - RNA, 14 nt, Homo sapiens
gagaaaagacauaa

SEQ ID NO: 31867 - RNA, 13 nt, Homo sapiens
cauacauguuaca

SEQ ID NO: 31868 - RNA, 15 nt, Homo sapiens
agugacauguuuaca

SEQ ID NO: 31869 - RNA, 17 nt, Homo sapiens
gcauuguaacuuaugaa

SEQ ID NO: 31870 - RNA, 17 nt, Homo sapiens
gugagacagcucugcau

SEQ ID NO: 31871 - RNA, 22 nt, Homo sapiens
cccccauuguggucacaggaag

SEQ ID NO: 31872 - RNA, 22 nt, Homo sapiens
ugccuggaucucacaagcacuu

SEQ ID NO: 31873 - RNA, 15 nt, Homo sapiens
gcgugagccaccaaa

SEQ ID NO: 31874 - RNA, 15 nt, Homo sapiens
cucuggcgacaguuu

SEQ ID NO: 31875 - RNA, 20 nt, Homo sapiens
ugcuacaaauacucuuagga

SEQ ID NO: 31876 - RNA, 15 nt, Homo sapiens
uaugcuaagugaaau

SEQ ID NO: 31877 - RNA, 13 nt, Homo sapiens
uauaucaguccuc

SEQ ID NO: 31878 - RNA, 14 nt, Homo sapiens
aguugauuuuacaa

SEQ ID NO: 31879 - RNA, 21 nt, Homo sapiens
uuuaacuagaauuuauucaau

SEQ ID NO: 31880 - RNA, 16 nt, Homo sapiens
gugaaguauacuguau

SEQ ID NO: 31881 - RNA, 18 nt, Homo sapiens
guauuuauugagcaccug

SEQ ID NO: 31882 - RNA, 16 nt, Homo sapiens
uagauaaacucagaaa

SEQ ID NO: 31883 - RNA, 18 nt, Homo sapiens
uuuuaugaaacauuacag

SEQ ID NO: 31884 - RNA, 24 nt, Homo sapiens
aucuuguuuuuccacuacugcuac

SEQ ID NO: 31885 - RNA, 16 nt, Homo sapiens
uaggaagagaaaccag

SEQ ID NO: 31886 - RNA, 18 nt, Homo sapiens
guucuucuuggucucagu

SEQ ID NO: 31887 - RNA, 15 nt, Homo sapiens
agacaucaacagaua

SEQ ID NO: 31888 - RNA, 20 nt, Homo sapiens
gacuauuauagaauggaacu

SEQ ID NO: 31889 - RNA, 13 nt, Homo sapiens
uuuaugugcaaua

SEQ ID NO: 31890 - RNA, 16 nt, Homo sapiens
gcgcagccaugugauu

SEQ ID NO: 31891 - RNA, 16 nt, Homo sapiens
cacagcugaacuuguu

SEQ ID NO: 31892 - RNA, 21 nt, Homo sapiens
caguaauuuuaaguaauuuca

SEQ ID NO: 31893 - RNA, 16 nt, Homo sapiens
caggcuccaaacugga

SEQ ID NO: 31894 - RNA, 15 nt, Homo sapiens
aaucccagcuacuug

SEQ ID NO: 31895 - RNA, 21 nt, Homo sapiens
uugguacuagauacugaaugu

SEQ ID NO: 31896 - RNA, 13 nt, Homo sapiens
aucuauuuauuaa

SEQ ID NO: 31897 - RNA, 23 nt, Homo sapiens
aucacuugaacccgggaggcaga

SEQ ID NO: 31898 - RNA, 15 nt, Homo sapiens
accuguaaucccagc

SEQ ID NO: 31899 - RNA, 16 nt, Homo sapiens
auucucucuccuguac

SEQ ID NO: 31900 - RNA, 20 nt, Homo sapiens
gcugucuauguggcuguauc

SEQ ID NO: 31901 - RNA, 20 nt, Homo sapiens
cugaauacauucugcuuuca

SEQ ID NO: 31902 - RNA, 18 nt, Homo sapiens
agcaaauguuaugcauaa

SEQ ID NO: 31903 - RNA, 12 nt, Homo sapiens
ugacacaucucu

SEQ ID NO: 31904 - RNA, 18 nt, Homo sapiens
caagugauccgcccaucu

SEQ ID NO: 31905 - RNA, 15 nt, Homo sapiens
uucuauuuauuuacu

SEQ ID NO: 31906 - RNA, 19 nt, Homo sapiens
gcuuuccguggcacugcau

SEQ ID NO: 31907 - RNA, 16 nt, Homo sapiens
uuccguggcacugcau

SEQ ID NO: 31908 - RNA, 20 nt, Homo sapiens
augugauuacccucuggguc

SEQ ID NO: 31909 - RNA, 23 nt, Homo sapiens
ucucuuuuuagagaaauuugcca

SEQ ID NO: 31910 - RNA, 16 nt, Homo sapiens
uggguucaagcgauuc

SEQ ID NO: 31911 - RNA, 17 nt, Homo sapiens
uuguaacuuaugaaccu

SEQ ID NO: 31912 - RNA, 13 nt, Homo sapiens
uaacacagugucu

SEQ ID NO: 31913 - RNA, 12 nt, Homo sapiens
auagcaagugaa

SEQ ID NO: 31914 - RNA, 16 nt, Homo sapiens
gaguggguuucacaag

SEQ ID NO: 31915 - RNA, 21 nt, Homo sapiens
auauuguugacaacugugacu

SEQ ID NO: 31916 - RNA, 14 nt, Homo sapiens
gaguuuggccagaa

SEQ ID NO: 31917 - RNA, 19 nt, Homo sapiens
ugaacacuuauaagugaag

SEQ ID NO: 31918 - RNA, 16 nt, Homo sapiens
ucugcaagcuuuucaa

SEQ ID NO: 31919 - RNA, 14 nt, Homo sapiens
aagccagacaucaa

SEQ ID NO: 31920 - RNA, 20 nt, Homo sapiens
auggagguuaagcacuuuaa

SEQ ID NO: 31921 - RNA, 14 nt, Homo sapiens
agcaaaaugugaua

SEQ ID NO: 31922 - RNA, 23 nt, Homo sapiens
auaucaugccccuguacuccagc

SEQ ID NO: 31923 - RNA, 22 nt, Homo sapiens
auuuuguuuuuaaacuggaaau

SEQ ID NO: 31924 - RNA, 22 nt, Homo sapiens
gagacagaaagcagaacaguga

SEQ ID NO: 31925 - RNA, 17 nt, Homo sapiens
auacuucaauacuucau

SEQ ID NO: 31926 - RNA, 15 nt, Homo sapiens
ucccugcagacauga

SEQ ID NO: 31927 - RNA, 20 nt, Homo sapiens
uugacuauuauagaauggaa

SEQ ID NO: 31928 - RNA, 20 nt, Homo sapiens
ucaaaacuucagacauagaa

SEQ ID NO: 31929 - RNA, 23 nt, Homo sapiens
caagccagccuugcuccuggcug

SEQ ID NO: 31930 - RNA, 19 nt, Homo sapiens
acuugggcgggacacaggc

SEQ ID NO: 31931 - RNA, 20 nt, Homo sapiens
cuuguugagauccccguguu

SEQ ID NO: 31932 - RNA, 15 nt, Homo sapiens
guaaacaaaggaauu

SEQ ID NO: 31933 - RNA, 21 nt, Homo sapiens
uaguguuggaaaaugugcaau

SEQ ID NO: 31934 - RNA, 12 nt, Homo sapiens
aaaaugugcaau

SEQ ID NO: 31935 - RNA, 13 nt, Homo sapiens
agguuaagcacuu

SEQ ID NO: 31936 - RNA, 15 nt, Homo sapiens
uugcaagacauagaa

SEQ ID NO: 31937 - RNA, 13 nt, Homo sapiens
cagcuaaguugca

SEQ ID NO: 31938 - RNA, 15 nt, Homo sapiens
augguuccauucucu

SEQ ID NO: 31939 - RNA, 16 nt, Homo sapiens
agggauuccccuaacc

SEQ ID NO: 31940 - RNA, 23 nt, Homo sapiens
auucccuuuugcugccucuaaaa

SEQ ID NO: 31941 - RNA, 16 nt, Homo sapiens
ccuuauuguaccucuc

SEQ ID NO: 31942 - RNA, 16 nt, Homo sapiens
uucaaaauuggacuua

SEQ ID NO: 31943 - RNA, 14 nt, Homo sapiens
gcugcucugugguc

SEQ ID NO: 31944 - RNA, 23 nt, Homo sapiens
ugagaugggagaaucacuugaac

SEQ ID NO: 31945 - RNA, 13 nt, Homo sapiens
caugaaagcguaa

SEQ ID NO: 31946 - RNA, 20 nt, Homo sapiens
cgaguggcccuucauguaca

SEQ ID NO: 31947 - RNA, 12 nt, Homo sapiens
cagccaaccugg

SEQ ID NO: 31948 - RNA, 16 nt, Homo sapiens
uuguuuuuaaacugga

SEQ ID NO: 31949 - RNA, 16 nt, Homo sapiens
augaauaaaguguaag

SEQ ID NO: 31950 - RNA, 22 nt, Homo sapiens
uccugagaccagccaaccuggg

SEQ ID NO: 31951 - RNA, 17 nt, Homo sapiens
aaaguguaaguucacaa

SEQ ID NO: 31952 - RNA, 18 nt, Homo sapiens
uauuguugacaacuguga

SEQ ID NO: 31953 - RNA, 18 nt, Homo sapiens
auaucaguccucuuucaa

SEQ ID NO: 31954 - RNA, 20 nt, Homo sapiens
aagauuguauagugcauguu

SEQ ID NO: 31955 - RNA, 18 nt, Homo sapiens
guuuaaugggcacagggu

SEQ ID NO: 31956 - RNA, 21 nt, Homo sapiens
aucaauucuauuacgugcaau

SEQ ID NO: 31957 - RNA, 17 nt, Homo sapiens
uucugcaagcuuuucaa

SEQ ID NO: 31958 - RNA, 12 nt, Homo sapiens
gcuuccuaacug

SEQ ID NO: 31959 - RNA, 15 nt, Homo sapiens
uuuccaaauucacaa

SEQ ID NO: 31960 - RNA, 15 nt, Homo sapiens
agaagacaacauuaa

SEQ ID NO: 31961 - RNA, 23 nt, Homo sapiens
ucacuuuuuuucuuuucucugcc

SEQ ID NO: 31962 - RNA, 16 nt, Homo sapiens
aacggaacaguaucca

SEQ ID NO: 31963 - RNA, 12 nt, Homo sapiens
cgacaguuuucc

SEQ ID NO: 31964 - RNA, 15 nt, Homo sapiens
aggcuccaaacugga

SEQ ID NO: 31965 - RNA, 16 nt, Homo sapiens
gcaaauguuaugcaua

SEQ ID NO: 31966 - RNA, 14 nt, Homo sapiens
uuaacacagugucu

SEQ ID NO: 31967 - RNA, 13 nt, Homo sapiens
ugcuaagugaaau

SEQ ID NO: 31968 - RNA, 21 nt, Homo sapiens
gaacucaaggaaaucuguguc

SEQ ID NO: 31969 - RNA, 16 nt, Homo sapiens
caaaauggauaugaca

SEQ ID NO: 31970 - RNA, 19 nt, Homo sapiens
gcucccuggaagagaucaa

SEQ ID NO: 31971 - RNA, 11 nt, Homo sapiens
acauacugcug

SEQ ID NO: 31972 - RNA, 20 nt, Homo sapiens
uuugaugauuaauucaccuu

SEQ ID NO: 31973 - RNA, 13 nt, Homo sapiens
ucaccaaggcuga

SEQ ID NO: 31974 - RNA, 14 nt, Homo sapiens
caauauccuaauaa

SEQ ID NO: 31975 - RNA, 19 nt, Homo sapiens
ccugcaggcgugaccugac

SEQ ID NO: 31976 - RNA, 16 nt, Homo sapiens
cugucuggacuuucca

SEQ ID NO: 31977 - RNA, 16 nt, Homo sapiens
aucaaccaaauggagu

SEQ ID NO: 31978 - RNA, 23 nt, Homo sapiens
agauuuuguuuuuaaacuggaaa

SEQ ID NO: 31979 - RNA, 14 nt, Homo sapiens
ccaauuuacuuugu

SEQ ID NO: 31980 - RNA, 19 nt, Homo sapiens
caagacucugucucaaaaa

SEQ ID NO: 31981 - RNA, 15 nt, Homo sapiens
gagugcaguggcgca

SEQ ID NO: 31982 - RNA, 14 nt, Homo sapiens
cucuucacagucac

SEQ ID NO: 31983 - RNA, 13 nt, Homo sapiens
gauaaacucagaa

SEQ ID NO: 31984 - RNA, 16 nt, Homo sapiens
agugucugaugaaugu

SEQ ID NO: 31985 - RNA, 15 nt, Homo sapiens
uuuaugcuaagugaa

SEQ ID NO: 31986 - RNA, 17 nt, Homo sapiens
uuguaaguuuaugcaua

SEQ ID NO: 31987 - RNA, 18 nt, Homo sapiens
uccaagccucauguccac

SEQ ID NO: 31988 - RNA, 23 nt, Homo sapiens
acaccauuccuucugcccugcuu

SEQ ID NO: 31989 - RNA, 16 nt, Homo sapiens
acagagaaaagacaua

SEQ ID NO: 31990 - RNA, 14 nt, Homo sapiens
uauuuuuaugugca

SEQ ID NO: 31991 - RNA, 18 nt, Homo sapiens
gccauaauuacuauguca

SEQ ID NO: 31992 - RNA, 21 nt, Homo sapiens
caauagaaggauguacauuuc

SEQ ID NO: 31993 - RNA, 14 nt, Homo sapiens
acaucuuucacauu

SEQ ID NO: 31994 - RNA, 15 nt, Homo sapiens
uaaucccagcacuuu

SEQ ID NO: 31995 - RNA, 17 nt, Homo sapiens
gagacgggguuugccau

SEQ ID NO: 31996 - RNA, 13 nt, Homo sapiens
auuaucaugcaaa

SEQ ID NO: 31997 - RNA, 16 nt, Homo sapiens
uccuucucaucuguga

SEQ ID NO: 31998 - RNA, 13 nt, Homo sapiens
aacaaagaagaca

SEQ ID NO: 31999 - RNA, 15 nt, Homo sapiens
aagugauacuaucca

SEQ ID NO: 32000 - RNA, 11 nt, Homo sapiens
augcuggccag

SEQ ID NO: 32001 - RNA, 19 nt, Homo sapiens
uugaugauuaauucaccuu

SEQ ID NO: 32002 - RNA, 23 nt, Homo sapiens
ugaaaaucuacacuccagugaga

SEQ ID NO: 32003 - RNA, 17 nt, Homo sapiens
aguuacugccgguuuga

SEQ ID NO: 32004 - RNA, 13 nt, Homo sapiens
cucuuggugccuc

SEQ ID NO: 32005 - RNA, 18 nt, Homo sapiens
gaauaaauaaauguaucu

SEQ ID NO: 32006 - RNA, 22 nt, Homo sapiens
cacgccuguaaucccagcacuu

SEQ ID NO: 32007 - RNA, 14 nt, Homo sapiens
auaaauuugguucu

SEQ ID NO: 32008 - RNA, 16 nt, Homo sapiens
uacauucugcuuucau

SEQ ID NO: 32009 - RNA, 18 nt, Homo sapiens
cuucuggguucaagcgau

SEQ ID NO: 32010 - RNA, 20 nt, Homo sapiens
cucuaacucagaaacaucag

SEQ ID NO: 32011 - RNA, 20 nt, Homo sapiens
aaaagauuguauagugcaug

SEQ ID NO: 32012 - RNA, 18 nt, Homo sapiens
ccaaggcuggagugcagu

SEQ ID NO: 32013 - RNA, 16 nt, Homo sapiens
guaacuggcaguuuuc

SEQ ID NO: 32014 - RNA, 15 nt, Homo sapiens
gauaucaugccccug

SEQ ID NO: 32015 - RNA, 19 nt, Homo sapiens
aauaauacaccagagauaa

SEQ ID NO: 32016 - RNA, 22 nt, Homo sapiens
cuggagcuugaaauagugucug

SEQ ID NO: 32017 - RNA, 22 nt, Homo sapiens
uuacuauuuauugcugaaugac

SEQ ID NO: 32018 - RNA, 11 nt, Homo sapiens
cuuuaucucag

SEQ ID NO: 32019 - RNA, 17 nt, Homo sapiens
agugcccaacuguuaua

SEQ ID NO: 32020 - RNA, 20 nt, Homo sapiens
cuggagugcaguggcgcaau

SEQ ID NO: 32021 - RNA, 21 nt, Homo sapiens
aaaauuagccgggcauggugg

SEQ ID NO: 32022 - RNA, 19 nt, Homo sapiens
uuccuucucaucugugauu

SEQ ID NO: 32023 - RNA, 18 nt, Homo sapiens
cagugucuggcacuuggg

SEQ ID NO: 32024 - RNA, 23 nt, Homo sapiens
gugauucccuccugcuacucugu

SEQ ID NO: 32025 - RNA, 19 nt, Homo sapiens
aaauugaaaggcauucucu

SEQ ID NO: 32026 - RNA, 21 nt, Homo sapiens
ccacaacuauauuaucaugca

SEQ ID NO: 32027 - RNA, 18 nt, Homo sapiens
gagacgggguuugccaug

SEQ ID NO: 32028 - RNA, 18 nt, Homo sapiens
gagccaccaaacccggcc

SEQ ID NO: 32029 - RNA, 16 nt, Homo sapiens
agauuucaugccuggu

SEQ ID NO: 32030 - RNA, 19 nt, Homo sapiens
ucaucuuggucacauacaa

SEQ ID NO: 32031 - RNA, 12 nt, Homo sapiens
ccaacuaggcag

SEQ ID NO: 32032 - RNA, 17 nt, Homo sapiens
uguguuuauuucacuug

SEQ ID NO: 32033 - RNA, 17 nt, Homo sapiens
aacuggaaauaaaagau

SEQ ID NO: 32034 - RNA, 17 nt, Homo sapiens
aauggaaaguaacucau

SEQ ID NO: 32035 - RNA, 14 nt, Homo sapiens
aaauaaaagcacuu

SEQ ID NO: 32036 - RNA, 11 nt, Homo sapiens
acagcucugca

SEQ ID NO: 32037 - RNA, 14 nt, Homo sapiens
ccacccuugccaug

SEQ ID NO: 32038 - RNA, 20 nt, Homo sapiens
auuuuguguucaguacaauu

SEQ ID NO: 32039 - RNA, 17 nt, Homo sapiens
ucugucuggacuuucca

SEQ ID NO: 32040 - RNA, 15 nt, Homo sapiens
agcaucucaggagau

SEQ ID NO: 32041 - RNA, 22 nt, Homo sapiens
caggauagagugggacaguucc

SEQ ID NO: 32042 - RNA, 21 nt, Homo sapiens
auucgcugcaaccuguugaua

SEQ ID NO: 32043 - RNA, 19 nt, Homo sapiens
aauuauuuuuacaguucuc

SEQ ID NO: 32044 - RNA, 23 nt, Homo sapiens
aaggcuuagacccucaugcugcc

SEQ ID NO: 32045 - RNA, 13 nt, Homo sapiens
acauagcaucuca

SEQ ID NO: 32046 - RNA, 14 nt, Homo sapiens
ggcacuugggacaa

SEQ ID NO: 32047 - RNA, 19 nt, Homo sapiens
auuguugacaacugugacu

SEQ ID NO: 32048 - RNA, 13 nt, Homo sapiens
aauugacacuuaa

SEQ ID NO: 32049 - RNA, 18 nt, Homo sapiens
gaggcugaggcgggugga

SEQ ID NO: 32050 - RNA, 21 nt, Homo sapiens
ccucaguuuccugaccuauga

SEQ ID NO: 32051 - RNA, 23 nt, Homo sapiens
agaaauuccaggaaaaucugcac

SEQ ID NO: 32052 - RNA, 13 nt, Homo sapiens
agacucugucuca

SEQ ID NO: 32053 - RNA, 21 nt, Homo sapiens
uuaaaaaaaaaccugagcccc

SEQ ID NO: 32054 - RNA, 19 nt, Homo sapiens
aauauuuuuaugugcaaua

SEQ ID NO: 32055 - RNA, 21 nt, Homo sapiens
ugcaagacauagaauaguguu

SEQ ID NO: 32056 - RNA, 14 nt, Homo sapiens
uuguaaaauggugu

SEQ ID NO: 32057 - RNA, 21 nt, Homo sapiens
uuguuuuaaaauuaaagcuaa

SEQ ID NO: 32058 - RNA, 12 nt, Homo sapiens
uacauacugcug

SEQ ID NO: 32059 - RNA, 17 nt, Homo sapiens
cacuuuaacacaguguc

SEQ ID NO: 32060 - RNA, 21 nt, Homo sapiens
auaaauaguuuaugauuccac

SEQ ID NO: 32061 - RNA, 12 nt, Homo sapiens
ccugugacuguc

SEQ ID NO: 32062 - RNA, 22 nt, Homo sapiens
aggcagcaggauagagugggac

SEQ ID NO: 32063 - RNA, 12 nt, Homo sapiens
cauuuucacuuu

SEQ ID NO: 32064 - RNA, 15 nt, Homo sapiens
auaugacacaucucu

SEQ ID NO: 32065 - RNA, 22 nt, Homo sapiens
auuacaaggcuuuaucucaggg

SEQ ID NO: 32066 - RNA, 22 nt, Homo sapiens
aaagggucucccucuguugcca

SEQ ID NO: 32067 - RNA, 12 nt, Homo sapiens
aggcauguaauu

SEQ ID NO: 32068 - RNA, 14 nt, Homo sapiens
cuuaaacacuaaaa

SEQ ID NO: 32069 - RNA, 19 nt, Homo sapiens
aaccuccaccuucuggguu

SEQ ID NO: 32070 - RNA, 19 nt, Homo sapiens
agaauauuuauuaccucug

SEQ ID NO: 32071 - RNA, 13 nt, Homo sapiens
aaauagugucuga

SEQ ID NO: 32072 - RNA, 19 nt, Homo sapiens
gcuggagugcaguggcgca

SEQ ID NO: 32073 - RNA, 19 nt, Homo sapiens
aauauaauaugcacacagu

SEQ ID NO: 32074 - RNA, 20 nt, Homo sapiens
gugcugggaauuacaggcgu

SEQ ID NO: 32075 - RNA, 19 nt, Homo sapiens
agagcaagacucugucuca

SEQ ID NO: 32076 - RNA, 19 nt, Homo sapiens
ccuuuggaugcacuuuaua

SEQ ID NO: 32077 - RNA, 13 nt, Homo sapiens
uuaaaauguaauu

SEQ ID NO: 32078 - RNA, 13 nt, Homo sapiens
ucaaauuccagaa

SEQ ID NO: 32079 - RNA, 10 nt, Homo sapiens
aggcugcaaa

SEQ ID NO: 32080 - RNA, 11 nt, Homo sapiens
cucaugcugcc

SEQ ID NO: 32081 - RNA, 16 nt, Homo sapiens
ggacuuacuauuuauu

SEQ ID NO: 32082 - RNA, 17 nt, Homo sapiens
ugaaaggcauucucuga

SEQ ID NO: 32083 - RNA, 16 nt, Homo sapiens
aauaauacaccagaga

SEQ ID NO: 32084 - RNA, 19 nt, Homo sapiens
cugccuugguauagcauau

SEQ ID NO: 32085 - RNA, 13 nt, Homo sapiens
gcacucuauguuc

SEQ ID NO: 32086 - RNA, 20 nt, Homo sapiens
agagacgggguuugccaugc

SEQ ID NO: 32087 - RNA, 18 nt, Homo sapiens
ugaaaacauagcaucuca

SEQ ID NO: 32088 - RNA, 21 nt, Homo sapiens
uauguaaauagaaacguguau

SEQ ID NO: 32089 - RNA, 23 nt, Homo sapiens
uccuagcgcagccaugugauuac

SEQ ID NO: 32090 - RNA, 14 nt, Homo sapiens
uuccaaauucacaa

SEQ ID NO: 32091 - RNA, 18 nt, Homo sapiens
cuucucuucacagucaca

SEQ ID NO: 32092 - RNA, 16 nt, Homo sapiens
guuggaaaaugugcaa

SEQ ID NO: 32093 - RNA, 17 nt, Homo sapiens
caaguuguguuugauau

SEQ ID NO: 32094 - RNA, 18 nt, Homo sapiens
cuguaaucccagcuacuu

SEQ ID NO: 32095 - RNA, 18 nt, Homo sapiens
ccacugcagaagacagua

SEQ ID NO: 32096 - RNA, 15 nt, Homo sapiens
aucucacaagcacuu

SEQ ID NO: 32097 - RNA, 23 nt, Homo sapiens
guauuuuauuacaucuuucacau

SEQ ID NO: 32098 - RNA, 14 nt, Homo sapiens
cgggguuugccaug

SEQ ID NO: 32099 - RNA, 14 nt, Homo sapiens
uaaaaucuaauuca

SEQ ID NO: 32100 - RNA, 16 nt, Homo sapiens
ccucucuuauagaaua

SEQ ID NO: 32101 - RNA, 21 nt, Homo sapiens
accagcccuacaccauuccuu

SEQ ID NO: 32102 - RNA, 19 nt, Homo sapiens
accaccacccuugccaugg

SEQ ID NO: 32103 - RNA, 22 nt, Homo sapiens
aucaauucuauuacgugcaaua

SEQ ID NO: 32104 - RNA, 19 nt, Homo sapiens
uauaucaguccucuuucaa

SEQ ID NO: 32105 - RNA, 19 nt, Homo sapiens
uguaaucccagcacuuugg

SEQ ID NO: 32106 - RNA, 15 nt, Homo sapiens
aacccaaauguucau

SEQ ID NO: 32107 - RNA, 19 nt, Homo sapiens
caucuuggucacauacaau

SEQ ID NO: 32108 - RNA, 17 nt, Homo sapiens
aauauuuauuaccucug

SEQ ID NO: 32109 - RNA, 15 nt, Homo sapiens
cgugagccaccaaac

SEQ ID NO: 32110 - RNA, 13 nt, Homo sapiens
ccugcagacauga

SEQ ID NO: 32111 - RNA, 15 nt, Homo sapiens
cugguaacauagguu

SEQ ID NO: 32112 - RNA, 16 nt, Homo sapiens
ggagaaucacuugaac

SEQ ID NO: 32113 - RNA, 15 nt, Homo sapiens
agacgggguuugcca

SEQ ID NO: 32114 - RNA, 13 nt, Homo sapiens
ggcgacaguuuuc

SEQ ID NO: 32115 - RNA, 18 nt, Homo sapiens
cuaaaaaggcauguaauu

SEQ ID NO: 32116 - RNA, 16 nt, Homo sapiens
acuggcucccuggaag

SEQ ID NO: 32117 - RNA, 22 nt, Homo sapiens
ggaaaaugugcaauaugugaug

SEQ ID NO: 32118 - RNA, 13 nt, Homo sapiens
uuuuccuucucau

SEQ ID NO: 32119 - RNA, 15 nt, Homo sapiens
aaauggagugacuua

SEQ ID NO: 32120 - RNA, 19 nt, Homo sapiens
agcuugaaauagugucuga

SEQ ID NO: 32121 - RNA, 20 nt, Homo sapiens
ugcacuccagccugagcgac

SEQ ID NO: 32122 - RNA, 22 nt, Homo sapiens
uucucugccuugguauagcaua

SEQ ID NO: 32123 - RNA, 16 nt, Homo sapiens
cauuuccaaauucaca

SEQ ID NO: 32124 - RNA, 17 nt, Homo sapiens
aaagcauuguaacuuau

SEQ ID NO: 32125 - RNA, 21 nt, Homo sapiens
auaccucaacccccauuucua

SEQ ID NO: 32126 - RNA, 20 nt, Homo sapiens
auuuauuuuuuuacuuccuc

SEQ ID NO: 32127 - RNA, 16 nt, Homo sapiens
aucucacaagcacuuu

SEQ ID NO: 32128 - RNA, 12 nt, Homo sapiens
auugagcaccug

SEQ ID NO: 32129 - RNA, 20 nt, Homo sapiens
ucuuuuuuuuaauaaaccau

SEQ ID NO: 32130 - RNA, 18 nt, Homo sapiens
ugggucucaguguccuca

SEQ ID NO: 32131 - RNA, 23 nt, Homo sapiens
uagaauauuuauuaccucugaua

SEQ ID NO: 32132 - RNA, 11 nt, Homo sapiens
aggcauucucu

SEQ ID NO: 32133 - RNA, 23 nt, Homo sapiens
uccaagccugaccacgcuuucua

SEQ ID NO: 32134 - RNA, 19 nt, Homo sapiens
agcuguggccagcuuguua

SEQ ID NO: 32135 - RNA, 18 nt, Homo sapiens
aagaaaggccagcaaauu

SEQ ID NO: 32136 - RNA, 18 nt, Homo sapiens
uacauuuccaaauucaca

SEQ ID NO: 32137 - RNA, 19 nt, Homo sapiens
accaguaacggaacaguau

SEQ ID NO: 32138 - RNA, 16 nt, Homo sapiens
auaguguuggaaaaug

SEQ ID NO: 32139 - RNA, 19 nt, Homo sapiens
cuguaucuuguuuuuccac

SEQ ID NO: 32140 - RNA, 12 nt, Homo sapiens
acuagucuuaua

SEQ ID NO: 32141 - RNA, 20 nt, Homo sapiens
acauuguuugucugucuuca

SEQ ID NO: 32142 - RNA, 13 nt, Homo sapiens
acaacugugacug

SEQ ID NO: 32143 - RNA, 15 nt, Homo sapiens
aguucugucuggacu

SEQ ID NO: 32144 - RNA, 14 nt, Homo sapiens
cuuggucucagugu

SEQ ID NO: 32145 - RNA, 15 nt, Homo sapiens
acuugaugauacaau

SEQ ID NO: 32146 - RNA, 17 nt, Homo sapiens
uccuguacuuuuuccag

SEQ ID NO: 32147 - RNA, 15 nt, Homo sapiens
uccgaagucuuccau

SEQ ID NO: 32148 - RNA, 23 nt, Homo sapiens
auggaaguugcagugagcugaua

SEQ ID NO: 32149 - RNA, 13 nt, Homo sapiens
cugaauacauucu

SEQ ID NO: 32150 - RNA, 20 nt, Homo sapiens
cagagcaagacucugucuca

SEQ ID NO: 32151 - RNA, 15 nt, Homo sapiens
uuuauugcugaauga

SEQ ID NO: 32152 - RNA, 23 nt, Homo sapiens
acuccagccugagcgacagugag

SEQ ID NO: 32153 - RNA, 13 nt, Homo sapiens
auuuucacuuuug

SEQ ID NO: 32154 - RNA, 17 nt, Homo sapiens
uguuggaaaaugugcaa

SEQ ID NO: 32155 - RNA, 20 nt, Homo sapiens
ccucauuccccaaccacuuc

SEQ ID NO: 32156 - RNA, 15 nt, Homo sapiens
guacuuuuuccagac

SEQ ID NO: 32157 - RNA, 17 nt, Homo sapiens
ucuuggucucaguguca

SEQ ID NO: 32158 - RNA, 18 nt, Homo sapiens
ccugaugaaaacauagca

SEQ ID NO: 32159 - RNA, 22 nt, Homo sapiens
gccaugugauuacccucugggu

SEQ ID NO: 32160 - RNA, 17 nt, Homo sapiens
ccucccuucucuucaca

SEQ ID NO: 32161 - RNA, 16 nt, Homo sapiens
auaauaugagaaucag

SEQ ID NO: 32162 - RNA, 16 nt, Homo sapiens
agcccauggcacucua

SEQ ID NO: 32163 - RNA, 13 nt, Homo sapiens
uagcaucucagga

SEQ ID NO: 32164 - RNA, 16 nt, Homo sapiens
uuuauaaauggacaaa

SEQ ID NO: 32165 - RNA, 21 nt, Homo sapiens
agacaccaccacccuugccau

SEQ ID NO: 32166 - RNA, 23 nt, Homo sapiens
aaaucggaucuggggcucuggga

SEQ ID NO: 32167 - RNA, 22 nt, Homo sapiens
aagcagggacuugaacccauau

SEQ ID NO: 32168 - RNA, 17 nt, Homo sapiens
aaucuucagaccuagaa

SEQ ID NO: 32169 - RNA, 17 nt, Homo sapiens
gaacugcauauguuucg

SEQ ID NO: 32170 - RNA, 20 nt, Homo sapiens
gaggcaagagaauugcuuga

SEQ ID NO: 32171 - RNA, 13 nt, Homo sapiens
uuuauuaccucug

SEQ ID NO: 32172 - RNA, 17 nt, Homo sapiens
ugccaugcuggccaggc

SEQ ID NO: 32173 - RNA, 22 nt, Homo sapiens
cacccuugccauggagguuaag

SEQ ID NO: 32174 - RNA, 13 nt, Homo sapiens
accaaauuuguau

SEQ ID NO: 32175 - RNA, 12 nt, Homo sapiens
aaguacucauac

SEQ ID NO: 32176 - RNA, 18 nt, Homo sapiens
uuauaauuccuauauccu

SEQ ID NO: 32177 - RNA, 14 nt, Homo sapiens
gggucucagugucc

SEQ ID NO: 32178 - RNA, 15 nt, Homo sapiens
aacauagcaucucag

SEQ ID NO: 32179 - RNA, 16 nt, Homo sapiens
gcugaggcaagagaau

SEQ ID NO: 32180 - RNA, 22 nt, Homo sapiens
aagucuuccauagagacuuugu

SEQ ID NO: 32181 - RNA, 15 nt, Homo sapiens
ucaucaaucaaauaa

SEQ ID NO: 32182 - RNA, 15 nt, Homo sapiens
agaauucuuacaugu

SEQ ID NO: 32183 - RNA, 22 nt, Homo sapiens
auaacuaggcguggacuuacua

SEQ ID NO: 32184 - RNA, 20 nt, Homo sapiens
gaggcagagguugcagugag

SEQ ID NO: 32185 - RNA, 17 nt, Homo sapiens
uuguaccgcaaugugac

SEQ ID NO: 32186 - RNA, 15 nt, Homo sapiens
cuggggccuguugaa

SEQ ID NO: 32187 - RNA, 21 nt, Homo sapiens
auagugucugaugaauguuaa

SEQ ID NO: 32188 - RNA, 21 nt, Homo sapiens
agacccucaugcugccaauau

SEQ ID NO: 32189 - RNA, 17 nt, Homo sapiens
ugcuggauucaagugau

SEQ ID NO: 32190 - RNA, 16 nt, Homo sapiens
cuggcacuugggacaa

SEQ ID NO: 32191 - RNA, 21 nt, Homo sapiens
aauuuuucucuaacucagaaa

SEQ ID NO: 32192 - RNA, 23 nt, Homo sapiens
ucacaggaaguagaggaggccac

SEQ ID NO: 32193 - RNA, 15 nt, Homo sapiens
aaggcuuuaucucag

SEQ ID NO: 32194 - RNA, 16 nt, Homo sapiens
uagaauuaacacauga

SEQ ID NO: 32195 - RNA, 23 nt, Homo sapiens
caaacaaacgaaaaacauuucaa

SEQ ID NO: 32196 - RNA, 17 nt, Homo sapiens
augugauauguaccuaa

SEQ ID NO: 32197 - RNA, 17 nt, Homo sapiens
cuguaaucccagcacuu

SEQ ID NO: 32198 - RNA, 16 nt, Homo sapiens
agaauucuuacauguu

SEQ ID NO: 32199 - RNA, 15 nt, Homo sapiens
cuuuccagagaccag

SEQ ID NO: 32200 - RNA, 11 nt, Homo sapiens
uuaaucaccaa

SEQ ID NO: 32201 - RNA, 22 nt, Homo sapiens
uccuagcgcagccaugugauua

SEQ ID NO: 32202 - RNA, 19 nt, Homo sapiens
acacuaaaaaggcauguaa

SEQ ID NO: 32203 - RNA, 17 nt, Homo sapiens
uuacaaaccucaagcca

SEQ ID NO: 32204 - RNA, 19 nt, Homo sapiens
gaagcaacccaaauguuca

SEQ ID NO: 32205 - RNA, 13 nt, Homo sapiens
uacauuuccaaau

SEQ ID NO: 32206 - RNA, 17 nt, Homo sapiens
gaaagcagggacuugaa

SEQ ID NO: 32207 - RNA, 14 nt, Homo sapiens
aucuacacuccagu

SEQ ID NO: 32208 - RNA, 16 nt, Homo sapiens
cagcccaagggugggu

SEQ ID NO: 32209 - RNA, 13 nt, Homo sapiens
agaucaagccauc

SEQ ID NO: 32210 - RNA, 20 nt, Homo sapiens
caaaacugauacccuuugaa

SEQ ID NO: 32211 - RNA, 16 nt, Homo sapiens
uucacaagacccaaaa

SEQ ID NO: 32212 - RNA, 21 nt, Homo sapiens
agaauuuauucaauuccucug

SEQ ID NO: 32213 - RNA, 21 nt, Homo sapiens
gugguuauuuagggaacugcu

SEQ ID NO: 32214 - RNA, 13 nt, Homo sapiens
gacaaauucuguu

SEQ ID NO: 32215 - RNA, 15 nt, Homo sapiens
agaauuaacacauga

SEQ ID NO: 32216 - RNA, 17 nt, Homo sapiens
aagcagaacagugauua

SEQ ID NO: 32217 - RNA, 18 nt, Homo sapiens
uguuacugccuaucagca

SEQ ID NO: 32218 - RNA, 20 nt, Homo sapiens
acagagcaagacucugucuc

SEQ ID NO: 32219 - RNA, 16 nt, Homo sapiens
acuggcaguuuuccau

SEQ ID NO: 32220 - RNA, 16 nt, Homo sapiens
agaguggguuucacaa

SEQ ID NO: 32221 - RNA, 23 nt, Homo sapiens
aaacugauacccuuugaaaaagu

SEQ ID NO: 32222 - RNA, 22 nt, Homo sapiens
agcuugaaauagugucugauga

SEQ ID NO: 32223 - RNA, 23 nt, Homo sapiens
aaucugaggccuccucucucagu

SEQ ID NO: 32224 - RNA, 15 nt, Homo sapiens
ggaaaaugugcaaua

SEQ ID NO: 32225 - RNA, 23 nt, Homo sapiens
cuuguuuuuccacuacugcuacc

SEQ ID NO: 32226 - RNA, 16 nt, Homo sapiens
uggaaaaugugcaaua

SEQ ID NO: 32227 - RNA, 17 nt, Homo sapiens
uauagaauggaacucaa

SEQ ID NO: 32228 - RNA, 13 nt, Homo sapiens
aaaaugugcaaua

SEQ ID NO: 32229 - RNA, 13 nt, Homo sapiens
cucaucaaucaaa

SEQ ID NO: 32230 - RNA, 15 nt, Homo sapiens
auuuaaagacaaaga

SEQ ID NO: 32231 - RNA, 23 nt, Homo sapiens
gaauucuuacauguuuucuuugc

SEQ ID NO: 32232 - RNA, 20 nt, Homo sapiens
gaaguugcagugagcugaua

SEQ ID NO: 32233 - RNA, 14 nt, Homo sapiens
uaggcuauucacaa

SEQ ID NO: 32234 - RNA, 14 nt, Homo sapiens
aauauuguugacaa

SEQ ID NO: 32235 - RNA, 17 nt, Homo sapiens
aaagacuaugaggaaua

SEQ ID NO: 32236 - RNA, 16 nt, Homo sapiens
auuuccaaauucacaa

SEQ ID NO: 32237 - RNA, 13 nt, Homo sapiens
ucaguuacucuga

SEQ ID NO: 32238 - RNA, 15 nt, Homo sapiens
cagaaauuguaucuu

SEQ ID NO: 32239 - RNA, 22 nt, Homo sapiens
gaaagaaaaucaggcuggccaa

SEQ ID NO: 32240 - RNA, 13 nt, Homo sapiens
acagaacuaugga

SEQ ID NO: 32241 - RNA, 20 nt, Homo sapiens
gcuaaguugcaccaacuuug

SEQ ID NO: 32242 - RNA, 19 nt, Homo sapiens
aaaacuuuaugcuaaguga

SEQ ID NO: 32243 - RNA, 15 nt, Homo sapiens
ccuaaccucauuccc

SEQ ID NO: 32244 - RNA, 21 nt, Homo sapiens
cuguaaucccagcacuuuggg

SEQ ID NO: 32245 - RNA, 16 nt, Homo sapiens
ucucuuauagaauauu

SEQ ID NO: 32246 - RNA, 23 nt, Homo sapiens
cuugccauggagguuaagcacuu

SEQ ID NO: 32247 - RNA, 13 nt, Homo sapiens
ugcugggaauuac

SEQ ID NO: 32248 - RNA, 17 nt, Homo sapiens
uacugcuaccacaacua

SEQ ID NO: 32249 - RNA, 13 nt, Homo sapiens
augauccugcaau

SEQ ID NO: 32250 - RNA, 16 nt, Homo sapiens
aaugguuccauucucu

SEQ ID NO: 32251 - RNA, 14 nt, Homo sapiens
guaccucucuuaua

SEQ ID NO: 32252 - RNA, 17 nt, Homo sapiens
uggcgcgcgccaccacg

SEQ ID NO: 32253 - RNA, 14 nt, Homo sapiens
gauuucaugccugg

SEQ ID NO: 32254 - RNA, 17 nt, Homo sapiens
uagagaaauuugccaau

SEQ ID NO: 32255 - RNA, 19 nt, Homo sapiens
ugagagacagcaggucuca

SEQ ID NO: 32256 - RNA, 16 nt, Homo sapiens
acuauccaguuacugc

SEQ ID NO: 32257 - RNA, 19 nt, Homo sapiens
aucuccgucucccaaagug

SEQ ID NO: 32258 - RNA, 23 nt, Homo sapiens
auaguguuggaaaaugugcaaua

SEQ ID NO: 32259 - RNA, 18 nt, Homo sapiens
aagcaacccaaauguuca

SEQ ID NO: 32260 - RNA, 17 nt, Homo sapiens
caacuauauuaucaugc

SEQ ID NO: 32261 - RNA, 22 nt, Homo sapiens
caaauucgcugcaaccuguuga

SEQ ID NO: 32262 - RNA, 17 nt, Homo sapiens
cccuucauguacaucca

SEQ ID NO: 32263 - RNA, 15 nt, Homo sapiens
ucccagcuacuuggg

SEQ ID NO: 32264 - RNA, 20 nt, Homo sapiens
aguuuucugcuuuaauuuca

SEQ ID NO: 32265 - RNA, 20 nt, Homo sapiens
uucugucuggacuuuccaga

SEQ ID NO: 32266 - RNA, 21 nt, Homo sapiens
agaggaaugaaguacucauac

SEQ ID NO: 32267 - RNA, 17 nt, Homo sapiens
uagagacuuugugaaaa

SEQ ID NO: 32268 - RNA, 18 nt, Homo sapiens
cuggcuuaaaauguaauu

SEQ ID NO: 32269 - RNA, 13 nt, Homo sapiens
augacacaucucu

SEQ ID NO: 32270 - RNA, 18 nt, Homo sapiens
gcccuucauguacaucca

SEQ ID NO: 32271 - RNA, 18 nt, Homo sapiens
uguaaugaaaaugaauau

SEQ ID NO: 32272 - RNA, 22 nt, Homo sapiens
ucgaacugcuggauucaaguga

SEQ ID NO: 32273 - RNA, 14 nt, Homo sapiens
ugagaagaaugacu

SEQ ID NO: 32274 - RNA, 20 nt, Homo sapiens
cgguuugaaaauaugccugc

SEQ ID NO: 32275 - RNA, 23 nt, Homo sapiens
caauuauaucaguccucuuucaa

SEQ ID NO: 32276 - RNA, 14 nt, Homo sapiens
caugaaaagauuau

SEQ ID NO: 32277 - RNA, 21 nt, Homo sapiens
gugauuacccucugggucuca

SEQ ID NO: 32278 - RNA, 18 nt, Homo sapiens
guaaguuuaugcauacag

SEQ ID NO: 32279 - RNA, 15 nt, Homo sapiens
aaccaugcccaagaa

SEQ ID NO: 32280 - RNA, 13 nt, Homo sapiens
ggaugauguuucg

SEQ ID NO: 32281 - RNA, 11 nt, Homo sapiens
augugcaauau

SEQ ID NO: 32282 - RNA, 15 nt, Homo sapiens
acuuuuggcuuguaa

SEQ ID NO: 32283 - RNA, 20 nt, Homo sapiens
agcccuucaugcauuugcac

SEQ ID NO: 32284 - RNA, 18 nt, Homo sapiens
aaacuuuaugcuaaguga

SEQ ID NO: 32285 - RNA, 13 nt, Homo sapiens
uaauuucagaaga

SEQ ID NO: 32286 - RNA, 18 nt, Homo sapiens
gaguuaggcuauucacaa

SEQ ID NO: 32287 - RNA, 21 nt, Homo sapiens
agcacuuuaacacagugucug

SEQ ID NO: 32288 - RNA, 19 nt, Homo sapiens
uucaaaaucaaauuccaga

SEQ ID NO: 32289 - RNA, 19 nt, Homo sapiens
cccuuugaugauuaauuca

SEQ ID NO: 32290 - RNA, 21 nt, Homo sapiens
ugaaaaucuacacuccaguga

SEQ ID NO: 32291 - RNA, 16 nt, Homo sapiens
ugugucaguggaugcu

SEQ ID NO: 32292 - RNA, 13 nt, Homo sapiens
aggaauauuugca

SEQ ID NO: 32293 - RNA, 17 nt, Homo sapiens
aggaaaaucugcacugu

SEQ ID NO: 32294 - RNA, 22 nt, Homo sapiens
aaugacacuagcuaauaucaau

SEQ ID NO: 32295 - RNA, 14 nt, Homo sapiens
cuuauugacuauua

SEQ ID NO: 32296 - RNA, 19 nt, Homo sapiens
caaccugggggcuuuaggg

SEQ ID NO: 32297 - RNA, 14 nt, Homo sapiens
ugagaacugcauau

SEQ ID NO: 32298 - RNA, 18 nt, Homo sapiens
aauauuugcaagacauag

SEQ ID NO: 32299 - RNA, 18 nt, Homo sapiens
aguuuaugcauacaguaa

SEQ ID NO: 32300 - RNA, 22 nt, Homo sapiens
agcagagacgggguuugccaug

SEQ ID NO: 32301 - RNA, 19 nt, Homo sapiens
caaacgaaaaacauuucaa

SEQ ID NO: 32302 - RNA, 20 nt, Homo sapiens
aaauugggaaaggaguagaa

SEQ ID NO: 32303 - RNA, 16 nt, Homo sapiens
cuuauaggaauugacc

SEQ ID NO: 32304 - RNA, 23 nt, Homo sapiens
agauuaagagauggguuugacaa

SEQ ID NO: 32305 - RNA, 21 nt, Homo sapiens
uauagugucuugggaauuuuc

SEQ ID NO: 32306 - RNA, 20 nt, Homo sapiens
ggccagaagucaaggcuuag

SEQ ID NO: 32307 - RNA, 19 nt, Homo sapiens
guuauuuagggaacugcuu

SEQ ID NO: 32308 - RNA, 13 nt, Homo sapiens
uauuuauuuacug

SEQ ID NO: 32309 - RNA, 23 nt, Homo sapiens
ccuuaaacucagggagcauuuau

SEQ ID NO: 32310 - RNA, 15 nt, Homo sapiens
uggauucaagugauc

SEQ ID NO: 32311 - RNA, 17 nt, Homo sapiens
gguggcucacgccugua

SEQ ID NO: 32312 - RNA, 20 nt, Homo sapiens
uagaauaauacuagucuuau

SEQ ID NO: 32313 - RNA, 17 nt, Homo sapiens
ugaaaaucuacacucca

SEQ ID NO: 32314 - RNA, 17 nt, Homo sapiens
aaagcagggacuugaac

SEQ ID NO: 32315 - RNA, 14 nt, Homo sapiens
cuguuccuucacau

SEQ ID NO: 32316 - RNA, 21 nt, Homo sapiens
aguguuggaaaaugugcaaua

SEQ ID NO: 32317 - RNA, 21 nt, Homo sapiens
gacacaggcuccaaacuggag

SEQ ID NO: 32318 - RNA, 22 nt, Homo sapiens
ccuggacaguuuucugcuuuaa

SEQ ID NO: 32319 - RNA, 21 nt, Homo sapiens
guuucgugaaguauacuguau

SEQ ID NO: 32320 - RNA, 15 nt, Homo sapiens
auucugcaagcuuuu

SEQ ID NO: 32321 - RNA, 15 nt, Homo sapiens
gcuaauuuguguauu

SEQ ID NO: 32322 - RNA, 17 nt, Homo sapiens
ucuggacuuuccagaga

SEQ ID NO: 32323 - RNA, 13 nt, Homo sapiens
ugcauuugcacua

SEQ ID NO: 32324 - RNA, 15 nt, Homo sapiens
cuagauacugaaugu

SEQ ID NO: 32325 - RNA, 14 nt, Homo sapiens
ggucucgaacugcu

SEQ ID NO: 32326 - RNA, 15 nt, Homo sapiens
cuaaauuugguucua

SEQ ID NO: 32327 - RNA, 21 nt, Homo sapiens
gagauugugccccugcacucc

SEQ ID NO: 32328 - RNA, 16 nt, Homo sapiens
acaucaguuacucuga

SEQ ID NO: 32329 - RNA, 19 nt, Homo sapiens
cuucuuggucucaguguca

SEQ ID NO: 32330 - RNA, 10 nt, Homo sapiens
augacuaugc

SEQ ID NO: 32331 - RNA, 16 nt, Homo sapiens
agcuguuuucccugac

SEQ ID NO: 32332 - RNA, 16 nt, Homo sapiens
cugccccugagcccau

SEQ ID NO: 32333 - RNA, 11 nt, Homo sapiens
ccuugagaaac

SEQ ID NO: 32334 - RNA, 19 nt, Homo sapiens
uauuuauugagcaccugca

SEQ ID NO: 32335 - RNA, 17 nt, Homo sapiens
uauuuuauaucaauuua

SEQ ID NO: 32336 - RNA, 20 nt, Homo sapiens
uuaaaaucuaauucaaacua

SEQ ID NO: 32337 - RNA, 21 nt, Homo sapiens
uuguguguuuauuucacuuga

SEQ ID NO: 32338 - RNA, 14 nt, Homo sapiens
aguacagacuuuuu

SEQ ID NO: 32339 - RNA, 23 nt, Homo sapiens
auuucaaaacucauuuccuaugu

SEQ ID NO: 32340 - RNA, 14 nt, Homo sapiens
cuguaaucacagcu

SEQ ID NO: 32341 - RNA, 22 nt, Homo sapiens
agcacuuucccucuuggugccu

SEQ ID NO: 32342 - RNA, 15 nt, Homo sapiens
aaugauuucauucaa

SEQ ID NO: 32343 - RNA, 11 nt, Homo sapiens
cccuugccaug

SEQ ID NO: 32344 - RNA, 18 nt, Homo sapiens
auuagaggucuccaaaau

SEQ ID NO: 32345 - RNA, 13 nt, Homo sapiens
ugcagacaugaga

SEQ ID NO: 32346 - RNA, 18 nt, Homo sapiens
acaauuauaucaguccuc

SEQ ID NO: 32347 - RNA, 13 nt, Homo sapiens
gggaguggcgcgc

SEQ ID NO: 32348 - RNA, 16 nt, Homo sapiens
ucuccgucucccaaag

SEQ ID NO: 32349 - RNA, 19 nt, Homo sapiens
ucuucccuuuuacauacug

SEQ ID NO: 32350 - RNA, 14 nt, Homo sapiens
gaaugagaagaaug

SEQ ID NO: 32351 - RNA, 18 nt, Homo sapiens
acuuaugaaccuuuacau

SEQ ID NO: 32352 - RNA, 14 nt, Homo sapiens
uccacuacugcuac

SEQ ID NO: 32353 - RNA, 22 nt, Homo sapiens
aauagaaggauguacauuucca

SEQ ID NO: 32354 - RNA, 22 nt, Homo sapiens
auguacauccauggugugcugg

SEQ ID NO: 32355 - RNA, 15 nt, Homo sapiens
gggucucaguguccu

SEQ ID NO: 32356 - RNA, 23 nt, Homo sapiens
uaacucagaaacaucaguuacuc

SEQ ID NO: 32357 - RNA, 13 nt, Homo sapiens
agcaaaaugugau

SEQ ID NO: 32358 - RNA, 20 nt, Homo sapiens
uccguggcacugcauacaau

SEQ ID NO: 32359 - RNA, 17 nt, Homo sapiens
uugaaauuaaccauaga

SEQ ID NO: 32360 - RNA, 23 nt, Homo sapiens
gcaaaugcuguauucuucuuugg

SEQ ID NO: 32361 - RNA, 17 nt, Homo sapiens
ugaugauuaauucaccu

SEQ ID NO: 32362 - RNA, 23 nt, Homo sapiens
ugaaaaaguauaaauaaaaugag

SEQ ID NO: 32363 - RNA, 14 nt, Homo sapiens
uugaaugugucagg

SEQ ID NO: 32364 - RNA, 21 nt, Homo sapiens
aauuuucaaaaucaaauucca

SEQ ID NO: 32365 - RNA, 21 nt, Homo sapiens
ccaacagaagcuuccauucca

SEQ ID NO: 32366 - RNA, 14 nt, Homo sapiens
agcagggacuugaa

SEQ ID NO: 32367 - RNA, 13 nt, Homo sapiens
cacuggcucccug

SEQ ID NO: 32368 - RNA, 14 nt, Homo sapiens
auuucacuugauga

SEQ ID NO: 32369 - RNA, 15 nt, Homo sapiens
gcccuucaugcauuu

SEQ ID NO: 32370 - RNA, 22 nt, Homo sapiens
uaaaauauuuuuaugugcaaua

SEQ ID NO: 32371 - RNA, 15 nt, Homo sapiens
uaaacaguagugaua

SEQ ID NO: 32372 - RNA, 14 nt, Homo sapiens
gaagcaacccaaau

SEQ ID NO: 32373 - RNA, 16 nt, Homo sapiens
gugacuuaguguacau

SEQ ID NO: 32374 - RNA, 15 nt, Homo sapiens
auuguaacuuaugaa

SEQ ID NO: 32375 - RNA, 14 nt, Homo sapiens
uggucacauacaau

SEQ ID NO: 32376 - RNA, 13 nt, Homo sapiens
augauacaaugaa

SEQ ID NO: 32377 - RNA, 18 nt, Homo sapiens
auuuuaaguaauuucaga

SEQ ID NO: 32378 - RNA, 18 nt, Homo sapiens
aaauauuuuuaugugcaa

SEQ ID NO: 32379 - RNA, 19 nt, Homo sapiens
uucucuggcgacaguuuuc

SEQ ID NO: 32380 - RNA, 14 nt, Homo sapiens
ggcuuuuauugcca

SEQ ID NO: 32381 - RNA, 20 nt, Homo sapiens
augaacacuuauaagugaag

SEQ ID NO: 32382 - RNA, 15 nt, Homo sapiens
gacaguuuucugcuu

SEQ ID NO: 32383 - RNA, 14 nt, Homo sapiens
gacgaaccuugaaa

SEQ ID NO: 32384 - RNA, 13 nt, Homo sapiens
aauaaaagcacuu

SEQ ID NO: 32385 - RNA, 14 nt, Homo sapiens
ugaaugugucaggu

SEQ ID NO: 32386 - RNA, 16 nt, Homo sapiens
uucagccugaaagagg

SEQ ID NO: 32387 - RNA, 14 nt, Homo sapiens
uaauuacuauguca

SEQ ID NO: 32388 - RNA, 12 nt, Homo sapiens
agccccaaaagg

SEQ ID NO: 32389 - RNA, 16 nt, Homo sapiens
uauggcuuaaugacac

SEQ ID NO: 32390 - RNA, 16 nt, Homo sapiens
ucugcuuuaauuucau

SEQ ID NO: 32391 - RNA, 21 nt, Homo sapiens
cuggcucccuggaagagauca

SEQ ID NO: 32392 - RNA, 19 nt, Homo sapiens
uguuggaaaaugugcaaua

SEQ ID NO: 32393 - RNA, 13 nt, Homo sapiens
acaucuuucacau

SEQ ID NO: 32394 - RNA, 17 nt, Homo sapiens
uagugucugaugaaugu

SEQ ID NO: 32395 - RNA, 17 nt, Homo sapiens
cuuaaaaucuaauucaa

SEQ ID NO: 32396 - RNA, 16 nt, Homo sapiens
gacaacugugacugua

SEQ ID NO: 32397 - RNA, 21 nt, Homo sapiens
gauaccucaacccccauuucu

SEQ ID NO: 32398 - RNA, 22 nt, Homo sapiens
ucccauggguuguguguuuauu

SEQ ID NO: 32399 - RNA, 21 nt, Homo sapiens
cucugcccauccugccccuga

SEQ ID NO: 32400 - RNA, 20 nt, Homo sapiens
uccagccugagcgacaguga

SEQ ID NO: 32401 - RNA, 14 nt, Homo sapiens
gaagaaauucugca

SEQ ID NO: 32402 - RNA, 19 nt, Homo sapiens
uugaaucccuuaaacucag

SEQ ID NO: 32403 - RNA, 19 nt, Homo sapiens
uagagaaauuugccaauuu

SEQ ID NO: 32404 - RNA, 15 nt, Homo sapiens
aaaaugugcaauaug

SEQ ID NO: 32405 - RNA, 16 nt, Homo sapiens
uuugugacuuuccuaa

SEQ ID NO: 32406 - RNA, 18 nt, Homo sapiens
aguagauaugaggcauuu

SEQ ID NO: 32407 - RNA, 15 nt, Homo sapiens
ugcagcugugccaua

SEQ ID NO: 32408 - RNA, 17 nt, Homo sapiens
caaagcugaauacauuc

SEQ ID NO: 32409 - RNA, 13 nt, Homo sapiens
gcgcagccaugug

SEQ ID NO: 32410 - RNA, 12 nt, Homo sapiens
gaaaauaugccu

SEQ ID NO: 32411 - RNA, 24 nt, Homo sapiens
augcaaccuuuggaugcacuuuau

SEQ ID NO: 32412 - RNA, 13 nt, Homo sapiens
aauuuucuuccaa

SEQ ID NO: 32413 - RNA, 15 nt, Homo sapiens
gauuacccucugggu

SEQ ID NO: 32414 - RNA, 20 nt, Homo sapiens
auugagcaccugcaggcgug

SEQ ID NO: 32415 - RNA, 13 nt, Homo sapiens
uuuuucauuauug

SEQ ID NO: 32416 - RNA, 21 nt, Homo sapiens
uugaagaugcuuguauuuuac

SEQ ID NO: 32417 - RNA, 18 nt, Homo sapiens
caacagaagcuuccauuc

SEQ ID NO: 32418 - RNA, 14 nt, Homo sapiens
uaugcauacaguaa

SEQ ID NO: 32419 - RNA, 20 nt, Homo sapiens
ucugggcuuggggcuuccua

SEQ ID NO: 32420 - RNA, 13 nt, Homo sapiens
ucugauaccucaa

SEQ ID NO: 32421 - RNA, 19 nt, Homo sapiens
gaaaaaguucugcagauaa

SEQ ID NO: 32422 - RNA, 20 nt, Homo sapiens
acauagaauuaacacaugau

SEQ ID NO: 32423 - RNA, 20 nt, Homo sapiens
accacugcagaagacaguau

SEQ ID NO: 32424 - RNA, 14 nt, Homo sapiens
auauccugugacug

SEQ ID NO: 32425 - RNA, 16 nt, Homo sapiens
ugccccagggaccuuu

SEQ ID NO: 32426 - RNA, 22 nt, Homo sapiens
cccaaaacugauacccuuugaa

SEQ ID NO: 32427 - RNA, 18 nt, Homo sapiens
cuaauagaauuaauggaa

SEQ ID NO: 32428 - RNA, 18 nt, Homo sapiens
cuauauuaucaugcaaau

SEQ ID NO: 32429 - RNA, 17 nt, Homo sapiens
aguacucauacauguua

SEQ ID NO: 32430 - RNA, 23 nt, Homo sapiens
cuaucagcauuuuacuacuuuaa

SEQ ID NO: 32431 - RNA, 21 nt, Homo sapiens
auauuugaauuuuaaaucuaa

SEQ ID NO: 32432 - RNA, 16 nt, Homo sapiens
ugaaacauuacaguua

SEQ ID NO: 32433 - RNA, 19 nt, Homo sapiens
gcauguaugacgugacugg

SEQ ID NO: 32434 - RNA, 21 nt, Homo sapiens
uaaaauggagacaccaccacc

SEQ ID NO: 32435 - RNA, 17 nt, Homo sapiens
agaaggauguacauuuc

SEQ ID NO: 32436 - RNA, 19 nt, Homo sapiens
augaauuuuuuucaucuuc

SEQ ID NO: 32437 - RNA, 18 nt, Homo sapiens
cuggcuggggccuguuga

SEQ ID NO: 32438 - RNA, 13 nt, Homo sapiens
cuuaaaauguaau

SEQ ID NO: 32439 - RNA, 20 nt, Homo sapiens
uacaaggcuuuaucucaggg

SEQ ID NO: 32440 - RNA, 16 nt, Homo sapiens
uguaucuuauucacau

SEQ ID NO: 32441 - RNA, 19 nt, Homo sapiens
uuccagagaccaguauucc

SEQ ID NO: 32442 - RNA, 23 nt, Homo sapiens
guaaaauugaaaggcauucucug

SEQ ID NO: 32443 - RNA, 13 nt, Homo sapiens
auguaacugcauu

SEQ ID NO: 32444 - RNA, 17 nt, Homo sapiens
auauaaauuuucccaaa

SEQ ID NO: 32445 - RNA, 13 nt, Homo sapiens
aacacagugucug

SEQ ID NO: 32446 - RNA, 17 nt, Homo sapiens
aauucuuacauguuuuc

SEQ ID NO: 32447 - RNA, 23 nt, Homo sapiens
aagucuuccauagagacuuugug

SEQ ID NO: 32448 - RNA, 12 nt, Homo sapiens
aauuuacuuugu

SEQ ID NO: 32449 - RNA, 13 nt, Homo sapiens
gaaauaagccaga

SEQ ID NO: 32450 - RNA, 13 nt, Homo sapiens
auuauuuuuacag

SEQ ID NO: 32451 - RNA, 18 nt, Homo sapiens
uaaaauuaucaauaucua

SEQ ID NO: 32452 - RNA, 12 nt, Homo sapiens
cacuucacuuuu

SEQ ID NO: 32453 - RNA, 19 nt, Homo sapiens
aaauaguuuaugauuccac

SEQ ID NO: 32454 - RNA, 22 nt, Homo sapiens
uugcuccuggcuggggccuguu

SEQ ID NO: 32455 - RNA, 22 nt, Homo sapiens
acacaugauccugcaauuccac

SEQ ID NO: 32456 - RNA, 19 nt, Homo sapiens
aaguugcaccaacuuugaa

SEQ ID NO: 32457 - RNA, 16 nt, Homo sapiens
uuuuacauacugcugu

SEQ ID NO: 32458 - RNA, 19 nt, Homo sapiens
aaucaccaaggcugauuaa

SEQ ID NO: 32459 - RNA, 16 nt, Homo sapiens
guagccacuucacuuu

SEQ ID NO: 32460 - RNA, 24 nt, Homo sapiens
uuucaaaaucaaauuccagaauga

SEQ ID NO: 32461 - RNA, 20 nt, Homo sapiens
gacauagaauuaacacauga

SEQ ID NO: 32462 - RNA, 13 nt, Homo sapiens
ccugcaauuccac

SEQ ID NO: 32463 - RNA, 14 nt, Homo sapiens
ccgaagucuuccau

SEQ ID NO: 32464 - RNA, 21 nt, Homo sapiens
caaucugagccagugcuuuaa

SEQ ID NO: 32465 - RNA, 16 nt, Homo sapiens
uaagcaaagacuauga

SEQ ID NO: 32466 - RNA, 22 nt, Homo sapiens
gcuugaaauagugucugaugaa

SEQ ID NO: 32467 - RNA, 20 nt, Homo sapiens
agcuacuugggaggcugaga

SEQ ID NO: 32468 - RNA, 16 nt, Homo sapiens
accuaaauuugguucu

SEQ ID NO: 32469 - RNA, 16 nt, Homo sapiens
acuuuuguguaaugaa

SEQ ID NO: 32470 - RNA, 14 nt, Homo sapiens
gaaagggucucccu

SEQ ID NO: 32471 - RNA, 18 nt, Homo sapiens
auggcuaguaucaaaaga

SEQ ID NO: 32472 - RNA, 18 nt, Homo sapiens
ugacuuaguguacaugaa

SEQ ID NO: 32473 - RNA, 19 nt, Homo sapiens
uaaauguaucuuauucaca

SEQ ID NO: 32474 - RNA, 15 nt, Homo sapiens
uaauucaaacuaaua

SEQ ID NO: 32475 - RNA, 16 nt, Homo sapiens
agaagaaugacuaugc

SEQ ID NO: 32476 - RNA, 12 nt, Homo sapiens
agcaucucagga

SEQ ID NO: 32477 - RNA, 18 nt, Homo sapiens
agcaggauagagugggac

SEQ ID NO: 32478 - RNA, 21 nt, Homo sapiens
ugugguccgaagucuuccaua

SEQ ID NO: 32479 - RNA, 15 nt, Homo sapiens
uugcaccaacuuuga

SEQ ID NO: 32480 - RNA, 21 nt, Homo sapiens
gaccacgcuuucuagcuguug

SEQ ID NO: 32481 - RNA, 14 nt, Homo sapiens
ccauuguggucaca

SEQ ID NO: 32482 - RNA, 21 nt, Homo sapiens
caucacagcugaacuuguuga

SEQ ID NO: 32483 - RNA, 17 nt, Homo sapiens
gccagacaucaacagau

SEQ ID NO: 32484 - RNA, 16 nt, Homo sapiens
auccagaaauaaugaa

SEQ ID NO: 32485 - RNA, 18 nt, Homo sapiens
ugucuucauagcagauuu

SEQ ID NO: 32486 - RNA, 20 nt, Homo sapiens
agcaaaauggauaugacaca

SEQ ID NO: 32487 - RNA, 13 nt, Homo sapiens
uugaaaaaguaua

SEQ ID NO: 32488 - RNA, 21 nt, Homo sapiens
uuuuuaaacaaaaaaagcauu

SEQ ID NO: 32489 - RNA, 17 nt, Homo sapiens
ggaucucacaagcacuu

SEQ ID NO: 32490 - RNA, 21 nt, Homo sapiens
aagggucucccucuguugcca

SEQ ID NO: 32491 - RNA, 19 nt, Homo sapiens
gagccaccaaacccggccu

SEQ ID NO: 32492 - RNA, 10 nt, Homo sapiens
augugcaaua

SEQ ID NO: 32493 - RNA, 13 nt, Homo sapiens
cuuaugaaccuuu

SEQ ID NO: 32494 - RNA, 12 nt, Homo sapiens
aaguauccuuca

SEQ ID NO: 32495 - RNA, 15 nt, Homo sapiens
agcccauggcacucu

SEQ ID NO: 32496 - RNA, 20 nt, Homo sapiens
gcuguuuccauagggugaca

SEQ ID NO: 32497 - RNA, 18 nt, Homo sapiens
ucucgaacugcuggauuc

SEQ ID NO: 32498 - RNA, 21 nt, Homo sapiens
uuaucaugcaaaugcuguauu

SEQ ID NO: 32499 - RNA, 16 nt, Homo sapiens
gaggagaaacuggaac

SEQ ID NO: 32500 - RNA, 13 nt, Homo sapiens
aucaggacgagaa

SEQ ID NO: 32501 - RNA, 22 nt, Homo sapiens
agcaagaucccauggguugugu

SEQ ID NO: 32502 - RNA, 19 nt, Homo sapiens
gaggcggguggaucacuug

SEQ ID NO: 32503 - RNA, 15 nt, Homo sapiens
aaccuuuacauccag

SEQ ID NO: 32504 - RNA, 13 nt, Homo sapiens
gaauuaauggaau

SEQ ID NO: 32505 - RNA, 14 nt, Homo sapiens
ugaccugacagccc

SEQ ID NO: 32506 - RNA, 17 nt, Homo sapiens
aguuuauauacaauuau

SEQ ID NO: 32507 - RNA, 14 nt, Homo sapiens
caccuguaauccca

SEQ ID NO: 32508 - RNA, 23 nt, Homo sapiens
acaccgaguggcccuucauguac

SEQ ID NO: 32509 - RNA, 21 nt, Homo sapiens
cuuugcuuuaaguguaacugg

SEQ ID NO: 32510 - RNA, 22 nt, Homo sapiens
uugggaggcugaggcaagagaa

SEQ ID NO: 32511 - RNA, 19 nt, Homo sapiens
aauagaaggauguacauuu

SEQ ID NO: 32512 - RNA, 20 nt, Homo sapiens
cagugagcugauaucaugcc

SEQ ID NO: 32513 - RNA, 13 nt, Homo sapiens
cccuuuuacauac

SEQ ID NO: 32514 - RNA, 16 nt, Homo sapiens
aauguucaucaaugaa

SEQ ID NO: 32515 - RNA, 18 nt, Homo sapiens
guguuuuucacauuugcg

SEQ ID NO: 32516 - RNA, 18 nt, Homo sapiens
auaucuaauauauaugaa

SEQ ID NO: 32517 - RNA, 13 nt, Homo sapiens
aagaaauucugca

SEQ ID NO: 32518 - RNA, 19 nt, Homo sapiens
ccuggucaacauggugaaa

SEQ ID NO: 32519 - RNA, 14 nt, Homo sapiens
agcuguuuccauag

SEQ ID NO: 32520 - RNA, 20 nt, Homo sapiens
gaaauuuaauucauguuucu

SEQ ID NO: 32521 - RNA, 12 nt, Homo sapiens
aaauuggacuua

SEQ ID NO: 32522 - RNA, 16 nt, Homo sapiens
auaaacucagaaauuu

SEQ ID NO: 32523 - RNA, 14 nt, Homo sapiens
aacagaacuaugga

SEQ ID NO: 32524 - RNA, 18 nt, Homo sapiens
gagaaucagaucauuuca

SEQ ID NO: 32525 - RNA, 18 nt, Homo sapiens
ugaaagcagggacuugaa

SEQ ID NO: 32526 - RNA, 9 nt, Homo sapiens
ugugcaaua

SEQ ID NO: 32527 - RNA, 21 nt, Homo sapiens
cucugugaacgauuuagaaag

SEQ ID NO: 32528 - RNA, 22 nt, Homo sapiens
auacaauuauuuuuacaguucu

SEQ ID NO: 32529 - RNA, 18 nt, Homo sapiens
ugcauugagaacugcaua

SEQ ID NO: 32530 - RNA, 22 nt, Homo sapiens
uuucaugaaaagauuaugaucu

SEQ ID NO: 32531 - RNA, 17 nt, Homo sapiens
agagacgggguuugcca

SEQ ID NO: 32532 - RNA, 15 nt, Homo sapiens
uaucaauaucuaaua

SEQ ID NO: 32533 - RNA, 15 nt, Homo sapiens
ugaauaaaguguaag

SEQ ID NO: 32534 - RNA, 15 nt, Homo sapiens
guagccacuucacuu

SEQ ID NO: 32535 - RNA, 12 nt, Homo sapiens
uauauccuguga

SEQ ID NO: 32536 - RNA, 13 nt, Homo sapiens
gugacuggccugc

SEQ ID NO: 32537 - RNA, 18 nt, Homo sapiens
ucaggaguuccuaaccag

SEQ ID NO: 32538 - RNA, 16 nt, Homo sapiens
cuaaaguaucuguauu

SEQ ID NO: 32539 - RNA, 17 nt, Homo sapiens
accuuauuguaccucuc

SEQ ID NO: 32540 - RNA, 14 nt, Homo sapiens
agugggacaguucc

SEQ ID NO: 32541 - RNA, 16 nt, Homo sapiens
aacucagaaacaucag

SEQ ID NO: 32542 - RNA, 20 nt, Homo sapiens
aaggcuuagacccucaugcu

SEQ ID NO: 32543 - RNA, 20 nt, Homo sapiens
gcaaccuccaccuucugggu

SEQ ID NO: 32544 - RNA, 14 nt, Homo sapiens
agacagaacuugaa

SEQ ID NO: 32545 - RNA, 21 nt, Homo sapiens
cugugauucccuccugcuacu

SEQ ID NO: 32546 - RNA, 20 nt, Homo sapiens
ccucaucuguaaaauggaga

SEQ ID NO: 32547 - RNA, 12 nt, Homo sapiens
aaucuacacucc

SEQ ID NO: 32548 - RNA, 22 nt, Homo sapiens
aacccaaauguucaucaaugaa

SEQ ID NO: 32549 - RNA, 20 nt, Homo sapiens
agaaggauguacauuuccaa

SEQ ID NO: 32550 - RNA, 23 nt, Homo sapiens
aucggaucuggggcucugggaua

SEQ ID NO: 32551 - RNA, 21 nt, Homo sapiens
uggacaguuuucugcuuuaau

SEQ ID NO: 32552 - RNA, 15 nt, Homo sapiens
cagcagagacggggu

SEQ ID NO: 32553 - RNA, 21 nt, Homo sapiens
caccaaacccggccugauuaa

SEQ ID NO: 32554 - RNA, 14 nt, Homo sapiens
ggcuggagugcagu

SEQ ID NO: 32555 - RNA, 13 nt, Homo sapiens
uauuuuaaucacc

SEQ ID NO: 32556 - RNA, 19 nt, Homo sapiens
auacaauuauuuuuacagu

SEQ ID NO: 32557 - RNA, 22 nt, Homo sapiens
uucucuucacagucacauucca

SEQ ID NO: 32558 - RNA, 21 nt, Homo sapiens
ucauuuccuauguaacugcau

SEQ ID NO: 32559 - RNA, 16 nt, Homo sapiens
uggcugggaguggcau

SEQ ID NO: 32560 - RNA, 22 nt, Homo sapiens
guuaagcacuuuaacacagugu

SEQ ID NO: 32561 - RNA, 14 nt, Homo sapiens
augaaaaugaauau

SEQ ID NO: 32562 - RNA, 21 nt, Homo sapiens
aauuacaggcgugagccacca

SEQ ID NO: 32563 - RNA, 17 nt, Homo sapiens
uaccucugauaccucaa

SEQ ID NO: 32564 - RNA, 14 nt, Homo sapiens
cagaacuugaaugu

SEQ ID NO: 32565 - RNA, 17 nt, Homo sapiens
aaagcuaaaguaucugu

SEQ ID NO: 32566 - RNA, 15 nt, Homo sapiens
agcugaauacauucu

SEQ ID NO: 32567 - RNA, 13 nt, Homo sapiens
ucacaagcacuuu

SEQ ID NO: 32568 - RNA, 17 nt, Homo sapiens
uguggcauuuucacuuu

SEQ ID NO: 32569 - RNA, 16 nt, Homo sapiens
gacugucucacuuaau

SEQ ID NO: 32570 - RNA, 14 nt, Homo sapiens
aaaccucaagccag

SEQ ID NO: 32571 - RNA, 17 nt, Homo sapiens
caagugauccgcccauc

SEQ ID NO: 32572 - RNA, 18 nt, Homo sapiens
agccaaguuuauauacaa

SEQ ID NO: 32573 - RNA, 23 nt, Homo sapiens
uaucucaggggccaacuaggcag

SEQ ID NO: 32574 - RNA, 14 nt, Homo sapiens
cuaugugauuacaa

SEQ ID NO: 32575 - RNA, 15 nt, Homo sapiens
ugcagauaaacagua

SEQ ID NO: 32576 - RNA, 23 nt, Homo sapiens
ugucuuacagagaaaagacauaa

SEQ ID NO: 32577 - RNA, 19 nt, Homo sapiens
ugaacaaauuuacagagac

SEQ ID NO: 32578 - RNA, 19 nt, Homo sapiens
gcagagacgggguuugcca

SEQ ID NO: 32579 - RNA, 14 nt, Homo sapiens
uucccaaaacugau

SEQ ID NO: 32580 - RNA, 20 nt, Homo sapiens
aauuuaucuugucucugggc

SEQ ID NO: 32581 - RNA, 17 nt, Homo sapiens
aacauagcaucucagga

SEQ ID NO: 32582 - RNA, 15 nt, Homo sapiens
uuuccacuacugcua

SEQ ID NO: 32583 - RNA, 15 nt, Homo sapiens
gcugggaguggcaug

SEQ ID NO: 32584 - RNA, 18 nt, Homo sapiens
guuuuuccacuacugcua

SEQ ID NO: 32585 - RNA, 23 nt, Homo sapiens
ugaaauaagccagacaucaacag

SEQ ID NO: 32586 - RNA, 16 nt, Homo sapiens
uguacaccaauauuca

SEQ ID NO: 32587 - RNA, 15 nt, Homo sapiens
ccauagagacuuugu

SEQ ID NO: 32588 - RNA, 14 nt, Homo sapiens
cagucacauuccaa

SEQ ID NO: 32589 - RNA, 13 nt, Homo sapiens
gauaauaugagaa

SEQ ID NO: 32590 - RNA, 14 nt, Homo sapiens
aacugcauugagaa

SEQ ID NO: 32591 - RNA, 23 nt, Homo sapiens
ucaucugugauucccuccugcua

SEQ ID NO: 32592 - RNA, 19 nt, Homo sapiens
cugcaaucugagccagugc

SEQ ID NO: 32593 - RNA, 15 nt, Homo sapiens
ugacccugaugaaaa

SEQ ID NO: 32594 - RNA, 17 nt, Homo sapiens
gaaaccuuauuguaccu

SEQ ID NO: 32595 - RNA, 18 nt, Homo sapiens
aacucauugcaaccucca

SEQ ID NO: 32596 - RNA, 14 nt, Homo sapiens
ggcauucucugaag

SEQ ID NO: 32597 - RNA, 14 nt, Homo sapiens
uauguggcuguauc

SEQ ID NO: 32598 - RNA, 15 nt, Homo sapiens
uauguucuaagaagu

SEQ ID NO: 32599 - RNA, 12 nt, Homo sapiens
acucauugcaac

SEQ ID NO: 32600 - RNA, 17 nt, Homo sapiens
gagggggcgcgugcagg

SEQ ID NO: 32601 - RNA, 16 nt, Homo sapiens
ggacacaggcuccaaa

SEQ ID NO: 32602 - RNA, 22 nt, Homo sapiens
cuauauccugugacugucucac

SEQ ID NO: 32603 - RNA, 18 nt, Homo sapiens
ugagacagcucugcauac

SEQ ID NO: 32604 - RNA, 15 nt, Homo sapiens
ggcugggaguggcau

SEQ ID NO: 32605 - RNA, 15 nt, Homo sapiens
caaucuuaacucauu

SEQ ID NO: 32606 - RNA, 17 nt, Homo sapiens
uuggaaaaugugcaaua

SEQ ID NO: 32607 - RNA, 14 nt, Homo sapiens
ucuauguggcugua

SEQ ID NO: 32608 - RNA, 13 nt, Homo sapiens
uagggaccugcug

SEQ ID NO: 32609 - RNA, 15 nt, Homo sapiens
ggaauuuucuuccaa

SEQ ID NO: 32610 - RNA, 17 nt, Homo sapiens
caaauguucaucaauga

SEQ ID NO: 32611 - RNA, 18 nt, Homo sapiens
cugcuggauucaagugau

SEQ ID NO: 32612 - RNA, 23 nt, Homo sapiens
aaggcuucucuuaaacacuaaaa

SEQ ID NO: 32613 - RNA, 11 nt, Homo sapiens
acuuuuuccag

SEQ ID NO: 32614 - RNA, 23 nt, Homo sapiens
cacuccagccugagcgacaguga

SEQ ID NO: 32615 - RNA, 17 nt, Homo sapiens
agccccgggaguggcgc

SEQ ID NO: 32616 - RNA, 22 nt, Homo sapiens
uauuuuuuaugaaacauuacag

SEQ ID NO: 32617 - RNA, 18 nt, Homo sapiens
auuuauugagcaccugca

SEQ ID NO: 32618 - RNA, 15 nt, Homo sapiens
agugaaaaacaucca

SEQ ID NO: 32619 - RNA, 12 nt, Homo sapiens
uuaccucugaua

SEQ ID NO: 32620 - RNA, 23 nt, Homo sapiens
aucaauucuauuacgugcaauac

SEQ ID NO: 32621 - RNA, 16 nt, Homo sapiens
gaauuaacacaugauc

SEQ ID NO: 32622 - RNA, 15 nt, Homo sapiens
gucucaguccaugaa

SEQ ID NO: 32623 - RNA, 14 nt, Homo sapiens
aagccucaugucca

SEQ ID NO: 32624 - RNA, 17 nt, Homo sapiens
acacaggcuccaaacug

SEQ ID NO: 32625 - RNA, 13 nt, Homo sapiens
uccugugacuguc

SEQ ID NO: 32626 - RNA, 17 nt, Homo sapiens
uaaaguacagacuuuuu

SEQ ID NO: 32627 - RNA, 19 nt, Homo sapiens
auuccuauauccugugacu

SEQ ID NO: 32628 - RNA, 11 nt, Homo sapiens
ccugugacugu

SEQ ID NO: 32629 - RNA, 12 nt, Homo sapiens
aacugugacugu

SEQ ID NO: 32630 - RNA, 13 nt, Homo sapiens
gaaauagugucug

SEQ ID NO: 32631 - RNA, 15 nt, Homo sapiens
aagauuaugaucuca

SEQ ID NO: 32632 - RNA, 18 nt, Homo sapiens
aaccacuucauucuugaa

SEQ ID NO: 32633 - RNA, 22 nt, Homo sapiens
ccuggcugggaguggcauguau

SEQ ID NO: 32634 - RNA, 19 nt, Homo sapiens
cauuugcuggagcucugcc

SEQ ID NO: 32635 - RNA, 14 nt, Homo sapiens
uucacuuauugacu

SEQ ID NO: 32636 - RNA, 17 nt, Homo sapiens
uuuauuauuuucaccug

SEQ ID NO: 32637 - RNA, 15 nt, Homo sapiens
agugagcugauauca

SEQ ID NO: 32638 - RNA, 19 nt, Homo sapiens
gagaacugcauauguuucg

SEQ ID NO: 32639 - RNA, 13 nt, Homo sapiens
gugcaauauguga

SEQ ID NO: 32640 - RNA, 18 nt, Homo sapiens
uuacagagaaaagacaua

SEQ ID NO: 32641 - RNA, 21 nt, Homo sapiens
gugcuuuccguggcacugcau

SEQ ID NO: 32642 - RNA, 15 nt, Homo sapiens
uuuagggaccugcug

SEQ ID NO: 32643 - RNA, 15 nt, Homo sapiens
gcuuaaaauguaauu

SEQ ID NO: 32644 - RNA, 13 nt, Homo sapiens
cuaugugauuaca

SEQ ID NO: 32645 - RNA, 19 nt, Homo sapiens
augguuccauucucucucc

SEQ ID NO: 32646 - RNA, 14 nt, Homo sapiens
agccacuucacuuu

SEQ ID NO: 32647 - RNA, 22 nt, Homo sapiens
auucaccuuccagugucucgga

SEQ ID NO: 32648 - RNA, 21 nt, Homo sapiens
uguuuucugacuaauuaggca

SEQ ID NO: 32649 - RNA, 15 nt, Homo sapiens
uuuaauggcauguca

SEQ ID NO: 32650 - RNA, 22 nt, Homo sapiens
auaauuccuauauccugugacu

SEQ ID NO: 32651 - RNA, 14 nt, Homo sapiens
agcagaacagugau

SEQ ID NO: 32652 - RNA, 19 nt, Homo sapiens
uguguggcauuuucacuuu

SEQ ID NO: 32653 - RNA, 17 nt, Homo sapiens
aggcuagaaccaccugc

SEQ ID NO: 32654 - RNA, 20 nt, Homo sapiens
uaaauggacaaaugcuuaug

SEQ ID NO: 32655 - RNA, 22 nt, Homo sapiens
uucugugggagaauucuuacau

SEQ ID NO: 32656 - RNA, 16 nt, Homo sapiens
uucucuaacucagaaa

SEQ ID NO: 32657 - RNA, 11 nt, Homo sapiens
cuuuucucugc

SEQ ID NO: 32658 - RNA, 15 nt, Homo sapiens
auuugcaagacauag

SEQ ID NO: 32659 - RNA, 22 nt, Homo sapiens
uaucucaggggccaacuaggca

SEQ ID NO: 32660 - RNA, 15 nt, Homo sapiens
uacucauacauguua

SEQ ID NO: 32661 - RNA, 16 nt, Homo sapiens
auacauucugcuuuca

SEQ ID NO: 32662 - RNA, 21 nt, Homo sapiens
ucaauuuaaaaaaaaaccuga

SEQ ID NO: 32663 - RNA, 23 nt, Homo sapiens
ugagaaaccuuauuguaccucuc

SEQ ID NO: 32664 - RNA, 18 nt, Homo sapiens
ggacuugggcgggacaca

SEQ ID NO: 32665 - RNA, 15 nt, Homo sapiens
cuugguauagcauau

SEQ ID NO: 32666 - RNA, 20 nt, Homo sapiens
ugaggacuugggcgggacac

SEQ ID NO: 32667 - RNA, 13 nt, Homo sapiens
aucaaaagaaaga

SEQ ID NO: 32668 - RNA, 13 nt, Homo sapiens
cugauuaaaccaa

SEQ ID NO: 32669 - RNA, 21 nt, Homo sapiens
aagcacuuuaacacagugucu

SEQ ID NO: 32670 - RNA, 21 nt, Homo sapiens
ucugucuggacuuuccagaga

SEQ ID NO: 32671 - RNA, 20 nt, Homo sapiens
ccaacuuugaagucugauuu

SEQ ID NO: 32672 - RNA, 20 nt, Homo sapiens
auaauaugcacacagugcuu

SEQ ID NO: 32673 - RNA, 18 nt, Homo sapiens
auuacaggcgugagccac

SEQ ID NO: 32674 - RNA, 20 nt, Homo sapiens
gcuggucucgaacugcugga

SEQ ID NO: 32675 - RNA, 12 nt, Homo sapiens
aauucauguuuc

SEQ ID NO: 32676 - RNA, 20 nt, Homo sapiens
acagcuacuugggaggcuga

SEQ ID NO: 32677 - RNA, 18 nt, Homo sapiens
auuuguuaaaauuaucaa

SEQ ID NO: 32678 - RNA, 18 nt, Homo sapiens
ccuggcugggaguggcau

SEQ ID NO: 32679 - RNA, 22 nt, Homo sapiens
aauucgcugcaaccuguugaua

SEQ ID NO: 32680 - RNA, 16 nt, Homo sapiens
ggcauuuucacuuuug

SEQ ID NO: 32681 - RNA, 12 nt, Homo sapiens
accacauggcuu

SEQ ID NO: 32682 - RNA, 15 nt, Homo sapiens
gccacuucacuuuuu

SEQ ID NO: 32683 - RNA, 18 nt, Homo sapiens
auauuuuuaugugcaaua

SEQ ID NO: 32684 - RNA, 18 nt, Homo sapiens
aaaucuacacuccaguga

SEQ ID NO: 32685 - RNA, 12 nt, Homo sapiens
uaacuagaauuu

SEQ ID NO: 32686 - RNA, 12 nt, Homo sapiens
ugcaagacauag

SEQ ID NO: 32687 - RNA, 20 nt, Homo sapiens
uuugcugccucuaaaaggcc

SEQ ID NO: 32688 - RNA, 22 nt, Homo sapiens
guuaccaguaacggaacaguau

SEQ ID NO: 32689 - RNA, 23 nt, Homo sapiens
auguuucgugaaguauacuguau

SEQ ID NO: 32690 - RNA, 22 nt, Homo sapiens
aagucagugcccaacuguuaua

SEQ ID NO: 32691 - RNA, 22 nt, Homo sapiens
agaguucugucuggacuuucca

SEQ ID NO: 32692 - RNA, 17 nt, Homo sapiens
auuuauuuuuuuacuuc

SEQ ID NO: 32693 - RNA, 23 nt, Homo sapiens
aaggaagaaauuccaggaaaauc

SEQ ID NO: 32694 - RNA, 15 nt, Homo sapiens
cccugcacuccagcc

SEQ ID NO: 32695 - RNA, 15 nt, Homo sapiens
auguguuuuucacau

SEQ ID NO: 32696 - RNA, 23 nt, Homo sapiens
ucacauuccaagccucaugucca

SEQ ID NO: 32697 - RNA, 17 nt, Homo sapiens
auuguaacuuaugaacc

SEQ ID NO: 32698 - RNA, 12 nt, Homo sapiens
ucuguaaucuuc

SEQ ID NO: 32699 - RNA, 17 nt, Homo sapiens
aucuacacuccagugag

SEQ ID NO: 32700 - RNA, 14 nt, Homo sapiens
aacauguucacuua

SEQ ID NO: 32701 - RNA, 21 nt, Homo sapiens
cuuaguguacaugaaagcgua

SEQ ID NO: 32702 - RNA, 22 nt, Homo sapiens
ugagaugggagaaucacuugaa

SEQ ID NO: 32703 - RNA, 23 nt, Homo sapiens
uauaaauuuucccaaaacugaua

SEQ ID NO: 32704 - RNA, 19 nt, Homo sapiens
gccaaggcuggagugcagu

SEQ ID NO: 32705 - RNA, 15 nt, Homo sapiens
cagaaauuuaauuca

SEQ ID NO: 32706 - RNA, 16 nt, Homo sapiens
cuucaugcauuugcac

SEQ ID NO: 32707 - RNA, 14 nt, Homo sapiens
ccucuguugccaag

SEQ ID NO: 32708 - RNA, 21 nt, Homo sapiens
cuuguuuuuccacuacugcua

SEQ ID NO: 32709 - RNA, 22 nt, Homo sapiens
ugagacagcucugcauacucau

SEQ ID NO: 32710 - RNA, 20 nt, Homo sapiens
gacaccaccacccuugccau

SEQ ID NO: 32711 - RNA, 11 nt, Homo sapiens
uuuacuuuguu

SEQ ID NO: 32712 - RNA, 18 nt, Homo sapiens
guuccuucacauccugug

SEQ ID NO: 32713 - RNA, 23 nt, Homo sapiens
aaagucagugcccaacuguuaua

SEQ ID NO: 32714 - RNA, 14 nt, Homo sapiens
uuauuguaccucuc

SEQ ID NO: 32715 - RNA, 21 nt, Homo sapiens
caagguucuucccuuuuacau

SEQ ID NO: 32716 - RNA, 19 nt, Homo sapiens
gggucucccucuguugcca

SEQ ID NO: 32717 - RNA, 23 nt, Homo sapiens
aaccaaauuuguauuuaagguau

SEQ ID NO: 32718 - RNA, 20 nt, Homo sapiens
ggaggcagagguugcaguga

SEQ ID NO: 32719 - RNA, 12 nt, Homo sapiens
cagaacagugau

SEQ ID NO: 32720 - RNA, 16 nt, Homo sapiens
uccccaaccacuucau

SEQ ID NO: 32721 - RNA, 15 nt, Homo sapiens
ucugcuuuaauuuca

SEQ ID NO: 32722 - RNA, 20 nt, Homo sapiens
gagugacuuaguguacauga

SEQ ID NO: 32723 - RNA, 17 nt, Homo sapiens
ugggaauuuucuuccaa

SEQ ID NO: 32724 - RNA, 23 nt, Homo sapiens
uggacuuuccagagaccaguauu

SEQ ID NO: 32725 - RNA, 20 nt, Homo sapiens
aucaugccccuguacuccag

SEQ ID NO: 32726 - RNA, 16 nt, Homo sapiens
ucagaagaaauucugc

SEQ ID NO: 32727 - RNA, 20 nt, Homo sapiens
cagagguugcagugagccga

SEQ ID NO: 32728 - RNA, 21 nt, Homo sapiens
gagacaccaccacccuugcca

SEQ ID NO: 32729 - RNA, 20 nt, Homo sapiens
augagaaucagaucauuuca

SEQ ID NO: 32730 - RNA, 20 nt, Homo sapiens
aguguuggaaaaugugcaau

SEQ ID NO: 32731 - RNA, 18 nt, Homo sapiens
auaaaguguaaguucaca

SEQ ID NO: 32732 - RNA, 20 nt, Homo sapiens
cugucuggacuuuccagaga

SEQ ID NO: 32733 - RNA, 18 nt, Homo sapiens
auuagccgggcauggugg

SEQ ID NO: 32734 - RNA, 12 nt, Homo sapiens
aaaaaagccaaa

SEQ ID NO: 32735 - RNA, 21 nt, Homo sapiens
gaauauuuauuaccucugaua

SEQ ID NO: 32736 - RNA, 16 nt, Homo sapiens
aacacuaaaaaggcau

SEQ ID NO: 32737 - RNA, 18 nt, Homo sapiens
cauagcagcuuauucaca

SEQ ID NO: 32738 - RNA, 19 nt, Homo sapiens
cuguuuccauagggugaca

SEQ ID NO: 32739 - RNA, 13 nt, Homo sapiens
auuacgugcaaua

SEQ ID NO: 32740 - RNA, 11 nt, Homo sapiens
ucucagugucc

SEQ ID NO: 32741 - RNA, 16 nt, Homo sapiens
aagaaugacuaugcaa

SEQ ID NO: 32742 - RNA, 14 nt, Homo sapiens
gaaaaugugcaaua

SEQ ID NO: 32743 - RNA, 19 nt, Homo sapiens
accuacaugagguacugag

SEQ ID NO: 32744 - RNA, 15 nt, Homo sapiens
cccauuucuauuuau

SEQ ID NO: 32745 - RNA, 21 nt, Homo sapiens
ucaucuguaaaauggagacac

SEQ ID NO: 32746 - RNA, 13 nt, Homo sapiens
ugaaauagugucu

SEQ ID NO: 32747 - RNA, 13 nt, Homo sapiens
uguuuuuaagcug

SEQ ID NO: 32748 - RNA, 21 nt, Homo sapiens
aaacuaccagcccuacaccau

SEQ ID NO: 32749 - RNA, 14 nt, Homo sapiens
cuuaaaaucuaauu

SEQ ID NO: 32750 - RNA, 22 nt, Homo sapiens
ugucuugggaauuuucuuccaa

SEQ ID NO: 32751 - RNA, 17 nt, Homo sapiens
augaaguacucauacau

SEQ ID NO: 32752 - RNA, 16 nt, Homo sapiens
uucaugcauuugcacu

SEQ ID NO: 32753 - RNA, 15 nt, Homo sapiens
gacccaaaaggcaga

SEQ ID NO: 32754 - RNA, 20 nt, Homo sapiens
gagauggaaguugcagugag

SEQ ID NO: 32755 - RNA, 22 nt, Homo sapiens
cugaggcaagagaauugcuuga

SEQ ID NO: 32756 - RNA, 22 nt, Homo sapiens
cuauguucuaagaagugaaaau

SEQ ID NO: 32757 - RNA, 21 nt, Homo sapiens
cuugaaauagugucugaugaa

SEQ ID NO: 32758 - RNA, 20 nt, Homo sapiens
aauauuuauuauuuucaccu

SEQ ID NO: 32759 - RNA, 19 nt, Homo sapiens
gguaucaaccaaauggagu

SEQ ID NO: 32760 - RNA, 18 nt, Homo sapiens
uaaauaguuuaugauucc

SEQ ID NO: 32761 - RNA, 23 nt, Homo sapiens
aagaaauucugcaagcuuuucaa

SEQ ID NO: 32762 - RNA, 15 nt, Homo sapiens
cuuuuauugccauga

SEQ ID NO: 32763 - RNA, 19 nt, Homo sapiens
acaaggcuuuaucucaggg

SEQ ID NO: 32764 - RNA, 17 nt, Homo sapiens
ugauuacaaggcuuuau

SEQ ID NO: 32765 - RNA, 20 nt, Homo sapiens
ugagagcccuucaugcauuu

SEQ ID NO: 32766 - RNA, 15 nt, Homo sapiens
cuugggcgggacaca

SEQ ID NO: 32767 - RNA, 13 nt, Homo sapiens
cacuccagccuga

SEQ ID NO: 32768 - RNA, 17 nt, Homo sapiens
auggcagcuuuccucaa

SEQ ID NO: 32769 - RNA, 16 nt, Homo sapiens
ugaaaaugaauaucua

SEQ ID NO: 32770 - RNA, 14 nt, Homo sapiens
aagacaaauucugu

SEQ ID NO: 32771 - RNA, 18 nt, Homo sapiens
auuguugacaacugugac

SEQ ID NO: 32772 - RNA, 18 nt, Homo sapiens
gaaaagauuaugaucuca

SEQ ID NO: 32773 - RNA, 13 nt, Homo sapiens
augcauacaguaa

SEQ ID NO: 32774 - RNA, 14 nt, Homo sapiens
aacuggcaguuuuc

SEQ ID NO: 32775 - RNA, 12 nt, Homo sapiens
cauguacaucca

SEQ ID NO: 32776 - RNA, 18 nt, Homo sapiens
augcaaccuuuggaugca

SEQ ID NO: 32777 - RNA, 11 nt, Homo sapiens
uuuaugugcaa

SEQ ID NO: 32778 - RNA, 21 nt, Homo sapiens
uucaugaaaagauuaugaucu

SEQ ID NO: 32779 - RNA, 22 nt, Homo sapiens
ggcagcaggauagagugggaca

SEQ ID NO: 32780 - RNA, 21 nt, Homo sapiens
uccuguacuuuuuccagacac

SEQ ID NO: 32781 - RNA, 13 nt, Homo sapiens
uggccugcuggau

SEQ ID NO: 32782 - RNA, 13 nt, Homo sapiens
ugugacuuuccua

SEQ ID NO: 32783 - RNA, 17 nt, Homo sapiens
aagugaaaaacauccag

SEQ ID NO: 32784 - RNA, 18 nt, Homo sapiens
guaucaaccaaauggagu

SEQ ID NO: 32785 - RNA, 18 nt, Homo sapiens
uuguaaaauggugugacc

SEQ ID NO: 32786 - RNA, 12 nt, Homo sapiens
aaguuuaugcau

SEQ ID NO: 32787 - RNA, 22 nt, Homo sapiens
aguauaaauaaaaugagcaaaa

SEQ ID NO: 32788 - RNA, 13 nt, Homo sapiens
ucaugcauuugca

SEQ ID NO: 32789 - RNA, 17 nt, Homo sapiens
cuggacuuuccagagac

SEQ ID NO: 32790 - RNA, 16 nt, Homo sapiens
aacccggccugauuaa

SEQ ID NO: 32791 - RNA, 23 nt, Homo sapiens
ucacauuggcuauuuaaagacaa

SEQ ID NO: 32792 - RNA, 18 nt, Homo sapiens
aauuuauucaauuccucu

SEQ ID NO: 32793 - RNA, 13 nt, Homo sapiens
cauuuucacuuuu

SEQ ID NO: 32794 - RNA, 18 nt, Homo sapiens
augaaaagauuaugaucu

SEQ ID NO: 32795 - RNA, 15 nt, Homo sapiens
gaagcuuccauucca

SEQ ID NO: 32796 - RNA, 17 nt, Homo sapiens
aaugaaugaauggcuaa

SEQ ID NO: 32797 - RNA, 18 nt, Homo sapiens
uacagagaaaagacauaa

SEQ ID NO: 32798 - RNA, 20 nt, Homo sapiens
auauaauaugcacacagugc

SEQ ID NO: 32799 - RNA, 21 nt, Homo sapiens
gacaccaccacccuugccaug

SEQ ID NO: 32800 - RNA, 17 nt, Homo sapiens
gcagaagcaacccaaau

SEQ ID NO: 32801 - RNA, 13 nt, Homo sapiens
auguuaugcauaa

SEQ ID NO: 32802 - RNA, 22 nt, Homo sapiens
aauuuucaaaaucaaauuccag

SEQ ID NO: 32803 - RNA, 23 nt, Homo sapiens
acuaauuaggcaaggcuauguga

SEQ ID NO: 32804 - RNA, 20 nt, Homo sapiens
cgucucuacuaaaaauacaa

SEQ ID NO: 32805 - RNA, 19 nt, Homo sapiens
acagccaggcggcuggaau

SEQ ID NO: 32806 - RNA, 12 nt, Homo sapiens
aucuacacucca

SEQ ID NO: 32807 - RNA, 23 nt, Homo sapiens
aguguccucaucuguaaaaugga

SEQ ID NO: 32808 - RNA, 22 nt, Homo sapiens
ugugauauguaccuaacgaagu

SEQ ID NO: 32809 - RNA, 17 nt, Homo sapiens
caaaacuucagacauag

SEQ ID NO: 32810 - RNA, 19 nt, Homo sapiens
uuaucaugcaaaugcugua

SEQ ID NO: 32811 - RNA, 23 nt, Homo sapiens
guagaaaaagcaguaacugacaa

SEQ ID NO: 32812 - RNA, 20 nt, Homo sapiens
aaaugggcuacuuuguccuu

SEQ ID NO: 32813 - RNA, 15 nt, Homo sapiens
uaucuuaguugguau

SEQ ID NO: 32814 - RNA, 13 nt, Homo sapiens
uaaguaauuucag

SEQ ID NO: 32815 - RNA, 14 nt, Homo sapiens
gcaggcgugaccug

SEQ ID NO: 32816 - RNA, 16 nt, Homo sapiens
uggaaaaaaaggaaga

SEQ ID NO: 32817 - RNA, 22 nt, Homo sapiens
ggaauauuugcaagacauagaa

SEQ ID NO: 32818 - RNA, 23 nt, Homo sapiens
uuaaguguaacuggcaguuuucc

SEQ ID NO: 32819 - RNA, 21 nt, Homo sapiens
cuggauguggagggggcgcgu

SEQ ID NO: 32820 - RNA, 11 nt, Homo sapiens
acaucuuucac

SEQ ID NO: 32821 - RNA, 17 nt, Homo sapiens
uaugauuccaccuacau

SEQ ID NO: 32822 - RNA, 22 nt, Homo sapiens
cucugaagaguggguuucacaa

SEQ ID NO: 32823 - RNA, 17 nt, Homo sapiens
cuucucuucacagucac

SEQ ID NO: 32824 - RNA, 20 nt, Homo sapiens
gaaaacauagcaucucagga

SEQ ID NO: 32825 - RNA, 15 nt, Homo sapiens
cuucuuggucucagu

SEQ ID NO: 32826 - RNA, 15 nt, Homo sapiens
ugugauuacaaggcu

SEQ ID NO: 32827 - RNA, 15 nt, Homo sapiens
caaaaucaaauucca

SEQ ID NO: 32828 - RNA, 17 nt, Homo sapiens
aauauuugcaagacaua

SEQ ID NO: 32829 - RNA, 17 nt, Homo sapiens
uuccucaaaacuucaga

SEQ ID NO: 32830 - RNA, 13 nt, Homo sapiens
cagggacuugaac

SEQ ID NO: 32831 - RNA, 21 nt, Homo sapiens
ugucucggagggauuccccua

SEQ ID NO: 32832 - RNA, 12 nt, Homo sapiens
ucaucaaugaau

SEQ ID NO: 32833 - RNA, 16 nt, Homo sapiens
uuaugcauaaagucag

SEQ ID NO: 32834 - RNA, 15 nt, Homo sapiens
uagaagcaucacagg

SEQ ID NO: 32835 - RNA, 15 nt, Homo sapiens
ggauagagugggaca

SEQ ID NO: 32836 - RNA, 23 nt, Homo sapiens
uuuaaaaaaaaaaaaaaagccaa

SEQ ID NO: 32837 - RNA, 16 nt, Homo sapiens
gcuuuaauuucaugaa

SEQ ID NO: 32838 - RNA, 10 nt, Homo sapiens
caagacauag

SEQ ID NO: 32839 - RNA, 17 nt, Homo sapiens
cugaagggcaucaugca

SEQ ID NO: 32840 - RNA, 17 nt, Homo sapiens
auaagcaaagacuauga

SEQ ID NO: 32841 - RNA, 20 nt, Homo sapiens
auuuucacuuuuggcuugua

SEQ ID NO: 32842 - RNA, 23 nt, Homo sapiens
gauuucaugccuggugcuuccaa

SEQ ID NO: 32843 - RNA, 19 nt, Homo sapiens
uucgugaaguauacuguau

SEQ ID NO: 32844 - RNA, 13 nt, Homo sapiens
uaagcaacaucua

SEQ ID NO: 32845 - RNA, 13 nt, Homo sapiens
guaaaauugaaag

SEQ ID NO: 32846 - RNA, 16 nt, Homo sapiens
cacagucacauuccaa

SEQ ID NO: 32847 - RNA, 16 nt, Homo sapiens
cacagaggaucugcuu

SEQ ID NO: 32848 - RNA, 12 nt, Homo sapiens
acaacugugacu

SEQ ID NO: 32849 - RNA, 19 nt, Homo sapiens
aggcaaggcuaugugauua

SEQ ID NO: 32850 - RNA, 22 nt, Homo sapiens
cugcaagcuuuucaaaauugga

SEQ ID NO: 32851 - RNA, 17 nt, Homo sapiens
aacuagaauuuauucaa

SEQ ID NO: 32852 - RNA, 22 nt, Homo sapiens
agagcccuucaugcauuugcac

SEQ ID NO: 32853 - RNA, 19 nt, Homo sapiens
cacuuugggaggcugaggc

SEQ ID NO: 32854 - RNA, 16 nt, Homo sapiens
uuaugaaacauuacag

SEQ ID NO: 32855 - RNA, 23 nt, Homo sapiens
aaugugucaggugacccugauga

SEQ ID NO: 32856 - RNA, 21 nt, Homo sapiens
cagaacuugaaugugucaggu

SEQ ID NO: 32857 - RNA, 21 nt, Homo sapiens
gcuuauucacaagacccaaaa

SEQ ID NO: 32858 - RNA, 16 nt, Homo sapiens
acuuaguguacaugaa

SEQ ID NO: 32859 - RNA, 22 nt, Homo sapiens
uggcaaaucucuauuaggaaau

SEQ ID NO: 32860 - RNA, 12 nt, Homo sapiens
uuauaaucuuuu

SEQ ID NO: 32861 - RNA, 18 nt, Homo sapiens
ugggagaaucacuugaac

SEQ ID NO: 32862 - RNA, 17 nt, Homo sapiens
uaaacaaaggaauuaug

SEQ ID NO: 32863 - RNA, 12 nt, Homo sapiens
caaacagaacua

SEQ ID NO: 32864 - RNA, 17 nt, Homo sapiens
uauugcugaaugacuac

SEQ ID NO: 32865 - RNA, 22 nt, Homo sapiens
agaaauuccaggaaaaucugca

SEQ ID NO: 32866 - RNA, 23 nt, Homo sapiens
guuuccuagcgcagccaugugau

SEQ ID NO: 32867 - RNA, 14 nt, Homo sapiens
auaaauggacaaau

SEQ ID NO: 32868 - RNA, 18 nt, Homo sapiens
gaaagcagggacuugaac

SEQ ID NO: 32869 - RNA, 22 nt, Homo sapiens
ugaauaaaguguaaguucacaa

SEQ ID NO: 32870 - RNA, 18 nt, Homo sapiens
ugguccgaagucuuccau

SEQ ID NO: 32871 - RNA, 12 nt, Homo sapiens
caguaacugaca

SEQ ID NO: 32872 - RNA, 17 nt, Homo sapiens
uucaaaauuggacuuaa

SEQ ID NO: 32873 - RNA, 19 nt, Homo sapiens
gcaacccaaauguucauca

SEQ ID NO: 32874 - RNA, 12 nt, Homo sapiens
gccaauuuacuu

SEQ ID NO: 32875 - RNA, 22 nt, Homo sapiens
ugucuuacagagaaaagacaua

SEQ ID NO: 32876 - RNA, 19 nt, Homo sapiens
ugucuggcacuugggacaa

SEQ ID NO: 32877 - RNA, 20 nt, Homo sapiens
ucccuuuuacauacugcugu

SEQ ID NO: 32878 - RNA, 12 nt, Homo sapiens
acugugacugua

SEQ ID NO: 32879 - RNA, 17 nt, Homo sapiens
aaggcuuuaucucaggg

SEQ ID NO: 32880 - RNA, 14 nt, Homo sapiens
uuccacuacugcua

SEQ ID NO: 32881 - RNA, 19 nt, Homo sapiens
cauggcacucuauguucua

SEQ ID NO: 32882 - RNA, 19 nt, Homo sapiens
gacuaugaggaauauuugc

SEQ ID NO: 32883 - RNA, 22 nt, Homo sapiens
gauagagugggacaguuccuga

SEQ ID NO: 32884 - RNA, 21 nt, Homo sapiens
uuuacauacugcugucuaugu

SEQ ID NO: 32885 - RNA, 21 nt, Homo sapiens
uuacuauuuauugcugaauga

SEQ ID NO: 32886 - RNA, 14 nt, Homo sapiens
accaguauucccuu

SEQ ID NO: 32887 - RNA, 13 nt, Homo sapiens
caauuccucuggg

SEQ ID NO: 32888 - RNA, 13 nt, Homo sapiens
uuacaucuuucac

SEQ ID NO: 32889 - RNA, 21 nt, Homo sapiens
aaauaacuaggcguggacuua

SEQ ID NO: 32890 - RNA, 19 nt, Homo sapiens
agaaauuugccaauuuacu

SEQ ID NO: 32891 - RNA, 21 nt, Homo sapiens
ggagcuugaaauagugucuga

SEQ ID NO: 32892 - RNA, 21 nt, Homo sapiens
guuuucccugaccucccucua

SEQ ID NO: 32893 - RNA, 13 nt, Homo sapiens
ucuugaaagcugu

SEQ ID NO: 32894 - RNA, 13 nt, Homo sapiens
cucaucugugauu

SEQ ID NO: 32895 - RNA, 20 nt, Homo sapiens
gccuguaaucccagcacuuu

SEQ ID NO: 32896 - RNA, 14 nt, Homo sapiens
aagaaauucugcaa

SEQ ID NO: 32897 - RNA, 18 nt, Homo sapiens
aagccaucggagcugcua

SEQ ID NO: 32898 - RNA, 17 nt, Homo sapiens
uacaauugaaaugacua

SEQ ID NO: 32899 - RNA, 20 nt, Homo sapiens
aguucugucuggacuuucca

SEQ ID NO: 32900 - RNA, 16 nt, Homo sapiens
uaaaugauuucauuca

SEQ ID NO: 32901 - RNA, 21 nt, Homo sapiens
guauauaaauuuucccaaaac

SEQ ID NO: 32902 - RNA, 13 nt, Homo sapiens
ugagcgacaguga

SEQ ID NO: 32903 - RNA, 16 nt, Homo sapiens
ugauucccuccugcua

SEQ ID NO: 32904 - RNA, 22 nt, Homo sapiens
aagauguagaggagaaacugga

SEQ ID NO: 32905 - RNA, 15 nt, Homo sapiens
cuguacuuuuuccag

SEQ ID NO: 32906 - RNA, 12 nt, Homo sapiens
aacccugucucu

SEQ ID NO: 32907 - RNA, 15 nt, Homo sapiens
caagccucaugucca

SEQ ID NO: 32908 - RNA, 22 nt, Homo sapiens
aaauauuuuuaugugcaauaaa

SEQ ID NO: 32909 - RNA, 16 nt, Homo sapiens
auggcuaguaucaaaa

SEQ ID NO: 32910 - RNA, 20 nt, Homo sapiens
caccagagauaauaugagaa

SEQ ID NO: 32911 - RNA, 22 nt, Homo sapiens
auguugaaaaaguucugcagau

SEQ ID NO: 32912 - RNA, 16 nt, Homo sapiens
gugccuguaaucacag

SEQ ID NO: 32913 - RNA, 17 nt, Homo sapiens
gccugcuggauguggag

SEQ ID NO: 32914 - RNA, 15 nt, Homo sapiens
uauuucacuugauga

SEQ ID NO: 32915 - RNA, 14 nt, Homo sapiens
aaaaugaauaucua

SEQ ID NO: 32916 - RNA, 15 nt, Homo sapiens
aauucugcaagcuuu

SEQ ID NO: 32917 - RNA, 14 nt, Homo sapiens
uggaaaaugugcaa

SEQ ID NO: 32918 - RNA, 16 nt, Homo sapiens
agauccccguguuacu

SEQ ID NO: 32919 - RNA, 14 nt, Homo sapiens
auacuccuaguaau

SEQ ID NO: 32920 - RNA, 18 nt, Homo sapiens
guuggaaaaugugcaaua

SEQ ID NO: 32921 - RNA, 23 nt, Homo sapiens
uuaaaauauuuuuaugugcaaua

SEQ ID NO: 32922 - RNA, 22 nt, Homo sapiens
aucuuguuuuuccacuacugcu

SEQ ID NO: 32923 - RNA, 16 nt, Homo sapiens
ugcaccaacuuugaag

SEQ ID NO: 32924 - RNA, 15 nt, Homo sapiens
uuaucuugucucugg

SEQ ID NO: 32925 - RNA, 16 nt, Homo sapiens
auuuuuaugugcaaua

SEQ ID NO: 32926 - RNA, 23 nt, Homo sapiens
aaauucgcugcaaccuguugaua

SEQ ID NO: 32927 - RNA, 14 nt, Homo sapiens
uguggucacaggaa

SEQ ID NO: 32928 - RNA, 15 nt, Homo sapiens
acaguuccugagacc

SEQ ID NO: 32929 - RNA, 15 nt, Homo sapiens
acauagcaucucagg

SEQ ID NO: 32930 - RNA, 17 nt, Homo sapiens
caucuuggucacauaca

SEQ ID NO: 32931 - RNA, 18 nt, Homo sapiens
gagcuugaaauagugucu

SEQ ID NO: 32932 - RNA, 16 nt, Homo sapiens
auucccuccugcuacu

SEQ ID NO: 32933 - RNA, 23 nt, Homo sapiens
ucuucccuuuuacauacugcugu

SEQ ID NO: 32934 - RNA, 22 nt, Homo sapiens
ugcagcccccauuguggucaca

SEQ ID NO: 32935 - RNA, 13 nt, Homo sapiens
acuagauacugaa

SEQ ID NO: 32936 - RNA, 20 nt, Homo sapiens
acggagauaucccaggaaaa

SEQ ID NO: 32937 - RNA, 18 nt, Homo sapiens
aagguauuuauugagcac

SEQ ID NO: 32938 - RNA, 16 nt, Homo sapiens
gagauuucaugccugg

SEQ ID NO: 32939 - RNA, 20 nt, Homo sapiens
aguaauuuuaaguaauuuca

SEQ ID NO: 32940 - RNA, 15 nt, Homo sapiens
caaggcuuuaucuca

SEQ ID NO: 32941 - RNA, 14 nt, Homo sapiens
auuugagacaggga

SEQ ID NO: 32942 - RNA, 17 nt, Homo sapiens
gaaucagaucauuucaa

SEQ ID NO: 32943 - RNA, 20 nt, Homo sapiens
gugaaauaaaaguagaauaa

SEQ ID NO: 32944 - RNA, 20 nt, Homo sapiens
cauuaaauauaauaugcaca

SEQ ID NO: 32945 - RNA, 20 nt, Homo sapiens
gagaaaccuuauuguaccuc

SEQ ID NO: 32946 - RNA, 15 nt, Homo sapiens
agcagggacuugaac

SEQ ID NO: 32947 - RNA, 16 nt, Homo sapiens
gccuugguauagcaua

SEQ ID NO: 32948 - RNA, 12 nt, Homo sapiens
uugaauccagaa

SEQ ID NO: 32949 - RNA, 16 nt, Homo sapiens
aaguugcaccaacuuu

SEQ ID NO: 32950 - RNA, 14 nt, Homo sapiens
gcuuccuaacugcu

SEQ ID NO: 32951 - RNA, 17 nt, Homo sapiens
aaauauaauaugcacac

SEQ ID NO: 32952 - RNA, 22 nt, Homo sapiens
uuuccuagcgcagccaugugau

SEQ ID NO: 32953 - RNA, 19 nt, Homo sapiens
guuuuccuucucaucugug

SEQ ID NO: 32954 - RNA, 23 nt, Homo sapiens
aggcuggucucgaacugcuggau

SEQ ID NO: 32955 - RNA, 20 nt, Homo sapiens
uaguuucccuugcaugguuu

SEQ ID NO: 32956 - RNA, 14 nt, Homo sapiens
uacaaggcuuuauc

SEQ ID NO: 32957 - RNA, 17 nt, Homo sapiens
auucacaagacccaaaa

SEQ ID NO: 32958 - RNA, 17 nt, Homo sapiens
ugaguggaugauguuuc

SEQ ID NO: 32959 - RNA, 21 nt, Homo sapiens
aaaaaaauuuuauagugucuu

SEQ ID NO: 32960 - RNA, 13 nt, Homo sapiens
gccccugcacucc

SEQ ID NO: 32961 - RNA, 20 nt, Homo sapiens
uccuuccuuaucacugacac

SEQ ID NO: 32962 - RNA, 16 nt, Homo sapiens
gagacucugucucagu

SEQ ID NO: 32963 - RNA, 13 nt, Homo sapiens
gacagaaagcaga

SEQ ID NO: 32964 - RNA, 18 nt, Homo sapiens
aggcauguaauugcuugu

SEQ ID NO: 32965 - RNA, 18 nt, Homo sapiens
uacucuguuccuucacau

SEQ ID NO: 32966 - RNA, 12 nt, Homo sapiens
uaaaagcacuua

SEQ ID NO: 32967 - RNA, 20 nt, Homo sapiens
aagcagaacagugauuacca

SEQ ID NO: 32968 - RNA, 12 nt, Homo sapiens
uuauuaccucug

SEQ ID NO: 32969 - RNA, 13 nt, Homo sapiens
uggcacugcauac

SEQ ID NO: 32970 - RNA, 16 nt, Homo sapiens
guaccgcaaugugacu

SEQ ID NO: 32971 - RNA, 16 nt, Homo sapiens
uuccuuaucacugaca

SEQ ID NO: 32972 - RNA, 13 nt, Homo sapiens
agauguagaggag

SEQ ID NO: 32973 - RNA, 16 nt, Homo sapiens
uuggaugcacuuuaua

SEQ ID NO: 32974 - RNA, 15 nt, Homo sapiens
uuauuaccucugaua

SEQ ID NO: 32975 - RNA, 19 nt, Homo sapiens
uaguguuggaaaaugugca

SEQ ID NO: 32976 - RNA, 15 nt, Homo sapiens
uggcauuuucacuuu

SEQ ID NO: 32977 - RNA, 17 nt, Homo sapiens
ccuggacaguuuucugc

SEQ ID NO: 32978 - RNA, 16 nt, Homo sapiens
caaguuguguuugaua

SEQ ID NO: 32979 - RNA, 20 nt, Homo sapiens
cuggaucucacaagcacuuu

SEQ ID NO: 32980 - RNA, 16 nt, Homo sapiens
cacuuauugacuauua

SEQ ID NO: 32981 - RNA, 19 nt, Homo sapiens
gaaaaucugcacugugggc

SEQ ID NO: 32982 - RNA, 19 nt, Homo sapiens
gguauuuauugagcaccug

SEQ ID NO: 32983 - RNA, 16 nt, Homo sapiens
caaauauuguugacaa

SEQ ID NO: 32984 - RNA, 14 nt, Homo sapiens
ucucaucugugauu

SEQ ID NO: 32985 - RNA, 22 nt, Homo sapiens
augaaaagauuaugaucucaga

SEQ ID NO: 32986 - RNA, 15 nt, Homo sapiens
uuuuaaguaauuuca

SEQ ID NO: 32987 - RNA, 21 nt, Homo sapiens
gcuacucuguuccuucacauc

SEQ ID NO: 32988 - RNA, 12 nt, Homo sapiens
gacuugaaccca

SEQ ID NO: 32989 - RNA, 17 nt, Homo sapiens
uguauuuuauuacaucu

SEQ ID NO: 32990 - RNA, 19 nt, Homo sapiens
agugaacaaauuuacagag

SEQ ID NO: 32991 - RNA, 17 nt, Homo sapiens
uuauuuuuuuacuuccu

SEQ ID NO: 32992 - RNA, 20 nt, Homo sapiens
ccuggacaguuuucugcuuu

SEQ ID NO: 32993 - RNA, 17 nt, Homo sapiens
gaucucacaagcacuuu

SEQ ID NO: 32994 - RNA, 11 nt, Homo sapiens
uacgugcaaua

SEQ ID NO: 32995 - RNA, 16 nt, Homo sapiens
gaaaauaaaagcacuu

SEQ ID NO: 32996 - RNA, 15 nt, Homo sapiens
uauccugugacuguc

SEQ ID NO: 32997 - RNA, 20 nt, Homo sapiens
gaacugcuggauucaaguga

SEQ ID NO: 32998 - RNA, 18 nt, Homo sapiens
uauauguguuuuucacau

SEQ ID NO: 32999 - RNA, 16 nt, Homo sapiens
acuccuaguaauuuaa

SEQ ID NO: 33000 - RNA, 19 nt, Homo sapiens
acuuuaacacagugucugg

SEQ ID NO: 33001 - RNA, 14 nt, Homo sapiens
acccaaaaggcaga

SEQ ID NO: 33002 - RNA, 15 nt, Homo sapiens
gcacuugggacaaaa

SEQ ID NO: 33003 - RNA, 12 nt, Homo sapiens
ccacuacugcua

SEQ ID NO: 33004 - RNA, 16 nt, Homo sapiens
ugcuaucgccaucaca

SEQ ID NO: 33005 - RNA, 15 nt, Homo sapiens
uaacuggcaguuuuc

SEQ ID NO: 33006 - RNA, 18 nt, Homo sapiens
gcaggauagagugggaca

SEQ ID NO: 33007 - RNA, 14 nt, Homo sapiens
auuuauugagcacc

SEQ ID NO: 33008 - RNA, 15 nt, Homo sapiens
gcaggcgugaccuga

SEQ ID NO: 33009 - RNA, 16 nt, Homo sapiens
acuaaaaauacaaaaa

SEQ ID NO: 33010 - RNA, 21 nt, Homo sapiens
uccuagcgcagccaugugauu

SEQ ID NO: 33011 - RNA, 18 nt, Homo sapiens
cgaaugguuccauucucu

SEQ ID NO: 33012 - RNA, 16 nt, Homo sapiens
cuuuuacauacugcug

SEQ ID NO: 33013 - RNA, 22 nt, Homo sapiens
acuccugguuccuaggugagca

SEQ ID NO: 33014 - RNA, 19 nt, Homo sapiens
uuaaaauuaucaauaucua

SEQ ID NO: 33015 - RNA, 13 nt, Homo sapiens
gcgugcaggcagc

SEQ ID NO: 33016 - RNA, 16 nt, Homo sapiens
caguggcgcaaucuua

SEQ ID NO: 33017 - RNA, 19 nt, Homo sapiens
cuacuugggaggcugaggc

SEQ ID NO: 33018 - RNA, 19 nt, Homo sapiens
agaauugcuugaacccagg

SEQ ID NO: 33019 - RNA, 21 nt, Homo sapiens
acaaaaaaagcauuguaacuu

SEQ ID NO: 33020 - RNA, 20 nt, Homo sapiens
aggagauggaaguugcagug

SEQ ID NO: 33021 - RNA, 18 nt, Homo sapiens
uuuccacuacugcuacca

SEQ ID NO: 33022 - RNA, 21 nt, Homo sapiens
uuauuaccucugauaccucaa

SEQ ID NO: 33023 - RNA, 14 nt, Homo sapiens
uugaaauagugucu

SEQ ID NO: 33024 - RNA, 17 nt, Homo sapiens
uaucuuguuuuuccacu

SEQ ID NO: 33025 - RNA, 19 nt, Homo sapiens
uccauugguuuaccuguga

SEQ ID NO: 33026 - RNA, 23 nt, Homo sapiens
agacauagaauuaacacaugauc

SEQ ID NO: 33027 - RNA, 20 nt, Homo sapiens
aaaacucauuuccuauguaa

SEQ ID NO: 33028 - RNA, 17 nt, Homo sapiens
gaauuuauucaauuccu

SEQ ID NO: 33029 - RNA, 12 nt, Homo sapiens
gggcgcgguggc

SEQ ID NO: 33030 - RNA, 11 nt, Homo sapiens
aaaggugacca

SEQ ID NO: 33031 - RNA, 18 nt, Homo sapiens
gcuugaaauagugucuga

SEQ ID NO: 33032 - RNA, 16 nt, Homo sapiens
uccugagaccagccaa

SEQ ID NO: 33033 - RNA, 20 nt, Homo sapiens
aggcuggagugcaguggcgc

SEQ ID NO: 33034 - RNA, 15 nt, Homo sapiens
aaauauaauaugcac

SEQ ID NO: 33035 - RNA, 18 nt, Homo sapiens
uucccugaccucccucua

SEQ ID NO: 33036 - RNA, 20 nt, Homo sapiens
aaucugagccagugcuuuaa

SEQ ID NO: 33037 - RNA, 15 nt, Homo sapiens
cacuugaugauacaa

SEQ ID NO: 33038 - RNA, 14 nt, Homo sapiens
aucuuacugaaggu

SEQ ID NO: 33039 - RNA, 20 nt, Homo sapiens
uaucuaauauauaugaauaa

SEQ ID NO: 33040 - RNA, 21 nt, Homo sapiens
acagcucugcauacucauuag

SEQ ID NO: 33041 - RNA, 18 nt, Homo sapiens
aaguuuaugcauacagua

SEQ ID NO: 33042 - RNA, 16 nt, Homo sapiens
uuuauuaccucugaua

SEQ ID NO: 33043 - RNA, 18 nt, Homo sapiens
acuuaaaaucuaauucaa

SEQ ID NO: 33044 - RNA, 16 nt, Homo sapiens
gucucaguccaugaag

SEQ ID NO: 33045 - RNA, 23 nt, Homo sapiens
aaacauuuaaauuauacaaucau

SEQ ID NO: 33046 - RNA, 15 nt, Homo sapiens
cuucauguacaucca

SEQ ID NO: 33047 - RNA, 22 nt, Homo sapiens
gagacaccaccacccuugccau

SEQ ID NO: 33048 - RNA, 15 nt, Homo sapiens
ucagggagcauuuau

SEQ ID NO: 33049 - RNA, 17 nt, Homo sapiens
uccaaauauuguugaca

SEQ ID NO: 33050 - RNA, 11 nt, Homo sapiens
uuacucugaag

SEQ ID NO: 33051 - RNA, 16 nt, Homo sapiens
caccagggccuggcug

SEQ ID NO: 33052 - RNA, 13 nt, Homo sapiens
auuauagaaugga

SEQ ID NO: 33053 - RNA, 22 nt, Homo sapiens
cuuuuggcuuguaaaguacaga

SEQ ID NO: 33054 - RNA, 18 nt, Homo sapiens
cucugggucucagugucc

SEQ ID NO: 33055 - RNA, 17 nt, Homo sapiens
auagaauuaacacauga

SEQ ID NO: 33056 - RNA, 12 nt, Homo sapiens
cggaacaguauc

SEQ ID NO: 33057 - RNA, 18 nt, Homo sapiens
agguacugagagugaaca

SEQ ID NO: 33058 - RNA, 12 nt, Homo sapiens
auuaauucaccu

SEQ ID NO: 33059 - RNA, 21 nt, Homo sapiens
uuaaacucagggagcauuuau

SEQ ID NO: 33060 - RNA, 17 nt, Homo sapiens
uaguuuaugauuccacc

SEQ ID NO: 33061 - RNA, 20 nt, Homo sapiens
cugcagaagacaguauggca

SEQ ID NO: 33062 - RNA, 14 nt, Homo sapiens
uguauagugcaugu

SEQ ID NO: 33063 - RNA, 19 nt, Homo sapiens
ggacuugggcgggacacag

SEQ ID NO: 33064 - RNA, 20 nt, Homo sapiens
uugacacuuaaaaaugguuu

SEQ ID NO: 33065 - RNA, 16 nt, Homo sapiens
aacaaaaaaagcauug

SEQ ID NO: 33066 - RNA, 21 nt, Homo sapiens
auccuaauaaaaaggugacca

SEQ ID NO: 33067 - RNA, 20 nt, Homo sapiens
ggccuccucucucaguuuuu

SEQ ID NO: 33068 - RNA, 22 nt, Homo sapiens
cuuagacccucaugcugccaau

SEQ ID NO: 33069 - RNA, 17 nt, Homo sapiens
aauauuuuuaugugcaa

SEQ ID NO: 33070 - RNA, 12 nt, Homo sapiens
uuucugcuuuaa

SEQ ID NO: 33071 - RNA, 19 nt, Homo sapiens
auauuuuuaugugcaauaa

SEQ ID NO: 33072 - RNA, 15 nt, Homo sapiens
aucuuguuuuuccac

SEQ ID NO: 33073 - RNA, 22 nt, Homo sapiens
agacagaaagcagaacagugau

SEQ ID NO: 33074 - RNA, 18 nt, Homo sapiens
caagugaaaaacauccag

SEQ ID NO: 33075 - RNA, 18 nt, Homo sapiens
gagaagaaugacuaugca

SEQ ID NO: 33076 - RNA, 23 nt, Homo sapiens
cuacucuguuccuucacauccug

SEQ ID NO: 33077 - RNA, 18 nt, Homo sapiens
uucugucuggacuuucca

SEQ ID NO: 33078 - RNA, 20 nt, Homo sapiens
agugaacaaauuuacagaga

SEQ ID NO: 33079 - RNA, 19 nt, Homo sapiens
uggaucucacaagcacuuu

SEQ ID NO: 33080 - RNA, 15 nt, Homo sapiens
auuaaggcuucucuu

SEQ ID NO: 33081 - RNA, 13 nt, Homo sapiens
caaccaaauggag

SEQ ID NO: 33082 - RNA, 12 nt, Homo sapiens
aaaagccaaaaa

SEQ ID NO: 33083 - RNA, 19 nt, Homo sapiens
uaagugaaauaagccagac

SEQ ID NO: 33084 - RNA, 20 nt, Homo sapiens
cagagaaaauaaaagcacuu

SEQ ID NO: 33085 - RNA, 17 nt, Homo sapiens
cuaaccagccuggucaa

SEQ ID NO: 33086 - RNA, 19 nt, Homo sapiens
caaauucuguuucuugaga

SEQ ID NO: 33087 - RNA, 16 nt, Homo sapiens
uguguggcauuuucac

SEQ ID NO: 33088 - RNA, 17 nt, Homo sapiens
uuuaucuugucucuggg

SEQ ID NO: 33089 - RNA, 20 nt, Homo sapiens
uucugcccugcuuuugcuag

SEQ ID NO: 33090 - RNA, 14 nt, Homo sapiens
ugacuggccugcug

SEQ ID NO: 33091 - RNA, 14 nt, Homo sapiens
uacaucuuucacau

SEQ ID NO: 33092 - RNA, 15 nt, Homo sapiens
auauccugugacugu

SEQ ID NO: 33093 - RNA, 23 nt, Homo sapiens
agagacagaaagcagaacaguga

SEQ ID NO: 33094 - RNA, 22 nt, Homo sapiens
augaaaacauagcaucucagga

SEQ ID NO: 33095 - RNA, 18 nt, Homo sapiens
cccuuuuacauacugcug

SEQ ID NO: 33096 - RNA, 21 nt, Homo sapiens
auugaaucccuuaaacucagg

SEQ ID NO: 33097 - RNA, 19 nt, Homo sapiens
auucuauuacgugcaauac

SEQ ID NO: 33098 - RNA, 20 nt, Homo sapiens
cagcauuuuacuacuuuaaa

SEQ ID NO: 33099 - RNA, 12 nt, Homo sapiens
auuuucuuccaa

SEQ ID NO: 33100 - RNA, 16 nt, Homo sapiens
gcaauaaaauguauuu

SEQ ID NO: 33101 - RNA, 14 nt, Homo sapiens
acagucacauucca

SEQ ID NO: 33102 - RNA, 13 nt, Homo sapiens
caacugugacugu

SEQ ID NO: 33103 - RNA, 22 nt, Homo sapiens
augcaaccuuuggaugcacuuu

SEQ ID NO: 33104 - RNA, 16 nt, Homo sapiens
uagagugggacaguuc

SEQ ID NO: 33105 - RNA, 21 nt, Homo sapiens
uaacugcauugagaacugcau

SEQ ID NO: 33106 - RNA, 17 nt, Homo sapiens
caguguccucaucugua

SEQ ID NO: 33107 - RNA, 14 nt, Homo sapiens
uaugugauguggca

SEQ ID NO: 33108 - RNA, 17 nt, Homo sapiens
gaaauagugucugauga

SEQ ID NO: 33109 - RNA, 16 nt, Homo sapiens
aaacauccagauacac

SEQ ID NO: 33110 - RNA, 19 nt, Homo sapiens
aucaauagaaggauguaca

SEQ ID NO: 33111 - RNA, 12 nt, Homo sapiens
auacagugucuu

SEQ ID NO: 33112 - RNA, 20 nt, Homo sapiens
uugaaauagugucugaugaa

SEQ ID NO: 33113 - RNA, 19 nt, Homo sapiens
cuggaucucacaagcacuu

SEQ ID NO: 33114 - RNA, 20 nt, Homo sapiens
cuacuugggaggcugaggca

SEQ ID NO: 33115 - RNA, 23 nt, Homo sapiens
aauauuguugacaacugugacug

SEQ ID NO: 33116 - RNA, 20 nt, Homo sapiens
aguuaggcuauucacaacca

SEQ ID NO: 33117 - RNA, 15 nt, Homo sapiens
agacucugucucagu

SEQ ID NO: 33118 - RNA, 21 nt, Homo sapiens
uuauagaauauuuauuaccuc

SEQ ID NO: 33119 - RNA, 17 nt, Homo sapiens
aaauucacaaguugugu

SEQ ID NO: 33120 - RNA, 24 nt, Homo sapiens
gccggagccccuugggcaggucac

SEQ ID NO: 33121 - RNA, 20 nt, Homo sapiens
ccuccaccuucuggguucaa

SEQ ID NO: 33122 - RNA, 18 nt, Homo sapiens
uacaguuagagauuuuua

SEQ ID NO: 33123 - RNA, 20 nt, Homo sapiens
aggcggguggaucacuugag

SEQ ID NO: 33124 - RNA, 18 nt, Homo sapiens
ucacuuuuuuucuuuucu

SEQ ID NO: 33125 - RNA, 14 nt, Homo sapiens
aaaugagcaaaagu

SEQ ID NO: 33126 - RNA, 20 nt, Homo sapiens
gugucuggcacuugggacaa

SEQ ID NO: 33127 - RNA, 19 nt, Homo sapiens
auuuuuacaguucucccaa

SEQ ID NO: 33128 - RNA, 13 nt, Homo sapiens
auagcaucucagg

SEQ ID NO: 33129 - RNA, 23 nt, Homo sapiens
caauaucuaauauauaugaauaa

SEQ ID NO: 33130 - RNA, 21 nt, Homo sapiens
uccugguuccuaggugagcag

SEQ ID NO: 33131 - RNA, 13 nt, Homo sapiens
aucauguauuuau

SEQ ID NO: 33132 - RNA, 16 nt, Homo sapiens
ccacgcccagcuaauu

SEQ ID NO: 33133 - RNA, 20 nt, Homo sapiens
ugccaaggcuggagugcagu

SEQ ID NO: 33134 - RNA, 19 nt, Homo sapiens
uaaaaggccugucccugca

SEQ ID NO: 33135 - RNA, 16 nt, Homo sapiens
gaagucuuccauagag

SEQ ID NO: 33136 - RNA, 18 nt, Homo sapiens
ccuuuggaugcacuuuau

SEQ ID NO: 33137 - RNA, 17 nt, Homo sapiens
aaacccggccugauuaa

SEQ ID NO: 33138 - RNA, 15 nt, Homo sapiens
cuaugugauuacaag

SEQ ID NO: 33139 - RNA, 11 nt, Homo sapiens
aggcauguaau

SEQ ID NO: 33140 - RNA, 20 nt, Homo sapiens
uuucacuuuuggcuuguaaa

SEQ ID NO: 33141 - RNA, 14 nt, Homo sapiens
gcagggacuugaac

SEQ ID NO: 33142 - RNA, 19 nt, Homo sapiens
ucccagcgagggacaccga

SEQ ID NO: 33143 - RNA, 19 nt, Homo sapiens
auguuucgcugauauaugu

SEQ ID NO: 33144 - RNA, 19 nt, Homo sapiens
ucccuucucuucacaguca

SEQ ID NO: 33145 - RNA, 16 nt, Homo sapiens
uuuuuaugugcaauaa

SEQ ID NO: 33146 - RNA, 23 nt, Homo sapiens
uagaguucugucuggacuuucca

SEQ ID NO: 33147 - RNA, 20 nt, Homo sapiens
gcuaagugaaauaagccaga

SEQ ID NO: 33148 - RNA, 14 nt, Homo sapiens
aucaccaaggcuga

SEQ ID NO: 33149 - RNA, 21 nt, Homo sapiens
uauuuacugagcuucucugug

SEQ ID NO: 33150 - RNA, 12 nt, Homo sapiens
agcgacagugag

SEQ ID NO: 33151 - RNA, 16 nt, Homo sapiens
cugacuaauuaggcaa

SEQ ID NO: 33152 - RNA, 17 nt, Homo sapiens
gcucugggauagcugac

SEQ ID NO: 33153 - RNA, 21 nt, Homo sapiens
uaagguauauaaauuuuccca

SEQ ID NO: 33154 - RNA, 11 nt, Homo sapiens
aaugugcaaua

SEQ ID NO: 33155 - RNA, 18 nt, Homo sapiens
aauuaauggaauauguaa

SEQ ID NO: 33156 - RNA, 22 nt, Homo sapiens
acaguauggcagcuuuccucaa

SEQ ID NO: 33157 - RNA, 13 nt, Homo sapiens
uccaaauucacaa

SEQ ID NO: 33158 - RNA, 21 nt, Homo sapiens
ucccaaagugcugggaauuac

SEQ ID NO: 33159 - RNA, 16 nt, Homo sapiens
aaagcagaacagugau

SEQ ID NO: 33160 - RNA, 16 nt, Homo sapiens
uuuaaucaccaaggcu

SEQ ID NO: 33161 - RNA, 16 nt, Homo sapiens
aucuaauauauaugaa

SEQ ID NO: 33162 - RNA, 23 nt, Homo sapiens
augcuuguauuuuacuuuuccau

SEQ ID NO: 33163 - RNA, 16 nt, Homo sapiens
auuuuaaguaauuuca

SEQ ID NO: 33164 - RNA, 20 nt, Homo sapiens
uaaugaaaaugaauaucuau

SEQ ID NO: 33165 - RNA, 20 nt, Homo sapiens
agguauauaaauuuucccaa

SEQ ID NO: 33166 - RNA, 22 nt, Homo sapiens
ugauucccuccugcuacucugu

SEQ ID NO: 33167 - RNA, 19 nt, Homo sapiens
cauuugcgaaugguuccau

SEQ ID NO: 33168 - RNA, 19 nt, Homo sapiens
ccagugagacagcucugca

SEQ ID NO: 33169 - RNA, 14 nt, Homo sapiens
aauuaacacaugau

SEQ ID NO: 33170 - RNA, 16 nt, Homo sapiens
gccuaucagcauuuua

SEQ ID NO: 33171 - RNA, 19 nt, Homo sapiens
caccacccuugccauggag

SEQ ID NO: 33172 - RNA, 16 nt, Homo sapiens
uaacugacaacuugaa

SEQ ID NO: 33173 - RNA, 22 nt, Homo sapiens
aaacaucaguuacucugaaggg

SEQ ID NO: 33174 - RNA, 17 nt, Homo sapiens
auccugugacugucuca

SEQ ID NO: 33175 - RNA, 21 nt, Homo sapiens
agaaugauuuuacggagauau

SEQ ID NO: 33176 - RNA, 19 nt, Homo sapiens
caggauagagugggacagu

SEQ ID NO: 33177 - RNA, 15 nt, Homo sapiens
caggcuccaaacugg

SEQ ID NO: 33178 - RNA, 18 nt, Homo sapiens
ccaaacuggagcuugaaa

SEQ ID NO: 33179 - RNA, 20 nt, Homo sapiens
cccucugggucucagugucc

SEQ ID NO: 33180 - RNA, 17 nt, Homo sapiens
caaggcuggagugcagu

SEQ ID NO: 33181 - RNA, 18 nt, Homo sapiens
acaaggcuuuaucucagg

SEQ ID NO: 33182 - RNA, 18 nt, Homo sapiens
gugagacagcucugcaua

SEQ ID NO: 33183 - RNA, 21 nt, Homo sapiens
auucuucuuugguggagauaa

SEQ ID NO: 33184 - RNA, 21 nt, Homo sapiens
gccuggaucucacaagcacuu

SEQ ID NO: 33185 - RNA, 14 nt, Homo sapiens
uccuauauccugug

SEQ ID NO: 33186 - RNA, 15 nt, Homo sapiens
gguggcgcgcaccug

SEQ ID NO: 33187 - RNA, 10 nt, Homo sapiens
auagugucuu

SEQ ID NO: 33188 - RNA, 20 nt, Homo sapiens
cucaggggccaacuaggcag

SEQ ID NO: 33189 - RNA, 12 nt, Homo sapiens
gauuucauucaa

SEQ ID NO: 33190 - RNA, 21 nt, Homo sapiens
gaggcauuugcagcugugcca

SEQ ID NO: 33191 - RNA, 19 nt, Homo sapiens
aaaauauuuuuaugugcaa

SEQ ID NO: 33192 - RNA, 21 nt, Homo sapiens
aggaauauuugcaagacauag

SEQ ID NO: 33193 - RNA, 17 nt, Homo sapiens
uauuugcaagacauaga

SEQ ID NO: 33194 - RNA, 16 nt, Homo sapiens
cauuguggucacagga

SEQ ID NO: 33195 - RNA, 21 nt, Homo sapiens
auuuuuuaugaaacauuacag

SEQ ID NO: 33196 - RNA, 18 nt, Homo sapiens
uguucacuuauugacuau

SEQ ID NO: 33197 - RNA, 22 nt, Homo sapiens
uacucugaagggcaucaugcau

SEQ ID NO: 33198 - RNA, 16 nt, Homo sapiens
cacaaccacucauuca

SEQ ID NO: 33199 - RNA, 16 nt, Homo sapiens
aaagcagggacuugaa

SEQ ID NO: 33200 - RNA, 14 nt, Homo sapiens
uggagacaccacca

SEQ ID NO: 33201 - RNA, 16 nt, Homo sapiens
agccagccuugcuccu

SEQ ID NO: 33202 - RNA, 14 nt, Homo sapiens
acccaaaguaucag

SEQ ID NO: 33203 - RNA, 15 nt, Homo sapiens
caggaaaaucugcac

SEQ ID NO: 33204 - RNA, 15 nt, Homo sapiens
aaauaaaagcacuua

SEQ ID NO: 33205 - RNA, 19 nt, Homo sapiens
gcaaccuuuggaugcacuu

SEQ ID NO: 33206 - RNA, 21 nt, Homo sapiens
gaacugcuggauucaagugau

SEQ ID NO: 33207 - RNA, 17 nt, Homo sapiens
ccaugugauuacccucu

SEQ ID NO: 33208 - RNA, 15 nt, Homo sapiens
gacuaauuaggcaag

SEQ ID NO: 33209 - RNA, 23 nt, Homo sapiens
ugaacaaauuuacagagacagaa

SEQ ID NO: 33210 - RNA, 12 nt, Homo sapiens
acuuugugaaaa

SEQ ID NO: 33211 - RNA, 15 nt, Homo sapiens
guugacaacugugac

SEQ ID NO: 33212 - RNA, 17 nt, Homo sapiens
acccaaauguucaucaa

SEQ ID NO: 33213 - RNA, 16 nt, Homo sapiens
uucacuuauugacuau

SEQ ID NO: 33214 - RNA, 18 nt, Homo sapiens
cauaagcaaagacuauga

SEQ ID NO: 33215 - RNA, 13 nt, Homo sapiens
uggauucaaguga

SEQ ID NO: 33216 - RNA, 14 nt, Homo sapiens
auggagugacuuag

SEQ ID NO: 33217 - RNA, 17 nt, Homo sapiens
cucuggcgacaguuuuc

SEQ ID NO: 33218 - RNA, 14 nt, Homo sapiens
cacccuugccaugg

SEQ ID NO: 33219 - RNA, 20 nt, Homo sapiens
agacaccaccacccuugcca

SEQ ID NO: 33220 - RNA, 15 nt, Homo sapiens
uuccuauguaacugc

SEQ ID NO: 33221 - RNA, 15 nt, Homo sapiens
ucucugccuugguau

SEQ ID NO: 33222 - RNA, 21 nt, Homo sapiens
ugaauaaaguguaaguucaca

SEQ ID NO: 33223 - RNA, 19 nt, Homo sapiens
auuuucaaaaucaaauucc

SEQ ID NO: 33224 - RNA, 13 nt, Homo sapiens
ccuuuuacauacu

SEQ ID NO: 33225 - RNA, 13 nt, Homo sapiens
auauauuuuuaga

SEQ ID NO: 33226 - RNA, 21 nt, Homo sapiens
cagagaaaauaaaagcacuua

SEQ ID NO: 33227 - RNA, 14 nt, Homo sapiens
gaauuuucuuccaa

SEQ ID NO: 33228 - RNA, 16 nt, Homo sapiens
ugagugccuguaauca

SEQ ID NO: 33229 - RNA, 21 nt, Homo sapiens
cagagacgggguuugccaugc

SEQ ID NO: 33230 - RNA, 15 nt, Homo sapiens
ucagacagaacuuga

SEQ ID NO: 33231 - RNA, 13 nt, Homo sapiens
aaugaauggcuaa

SEQ ID NO: 33232 - RNA, 15 nt, Homo sapiens
acaaugaacacuuau

SEQ ID NO: 33233 - RNA, 20 nt, Homo sapiens
cuagcaaauguuaugcauaa

SEQ ID NO: 33234 - RNA, 19 nt, Homo sapiens
ugaaaagauuaugaucuca

SEQ ID NO: 33235 - RNA, 20 nt, Homo sapiens
guguuggaaaaugugcaaua

SEQ ID NO: 33236 - RNA, 21 nt, Homo sapiens
guuauuuagggaacugcuuga

SEQ ID NO: 33237 - RNA, 16 nt, Homo sapiens
acagugucuggcacuu

SEQ ID NO: 33238 - RNA, 15 nt, Homo sapiens
uuaggcuauucacaa

SEQ ID NO: 33239 - RNA, 14 nt, Homo sapiens
caucuuggucacau

SEQ ID NO: 33240 - RNA, 19 nt, Homo sapiens
uaguuguaccgcaauguga

SEQ ID NO: 33241 - RNA, 20 nt, Homo sapiens
uccugugacugucucacuua

SEQ ID NO: 33242 - RNA, 10 nt, Homo sapiens
acgugcaaua

SEQ ID NO: 33243 - RNA, 14 nt, Homo sapiens
ugagcgacagugag

SEQ ID NO: 33244 - RNA, 10 nt, Homo sapiens
uaugugcaau

SEQ ID NO: 33245 - RNA, 12 nt, Homo sapiens
uagcaucucagg

SEQ ID NO: 33246 - RNA, 23 nt, Homo sapiens
aaauauuguugacaacugugacu

SEQ ID NO: 33247 - RNA, 15 nt, Homo sapiens
ucaucaaugaaugaa

SEQ ID NO: 33248 - RNA, 20 nt, Homo sapiens
uaagcaaaaugugauaugua

SEQ ID NO: 33249 - RNA, 15 nt, Homo sapiens
cuauauccugugacu

SEQ ID NO: 33250 - RNA, 17 nt, Homo sapiens
cuggcacuugggacaaa

SEQ ID NO: 33251 - RNA, 15 nt, Homo sapiens
uuccuggacaguuuu

SEQ ID NO: 33252 - RNA, 22 nt, Homo sapiens
augugucaggugacccugauga

SEQ ID NO: 33253 - RNA, 18 nt, Homo sapiens
uuaugaaacauuacaguu

SEQ ID NO: 33254 - RNA, 20 nt, Homo sapiens
ccagccugggugacagagca

SEQ ID NO: 33255 - RNA, 22 nt, Homo sapiens
gccuggaucucacaagcacuuu

SEQ ID NO: 33256 - RNA, 22 nt, Homo sapiens
acaguuuucugcuuuaauuuca

SEQ ID NO: 33257 - RNA, 21 nt, Homo sapiens
uaaaauauuuuuaugugcaau

SEQ ID NO: 33258 - RNA, 21 nt, Homo sapiens
cuugagaaaccuuauuguacc

SEQ ID NO: 33259 - RNA, 12 nt, Homo sapiens
aaauagugucug

SEQ ID NO: 33260 - RNA, 12 nt, Homo sapiens
ugacaacuguga

SEQ ID NO: 33261 - RNA, 16 nt, Homo sapiens
uuaugaaccuuuacau

SEQ ID NO: 33262 - RNA, 21 nt, Homo sapiens
guaaguuuaugcauacaguaa

SEQ ID NO: 33263 - RNA, 15 nt, Homo sapiens
cuugggcaggucaca

SEQ ID NO: 33264 - RNA, 19 nt, Homo sapiens
uuuguagccacuucacuuu

SEQ ID NO: 33265 - RNA, 17 nt, Homo sapiens
ucauguacauccauggu

SEQ ID NO: 33266 - RNA, 18 nt, Homo sapiens
ccaagaaugagaagaaug

SEQ ID NO: 33267 - RNA, 19 nt, Homo sapiens
ugacacuagcuaauaucaa

SEQ ID NO: 33268 - RNA, 20 nt, Homo sapiens
uucaccuuccagugucucgg

SEQ ID NO: 33269 - RNA, 13 nt, Homo sapiens
uccuucagccuga

SEQ ID NO: 33270 - RNA, 20 nt, Homo sapiens
aagaccuggucgucgucuug

SEQ ID NO: 33271 - RNA, 13 nt, Homo sapiens
aggucuccaaaau

SEQ ID NO: 33272 - RNA, 15 nt, Homo sapiens
gaaaaugugcaauau

SEQ ID NO: 33273 - RNA, 18 nt, Homo sapiens
uauuuaaagacaaagaca

SEQ ID NO: 33274 - RNA, 19 nt, Homo sapiens
cugcuggauucaagugauc

SEQ ID NO: 33275 - RNA, 15 nt, Homo sapiens
ucucacaagcacuuu

SEQ ID NO: 33276 - RNA, 18 nt, Homo sapiens
uucacuugaugauacaau

SEQ ID NO: 33277 - RNA, 16 nt, Homo sapiens
gacuuuggcaaaugag

SEQ ID NO: 33278 - RNA, 15 nt, Homo sapiens
aauagugucugauga

SEQ ID NO: 33279 - RNA, 19 nt, Homo sapiens
cugagcagucagaagaccu

SEQ ID NO: 33280 - RNA, 21 nt, Homo sapiens
gaugccccagggaccuuugua

SEQ ID NO: 33281 - RNA, 16 nt, Homo sapiens
ggaguggcauguauga

SEQ ID NO: 33282 - RNA, 17 nt, Homo sapiens
aguaacggaacaguauc

SEQ ID NO: 33283 - RNA, 23 nt, Homo sapiens
agaauuuucaaaaucaaauucca

SEQ ID NO: 33284 - RNA, 20 nt, Homo sapiens
aaccuccaccuucuggguuc

SEQ ID NO: 33285 - RNA, 19 nt, Homo sapiens
caugugauuacccucuggg

SEQ ID NO: 33286 - RNA, 22 nt, Homo sapiens
uguuagcaaaauggauaugaca

SEQ ID NO: 33287 - RNA, 21 nt, Homo sapiens
ucuuuuuagagaaauuugcca

SEQ ID NO: 33288 - RNA, 22 nt, Homo sapiens
aagagaauauuagcuuuacugu

SEQ ID NO: 33289 - RNA, 23 nt, Homo sapiens
gaugaaaacauagcaucucagga

SEQ ID NO: 33290 - RNA, 15 nt, Homo sapiens
aucagcuaaguugca

SEQ ID NO: 33291 - RNA, 14 nt, Homo sapiens
gagaaguuaagcaa

SEQ ID NO: 33292 - RNA, 21 nt, Homo sapiens
uaaauaaauguaucuuauuca

SEQ ID NO: 33293 - RNA, 16 nt, Homo sapiens
aguuaagcaacaucua

SEQ ID NO: 33294 - RNA, 16 nt, Homo sapiens
uuauuuuuacaguucu

SEQ ID NO: 33295 - RNA, 18 nt, Homo sapiens
ggaguuaggcuauucaca

SEQ ID NO: 33296 - RNA, 19 nt, Homo sapiens
cacuuuaacacagugucug

SEQ ID NO: 33297 - RNA, 22 nt, Homo sapiens
uguaaguuuaugcauacaguaa

SEQ ID NO: 33298 - RNA, 19 nt, Homo sapiens
gaagaguggguuucacaag

SEQ ID NO: 33299 - RNA, 10 nt, Homo sapiens
caguaacuga

SEQ ID NO: 33300 - RNA, 18 nt, Homo sapiens
auucuauuacgugcaaua

SEQ ID NO: 33301 - RNA, 21 nt, Homo sapiens
cuaagaagugaaaaucuacac

SEQ ID NO: 33302 - RNA, 20 nt, Homo sapiens
ggaauauuugcaagacauag

SEQ ID NO: 33303 - RNA, 17 nt, Homo sapiens
auuaccucugauaccuc

SEQ ID NO: 33304 - RNA, 14 nt, Homo sapiens
uggaacucaaggaa

SEQ ID NO: 33305 - RNA, 11 nt, Homo sapiens
ucacauuugcg

SEQ ID NO: 33306 - RNA, 17 nt, Homo sapiens
uguagauaaacucagaa

SEQ ID NO: 33307 - RNA, 14 nt, Homo sapiens
augccugcaaucug

SEQ ID NO: 33308 - RNA, 11 nt, Homo sapiens
aaaagacauaa

SEQ ID NO: 33309 - RNA, 23 nt, Homo sapiens
cuguaaucccagcacuuugggag

SEQ ID NO: 33310 - RNA, 22 nt, Homo sapiens
gagcaagacucugucucaaaaa

SEQ ID NO: 33311 - RNA, 19 nt, Homo sapiens
cuuuucaaaauuggacuua

SEQ ID NO: 33312 - RNA, 14 nt, Homo sapiens
gugaaauaagccag

SEQ ID NO: 33313 - RNA, 13 nt, Homo sapiens
ugacccacaagaa

SEQ ID NO: 33314 - RNA, 15 nt, Homo sapiens
aggcauucucugaag

SEQ ID NO: 33315 - RNA, 21 nt, Homo sapiens
ucuuaaacacuaaaaaggcau

SEQ ID NO: 33316 - RNA, 22 nt, Homo sapiens
gaaguacucauacauguuacaa

SEQ ID NO: 33317 - RNA, 13 nt, Homo sapiens
accgcaaugugac

SEQ ID NO: 33318 - RNA, 15 nt, Homo sapiens
auaagcuguuuuuau

SEQ ID NO: 33319 - RNA, 17 nt, Homo sapiens
uucuauuacgugcaaua

SEQ ID NO: 33320 - RNA, 14 nt, Homo sapiens
agacucugucucag

SEQ ID NO: 33321 - RNA, 23 nt, Homo sapiens
aauaaaagauuguauagugcaug

SEQ ID NO: 33322 - RNA, 13 nt, Homo sapiens
acccuugccaugg

SEQ ID NO: 33323 - RNA, 15 nt, Homo sapiens
aagugcugggaauua

SEQ ID NO: 33324 - RNA, 23 nt, Homo sapiens
gauuacaaggcuuuaucucaggg

SEQ ID NO: 33325 - RNA, 21 nt, Homo sapiens
uguauauuuuauaucaauuua

SEQ ID NO: 33326 - RNA, 20 nt, Homo sapiens
uaaguugcaccaacuuugaa

SEQ ID NO: 33327 - RNA, 16 nt, Homo sapiens
aggugacccugaugaa

SEQ ID NO: 33328 - RNA, 18 nt, Homo sapiens
aacuugaaugugucaggu

SEQ ID NO: 33329 - RNA, 14 nt, Homo sapiens
uggccagaagucaa

SEQ ID NO: 33330 - RNA, 13 nt, Homo sapiens
agauuaugaucuc

SEQ ID NO: 33331 - RNA, 13 nt, Homo sapiens
aauggcaugucag

SEQ ID NO: 33332 - RNA, 14 nt, Homo sapiens
aaugaaguacucau

SEQ ID NO: 33333 - RNA, 14 nt, Homo sapiens
aagucuuccauaga

SEQ ID NO: 33334 - RNA, 17 nt, Homo sapiens
ccaaacagaacuaugga

SEQ ID NO: 33335 - RNA, 16 nt, Homo sapiens
agccacuucacuuuuu

SEQ ID NO: 33336 - RNA, 22 nt, Homo sapiens
uucugcagauaaacaguaguga

SEQ ID NO: 33337 - RNA, 18 nt, Homo sapiens
uaagugaagugauacuau

SEQ ID NO: 33338 - RNA, 12 nt, Homo sapiens
auauuagcuuua

SEQ ID NO: 33339 - RNA, 16 nt, Homo sapiens
aggagauuucaugccu

SEQ ID NO: 33340 - RNA, 17 nt, Homo sapiens
ggaagaaauuccaggaa

SEQ ID NO: 33341 - RNA, 22 nt, Homo sapiens
aucuuuuauacagugucuuaca

SEQ ID NO: 33342 - RNA, 12 nt, Homo sapiens
gggaguggcgcg

SEQ ID NO: 33343 - RNA, 17 nt, Homo sapiens
cauuuccaaauucacaa

SEQ ID NO: 33344 - RNA, 22 nt, Homo sapiens
aagaguggguuucacaagugaa

SEQ ID NO: 33345 - RNA, 13 nt, Homo sapiens
augauuucauuca

SEQ ID NO: 33346 - RNA, 14 nt, Homo sapiens
aaucccagcacuuu

SEQ ID NO: 33347 - RNA, 21 nt, Homo sapiens
gagaugggagaaucacuugaa

SEQ ID NO: 33348 - RNA, 17 nt, Homo sapiens
uaaaaaggcauguaauu

SEQ ID NO: 33349 - RNA, 15 nt, Homo sapiens
gcagauaaacaguag

SEQ ID NO: 33350 - RNA, 21 nt, Homo sapiens
ggccuguugaagaugcuugua

SEQ ID NO: 33351 - RNA, 19 nt, Homo sapiens
acauccagauagguuacca

SEQ ID NO: 33352 - RNA, 15 nt, Homo sapiens
aaucagaucauuuca

SEQ ID NO: 33353 - RNA, 18 nt, Homo sapiens
gcagcuuauucacaagac

SEQ ID NO: 33354 - RNA, 19 nt, Homo sapiens
acauaagcaaagacuauga

SEQ ID NO: 33355 - RNA, 17 nt, Homo sapiens
auuuccaaauucacaag

SEQ ID NO: 33356 - RNA, 16 nt, Homo sapiens
cuaaccagccugguca

SEQ ID NO: 33357 - RNA, 21 nt, Homo sapiens
cuguaaucccagcuacuuggg

SEQ ID NO: 33358 - RNA, 16 nt, Homo sapiens
auuuuucucuaacuca

SEQ ID NO: 33359 - RNA, 14 nt, Homo sapiens
accagccaaccugg

SEQ ID NO: 33360 - RNA, 23 nt, Homo sapiens
agacaccaccacccuugccaugg

SEQ ID NO: 33361 - RNA, 23 nt, Homo sapiens
auuuuuccccaaaaagaauggga

SEQ ID NO: 33362 - RNA, 23 nt, Homo sapiens
gaaagcuugcccuggugccucac

SEQ ID NO: 33363 - RNA, 13 nt, Homo sapiens
caaaucucuauua

SEQ ID NO: 33364 - RNA, 14 nt, Homo sapiens
ugaugaauguuaaa

SEQ ID NO: 33365 - RNA, 16 nt, Homo sapiens
ccauagagacuuugug

SEQ ID NO: 33366 - RNA, 19 nt, Homo sapiens
cuucuggguucaagcgauu

SEQ ID NO: 33367 - RNA, 19 nt, Homo sapiens
augauuccaccuacaugag

SEQ ID NO: 33368 - RNA, 17 nt, Homo sapiens
uuuaaugggcacagggu

SEQ ID NO: 33369 - RNA, 20 nt, Homo sapiens
gccauaauuacuaugucauu

SEQ ID NO: 33370 - RNA, 17 nt, Homo sapiens
ugaggaauauuugcaag

SEQ ID NO: 33371 - RNA, 18 nt, Homo sapiens
ucaguccaugaagaugua

SEQ ID NO: 33372 - RNA, 12 nt, Homo sapiens
aaagccaaaaac

SEQ ID NO: 33373 - RNA, 17 nt, Homo sapiens
cugggucucaguguccu

SEQ ID NO: 33374 - RNA, 12 nt, Homo sapiens
gaaaaugugcaa

SEQ ID NO: 33375 - RNA, 16 nt, Homo sapiens
auaugacacaucucug

SEQ ID NO: 33376 - RNA, 20 nt, Homo sapiens
ucuugggaauuuucuuccaa

SEQ ID NO: 33377 - RNA, 14 nt, Homo sapiens
auccugcaauucca

SEQ ID NO: 33378 - RNA, 13 nt, Homo sapiens
gcuuuaauuucau

SEQ ID NO: 33379 - RNA, 21 nt, Homo sapiens
agcaagugaauuuuucucuaa

SEQ ID NO: 33380 - RNA, 22 nt, Homo sapiens
gucucaguguccucaucuguaa

SEQ ID NO: 33381 - RNA, 18 nt, Homo sapiens
aaaagcaguaacugacaa

SEQ ID NO: 33382 - RNA, 16 nt, Homo sapiens
aauagugucugaugaa

SEQ ID NO: 33383 - RNA, 13 nt, Homo sapiens
aauuccucuggga

SEQ ID NO: 33384 - RNA, 14 nt, Homo sapiens
ccaaggcuggagug

SEQ ID NO: 33385 - RNA, 23 nt, Homo sapiens
aguuguaccgcaaugugacuuaa

SEQ ID NO: 33386 - RNA, 23 nt, Homo sapiens
cauugagaacugcauauguuucg

SEQ ID NO: 33387 - RNA, 23 nt, Homo sapiens
cauacaauuauuuuuacaguucu

SEQ ID NO: 33388 - RNA, 21 nt, Homo sapiens
uuauaagugaagugauacuau

SEQ ID NO: 33389 - RNA, 21 nt, Homo sapiens
aacacuaaaaaggcauguaau

SEQ ID NO: 33390 - RNA, 16 nt, Homo sapiens
aagcaaaaugugauau

SEQ ID NO: 33391 - RNA, 22 nt, Homo sapiens
auaagugaagugauacuaucca

SEQ ID NO: 33392 - RNA, 19 nt, Homo sapiens
ugcuuguuagcaaaaugga

SEQ ID NO: 33393 - RNA, 22 nt, Homo sapiens
gaccaauaaccaugcccaagaa

SEQ ID NO: 33394 - RNA, 21 nt, Homo sapiens
cccccauuguggucacaggaa

SEQ ID NO: 33395 - RNA, 22 nt, Homo sapiens
cauaaauuagaggucuccaaaa

SEQ ID NO: 33396 - RNA, 14 nt, Homo sapiens
gcuggagugcagug

SEQ ID NO: 33397 - RNA, 22 nt, Homo sapiens
ugaaaaaaaauuuuauaguguc

SEQ ID NO: 33398 - RNA, 20 nt, Homo sapiens
aaacuuuaugcuaagugaaa

SEQ ID NO: 33399 - RNA, 17 nt, Homo sapiens
uguaaguuuaugcauac

SEQ ID NO: 33400 - RNA, 15 nt, Homo sapiens
cacgcccagcuaauu

SEQ ID NO: 33401 - RNA, 12 nt, Homo sapiens
uuacgugcaaua

SEQ ID NO: 33402 - RNA, 14 nt, Homo sapiens
ugcauuugcacuau

SEQ ID NO: 33403 - RNA, 22 nt, Homo sapiens
gaaagcuguggccagcuuguua

SEQ ID NO: 33404 - RNA, 23 nt, Homo sapiens
gaaauuugccaauuuacuuuguu

SEQ ID NO: 33405 - RNA, 16 nt, Homo sapiens
cagagaaaagacauaa

SEQ ID NO: 33406 - RNA, 16 nt, Homo sapiens
gaaucccuuaaacuca

SEQ ID NO: 33407 - RNA, 19 nt, Homo sapiens
gaaguacucauacauguua

SEQ ID NO: 33408 - RNA, 15 nt, Homo sapiens
caauuccucugggaa

SEQ ID NO: 33409 - RNA, 17 nt, Homo sapiens
gaguucugucuggacuu

SEQ ID NO: 33410 - RNA, 22 nt, Homo sapiens
caaauaaguauuuauaauagca

SEQ ID NO: 33411 - RNA, 16 nt, Homo sapiens
caucuguaaaauggag

SEQ ID NO: 33412 - RNA, 15 nt, Homo sapiens
uauuuauugcugaau

SEQ ID NO: 33413 - RNA, 19 nt, Homo sapiens
ugcuggccaggcuggucuc

SEQ ID NO: 33414 - RNA, 17 nt, Homo sapiens
aucaaauuccagaauga

SEQ ID NO: 33415 - RNA, 21 nt, Homo sapiens
agaaaccuuauuguaccucuc

SEQ ID NO: 33416 - RNA, 19 nt, Homo sapiens
cagccugggugacagagca

SEQ ID NO: 33417 - RNA, 14 nt, Homo sapiens
auuuauuaccucug

SEQ ID NO: 33418 - RNA, 18 nt, Homo sapiens
cuuggucacauacaauua

SEQ ID NO: 33419 - RNA, 21 nt, Homo sapiens
agauguagauaaacucagaaa

SEQ ID NO: 33420 - RNA, 18 nt, Homo sapiens
uggaauauguaaauagaa

SEQ ID NO: 33421 - RNA, 12 nt, Homo sapiens
caucuuucacau

SEQ ID NO: 33422 - RNA, 14 nt, Homo sapiens
gguacauauuucuu

SEQ ID NO: 33423 - RNA, 20 nt, Homo sapiens
acaugauccugcaauuccac

SEQ ID NO: 33424 - RNA, 17 nt, Homo sapiens
uaacuagaauuuauuca

SEQ ID NO: 33425 - RNA, 11 nt, Homo sapiens
aagucuuccau

SEQ ID NO: 33426 - RNA, 18 nt, Homo sapiens
ucuaacucagaaacauca

SEQ ID NO: 33427 - RNA, 18 nt, Homo sapiens
gacaaagacaaauucugu

SEQ ID NO: 33428 - RNA, 16 nt, Homo sapiens
gcacuuuaaacauuua

SEQ ID NO: 33429 - RNA, 17 nt, Homo sapiens
aaacauagcaucucagg

SEQ ID NO: 33430 - RNA, 20 nt, Homo sapiens
aaauauuuuuaugugcaaua

SEQ ID NO: 33431 - RNA, 12 nt, Homo sapiens
ccaaacuggagc

SEQ ID NO: 33432 - RNA, 12 nt, Homo sapiens
caaauuccagaa

SEQ ID NO: 33433 - RNA, 15 nt, Homo sapiens
ccucuguugccaagg

SEQ ID NO: 33434 - RNA, 20 nt, Homo sapiens
augguggcgcgcaccuguaa

SEQ ID NO: 33435 - RNA, 12 nt, Homo sapiens
accagggacuga

SEQ ID NO: 33436 - RNA, 13 nt, Homo sapiens
uccuggacaguuu

SEQ ID NO: 33437 - RNA, 18 nt, Homo sapiens
uggaucucacaagcacuu

SEQ ID NO: 33438 - RNA, 17 nt, Homo sapiens
aggauagagugggacag

SEQ ID NO: 33439 - RNA, 20 nt, Homo sapiens
guacuccagccugggugaca

SEQ ID NO: 33440 - RNA, 22 nt, Homo sapiens
gaagaguggguuucacaaguga

SEQ ID NO: 33441 - RNA, 21 nt, Homo sapiens
aacucaaggaaaucuguguca

SEQ ID NO: 33442 - RNA, 15 nt, Homo sapiens
aagcagaacagugau

SEQ ID NO: 33443 - RNA, 23 nt, Homo sapiens
uuuuuccuuccuuaucacugaca

SEQ ID NO: 33444 - RNA, 17 nt, Homo sapiens
agaggagaaacuggaac

SEQ ID NO: 33445 - RNA, 19 nt, Homo sapiens
ugacuaauuaggcaaggcu

SEQ ID NO: 33446 - RNA, 23 nt, Homo sapiens
cagaagaaauucugcaagcuuuu

SEQ ID NO: 33447 - RNA, 16 nt, Homo sapiens
gaggcugaggcaagag

SEQ ID NO: 33448 - RNA, 18 nt, Homo sapiens
uucaaacuaauagaauua

SEQ ID NO: 33449 - RNA, 19 nt, Homo sapiens
uguagauaaacucagaaau

SEQ ID NO: 33450 - RNA, 13 nt, Homo sapiens
cauuugcacuauu

SEQ ID NO: 33451 - RNA, 16 nt, Homo sapiens
uggaacucaaggaaau

SEQ ID NO: 33452 - RNA, 14 nt, Homo sapiens
aaucagaucauuuc

SEQ ID NO: 33453 - RNA, 15 nt, Homo sapiens
cugagcgacagugag

SEQ ID NO: 33454 - RNA, 16 nt, Homo sapiens
cuauuacgugcaauac

SEQ ID NO: 33455 - RNA, 14 nt, Homo sapiens
guggcgacucuaua

SEQ ID NO: 33456 - RNA, 14 nt, Homo sapiens
gauagagugggaca

SEQ ID NO: 33457 - RNA, 15 nt, Homo sapiens
aagcccaauauuaua

SEQ ID NO: 33458 - RNA, 19 nt, Homo sapiens
auuuguuaaaauuaucaau

SEQ ID NO: 33459 - RNA, 19 nt, Homo sapiens
augggagaaucacuugaac

SEQ ID NO: 33460 - RNA, 23 nt, Homo sapiens
cuggcugggaguggcauguauga

SEQ ID NO: 33461 - RNA, 20 nt, Homo sapiens
agugaaaaucuacacuccag

SEQ ID NO: 33462 - RNA, 16 nt, Homo sapiens
cuuccucagcuguaga

SEQ ID NO: 33463 - RNA, 16 nt, Homo sapiens
uauugagcaccugcag

SEQ ID NO: 33464 - RNA, 16 nt, Homo sapiens
ucccugcagacaugag

SEQ ID NO: 33465 - RNA, 17 nt, Homo sapiens
uggguuguguguuuauu

SEQ ID NO: 33466 - RNA, 20 nt, Homo sapiens
aaaaccaaauuuguauuuaa

SEQ ID NO: 33467 - RNA, 23 nt, Homo sapiens
gaagagaauauuagcuuuacugu

SEQ ID NO: 33468 - RNA, 16 nt, Homo sapiens
aggcuuuaucucaggg

SEQ ID NO: 33469 - RNA, 15 nt, Homo sapiens
uguguucaguacaau

SEQ ID NO: 33470 - RNA, 15 nt, Homo sapiens
aucagcauuuuacua

SEQ ID NO: 33471 - RNA, 20 nt, Homo sapiens
uaaaauuaucaauaucuaau

SEQ ID NO: 33472 - RNA, 19 nt, Homo sapiens
gguuugccaugcuggccag

SEQ ID NO: 33473 - RNA, 19 nt, Homo sapiens
uggaaauaaaagauuguau

SEQ ID NO: 33474 - RNA, 15 nt, Homo sapiens
agagaaaagacauaa

SEQ ID NO: 33475 - RNA, 22 nt, Homo sapiens
agacuaugaggaauauuugcaa

SEQ ID NO: 33476 - RNA, 20 nt, Homo sapiens
cucuacuaaaaauacaaaaa

SEQ ID NO: 33477 - RNA, 16 nt, Homo sapiens
uuguuggauaaaucag

SEQ ID NO: 33478 - RNA, 20 nt, Homo sapiens
augaaaagauuaugaucuca

SEQ ID NO: 33479 - RNA, 14 nt, Homo sapiens
auuugcaagacaua

SEQ ID NO: 33480 - RNA, 14 nt, Homo sapiens
uuacagagacagaa

SEQ ID NO: 33481 - RNA, 11 nt, Homo sapiens
auuugagacag

SEQ ID NO: 33482 - RNA, 23 nt, Homo sapiens
guucuucccuuuuacauacugcu

SEQ ID NO: 33483 - RNA, 19 nt, Homo sapiens
accagagauaauaugagaa

SEQ ID NO: 33484 - RNA, 14 nt, Homo sapiens
uuuaaguaauuuca

SEQ ID NO: 33485 - RNA, 20 nt, Homo sapiens
cacagcugaacuuguugaga

SEQ ID NO: 33486 - RNA, 18 nt, Homo sapiens
cucaaaacuucagacaua

SEQ ID NO: 33487 - RNA, 13 nt, Homo sapiens
gagcgacagugag

SEQ ID NO: 33488 - RNA, 20 nt, Homo sapiens
uaagcacuuuaacacagugu

SEQ ID NO: 33489 - RNA, 23 nt, Homo sapiens
agccaaccugggggcuuuaggga

SEQ ID NO: 33490 - RNA, 16 nt, Homo sapiens
auaauacuagucuuau

SEQ ID NO: 33491 - RNA, 23 nt, Homo sapiens
aguuuuccuucucaucugugauu

SEQ ID NO: 33492 - RNA, 19 nt, Homo sapiens
aggagaaacuggaacucuc

SEQ ID NO: 33493 - RNA, 16 nt, Homo sapiens
auguguggcauuuuca

SEQ ID NO: 33494 - RNA, 20 nt, Homo sapiens
ggcgacaguuuuccuucuca

SEQ ID NO: 33495 - RNA, 13 nt, Homo sapiens
ccuuaaacucagg

SEQ ID NO: 33496 - RNA, 12 nt, Homo sapiens
gcagaacaguga

SEQ ID NO: 33497 - RNA, 17 nt, Homo sapiens
agauagguuaccaguaa

SEQ ID NO: 33498 - RNA, 22 nt, Homo sapiens
agaccuggucgucgucuugacu

SEQ ID NO: 33499 - RNA, 13 nt, Homo sapiens
cccaaaaggcaga

SEQ ID NO: 33500 - RNA, 18 nt, Homo sapiens
agcaacccaaauguucau

SEQ ID NO: 33501 - RNA, 18 nt, Homo sapiens
gguauauaaauuuuccca

SEQ ID NO: 33502 - RNA, 22 nt, Homo sapiens
ugacaacugugacuguacccaa

SEQ ID NO: 33503 - RNA, 17 nt, Homo sapiens
cuuguuagcaaaaugga

SEQ ID NO: 33504 - RNA, 17 nt, Homo sapiens
auuuauuaccucugaua

SEQ ID NO: 33505 - RNA, 17 nt, Homo sapiens
gaaugagaagaaugacu

SEQ ID NO: 33506 - RNA, 21 nt, Homo sapiens
cuuccaaacagaacuauggaa

SEQ ID NO: 33507 - RNA, 18 nt, Homo sapiens
cagaaagcagaacaguga

SEQ ID NO: 33508 - RNA, 20 nt, Homo sapiens
uuacugagcuucucugugaa

SEQ ID NO: 33509 - RNA, 15 nt, Homo sapiens
uauuacgugcaauac

SEQ ID NO: 33510 - RNA, 21 nt, Homo sapiens
gauaucaugccccuguacucc

SEQ ID NO: 33511 - RNA, 19 nt, Homo sapiens
aagcuguuuccauagggug

SEQ ID NO: 33512 - RNA, 18 nt, Homo sapiens
acaucaguuacucugaag

SEQ ID NO: 33513 - RNA, 14 nt, Homo sapiens
uguguuuuucacau

SEQ ID NO: 33514 - RNA, 21 nt, Homo sapiens
uaagcacuuuaacacaguguc

SEQ ID NO: 33515 - RNA, 21 nt, Homo sapiens
gcagugagcugauaucaugcc

SEQ ID NO: 33516 - RNA, 18 nt, Homo sapiens
ugauuccaccuacaugag

SEQ ID NO: 33517 - RNA, 18 nt, Homo sapiens
cugccaauauccuaauaa

SEQ ID NO: 33518 - RNA, 14 nt, Homo sapiens
cucacaagcacuuu

SEQ ID NO: 33519 - RNA, 15 nt, Homo sapiens
uccuuaucacugaca

SEQ ID NO: 33520 - RNA, 19 nt, Homo sapiens
aacaucaguuacucugaag

SEQ ID NO: 33521 - RNA, 15 nt, Homo sapiens
cuuaacucauugcaa

SEQ ID NO: 33522 - RNA, 20 nt, Homo sapiens
uuagacccucaugcugccaa

SEQ ID NO: 33523 - RNA, 15 nt, Homo sapiens
gacuuaaaaucuaau

SEQ ID NO: 33524 - RNA, 15 nt, Homo sapiens
aaacauguucacuua

SEQ ID NO: 33525 - RNA, 21 nt, Homo sapiens
auugaaaggcauucucugaag

SEQ ID NO: 33526 - RNA, 20 nt, Homo sapiens
ucucuacuaaaaauacaaaa

SEQ ID NO: 33527 - RNA, 15 nt, Homo sapiens
cauccagauagguua

SEQ ID NO: 33528 - RNA, 14 nt, Homo sapiens
aucaguuacucuga

SEQ ID NO: 33529 - RNA, 15 nt, Homo sapiens
ggaggcugaggcaag

SEQ ID NO: 33530 - RNA, 19 nt, Homo sapiens
auccagauagguuaccagu

SEQ ID NO: 33531 - RNA, 20 nt, Homo sapiens
accaaacccggccugauuaa

SEQ ID NO: 33532 - RNA, 13 nt, Homo sapiens
aguacagacuuuu

SEQ ID NO: 33533 - RNA, 12 nt, Homo sapiens
aaaugugcaaua

SEQ ID NO: 33534 - RNA, 15 nt, Homo sapiens
agcagaacagugauu

SEQ ID NO: 33535 - RNA, 17 nt, Homo sapiens
aucagcauuuuacuacu

SEQ ID NO: 33536 - RNA, 23 nt, Homo sapiens
auauuuuuuaugaaacauuacag

SEQ ID NO: 33537 - RNA, 22 nt, Homo sapiens
uucuauuacgugcaauacuuca

SEQ ID NO: 33538 - RNA, 19 nt, Homo sapiens
uacaaggcuuuaucucagg

SEQ ID NO: 33539 - RNA, 17 nt, Homo sapiens
aaaguucugcagauaaa

SEQ ID NO: 33540 - RNA, 18 nt, Homo sapiens
accaccacccuugccaug

SEQ ID NO: 33541 - RNA, 12 nt, Homo sapiens
cacuugaacccg

SEQ ID NO: 33542 - RNA, 17 nt, Homo sapiens
gaacgguaaauuucugu

SEQ ID NO: 33543 - RNA, 20 nt, Homo sapiens
gggaggcagagguugcagug

SEQ ID NO: 33544 - RNA, 21 nt, Homo sapiens
cugcaaucugagccagugcuu

SEQ ID NO: 33545 - RNA, 19 nt, Homo sapiens
gaagaaauuccaggaaaau

SEQ ID NO: 33546 - RNA, 17 nt, Homo sapiens
gcacuuuaacacagugu

SEQ ID NO: 33547 - RNA, 20 nt, Homo sapiens
ccuggaucucacaagcacuu

SEQ ID NO: 33548 - RNA, 22 nt, Homo sapiens
agcauauguuuuuguaaguuua

SEQ ID NO: 33549 - RNA, 23 nt, Homo sapiens
uccucuuucaaagguagccauca

SEQ ID NO: 33550 - RNA, 21 nt, Homo sapiens
cagccuggucaacauggugaa

SEQ ID NO: 33551 - RNA, 23 nt, Homo sapiens
gaauaguguuggaaaaugugcaa

SEQ ID NO: 33552 - RNA, 17 nt, Homo sapiens
cuguaaaauggagacac

SEQ ID NO: 33553 - RNA, 18 nt, Homo sapiens
cuuuaacacagugucugg

SEQ ID NO: 33554 - RNA, 13 nt, Homo sapiens
aauauuguugaca

SEQ ID NO: 33555 - RNA, 20 nt, Homo sapiens
caacuauauuaucaugcaaa

SEQ ID NO: 33556 - RNA, 13 nt, Homo sapiens
uagaauuuauuca

SEQ ID NO: 33557 - RNA, 21 nt, Homo sapiens
aauucuauuacgugcaauacu

SEQ ID NO: 33558 - RNA, 9 nt, Homo sapiens
uaugugcaa

SEQ ID NO: 33559 - RNA, 21 nt, Homo sapiens
gugaccugacagcccaagggu

SEQ ID NO: 33560 - RNA, 19 nt, Homo sapiens
ugcuggcuuaaaauguaau

SEQ ID NO: 33561 - RNA, 22 nt, Homo sapiens
ugcagauaaacaguagugauag

SEQ ID NO: 33562 - RNA, 14 nt, Homo sapiens
uuuaugauuccacc

SEQ ID NO: 33563 - RNA, 14 nt, Homo sapiens
uaguguacaugaaa

SEQ ID NO: 33564 - RNA, 16 nt, Homo sapiens
ccaaauuuguauuuaa

SEQ ID NO: 33565 - RNA, 14 nt, Homo sapiens
ucacauccuguguu

SEQ ID NO: 33566 - RNA, 21 nt, Homo sapiens
ucaauucuauuacgugcaaua

SEQ ID NO: 33567 - RNA, 21 nt, Homo sapiens
aaaaaugguuuaaauggucaa

SEQ ID NO: 33568 - RNA, 23 nt, Homo sapiens
uacauuguuugucugucuucaua

SEQ ID NO: 33569 - RNA, 16 nt, Homo sapiens
ccuucauguacaucca

SEQ ID NO: 33570 - RNA, 19 nt, Homo sapiens
cugucuggacuuuccagag

SEQ ID NO: 33571 - RNA, 20 nt, Homo sapiens
ggcuggagugcaguggcgca

SEQ ID NO: 33572 - RNA, 14 nt, Homo sapiens
gaaagaggaaugaa

SEQ ID NO: 33573 - RNA, 15 nt, Homo sapiens
gacuggccugcugga

SEQ ID NO: 33574 - RNA, 15 nt, Homo sapiens
ucacagguugaccaa

SEQ ID NO: 33575 - RNA, 15 nt, Homo sapiens
cauaaagucagugcc

SEQ ID NO: 33576 - RNA, 15 nt, Homo sapiens
agccaccaaacccgg

SEQ ID NO: 33577 - RNA, 14 nt, Homo sapiens
ccaaguuuauauac

SEQ ID NO: 33578 - RNA, 16 nt, Homo sapiens
cagagaccaguauucc

SEQ ID NO: 33579 - RNA, 14 nt, Homo sapiens
ggugacagagcaag

SEQ ID NO: 33580 - RNA, 14 nt, Homo sapiens
ugauuuuacaauug

SEQ ID NO: 33581 - RNA, 20 nt, Homo sapiens
acgugacuggccugcuggau

SEQ ID NO: 33582 - RNA, 17 nt, Homo sapiens
augaggaauauuugcaa

SEQ ID NO: 33583 - RNA, 20 nt, Homo sapiens
ucuggacuuuccagagacca

SEQ ID NO: 33584 - RNA, 20 nt, Homo sapiens
uaaaauauuuuuaugugcaa

SEQ ID NO: 33585 - RNA, 17 nt, Homo sapiens
auuugccaauuuacuuu

SEQ ID NO: 33586 - RNA, 20 nt, Homo sapiens
auauauguguuuuucacauu

SEQ ID NO: 33587 - RNA, 19 nt, Homo sapiens
gucagugcccaacuguuau

SEQ ID NO: 33588 - RNA, 19 nt, Homo sapiens
acaagacccaaaaggcaga

SEQ ID NO: 33589 - RNA, 14 nt, Homo sapiens
gaaauagugucuga

SEQ ID NO: 33590 - RNA, 22 nt, Homo sapiens
aagcuuccauuccaagccugac

SEQ ID NO: 33591 - RNA, 23 nt, Homo sapiens
cuccuggcuggggccuguugaag

SEQ ID NO: 33592 - RNA, 18 nt, Homo sapiens
ccaaaaucggaucugggg

SEQ ID NO: 33593 - RNA, 19 nt, Homo sapiens
guaauuuuaaguaauuuca

SEQ ID NO: 33594 - RNA, 19 nt, Homo sapiens
ugaaagcagggacuugaac

SEQ ID NO: 33595 - RNA, 23 nt, Homo sapiens
gaggauguguggcauuuucacuu

SEQ ID NO: 33596 - RNA, 18 nt, Homo sapiens
gcccccauuguggucaca

SEQ ID NO: 33597 - RNA, 13 nt, Homo sapiens
uuuauugccauga

SEQ ID NO: 33598 - RNA, 16 nt, Homo sapiens
uuguaccgcaauguga

SEQ ID NO: 33599 - RNA, 20 nt, Homo sapiens
cucaguguccucaucuguaa

SEQ ID NO: 33600 - RNA, 17 nt, Homo sapiens
gacgggguuugccaugc

SEQ ID NO: 33601 - RNA, 20 nt, Homo sapiens
acuaauagaauuaauggaau

SEQ ID NO: 33602 - RNA, 16 nt, Homo sapiens
cacugcagaagacagu

SEQ ID NO: 33603 - RNA, 20 nt, Homo sapiens
gccauggagguuaagcacuu

SEQ ID NO: 33604 - RNA, 18 nt, Homo sapiens
uguuggaaaaugugcaau

SEQ ID NO: 33605 - RNA, 10 nt, Homo sapiens
cauacugcug

SEQ ID NO: 33606 - RNA, 23 nt, Homo sapiens
gccagugcuuuaauggcauguca

SEQ ID NO: 33607 - RNA, 20 nt, Homo sapiens
cugucccugcagacaugaga

SEQ ID NO: 33608 - RNA, 19 nt, Homo sapiens
guugaaaaaguucugcaga

SEQ ID NO: 33609 - RNA, 13 nt, Homo sapiens
uuuacuuccucag

SEQ ID NO: 33610 - RNA, 11 nt, Homo sapiens
aaaagcacuua

SEQ ID NO: 33611 - RNA, 14 nt, Homo sapiens
cugcuuuaauuuca

SEQ ID NO: 33612 - RNA, 15 nt, Homo sapiens
uugacaacugugacu

SEQ ID NO: 33613 - RNA, 17 nt, Homo sapiens
aagugaaauaagccaga

SEQ ID NO: 33614 - RNA, 17 nt, Homo sapiens
aagugauacuauccagu

SEQ ID NO: 33615 - RNA, 12 nt, Homo sapiens
cacaagcacuuu

SEQ ID NO: 33616 - RNA, 15 nt, Homo sapiens
caaccacucauucaa

SEQ ID NO: 33617 - RNA, 13 nt, Homo sapiens
ggagaaacuggaa

SEQ ID NO: 33618 - RNA, 23 nt, Homo sapiens
gagcuugaaauagugucugauga

SEQ ID NO: 33619 - RNA, 14 nt, Homo sapiens
augaaugaauggcu

SEQ ID NO: 33620 - RNA, 20 nt, Homo sapiens
auugugccccugcacuccag

SEQ ID NO: 33621 - RNA, 19 nt, Homo sapiens
aaguauccuucagccugaa

SEQ ID NO: 33622 - RNA, 15 nt, Homo sapiens
guggcauuuucacuu

SEQ ID NO: 33623 - RNA, 18 nt, Homo sapiens
cucauuccccaaccacuu

SEQ ID NO: 33624 - RNA, 14 nt, Homo sapiens
uauuacgugcaaua

SEQ ID NO: 33625 - RNA, 17 nt, Homo sapiens
auggagguuaagcacuu

SEQ ID NO: 33626 - RNA, 12 nt, Homo sapiens
ucccuuuuacau

SEQ ID NO: 33627 - RNA, 16 nt, Homo sapiens
guaaucccagcacuuu

SEQ ID NO: 33628 - RNA, 14 nt, Homo sapiens
cuuauuguaccucu

SEQ ID NO: 33629 - RNA, 15 nt, Homo sapiens
ccuuuuuguuauuag

SEQ ID NO: 33630 - RNA, 11 nt, Homo sapiens
gcaacccaaau

SEQ ID NO: 33631 - RNA, 17 nt, Homo sapiens
auugaaaggcauucucu

SEQ ID NO: 33632 - RNA, 21 nt, Homo sapiens
aaagaaaaucaggcuggccaa

SEQ ID NO: 33633 - RNA, 17 nt, Homo sapiens
acaaaccucaagccagc

SEQ ID NO: 33634 - RNA, 15 nt, Homo sapiens
uuggaaaaugugcaa

SEQ ID NO: 33635 - RNA, 14 nt, Homo sapiens
uaaaguacagacuu

SEQ ID NO: 33636 - RNA, 19 nt, Homo sapiens
auuacgugcaauacuucaa

SEQ ID NO: 33637 - RNA, 16 nt, Homo sapiens
cuggagugcaguggcg

SEQ ID NO: 33638 - RNA, 18 nt, Homo sapiens
ugauccugcaauuccacu

SEQ ID NO: 33639 - RNA, 14 nt, Homo sapiens
acugucucacuuaa

SEQ ID NO: 33640 - RNA, 13 nt, Homo sapiens
cuaauuaggcaag

SEQ ID NO: 33641 - RNA, 22 nt, Homo sapiens
uuaauaaaccauuuuuacuugg

SEQ ID NO: 33642 - RNA, 20 nt, Homo sapiens
gauacaaugaacacuuauaa

SEQ ID NO: 33643 - RNA, 22 nt, Homo sapiens
cuguacuccagccugggugaca

SEQ ID NO: 33644 - RNA, 16 nt, Homo sapiens
uauuacgugcaauacu

SEQ ID NO: 33645 - RNA, 21 nt, Homo sapiens
aucauuucaaaacucauuucc

SEQ ID NO: 33646 - RNA, 19 nt, Homo sapiens
gccauaauuacuaugucau

SEQ ID NO: 33647 - RNA, 13 nt, Homo sapiens
agauaaacaguag

SEQ ID NO: 33648 - RNA, 21 nt, Homo sapiens
gacagaaagcagaacagugau

SEQ ID NO: 33649 - RNA, 19 nt, Homo sapiens
guuuuuccacuacugcuac

SEQ ID NO: 33650 - RNA, 21 nt, Homo sapiens
cucuauagacucuaggacaua

SEQ ID NO: 33651 - RNA, 20 nt, Homo sapiens
aaagauuucuugaguuuugu

SEQ ID NO: 33652 - RNA, 18 nt, Homo sapiens
ugccuugguauagcauau

SEQ ID NO: 33653 - RNA, 19 nt, Homo sapiens
cuuccaaacagaacuaugg

SEQ ID NO: 33654 - RNA, 20 nt, Homo sapiens
acauuacaguuagagauuuu

SEQ ID NO: 33655 - RNA, 14 nt, Homo sapiens
auuacaucuuucac

SEQ ID NO: 33656 - RNA, 16 nt, Homo sapiens
agaaucacuugaaccc

SEQ ID NO: 33657 - RNA, 16 nt, Homo sapiens
ucucuaacucagaaac

SEQ ID NO: 33658 - RNA, 18 nt, Homo sapiens
ucugauuuuccuggacag

SEQ ID NO: 33659 - RNA, 15 nt, Homo sapiens
gacaacugugacugu

SEQ ID NO: 33660 - RNA, 16 nt, Homo sapiens
ucuauuacgugcaaua

SEQ ID NO: 33661 - RNA, 18 nt, Homo sapiens
auuuuauuacaucuuuca

SEQ ID NO: 33662 - RNA, 16 nt, Homo sapiens
guggcauuuucacuuu

SEQ ID NO: 33663 - RNA, 20 nt, Homo sapiens
uauuuguacaccaauauuca

SEQ ID NO: 33664 - RNA, 11 nt, Homo sapiens
auuugcacuau

SEQ ID NO: 33665 - RNA, 15 nt, Homo sapiens
uagccacuucacuuu

SEQ ID NO: 33666 - RNA, 22 nt, Homo sapiens
aaaggccugucccugcagacau

SEQ ID NO: 33667 - RNA, 15 nt, Homo sapiens
auguuucgcugauau

SEQ ID NO: 33668 - RNA, 16 nt, Homo sapiens
cacgccuguaauccca

SEQ ID NO: 33669 - RNA, 22 nt, Homo sapiens
cugaugaaaacauagcaucuca

SEQ ID NO: 33670 - RNA, 20 nt, Homo sapiens
gccuguugaagaugcuugua

SEQ ID NO: 33671 - RNA, 21 nt, Homo sapiens
augaaaacauagcaucucagg

SEQ ID NO: 33672 - RNA, 19 nt, Homo sapiens
caagcuuuucaaaauugga

SEQ ID NO: 33673 - RNA, 14 nt, Homo sapiens
aacagaagcuucca

SEQ ID NO: 33674 - RNA, 15 nt, Homo sapiens
uccuauguaacugca

SEQ ID NO: 33675 - RNA, 20 nt, Homo sapiens
gccaaggcuggagugcagug

SEQ ID NO: 33676 - RNA, 17 nt, Homo sapiens
aacuggcaguuuuccau

SEQ ID NO: 33677 - RNA, 14 nt, Homo sapiens
gcaccaacuuugaa

SEQ ID NO: 33678 - RNA, 21 nt, Homo sapiens
ugaaaacauagcaucucagga

SEQ ID NO: 33679 - RNA, 19 nt, Homo sapiens
ggcuaagcaaaaugugaua

SEQ ID NO: 33680 - RNA, 12 nt, Homo sapiens
cacagugucugg

SEQ ID NO: 33681 - RNA, 22 nt, Homo sapiens
accagccuggucaacaugguga

SEQ ID NO: 33682 - RNA, 13 nt, Homo sapiens
ucauguacaucca

SEQ ID NO: 33683 - RNA, 12 nt, Homo sapiens
auagaauuaaca

SEQ ID NO: 33684 - RNA, 20 nt, Homo sapiens
gcccaucuccgucucccaaa

SEQ ID NO: 33685 - RNA, 19 nt, Homo sapiens
uguaaucccagcuacuugg

SEQ ID NO: 33686 - RNA, 13 nt, Homo sapiens
uuugcaagacaua

SEQ ID NO: 33687 - RNA, 21 nt, Homo sapiens
aaccucauuccccaaccacuu

SEQ ID NO: 33688 - RNA, 17 nt, Homo sapiens
ggcuuuagggaccugcu

SEQ ID NO: 33689 - RNA, 14 nt, Homo sapiens
gucucccaaagugc

SEQ ID NO: 33690 - RNA, 20 nt, Homo sapiens
gagcuguuuucccugaccuc

SEQ ID NO: 33691 - RNA, 23 nt, Homo sapiens
aaagcagggacuugaacccauau

SEQ ID NO: 33692 - RNA, 14 nt, Homo sapiens
uuaguguacaugaa

SEQ ID NO: 33693 - RNA, 17 nt, Homo sapiens
auuacaggcgugagcca

SEQ ID NO: 33694 - RNA, 14 nt, Homo sapiens
uaugacacaucucu

SEQ ID NO: 33695 - RNA, 23 nt, Homo sapiens
acagaagagugacauguuuacaa

SEQ ID NO: 33696 - RNA, 19 nt, Homo sapiens
gcacuuuaacacagugucu

SEQ ID NO: 33697 - RNA, 17 nt, Homo sapiens
uagaauauuuauuaccu

SEQ ID NO: 33698 - RNA, 13 nt, Homo sapiens
cuggagcucugcc

SEQ ID NO: 33699 - RNA, 18 nt, Homo sapiens
caguuccugagaccagcc

SEQ ID NO: 33700 - RNA, 15 nt, Homo sapiens
gaccugacagcccaa

SEQ ID NO: 33701 - RNA, 19 nt, Homo sapiens
aauauauuuuuagacucau

SEQ ID NO: 33702 - RNA, 17 nt, Homo sapiens
ugccccugcacuccagc

SEQ ID NO: 33703 - RNA, 19 nt, Homo sapiens
agguauuuauugagcaccu

SEQ ID NO: 33704 - RNA, 21 nt, Homo sapiens
auuacaaggcuuuaucucagg

SEQ ID NO: 33705 - RNA, 14 nt, Homo sapiens
aauugacacuuaaa

SEQ ID NO: 33706 - RNA, 18 nt, Homo sapiens
uaugacgugacuggccug

SEQ ID NO: 33707 - RNA, 10 nt, Homo sapiens
uuugccaugc

SEQ ID NO: 33708 - RNA, 15 nt, Homo sapiens
uuaaagaauuuucaa

SEQ ID NO: 33709 - RNA, 15 nt, Homo sapiens
aaugguuccauucuc

SEQ ID NO: 33710 - RNA, 15 nt, Homo sapiens
cuuaugaaacuaaga

SEQ ID NO: 33711 - RNA, 18 nt, Homo sapiens
acuugaugauacaaugaa

SEQ ID NO: 33712 - RNA, 19 nt, Homo sapiens
aagguauuuuaaucaccaa

SEQ ID NO: 33713 - RNA, 21 nt, Homo sapiens
uauuuauaauuccuauauccu

SEQ ID NO: 33714 - RNA, 13 nt, Homo sapiens
cacugcauacaau

SEQ ID NO: 33715 - RNA, 14 nt, Homo sapiens
ugccuguaaucaca

SEQ ID NO: 33716 - RNA, 20 nt, Homo sapiens
caacuugaauaauacaccag

SEQ ID NO: 33717 - RNA, 19 nt, Homo sapiens
ucacaaccacucauucaaa

SEQ ID NO: 33718 - RNA, 21 nt, Homo sapiens
gcgcaaucuuaacucauugca

SEQ ID NO: 33719 - RNA, 15 nt, Homo sapiens
gaggagaaacuggaa

SEQ ID NO: 33720 - RNA, 21 nt, Homo sapiens
ccaaaagguauuuuaaucacc

SEQ ID NO: 33721 - RNA, 19 nt, Homo sapiens
uggagcuugaaauaguguc

SEQ ID NO: 33722 - RNA, 13 nt, Homo sapiens
cgaagucuuccau

SEQ ID NO: 33723 - RNA, 20 nt, Homo sapiens
uaaucccagcuacuugggag

SEQ ID NO: 33724 - RNA, 20 nt, Homo sapiens
caagcuuuucaaaauuggac

SEQ ID NO: 33725 - RNA, 18 nt, Homo sapiens
agcaagacucugucucaa

SEQ ID NO: 33726 - RNA, 13 nt, Homo sapiens
ccaagccugacca

SEQ ID NO: 33727 - RNA, 17 nt, Homo sapiens
aaaauuaucaauaucua

SEQ ID NO: 33728 - RNA, 11 nt, Homo sapiens
caagaaugaga

SEQ ID NO: 33729 - RNA, 17 nt, Homo sapiens
cagucacauuccaagcc

SEQ ID NO: 33730 - RNA, 19 nt, Homo sapiens
ugauacuuuuuucauuauu

SEQ ID NO: 33731 - RNA, 14 nt, Homo sapiens
acuaauuaggcaag

SEQ ID NO: 33732 - RNA, 23 nt, Homo sapiens
aaaaggccugucccugcagacau

SEQ ID NO: 33733 - RNA, 11 nt, Homo sapiens
augugcaauaa

SEQ ID NO: 33734 - RNA, 19 nt, Homo sapiens
uaaacacuaaaaaggcaug

SEQ ID NO: 33735 - RNA, 16 nt, Homo sapiens
aacagaagcuuccauu

SEQ ID NO: 33736 - RNA, 14 nt, Homo sapiens
ccucaugcugccaa

SEQ ID NO: 33737 - RNA, 21 nt, Homo sapiens
uaauuuaucuugucucugggc

SEQ ID NO: 33738 - RNA, 21 nt, Homo sapiens
aagcaaagacuaugaggaaua

SEQ ID NO: 33739 - RNA, 23 nt, Homo sapiens
agagcccuucaugcauuugcacu

SEQ ID NO: 33740 - RNA, 17 nt, Homo sapiens
gagguacugagagugaa

SEQ ID NO: 33741 - RNA, 16 nt, Homo sapiens
augcauuugcacuauu

SEQ ID NO: 33742 - RNA, 20 nt, Homo sapiens
gaaaaucuacacuccaguga

SEQ ID NO: 33743 - RNA, 16 nt, Homo sapiens
uauuacaucuuucaca

SEQ ID NO: 33744 - RNA, 19 nt, Homo sapiens
uagcgcagccaugugauua

SEQ ID NO: 33745 - RNA, 16 nt, Homo sapiens
ucaugcaaaugcugua

SEQ ID NO: 33746 - RNA, 18 nt, Homo sapiens
guuugaaaauaugccugc

SEQ ID NO: 33747 - RNA, 22 nt, Homo sapiens
gaccuuuguagccacuucacuu

SEQ ID NO: 33748 - RNA, 16 nt, Homo sapiens
cacugugggcuuuuau

SEQ ID NO: 33749 - RNA, 21 nt, Homo sapiens
ucuagcaaauguuaugcauaa

SEQ ID NO: 33750 - RNA, 21 nt, Homo sapiens
ccugucccugcagacaugaga

SEQ ID NO: 33751 - RNA, 21 nt, Homo sapiens
uugccaaggcuggagugcagu

SEQ ID NO: 33752 - RNA, 13 nt, Homo sapiens
cuuugaagucuga

SEQ ID NO: 33753 - RNA, 17 nt, Homo sapiens
auccaaagcugaauaca

SEQ ID NO: 33754 - RNA, 15 nt, Homo sapiens
guuuuuaagcuguuu

SEQ ID NO: 33755 - RNA, 15 nt, Homo sapiens
uggaaaaugugcaau

SEQ ID NO: 33756 - RNA, 12 nt, Homo sapiens
uuaugugcaaua

SEQ ID NO: 33757 - RNA, 20 nt, Homo sapiens
caaaugagccggagccccuu

SEQ ID NO: 33758 - RNA, 21 nt, Homo sapiens
uguaaugaaaaugaauaucua

SEQ ID NO: 33759 - RNA, 15 nt, Homo sapiens
cuuugaagucugauu

SEQ ID NO: 33760 - RNA, 16 nt, Homo sapiens
uuccuauguaacugca

SEQ ID NO: 33761 - RNA, 13 nt, Homo sapiens
aaucugcacugug

SEQ ID NO: 33762 - RNA, 21 nt, Homo sapiens
accuguugauagcaagugaau

SEQ ID NO: 33763 - RNA, 17 nt, Homo sapiens
cuaaaucaauucuauua

SEQ ID NO: 33764 - RNA, 15 nt, Homo sapiens
uggaacucaaggaaa

SEQ ID NO: 33765 - RNA, 11 nt, Homo sapiens
uaaaagcacuu

SEQ ID NO: 33766 - RNA, 18 nt, Homo sapiens
auaaacaguagugauagu

SEQ ID NO: 33767 - RNA, 12 nt, Homo sapiens
gaagucuuccau

SEQ ID NO: 33768 - RNA, 14 nt, Homo sapiens
gcagcuuauucaca

SEQ ID NO: 33769 - RNA, 16 nt, Homo sapiens
uacauuuccaaauuca

SEQ ID NO: 33770 - RNA, 10 nt, Homo sapiens
ggggcuuccu

SEQ ID NO: 33771 - RNA, 20 nt, Homo sapiens
cugaagggcaucaugcaucu

SEQ ID NO: 33772 - RNA, 19 nt, Homo sapiens
caaucuuaacucauugcaa

SEQ ID NO: 33773 - RNA, 16 nt, Homo sapiens
caaauguuaugcauaa

SEQ ID NO: 33774 - RNA, 21 nt, Homo sapiens
gagccaccaaacccggccuga

SEQ ID NO: 33775 - RNA, 21 nt, Homo sapiens
acgccuguaaucccagcacuu

SEQ ID NO: 33776 - RNA, 22 nt, Homo sapiens
gaauaguguuggaaaaugugca

SEQ ID NO: 33777 - RNA, 17 nt, Homo sapiens
agacagcaggucucaug

SEQ ID NO: 33778 - RNA, 17 nt, Homo sapiens
ccuuuuacauacugcug

SEQ ID NO: 33779 - RNA, 17 nt, Homo sapiens
agaaucagaucauuuca

SEQ ID NO: 33780 - RNA, 19 nt, Homo sapiens
cacuaaaaaggcauguaau

SEQ ID NO: 33781 - RNA, 19 nt, Homo sapiens
ccaaguuuauauacaauua

SEQ ID NO: 33782 - RNA, 18 nt, Homo sapiens
acuaaauugacacuuaaa

SEQ ID NO: 33783 - RNA, 13 nt, Homo sapiens
gacaacugugacu

SEQ ID NO: 33784 - RNA, 18 nt, Homo sapiens
cagccaggcggcuggaau

SEQ ID NO: 33785 - RNA, 14 nt, Homo sapiens
agaacuugaaugug

SEQ ID NO: 33786 - RNA, 20 nt, Homo sapiens
cugcauugagaacugcauau

SEQ ID NO: 33787 - RNA, 15 nt, Homo sapiens
gaauuaacacaugau

SEQ ID NO: 33788 - RNA, 13 nt, Homo sapiens
aaucugagccagu

SEQ ID NO: 33789 - RNA, 12 nt, Homo sapiens
acauacaauuau

SEQ ID NO: 33790 - RNA, 14 nt, Homo sapiens
acugcauacaaucu

SEQ ID NO: 33791 - RNA, 15 nt, Homo sapiens
ggcuuuaucucaggg

SEQ ID NO: 33792 - RNA, 23 nt, Homo sapiens
uuacuauuuauugcugaaugacu

SEQ ID NO: 33793 - RNA, 19 nt, Homo sapiens
ugagugccuguaaucacag

SEQ ID NO: 33794 - RNA, 17 nt, Homo sapiens
auaugccugcaaucuga

SEQ ID NO: 33795 - RNA, 21 nt, Homo sapiens
gauagguuaccaguaacggaa

SEQ ID NO: 33796 - RNA, 22 nt, Homo sapiens
aauaguguuggaaaaugugcaa

SEQ ID NO: 33797 - RNA, 16 nt, Homo sapiens
uaaaguacagacuuuu

SEQ ID NO: 33798 - RNA, 17 nt, Homo sapiens
caagugaaaaacaucca

SEQ ID NO: 33799 - RNA, 13 nt, Homo sapiens
aagcaacaucuag

SEQ ID NO: 33800 - RNA, 20 nt, Homo sapiens
gaugggagaaucacuugaac

SEQ ID NO: 33801 - RNA, 24 nt, Homo sapiens
ggacuugggcgggacacaggcucc

SEQ ID NO: 33802 - RNA, 19 nt, Homo sapiens
cagugagccgagauugugc

SEQ ID NO: 33803 - RNA, 17 nt, Homo sapiens
uguagccacuucacuuu

SEQ ID NO: 33804 - RNA, 16 nt, Homo sapiens
uggcacuugggacaaa

SEQ ID NO: 33805 - RNA, 14 nt, Homo sapiens
ggccaacuaggcag

SEQ ID NO: 33806 - RNA, 18 nt, Homo sapiens
augcuuguauuuuacuuu

SEQ ID NO: 33807 - RNA, 23 nt, Homo sapiens
aauauguaaauagaaacguguau

SEQ ID NO: 33808 - RNA, 22 nt, Homo sapiens
auguucacuuauugacuauuau

SEQ ID NO: 33809 - RNA, 19 nt, Homo sapiens
aauucuauuacgugcaaua

SEQ ID NO: 33810 - RNA, 14 nt, Homo sapiens
auauaauaugcaca

SEQ ID NO: 33811 - RNA, 15 nt, Homo sapiens
cuauguggcuguauc

SEQ ID NO: 33812 - RNA, 13 nt, Homo sapiens
uacauacugcugu

SEQ ID NO: 33813 - RNA, 14 nt, Homo sapiens
ucauacauguuaca

SEQ ID NO: 33814 - RNA, 20 nt, Homo sapiens
uccuagcgcagccaugugau

SEQ ID NO: 33815 - RNA, 12 nt, Homo sapiens
gugucaggugac

SEQ ID NO: 33816 - RNA, 22 nt, Homo sapiens
uacaauuauuuuuacaguucuc

SEQ ID NO: 33817 - RNA, 14 nt, Homo sapiens
agauaauaugagaa

SEQ ID NO: 33818 - RNA, 16 nt, Homo sapiens
guauuuuacuuuucca

SEQ ID NO: 33819 - RNA, 14 nt, Homo sapiens
uguaauugcuuguu

SEQ ID NO: 33820 - RNA, 13 nt, Homo sapiens
cauagagacuuug

SEQ ID NO: 33821 - RNA, 15 nt, Homo sapiens
cucaguguccucauc

SEQ ID NO: 33822 - RNA, 17 nt, Homo sapiens
acagagaaaagacauaa

SEQ ID NO: 33823 - RNA, 22 nt, Homo sapiens
aauauuguugacaacugugacu

SEQ ID NO: 33824 - RNA, 22 nt, Homo sapiens
cugcauacucauuaggauggcu

SEQ ID NO: 33825 - RNA, 15 nt, Homo sapiens
uaaugaaaaugaaua

SEQ ID NO: 33826 - RNA, 21 nt, Homo sapiens
uuucaccuguuuuuaagcugu

SEQ ID NO: 33827 - RNA, 15 nt, Homo sapiens
gagguuaagcacuuu

SEQ ID NO: 33828 - RNA, 22 nt, Homo sapiens
ccgcaaugugacuuaaugccac

SEQ ID NO: 33829 - RNA, 23 nt, Homo sapiens
aucuuguuuuuccacuacugcua

SEQ ID NO: 33830 - RNA, 16 nt, Homo sapiens
caccaaacccggccug

SEQ ID NO: 33831 - RNA, 17 nt, Homo sapiens
ugacaacugugacugua

SEQ ID NO: 33832 - RNA, 15 nt, Homo sapiens
ugacugucucacuua

SEQ ID NO: 33833 - RNA, 20 nt, Homo sapiens
uagagugggacaguuccuga

SEQ ID NO: 33834 - RNA, 14 nt, Homo sapiens
agaaucacuugaac

SEQ ID NO: 33835 - RNA, 13 nt, Homo sapiens
ucuucacagucac

SEQ ID NO: 33836 - RNA, 20 nt, Homo sapiens
uaaauguaucuuauucacau

SEQ ID NO: 33837 - RNA, 17 nt, Homo sapiens
aaauagugucugaugaa

SEQ ID NO: 33838 - RNA, 19 nt, Homo sapiens
accuguuuuuaagcuguuu

SEQ ID NO: 33839 - RNA, 13 nt, Homo sapiens
ccuguaaucacag

SEQ ID NO: 33840 - RNA, 18 nt, Homo sapiens
caaccuccaccuucuggg

SEQ ID NO: 33841 - RNA, 21 nt, Homo sapiens
agaguucugucuggacuuucc

SEQ ID NO: 33842 - RNA, 16 nt, Homo sapiens
ucccaaagugcuggga

SEQ ID NO: 33843 - RNA, 23 nt, Homo sapiens
acucauugcaaccuccaccuucu

SEQ ID NO: 33844 - RNA, 15 nt, Homo sapiens
ucuuggucacauaca

SEQ ID NO: 33845 - RNA, 15 nt, Homo sapiens
aagagaucaagccau

SEQ ID NO: 33846 - RNA, 17 nt, Homo sapiens
auagcagcuuauucaca

SEQ ID NO: 33847 - RNA, 23 nt, Homo sapiens
uaaugaaaaugaauaucuauuaa

SEQ ID NO: 33848 - RNA, 12 nt, Homo sapiens
acagaacuugaa

SEQ ID NO: 33849 - RNA, 17 nt, Homo sapiens
acuuaaaaucuaauuca

SEQ ID NO: 33850 - RNA, 13 nt, Homo sapiens
uccacuacugcua

SEQ ID NO: 33851 - RNA, 14 nt, Homo sapiens
acaugauccugcaa

SEQ ID NO: 33852 - RNA, 23 nt, Homo sapiens
uguauuuuauuacaucuuucaca

SEQ ID NO: 33853 - RNA, 21 nt, Homo sapiens
caauucuauuacgugcaauac

SEQ ID NO: 33854 - RNA, 13 nt, Homo sapiens
guuuucugacuaa

SEQ ID NO: 33855 - RNA, 16 nt, Homo sapiens
uccaagccucaugucc

SEQ ID NO: 33856 - RNA, 13 nt, Homo sapiens
auaaaagcacuua

SEQ ID NO: 33857 - RNA, 18 nt, Homo sapiens
aguugauuuuacaauuga

SEQ ID NO: 33858 - RNA, 21 nt, Homo sapiens
cuucuuggucucagugucaau

SEQ ID NO: 33859 - RNA, 12 nt, Homo sapiens
uggucucagugu

SEQ ID NO: 33860 - RNA, 20 nt, Homo sapiens
gauugugccccugcacucca

SEQ ID NO: 33861 - RNA, 13 nt, Homo sapiens
cuugaugauacaa

SEQ ID NO: 33862 - RNA, 21 nt, Homo sapiens
uucuucuuggucucaguguca

SEQ ID NO: 33863 - RNA, 13 nt, Homo sapiens
uuuaugcauacag

SEQ ID NO: 33864 - RNA, 14 nt, Homo sapiens
ugcauacaguaauu

SEQ ID NO: 33865 - RNA, 15 nt, Homo sapiens
gcaaugugacuuaau

SEQ ID NO: 33866 - RNA, 19 nt, Homo sapiens
gcuguuuuuauauauguga

SEQ ID NO: 33867 - RNA, 16 nt, Homo sapiens
uaggaacgguaaauuu

SEQ ID NO: 33868 - RNA, 12 nt, Homo sapiens
uacaucuuucac

SEQ ID NO: 33869 - RNA, 15 nt, Homo sapiens
caucuguaaaaugga

SEQ ID NO: 33870 - RNA, 17 nt, Homo sapiens
aauugaaaggcauucuc

SEQ ID NO: 33871 - RNA, 18 nt, Homo sapiens
auucccuuuugcugccuc

SEQ ID NO: 33872 - RNA, 19 nt, Homo sapiens
auuacaaggcuuuaucuca

SEQ ID NO: 33873 - RNA, 14 nt, Homo sapiens
uaacugcauugaga

SEQ ID NO: 33874 - RNA, 22 nt, Homo sapiens
gagaaaccuuauuguaccucuc

SEQ ID NO: 33875 - RNA, 23 nt, Homo sapiens
uauaagugaagugauacuaucca

SEQ ID NO: 33876 - RNA, 23 nt, Homo sapiens
cuauuauagaauggaacucaagg

SEQ ID NO: 33877 - RNA, 19 nt, Homo sapiens
caacccaaauguucaucaa

SEQ ID NO: 33878 - RNA, 15 nt, Homo sapiens
aguguaaguucacaa

SEQ ID NO: 33879 - RNA, 13 nt, Homo sapiens
agaaucacuugaa

SEQ ID NO: 33880 - RNA, 16 nt, Homo sapiens
uuauuacaucuuucac

SEQ ID NO: 33881 - RNA, 22 nt, Homo sapiens
gugugaccacugcagaagacag

SEQ ID NO: 33882 - RNA, 22 nt, Homo sapiens
cuuuaauuucaugaaaagauua

SEQ ID NO: 33883 - RNA, 18 nt, Homo sapiens
aggugagcaggugaugcc

SEQ ID NO: 33884 - RNA, 21 nt, Homo sapiens
acaauuauuuuuacaguucuc

SEQ ID NO: 33885 - RNA, 17 nt, Homo sapiens
gaaaauaaaagcacuua

SEQ ID NO: 33886 - RNA, 20 nt, Homo sapiens
cgcgcaccuguaaucccagc

SEQ ID NO: 33887 - RNA, 19 nt, Homo sapiens
acaaauuuacagagacaga

SEQ ID NO: 33888 - RNA, 15 nt, Homo sapiens
gcauuuucacuuuug

SEQ ID NO: 33889 - RNA, 23 nt, Homo sapiens
gagaaaccagggagccccuuuga

SEQ ID NO: 33890 - RNA, 13 nt, Homo sapiens
agaauggaacuca

SEQ ID NO: 33891 - RNA, 14 nt, Homo sapiens
caguccucuuucaa

SEQ ID NO: 33892 - RNA, 15 nt, Homo sapiens
auacuauccaguuac

SEQ ID NO: 33893 - RNA, 16 nt, Homo sapiens
aauugacccacaagaa

SEQ ID NO: 33894 - RNA, 20 nt, Homo sapiens
ugcugggaauuacaggcgug

SEQ ID NO: 33895 - RNA, 13 nt, Homo sapiens
cagcuuauucaca

SEQ ID NO: 33896 - RNA, 23 nt, Homo sapiens
auaauagguuugugacuuuccua

SEQ ID NO: 33897 - RNA, 20 nt, Homo sapiens
gugaaauaagccagacauca

SEQ ID NO: 33898 - RNA, 13 nt, Homo sapiens
gaaaaacauuuca

SEQ ID NO: 33899 - RNA, 15 nt, Homo sapiens
acagaggaucugcuu

SEQ ID NO: 33900 - RNA, 15 nt, Homo sapiens
acagucacauuccaa

SEQ ID NO: 33901 - RNA, 16 nt, Homo sapiens
cauaauuacuauguca

SEQ ID NO: 33902 - RNA, 19 nt, Homo sapiens
uuccaggaaaaucugcacu

SEQ ID NO: 33903 - RNA, 16 nt, Homo sapiens
gaaaggcauucucuga

SEQ ID NO: 33904 - RNA, 18 nt, Homo sapiens
uuuguuauuuuuccccaa

SEQ ID NO: 33905 - RNA, 15 nt, Homo sapiens
uguuuuuaaacugga

SEQ ID NO: 33906 - RNA, 16 nt, Homo sapiens
ugucucaguccaugaa

SEQ ID NO: 33907 - RNA, 22 nt, Homo sapiens
caguaacggaacaguauccagu

SEQ ID NO: 33908 - RNA, 18 nt, Homo sapiens
acacuaaaaaggcaugua

SEQ ID NO: 33909 - RNA, 20 nt, Homo sapiens
agaaaccuuauuguaccucu

SEQ ID NO: 33910 - RNA, 20 nt, Homo sapiens
ccaaaguaucaggacgagaa

SEQ ID NO: 33911 - RNA, 16 nt, Homo sapiens
uguaaaauggagacac

SEQ ID NO: 33912 - RNA, 21 nt, Homo sapiens
cuuagacccucaugcugccaa

SEQ ID NO: 33913 - RNA, 21 nt, Homo sapiens
ugugacuuaaugccacuaaau

SEQ ID NO: 33914 - RNA, 13 nt, Homo sapiens
ccucuguugccaa

SEQ ID NO: 33915 - RNA, 20 nt, Homo sapiens
gaaaccuuauuguaccucuc

SEQ ID NO: 33916 - RNA, 18 nt, Homo sapiens
caggauagagugggacag

SEQ ID NO: 33917 - RNA, 23 nt, Homo sapiens
ucagaaauuuaauucauguuucu

SEQ ID NO: 33918 - RNA, 20 nt, Homo sapiens
ggucaauuuuguuauguaua

SEQ ID NO: 33919 - RNA, 23 nt, Homo sapiens
gugaauuuuucucuaacucagaa

SEQ ID NO: 33920 - RNA, 14 nt, Homo sapiens
cacaaaauugggaa

SEQ ID NO: 33921 - RNA, 22 nt, Homo sapiens
agaagugaaaaucuacacucca

SEQ ID NO: 33922 - RNA, 19 nt, Homo sapiens
uguaaucacagcuacuugg

SEQ ID NO: 33923 - RNA, 21 nt, Homo sapiens
ugaggcggguggaucacuuga

SEQ ID NO: 33924 - RNA, 23 nt, Homo sapiens
auuucacuugaugauacaaugaa

SEQ ID NO: 33925 - RNA, 20 nt, Homo sapiens
uuaugaaccuuuacauccag

SEQ ID NO: 33926 - RNA, 23 nt, Homo sapiens
uaugcaaccuuuggaugcacuuu

SEQ ID NO: 33927 - RNA, 22 nt, Homo sapiens
uaauggaauauguaaauagaaa

SEQ ID NO: 33928 - RNA, 21 nt, Homo sapiens
uggcuaagcaaaaugugauau

SEQ ID NO: 33929 - RNA, 18 nt, Homo sapiens
uucccuugaugaagaagu

SEQ ID NO: 33930 - RNA, 11 nt, Homo sapiens
uuccgcauccu

SEQ ID NO: 33931 - RNA, 18 nt, Homo sapiens
uucccgcuguuccucgcc

SEQ ID NO: 33932 - RNA, 17 nt, Homo sapiens
uuccaucaaggguacac

SEQ ID NO: 33933 - RNA, 22 nt, Homo sapiens
uucaugaaggggcggcggcccu

SEQ ID NO: 33934 - RNA, 13 nt, Homo sapiens
uuagaaacacaac

SEQ ID NO: 33935 - RNA, 13 nt, Homo sapiens
uguuccucgccac

SEQ ID NO: 33936 - RNA, 14 nt, Homo sapiens
uguuccucgccacg

SEQ ID NO: 33937 - RNA, 12 nt, Homo sapiens
uguucgcgcgcc

SEQ ID NO: 33938 - RNA, 16 nt, Homo sapiens
uguuuagaaacacaac

SEQ ID NO: 33939 - RNA, 12 nt, Homo sapiens
uuggagaagaac

SEQ ID NO: 33940 - RNA, 15 nt, Homo sapiens
uucgcgcgccuccgc

SEQ ID NO: 33941 - RNA, 12 nt, Homo sapiens
uuccucccggcc

SEQ ID NO: 33942 - RNA, 16 nt, Homo sapiens
uuccucccggccgcgc

SEQ ID NO: 33943 - RNA, 12 nt, Homo sapiens
uucugaagaaga

SEQ ID NO: 33944 - RNA, 18 nt, Homo sapiens
uuucaugaaggggcggcg

SEQ ID NO: 33945 - RNA, 14 nt, Homo sapiens
uuucccaacuccag

SEQ ID NO: 33946 - RNA, 12 nt, Homo sapiens
uggcgcuggcug

SEQ ID NO: 33947 - RNA, 13 nt, Homo sapiens
uggcgcuggcugc

SEQ ID NO: 33948 - RNA, 15 nt, Homo sapiens
uggcgcuggcugcgc

SEQ ID NO: 33949 - RNA, 23 nt, Homo sapiens
uggcaccgcuguacgcgagcgcg

SEQ ID NO: 33950 - RNA, 18 nt, Homo sapiens
ugcucauggaauuggagc

SEQ ID NO: 33951 - RNA, 12 nt, Homo sapiens
ugcugguggcgc

SEQ ID NO: 33952 - RNA, 13 nt, Homo sapiens
ugcugguggcgcu

SEQ ID NO: 33953 - RNA, 17 nt, Homo sapiens
ugcugguggcgcuggcu

SEQ ID NO: 33954 - RNA, 22 nt, Homo sapiens
ugcugguggcgcuggcugcgcu

SEQ ID NO: 33955 - RNA, 14 nt, Homo sapiens
uggaauuggagcuc

SEQ ID NO: 33956 - RNA, 18 nt, Homo sapiens
uggaauuggagcucgugg

SEQ ID NO: 33957 - RNA, 21 nt, Homo sapiens
uggucuaccuguucgcgcgcc

SEQ ID NO: 33958 - RNA, 10 nt, Homo sapiens
ugugaagcaa

SEQ ID NO: 33959 - RNA, 11 nt, Homo sapiens
ugugaagcaaa

SEQ ID NO: 33960 - RNA, 11 nt, Homo sapiens
ugugacucauu

SEQ ID NO: 33961 - RNA, 12 nt, Homo sapiens
ugugcggccugg

SEQ ID NO: 33962 - RNA, 13 nt, Homo sapiens
ugguggcgcuggc

SEQ ID NO: 33963 - RNA, 15 nt, Homo sapiens
uggcugcgcucggcc

SEQ ID NO: 33964 - RNA, 17 nt, Homo sapiens
uggcugcgcucggccug

SEQ ID NO: 33965 - RNA, 23 nt, Homo sapiens
uggcugcgcucggccugcucgcc

SEQ ID NO: 33966 - RNA, 18 nt, Homo sapiens
uggcugcugguggcgcug

SEQ ID NO: 33967 - RNA, 23 nt, Homo sapiens
uggcugcugguggcgcuggcugc

SEQ ID NO: 33968 - RNA, 18 nt, Homo sapiens
uggcgcuggcugcgcucg

SEQ ID NO: 33969 - RNA, 19 nt, Homo sapiens
uggcgcuggcugcgcucgg

SEQ ID NO: 33970 - RNA, 20 nt, Homo sapiens
uggcgcuggcugcgcucggc

SEQ ID NO: 33971 - RNA, 21 nt, Homo sapiens
uggcgcuggcugcgcucggcc

SEQ ID NO: 33972 - RNA, 16 nt, Homo sapiens
ugggccugagaccaag

SEQ ID NO: 33973 - RNA, 17 nt, Homo sapiens
ugggccugagaccaagg

SEQ ID NO: 33974 - RNA, 18 nt, Homo sapiens
ugggccugagaccaaggc

SEQ ID NO: 33975 - RNA, 19 nt, Homo sapiens
ugggccugagaccaaggcc

SEQ ID NO: 33976 - RNA, 17 nt, Homo sapiens
uggggcugaugcaguug

SEQ ID NO: 33977 - RNA, 11 nt, Homo sapiens
ugggucgccgg

SEQ ID NO: 33978 - RNA, 14 nt, Homo sapiens
ugggucgccggcau

SEQ ID NO: 33979 - RNA, 18 nt, Homo sapiens
ugggucgccggcaucuuc

SEQ ID NO: 33980 - RNA, 21 nt, Homo sapiens
ucuucuuucaugaaggggcgg

SEQ ID NO: 33981 - RNA, 17 nt, Homo sapiens
ucuggcugcugguggcg

SEQ ID NO: 33982 - RNA, 12 nt, Homo sapiens
ucugggucgccg

SEQ ID NO: 33983 - RNA, 15 nt, Homo sapiens
ucugggucgccggca

SEQ ID NO: 33984 - RNA, 16 nt, Homo sapiens
ucugggucgccggcau

SEQ ID NO: 33985 - RNA, 17 nt, Homo sapiens
ucugggucgccggcauc

SEQ ID NO: 33986 - RNA, 22 nt, Homo sapiens
uccucggacggcuccggacgcu

SEQ ID NO: 33987 - RNA, 14 nt, Homo sapiens
ucggacggcuccgg

SEQ ID NO: 33988 - RNA, 15 nt, Homo sapiens
ucggccugcucgccc

SEQ ID NO: 33989 - RNA, 16 nt, Homo sapiens
ucggccugcucgccca

SEQ ID NO: 33990 - RNA, 17 nt, Homo sapiens
ucggccugcucgcccac

SEQ ID NO: 33991 - RNA, 12 nt, Homo sapiens
ucuagugagcag

SEQ ID NO: 33992 - RNA, 12 nt, Homo sapiens
uccucccggccg

SEQ ID NO: 33993 - RNA, 14 nt, Homo sapiens
uccucccggccgcg

SEQ ID NO: 33994 - RNA, 20 nt, Homo sapiens
uccucccggccgcgcugcgc

SEQ ID NO: 33995 - RNA, 21 nt, Homo sapiens
uccucccggccgcgcugcgcg

SEQ ID NO: 33996 - RNA, 13 nt, Homo sapiens
uccucgccacgcu

SEQ ID NO: 33997 - RNA, 18 nt, Homo sapiens
ucgcaggaccaucccggc

SEQ ID NO: 33998 - RNA, 20 nt, Homo sapiens
ucgcaggaccaucccggccg

SEQ ID NO: 33999 - RNA, 22 nt, Homo sapiens
ucgcaggaccaucccggccggc

SEQ ID NO: 34000 - RNA, 23 nt, Homo sapiens
ucgcaggaccaucccggccggcg

SEQ ID NO: 34001 - RNA, 12 nt, Homo sapiens
ucgccacgcucu

SEQ ID NO: 34002 - RNA, 18 nt, Homo sapiens
ucgccacgcucugggucg

SEQ ID NO: 34003 - RNA, 22 nt, Homo sapiens
ucgccacgcucugggucgccgg

SEQ ID NO: 34004 - RNA, 23 nt, Homo sapiens
ucgccacgcucugggucgccggc

SEQ ID NO: 34005 - RNA, 19 nt, Homo sapiens
ucgcuuccgcauccuaguc

SEQ ID NO: 34006 - RNA, 16 nt, Homo sapiens
ucgcccacuuccuccc

SEQ ID NO: 34007 - RNA, 19 nt, Homo sapiens
ucgcccacuuccucccggc

SEQ ID NO: 34008 - RNA, 20 nt, Homo sapiens
ucgcccacuuccucccggcc

SEQ ID NO: 34009 - RNA, 22 nt, Homo sapiens
ucgcccacuuccucccggccgc

SEQ ID NO: 34010 - RNA, 23 nt, Homo sapiens
ucgcccacuuccucccggccgcg

SEQ ID NO: 34011 - RNA, 11 nt, Homo sapiens
ucgcgcgccuc

SEQ ID NO: 34012 - RNA, 15 nt, Homo sapiens
ucgcgcgccuccgcu

SEQ ID NO: 34013 - RNA, 19 nt, Homo sapiens
uccgcuacuuccagggcua

SEQ ID NO: 34014 - RNA, 13 nt, Homo sapiens
uccggacgcugcu

SEQ ID NO: 34015 - RNA, 14 nt, Homo sapiens
uccggacgcugcug

SEQ ID NO: 34016 - RNA, 17 nt, Homo sapiens
uccggacgcugcugccg

SEQ ID NO: 34017 - RNA, 12 nt, Homo sapiens
uccgggucgcag

SEQ ID NO: 34018 - RNA, 14 nt, Homo sapiens
ucccuuaccuggga

SEQ ID NO: 34019 - RNA, 15 nt, Homo sapiens
uccgcauccuagucu

SEQ ID NO: 34020 - RNA, 12 nt, Homo sapiens
uccgcgcagcuc

SEQ ID NO: 34021 - RNA, 16 nt, Homo sapiens
uccgcgcagcucaggc

SEQ ID NO: 34022 - RNA, 18 nt, Homo sapiens
uccgcgcagcucaggcug

SEQ ID NO: 34023 - RNA, 19 nt, Homo sapiens
uccgcgcagcucaggcugg

SEQ ID NO: 34024 - RNA, 20 nt, Homo sapiens
uccgcgcagcucaggcuggc

SEQ ID NO: 34025 - RNA, 21 nt, Homo sapiens
uccgcgcagcucaggcuggca

SEQ ID NO: 34026 - RNA, 17 nt, Homo sapiens
ugcaguucugaagaaga

SEQ ID NO: 34027 - RNA, 11 nt, Homo sapiens
ugccccgggga

SEQ ID NO: 34028 - RNA, 12 nt, Homo sapiens
ugccccggggag

SEQ ID NO: 34029 - RNA, 13 nt, Homo sapiens
ugccccggggagg

SEQ ID NO: 34030 - RNA, 11 nt, Homo sapiens
ugcacaucaaa

SEQ ID NO: 34031 - RNA, 21 nt, Homo sapiens
ugcagcgaguacuucccgcug

SEQ ID NO: 34032 - RNA, 19 nt, Homo sapiens
ugccccggggaggggcgcu

SEQ ID NO: 34033 - RNA, 22 nt, Homo sapiens
ugccccggggaggggcgcucgc

SEQ ID NO: 34034 - RNA, 13 nt, Homo sapiens
ugccgugggccug

SEQ ID NO: 34035 - RNA, 14 nt, Homo sapiens
ugccgugggccuga

SEQ ID NO: 34036 - RNA, 19 nt, Homo sapiens
ugccgugggccugagacca

SEQ ID NO: 34037 - RNA, 12 nt, Homo sapiens
ugcgcgccgcgc

SEQ ID NO: 34038 - RNA, 13 nt, Homo sapiens
ugcgcgccgcgcu

SEQ ID NO: 34039 - RNA, 14 nt, Homo sapiens
ugcgcgccgcgcuc

SEQ ID NO: 34040 - RNA, 15 nt, Homo sapiens
ugcgcgccgcgcucc

SEQ ID NO: 34041 - RNA, 16 nt, Homo sapiens
ugcgcgccgcgcuccu

SEQ ID NO: 34042 - RNA, 17 nt, Homo sapiens
ugcgcgccgcgcuccuc

SEQ ID NO: 34043 - RNA, 18 nt, Homo sapiens
ugcgcgccgcgcuccucg

SEQ ID NO: 34044 - RNA, 14 nt, Homo sapiens
ugcgcucggccugc

SEQ ID NO: 34045 - RNA, 16 nt, Homo sapiens
ugcgcucggccugcuc

SEQ ID NO: 34046 - RNA, 12 nt, Homo sapiens
ugcggccugguc

SEQ ID NO: 34047 - RNA, 15 nt, Homo sapiens
ugcucgcccacuucc

SEQ ID NO: 34048 - RNA, 17 nt, Homo sapiens
ugcucgcccacuuccuc

SEQ ID NO: 34049 - RNA, 21 nt, Homo sapiens
ugcucgcccacuuccucccgg

SEQ ID NO: 34050 - RNA, 19 nt, Homo sapiens
ugauaugggucuugauaaa

SEQ ID NO: 34051 - RNA, 13 nt, Homo sapiens
ugagaccaaggcc

SEQ ID NO: 34052 - RNA, 20 nt, Homo sapiens
ugagaccaaggcccccgggc

SEQ ID NO: 34053 - RNA, 23 nt, Homo sapiens
ugaauuaaguuuuuuuuuaaaaa

SEQ ID NO: 34054 - RNA, 20 nt, Homo sapiens
ucuuucaugaaggggcggcg

SEQ ID NO: 34055 - RNA, 23 nt, Homo sapiens
ucuuucaugaaggggcggcggcc

SEQ ID NO: 34056 - RNA, 13 nt, Homo sapiens
ugaaggggcggcg

SEQ ID NO: 34057 - RNA, 14 nt, Homo sapiens
ugaaggggcggcgg

SEQ ID NO: 34058 - RNA, 17 nt, Homo sapiens
ugaaggggcggcggccc

SEQ ID NO: 34059 - RNA, 21 nt, Homo sapiens
ugaacuagaguuuagcuggaa

SEQ ID NO: 34060 - RNA, 13 nt, Homo sapiens
ugaacugcagcga

SEQ ID NO: 34061 - RNA, 19 nt, Homo sapiens
uccaacuaucucauuucca

SEQ ID NO: 34062 - RNA, 21 nt, Homo sapiens
ucaggcuggcaccgcuguacg

SEQ ID NO: 34063 - RNA, 18 nt, Homo sapiens
ucaucccacccgcccacc

SEQ ID NO: 34064 - RNA, 14 nt, Homo sapiens
ucaugaaggggcgg

SEQ ID NO: 34065 - RNA, 18 nt, Homo sapiens
ucaugaaggggcggcggc

SEQ ID NO: 34066 - RNA, 13 nt, Homo sapiens
uccagcugccccg

SEQ ID NO: 34067 - RNA, 14 nt, Homo sapiens
uccagcugccccgg

SEQ ID NO: 34068 - RNA, 15 nt, Homo sapiens
uccagcugccccggg

SEQ ID NO: 34069 - RNA, 22 nt, Homo sapiens
uccagcugccccggggaggggc

SEQ ID NO: 34070 - RNA, 17 nt, Homo sapiens
uccagggcuacgcgcgc

SEQ ID NO: 34071 - RNA, 19 nt, Homo sapiens
uccagggcuacgcgcgcuc

SEQ ID NO: 34072 - RNA, 13 nt, Homo sapiens
ucccacccgccca

SEQ ID NO: 34073 - RNA, 20 nt, Homo sapiens
ucccgcuguuccucgccacg

SEQ ID NO: 34074 - RNA, 12 nt, Homo sapiens
ucccggccgcgc

SEQ ID NO: 34075 - RNA, 16 nt, Homo sapiens
ucccggccgcgcugcg

SEQ ID NO: 34076 - RNA, 17 nt, Homo sapiens
ucccggccgcgcugcgc

SEQ ID NO: 34077 - RNA, 19 nt, Homo sapiens
ucccggccgcgcugcgcgc

SEQ ID NO: 34078 - RNA, 22 nt, Homo sapiens
ucccggccgcgcugcgcgccgc

SEQ ID NO: 34079 - RNA, 23 nt, Homo sapiens
ucccggccgcgcugcgcgccgcg

SEQ ID NO: 34080 - RNA, 12 nt, Homo sapiens
ucccggccggcg

SEQ ID NO: 34081 - RNA, 13 nt, Homo sapiens
ucccggccggcgc

SEQ ID NO: 34082 - RNA, 14 nt, Homo sapiens
ucccggccggcgcg

SEQ ID NO: 34083 - RNA, 15 nt, Homo sapiens
ucccggccggcgcgc

SEQ ID NO: 34084 - RNA, 17 nt, Homo sapiens
ucccggccggcgcgcuc

SEQ ID NO: 34085 - RNA, 13 nt, Homo sapiens
uauauuugaaaua

SEQ ID NO: 34086 - RNA, 22 nt, Homo sapiens
ucaccucauggaauuggagcuc

SEQ ID NO: 34087 - RNA, 15 nt, Homo sapiens
uaaugauaacuggaa

SEQ ID NO: 34088 - RNA, 14 nt, Homo sapiens
uaaugauaacugga

SEQ ID NO: 34089 - RNA, 20 nt, Homo sapiens
uacuucccgcuguuccucgc

SEQ ID NO: 34090 - RNA, 16 nt, Homo sapiens
uacgcgcgcuccgcgc

SEQ ID NO: 34091 - RNA, 21 nt, Homo sapiens
uacgcgcgcuccgcgcagcuc

SEQ ID NO: 34092 - RNA, 16 nt, Homo sapiens
uaccuguucgcgcgcc

SEQ ID NO: 34093 - RNA, 17 nt, Homo sapiens
uaccuguucgcgcgccu

SEQ ID NO: 34094 - RNA, 19 nt, Homo sapiens
uaccuguucgcgcgccucc

SEQ ID NO: 34095 - RNA, 13 nt, Homo sapiens
uacgcgcgcuccg

SEQ ID NO: 34096 - RNA, 13 nt, Homo sapiens
uacgcgagcgcgc

SEQ ID NO: 34097 - RNA, 18 nt, Homo sapiens
uacgcgagcgcgcgcgcc

SEQ ID NO: 34098 - RNA, 19 nt, Homo sapiens
uacgcgagcgcgcgcgccc

SEQ ID NO: 34099 - RNA, 10 nt, Homo sapiens
guucgcgcgc

SEQ ID NO: 34100 - RNA, 14 nt, Homo sapiens
guucgcgcgccucc

SEQ ID NO: 34101 - RNA, 15 nt, Homo sapiens
guucgcgcgccuccg

SEQ ID NO: 34102 - RNA, 14 nt, Homo sapiens
guuccucgccacgc

SEQ ID NO: 34103 - RNA, 15 nt, Homo sapiens
guuccucgccacgcu

SEQ ID NO: 34104 - RNA, 11 nt, Homo sapiens
guggcgcuggc

SEQ ID NO: 34105 - RNA, 15 nt, Homo sapiens
guggcgcuggcugcg

SEQ ID NO: 34106 - RNA, 20 nt, Homo sapiens
guggcgcuggcugcgcucgg

SEQ ID NO: 34107 - RNA, 16 nt, Homo sapiens
guccgggucgcaggac

SEQ ID NO: 34108 - RNA, 20 nt, Homo sapiens
guccgggucgcaggaccauc

SEQ ID NO: 34109 - RNA, 15 nt, Homo sapiens
gucuaccuguucgcg

SEQ ID NO: 34110 - RNA, 16 nt, Homo sapiens
gucuaccuguucgcgc

SEQ ID NO: 34111 - RNA, 21 nt, Homo sapiens
gucuaccuguucgcgcgccuc

SEQ ID NO: 34112 - RNA, 22 nt, Homo sapiens
gucuaccuguucgcgcgccucc

SEQ ID NO: 34113 - RNA, 17 nt, Homo sapiens
gucgcaggaccaucccg

SEQ ID NO: 34114 - RNA, 19 nt, Homo sapiens
gucgcaggaccaucccggc

SEQ ID NO: 34115 - RNA, 20 nt, Homo sapiens
gucgcaggaccaucccggcc

SEQ ID NO: 34116 - RNA, 22 nt, Homo sapiens
gucgcaggaccaucccggccgg

SEQ ID NO: 34117 - RNA, 24 nt, Homo sapiens
gucgcaggaccaucccggccggcg

SEQ ID NO: 34118 - RNA, 13 nt, Homo sapiens
gucgccggcaucu

SEQ ID NO: 34119 - RNA, 14 nt, Homo sapiens
gucgccggcaucuu

SEQ ID NO: 34120 - RNA, 12 nt, Homo sapiens
ggcugcgcucgg

SEQ ID NO: 34121 - RNA, 15 nt, Homo sapiens
ggcugcgcucggccu

SEQ ID NO: 34122 - RNA, 16 nt, Homo sapiens
ggcugcgcucggccug

SEQ ID NO: 34123 - RNA, 17 nt, Homo sapiens
ggcugcgcucggccugc

SEQ ID NO: 34124 - RNA, 18 nt, Homo sapiens
ggcugcgcucggccugcu

SEQ ID NO: 34125 - RNA, 20 nt, Homo sapiens
ggcugcgcucggccugcucg

SEQ ID NO: 34126 - RNA, 21 nt, Homo sapiens
ggcugcgcucggccugcucgc

SEQ ID NO: 34127 - RNA, 22 nt, Homo sapiens
ggcugcgcucggccugcucgcc

SEQ ID NO: 34128 - RNA, 14 nt, Homo sapiens
ggcugcugguggcg

SEQ ID NO: 34129 - RNA, 17 nt, Homo sapiens
ggcugcugguggcgcug

SEQ ID NO: 34130 - RNA, 19 nt, Homo sapiens
ggcugcugguggcgcuggc

SEQ ID NO: 34131 - RNA, 20 nt, Homo sapiens
ggcugcugguggcgcuggcu

SEQ ID NO: 34132 - RNA, 16 nt, Homo sapiens
ggcuccggacgcugcu

SEQ ID NO: 34133 - RNA, 20 nt, Homo sapiens
ggcuccggacgcugcugccg

SEQ ID NO: 34134 - RNA, 16 nt, Homo sapiens
ggcuacgcgcgcuccg

SEQ ID NO: 34135 - RNA, 20 nt, Homo sapiens
ggcuacgcgcgcuccgcgca

SEQ ID NO: 34136 - RNA, 21 nt, Homo sapiens
ggcuacgcgcgcuccgcgcag

SEQ ID NO: 34137 - RNA, 19 nt, Homo sapiens
ggccuggucuaccuguucg

SEQ ID NO: 34138 - RNA, 13 nt, Homo sapiens
ggcggggagcgag

SEQ ID NO: 34139 - RNA, 14 nt, Homo sapiens
ggcggggagcgagc

SEQ ID NO: 34140 - RNA, 14 nt, Homo sapiens
ggcggguccggguc

SEQ ID NO: 34141 - RNA, 18 nt, Homo sapiens
ggcggguccgggucgcag

SEQ ID NO: 34142 - RNA, 19 nt, Homo sapiens
ggcggguccgggucgcagg

SEQ ID NO: 34143 - RNA, 11 nt, Homo sapiens
gggcuacgcgc

SEQ ID NO: 34144 - RNA, 16 nt, Homo sapiens
gggcuacgcgcgcucc

SEQ ID NO: 34145 - RNA, 18 nt, Homo sapiens
gggccgacggagccggga

SEQ ID NO: 34146 - RNA, 14 nt, Homo sapiens
gggcgcggggcggg

SEQ ID NO: 34147 - RNA, 14 nt, Homo sapiens
ggcuggcaccgcug

SEQ ID NO: 34148 - RNA, 15 nt, Homo sapiens
ggcuggcaccgcugu

SEQ ID NO: 34149 - RNA, 16 nt, Homo sapiens
ggcuggcaccgcugua

SEQ ID NO: 34150 - RNA, 17 nt, Homo sapiens
ggcuggcaccgcuguac

SEQ ID NO: 34151 - RNA, 17 nt, Homo sapiens
gggaaagaagagccgga

SEQ ID NO: 34152 - RNA, 20 nt, Homo sapiens
gggaaagaagagccggagcc

SEQ ID NO: 34153 - RNA, 13 nt, Homo sapiens
gggaaagggcugu

SEQ ID NO: 34154 - RNA, 18 nt, Homo sapiens
gggagaaccuagggugau

SEQ ID NO: 34155 - RNA, 20 nt, Homo sapiens
gggagcgagccccaggcggg

SEQ ID NO: 34156 - RNA, 12 nt, Homo sapiens
ggggaggggcgc

SEQ ID NO: 34157 - RNA, 15 nt, Homo sapiens
ggggaggggcgcucg

SEQ ID NO: 34158 - RNA, 11 nt, Homo sapiens
ggggcgcucgc

SEQ ID NO: 34159 - RNA, 14 nt, Homo sapiens
ggggcgcucgcuuc

SEQ ID NO: 34160 - RNA, 23 nt, Homo sapiens
gggucgcaggaccaucccggccg

SEQ ID NO: 34161 - RNA, 16 nt, Homo sapiens
gggugaacugcagcga

SEQ ID NO: 34162 - RNA, 21 nt, Homo sapiens
ggucuaccaaaaaucucaaua

SEQ ID NO: 34163 - RNA, 19 nt, Homo sapiens
ggucuaccuguucgcgcgc

SEQ ID NO: 34164 - RNA, 20 nt, Homo sapiens
ggucuaccuguucgcgcgcc

SEQ ID NO: 34165 - RNA, 21 nt, Homo sapiens
ggucuaccuguucgcgcgccu

SEQ ID NO: 34166 - RNA, 20 nt, Homo sapiens
ggucgcaggaccaucccggc

SEQ ID NO: 34167 - RNA, 21 nt, Homo sapiens
ggucgcaggaccaucccggcc

SEQ ID NO: 34168 - RNA, 23 nt, Homo sapiens
ggucgcaggaccaucccggccgg

SEQ ID NO: 34169 - RNA, 11 nt, Homo sapiens
ggucgccggca

SEQ ID NO: 34170 - RNA, 14 nt, Homo sapiens
guacgcgagcgcgc

SEQ ID NO: 34171 - RNA, 15 nt, Homo sapiens
guacgcgagcgcgcg

SEQ ID NO: 34172 - RNA, 16 nt, Homo sapiens
guacgcgagcgcgcgc

SEQ ID NO: 34173 - RNA, 17 nt, Homo sapiens
guacgcgagcgcgcgcg

SEQ ID NO: 34174 - RNA, 19 nt, Homo sapiens
guacgcgagcgcgcgcgcc

SEQ ID NO: 34175 - RNA, 21 nt, Homo sapiens
guacgcgagcgcgcgcgcccu

SEQ ID NO: 34176 - RNA, 13 nt, Homo sapiens
gguggcgcuggcu

SEQ ID NO: 34177 - RNA, 15 nt, Homo sapiens
gguggcgcuggcugc

SEQ ID NO: 34178 - RNA, 20 nt, Homo sapiens
gguggcgcuggcugcgcucg

SEQ ID NO: 34179 - RNA, 20 nt, Homo sapiens
ggucuugauaaauggcuucc

SEQ ID NO: 34180 - RNA, 20 nt, Homo sapiens
gcucauggaauuggagcucg

SEQ ID NO: 34181 - RNA, 22 nt, Homo sapiens
gcucauggaauuggagcucgug

SEQ ID NO: 34182 - RNA, 13 nt, Homo sapiens
gcucugggucgcc

SEQ ID NO: 34183 - RNA, 16 nt, Homo sapiens
gcucugggucgccggc

SEQ ID NO: 34184 - RNA, 17 nt, Homo sapiens
gcucugggucgccggca

SEQ ID NO: 34185 - RNA, 10 nt, Homo sapiens
gcugcgcgcc

SEQ ID NO: 34186 - RNA, 12 nt, Homo sapiens
gcugcgcgccgc

SEQ ID NO: 34187 - RNA, 13 nt, Homo sapiens
gcugcgcgccgcg

SEQ ID NO: 34188 - RNA, 15 nt, Homo sapiens
gcugcgcgccgcgcu

SEQ ID NO: 34189 - RNA, 16 nt, Homo sapiens
gcugcgcgccgcgcuc

SEQ ID NO: 34190 - RNA, 17 nt, Homo sapiens
gcugcgcgccgcgcucc

SEQ ID NO: 34191 - RNA, 12 nt, Homo sapiens
gcugccccgggg

SEQ ID NO: 34192 - RNA, 13 nt, Homo sapiens
gcugccccgggga

SEQ ID NO: 34193 - RNA, 20 nt, Homo sapiens
gcugccccggggaggggcgc

SEQ ID NO: 34194 - RNA, 24 nt, Homo sapiens
gcugccccggggaggggcgcucgc

SEQ ID NO: 34195 - RNA, 15 nt, Homo sapiens
gcugccgugggccug

SEQ ID NO: 34196 - RNA, 18 nt, Homo sapiens
gcugccgugggccugaga

SEQ ID NO: 34197 - RNA, 20 nt, Homo sapiens
gcuccgcgcagcucaggcug

SEQ ID NO: 34198 - RNA, 16 nt, Homo sapiens
gcuccggacgcugcug

SEQ ID NO: 34199 - RNA, 19 nt, Homo sapiens
gcuccggacgcugcugccg

SEQ ID NO: 34200 - RNA, 21 nt, Homo sapiens
gcuccggacgcugcugccgug

SEQ ID NO: 34201 - RNA, 22 nt, Homo sapiens
gcuccggacgcugcugccgugg

SEQ ID NO: 34202 - RNA, 13 nt, Homo sapiens
gcuccucggacgg

SEQ ID NO: 34203 - RNA, 16 nt, Homo sapiens
gcuccucggacggcuc

SEQ ID NO: 34204 - RNA, 17 nt, Homo sapiens
gcuccucggacggcucc

SEQ ID NO: 34205 - RNA, 19 nt, Homo sapiens
gcuccucggacggcuccgg

SEQ ID NO: 34206 - RNA, 20 nt, Homo sapiens
gcuccucggacggcuccgga

SEQ ID NO: 34207 - RNA, 18 nt, Homo sapiens
gcucgcccacuuccuccc

SEQ ID NO: 34208 - RNA, 19 nt, Homo sapiens
gcucgcccacuuccucccg

SEQ ID NO: 34209 - RNA, 23 nt, Homo sapiens
gcucgcccacuuccucccggccg

SEQ ID NO: 34210 - RNA, 13 nt, Homo sapiens
gcucgcuuccgca

SEQ ID NO: 34211 - RNA, 15 nt, Homo sapiens
gcucgcuuccgcauc

SEQ ID NO: 34212 - RNA, 18 nt, Homo sapiens
gcucgcuuccgcauccua

SEQ ID NO: 34213 - RNA, 20 nt, Homo sapiens
gcucgcuuccgcauccuagu

SEQ ID NO: 34214 - RNA, 14 nt, Homo sapiens
gcucggccugcucg

SEQ ID NO: 34215 - RNA, 17 nt, Homo sapiens
gcucggccugcucgccc

SEQ ID NO: 34216 - RNA, 18 nt, Homo sapiens
gcucggccugcucgccca

SEQ ID NO: 34217 - RNA, 12 nt, Homo sapiens
gcucaggcuggc

SEQ ID NO: 34218 - RNA, 23 nt, Homo sapiens
gcucaggcuggcaccgcuguacg

SEQ ID NO: 34219 - RNA, 20 nt, Homo sapiens
gcucaucccacccgcccacc

SEQ ID NO: 34220 - RNA, 21 nt, Homo sapiens
gcucaucccacccgcccaccg

SEQ ID NO: 34221 - RNA, 23 nt, Homo sapiens
gcucaucccacccgcccaccgca

SEQ ID NO: 34222 - RNA, 11 nt, Homo sapiens
gcuacgcgcgc

SEQ ID NO: 34223 - RNA, 19 nt, Homo sapiens
gcuacgcgcgcuccgcgca

SEQ ID NO: 34224 - RNA, 20 nt, Homo sapiens
gcuacuuccagggcuacgcg

SEQ ID NO: 34225 - RNA, 21 nt, Homo sapiens
gcuacuuccagggcuacgcgc

SEQ ID NO: 34226 - RNA, 14 nt, Homo sapiens
gcuuccgcauccua

SEQ ID NO: 34227 - RNA, 13 nt, Homo sapiens
gcuguuccucgcc

SEQ ID NO: 34228 - RNA, 18 nt, Homo sapiens
gcuguuccucgccacgcu

SEQ ID NO: 34229 - RNA, 22 nt, Homo sapiens
gcuguuccucgccacgcucugg

SEQ ID NO: 34230 - RNA, 12 nt, Homo sapiens
gcugcgcucggc

SEQ ID NO: 34231 - RNA, 14 nt, Homo sapiens
gcugcgcucggccu

SEQ ID NO: 34232 - RNA, 16 nt, Homo sapiens
gcugcgcucggccugc

SEQ ID NO: 34233 - RNA, 17 nt, Homo sapiens
gcugcgcucggccugcu

SEQ ID NO: 34234 - RNA, 19 nt, Homo sapiens
gcugcgcucggccugcucg

SEQ ID NO: 34235 - RNA, 20 nt, Homo sapiens
gcugcgcucggccugcucgc

SEQ ID NO: 34236 - RNA, 23 nt, Homo sapiens
gcugcgcucggccugcucgccca

SEQ ID NO: 34237 - RNA, 14 nt, Homo sapiens
gcugcugccguggg

SEQ ID NO: 34238 - RNA, 14 nt, Homo sapiens
gcugcugguggcgc

SEQ ID NO: 34239 - RNA, 16 nt, Homo sapiens
gcugcugguggcgcug

SEQ ID NO: 34240 - RNA, 18 nt, Homo sapiens
gcugcugguggcgcuggc

SEQ ID NO: 34241 - RNA, 22 nt, Homo sapiens
gcugcugguggcgcuggcugcg

SEQ ID NO: 34242 - RNA, 12 nt, Homo sapiens
gcugguggcgcu

SEQ ID NO: 34243 - RNA, 14 nt, Homo sapiens
gcugguggcgcugg

SEQ ID NO: 34244 - RNA, 15 nt, Homo sapiens
gcugguggcgcuggc

SEQ ID NO: 34245 - RNA, 19 nt, Homo sapiens
gcugguggcgcuggcugcg

SEQ ID NO: 34246 - RNA, 22 nt, Homo sapiens
gcugguggcgcuggcugcgcuc

SEQ ID NO: 34247 - RNA, 14 nt, Homo sapiens
gcuguacgcgagcg

SEQ ID NO: 34248 - RNA, 15 nt, Homo sapiens
gcuguacgcgagcgc

SEQ ID NO: 34249 - RNA, 16 nt, Homo sapiens
gcuguacgcgagcgcg

SEQ ID NO: 34250 - RNA, 18 nt, Homo sapiens
gcuguacgcgagcgcgcg

SEQ ID NO: 34251 - RNA, 19 nt, Homo sapiens
gcuguacgcgagcgcgcgc

SEQ ID NO: 34252 - RNA, 22 nt, Homo sapiens
gcuguacgcgagcgcgcgcgcc

SEQ ID NO: 34253 - RNA, 12 nt, Homo sapiens
gcuggcugcgcu

SEQ ID NO: 34254 - RNA, 19 nt, Homo sapiens
gcuggcugcgcucggccug

SEQ ID NO: 34255 - RNA, 20 nt, Homo sapiens
gcuggcugcgcucggccugc

SEQ ID NO: 34256 - RNA, 22 nt, Homo sapiens
gcuggcugcgcucggccugcuc

SEQ ID NO: 34257 - RNA, 19 nt, Homo sapiens
gcuggcaccgcuguacgcg

SEQ ID NO: 34258 - RNA, 23 nt, Homo sapiens
gcuggcaccgcuguacgcgagcg

SEQ ID NO: 34259 - RNA, 24 nt, Homo sapiens
gcuggcaccgcuguacgcgagcgc

SEQ ID NO: 34260 - RNA, 11 nt, Homo sapiens
ggcaccgcugu

SEQ ID NO: 34261 - RNA, 14 nt, Homo sapiens
ggcccugugcggcc

SEQ ID NO: 34262 - RNA, 18 nt, Homo sapiens
ggcccugugcggccuggu

SEQ ID NO: 34263 - RNA, 19 nt, Homo sapiens
ggcccugugcggccugguc

SEQ ID NO: 34264 - RNA, 20 nt, Homo sapiens
ggcccugugcggccuggucu

SEQ ID NO: 34265 - RNA, 12 nt, Homo sapiens
ggccgacggagc

SEQ ID NO: 34266 - RNA, 13 nt, Homo sapiens
ggccgacggagcc

SEQ ID NO: 34267 - RNA, 15 nt, Homo sapiens
ggccgacggagccgg

SEQ ID NO: 34268 - RNA, 19 nt, Homo sapiens
ggccgacggagccgggaaa

SEQ ID NO: 34269 - RNA, 11 nt, Homo sapiens
ggccgcgcugc

SEQ ID NO: 34270 - RNA, 12 nt, Homo sapiens
ggccgcgcugcg

SEQ ID NO: 34271 - RNA, 14 nt, Homo sapiens
ggccgcgcugcgcg

SEQ ID NO: 34272 - RNA, 16 nt, Homo sapiens
ggccgcgcugcgcgcc

SEQ ID NO: 34273 - RNA, 17 nt, Homo sapiens
ggccgcgcugcgcgccg

SEQ ID NO: 34274 - RNA, 19 nt, Homo sapiens
ggccgcgcugcgcgccgcg

SEQ ID NO: 34275 - RNA, 13 nt, Homo sapiens
ggccggcgcgcuc

SEQ ID NO: 34276 - RNA, 14 nt, Homo sapiens
ggccggcgcgcuca

SEQ ID NO: 34277 - RNA, 16 nt, Homo sapiens
ggccggcgcgcucauc

SEQ ID NO: 34278 - RNA, 23 nt, Homo sapiens
ggccugagaccaaggcccccggg

SEQ ID NO: 34279 - RNA, 14 nt, Homo sapiens
ggccugcucgccca

SEQ ID NO: 34280 - RNA, 21 nt, Homo sapiens
ggccugcucgcccacuuccuc

SEQ ID NO: 34281 - RNA, 14 nt, Homo sapiens
ggcccccgggccga

SEQ ID NO: 34282 - RNA, 16 nt, Homo sapiens
ggcccccgggccgacg

SEQ ID NO: 34283 - RNA, 14 nt, Homo sapiens
ggcgcgcucauccc

SEQ ID NO: 34284 - RNA, 22 nt, Homo sapiens
ggcgcgcucaucccacccgccc

SEQ ID NO: 34285 - RNA, 21 nt, Homo sapiens
ggcgcggcgggagggcgcggg

SEQ ID NO: 34286 - RNA, 21 nt, Homo sapiens
ggcgcggggcggggagcgagc

SEQ ID NO: 34287 - RNA, 23 nt, Homo sapiens
ggcgcggggcggggagcgagccc

SEQ ID NO: 34288 - RNA, 13 nt, Homo sapiens
ggcgcucgcuucc

SEQ ID NO: 34289 - RNA, 18 nt, Homo sapiens
ggcgcucgcuuccgcauc

SEQ ID NO: 34290 - RNA, 20 nt, Homo sapiens
ggcgcucgcuuccgcauccu

SEQ ID NO: 34291 - RNA, 12 nt, Homo sapiens
ggcgcuggcugc

SEQ ID NO: 34292 - RNA, 20 nt, Homo sapiens
ggcgcuggcugcgcucggcc

SEQ ID NO: 34293 - RNA, 21 nt, Homo sapiens
ggcgcuggcugcgcucggccu

SEQ ID NO: 34294 - RNA, 21 nt, Homo sapiens
ggcggcccugugcggccuggu

SEQ ID NO: 34295 - RNA, 11 nt, Homo sapiens
ggcggcggccc

SEQ ID NO: 34296 - RNA, 13 nt, Homo sapiens
ggcggcggcccug

SEQ ID NO: 34297 - RNA, 21 nt, Homo sapiens
ggcggcggcccugugcggccu

SEQ ID NO: 34298 - RNA, 15 nt, Homo sapiens
ggaaagaagagccgg

SEQ ID NO: 34299 - RNA, 13 nt, Homo sapiens
ggaaaggcagcuc

SEQ ID NO: 34300 - RNA, 16 nt, Homo sapiens
ggaauuggagcucgug

SEQ ID NO: 34301 - RNA, 18 nt, Homo sapiens
ggacagucaccucaugga

SEQ ID NO: 34302 - RNA, 17 nt, Homo sapiens
ggacauuugcucaugga

SEQ ID NO: 34303 - RNA, 13 nt, Homo sapiens
ggaccaucccggc

SEQ ID NO: 34304 - RNA, 14 nt, Homo sapiens
ggaccaucccggcc

SEQ ID NO: 34305 - RNA, 15 nt, Homo sapiens
ggaccaucccggccg

SEQ ID NO: 34306 - RNA, 18 nt, Homo sapiens
ggaccaucccggccggcg

SEQ ID NO: 34307 - RNA, 23 nt, Homo sapiens
ggaccaucccggccggcgcgcuc

SEQ ID NO: 34308 - RNA, 11 nt, Homo sapiens
ggacgcugcug

SEQ ID NO: 34309 - RNA, 14 nt, Homo sapiens
ggacgcugcugccg

SEQ ID NO: 34310 - RNA, 15 nt, Homo sapiens
ggacgcugcugccgu

SEQ ID NO: 34311 - RNA, 12 nt, Homo sapiens
ggacggcuccgg

SEQ ID NO: 34312 - RNA, 13 nt, Homo sapiens
ggacggcuccgga

SEQ ID NO: 34313 - RNA, 19 nt, Homo sapiens
ggacggcuccggacgcugc

SEQ ID NO: 34314 - RNA, 20 nt, Homo sapiens
ggacggcuccggacgcugcu

SEQ ID NO: 34315 - RNA, 21 nt, Homo sapiens
ggacggcuccggacgcugcug

SEQ ID NO: 34316 - RNA, 19 nt, Homo sapiens
ggagccgggaaagaagagc

SEQ ID NO: 34317 - RNA, 16 nt, Homo sapiens
ggagccuccagcugcc

SEQ ID NO: 34318 - RNA, 18 nt, Homo sapiens
ggagcgagccccaggcgg

SEQ ID NO: 34319 - RNA, 22 nt, Homo sapiens
ggagcgagccccaggcgggucc

SEQ ID NO: 34320 - RNA, 10 nt, Homo sapiens
ggagcucgug

SEQ ID NO: 34321 - RNA, 22 nt, Homo sapiens
ggagggaagccuuggggcugau

SEQ ID NO: 34322 - RNA, 15 nt, Homo sapiens
ggagggcgcggggcg

SEQ ID NO: 34323 - RNA, 13 nt, Homo sapiens
ggaggggcgcucg

SEQ ID NO: 34324 - RNA, 18 nt, Homo sapiens
gccagauuuuccugaaaa

SEQ ID NO: 34325 - RNA, 11 nt, Homo sapiens
gccacgcucug

SEQ ID NO: 34326 - RNA, 16 nt, Homo sapiens
gccacgcucugggucg

SEQ ID NO: 34327 - RNA, 22 nt, Homo sapiens
gccacgcucugggucgccggca

SEQ ID NO: 34328 - RNA, 23 nt, Homo sapiens
gccacgcucugggucgccggcau

SEQ ID NO: 34329 - RNA, 24 nt, Homo sapiens
gcauuauauuuauuacuguaagaa

SEQ ID NO: 34330 - RNA, 13 nt, Homo sapiens
gcaguucugaaga

SEQ ID NO: 34331 - RNA, 17 nt, Homo sapiens
gcaguucugaagaagau

SEQ ID NO: 34332 - RNA, 18 nt, Homo sapiens
gcaggaccaucccggccg

SEQ ID NO: 34333 - RNA, 19 nt, Homo sapiens
gcaggaccaucccggccgg

SEQ ID NO: 34334 - RNA, 22 nt, Homo sapiens
gcaggaccaucccggccggcgc

SEQ ID NO: 34335 - RNA, 17 nt, Homo sapiens
gcagcgaguacuucccg

SEQ ID NO: 34336 - RNA, 18 nt, Homo sapiens
gcagcgaguacuucccgc

SEQ ID NO: 34337 - RNA, 21 nt, Homo sapiens
gcagcgaguacuucccgcugu

SEQ ID NO: 34338 - RNA, 22 nt, Homo sapiens
gcagcgaguacuucccgcuguu

SEQ ID NO: 34339 - RNA, 20 nt, Homo sapiens
gcagcucaggcuggcaccgc

SEQ ID NO: 34340 - RNA, 14 nt, Homo sapiens
gcccucuggcugcu

SEQ ID NO: 34341 - RNA, 16 nt, Homo sapiens
gcccucuggcugcugg

SEQ ID NO: 34342 - RNA, 14 nt, Homo sapiens
gcccugugcggccu

SEQ ID NO: 34343 - RNA, 17 nt, Homo sapiens
gcccugugcggccuggu

SEQ ID NO: 34344 - RNA, 18 nt, Homo sapiens
gcccugugcggccugguc

SEQ ID NO: 34345 - RNA, 19 nt, Homo sapiens
gcccugugcggccuggucu

SEQ ID NO: 34346 - RNA, 13 nt, Homo sapiens
gccgacggagccg

SEQ ID NO: 34347 - RNA, 15 nt, Homo sapiens
gccgacggagccggg

SEQ ID NO: 34348 - RNA, 16 nt, Homo sapiens
gccgacggagccggga

SEQ ID NO: 34349 - RNA, 11 nt, Homo sapiens
gccggagccuc

SEQ ID NO: 34350 - RNA, 12 nt, Homo sapiens
gccggagccucc

SEQ ID NO: 34351 - RNA, 13 nt, Homo sapiens
gccggagccucca

SEQ ID NO: 34352 - RNA, 14 nt, Homo sapiens
gccggagccuccag

SEQ ID NO: 34353 - RNA, 15 nt, Homo sapiens
gccggagccuccagc

SEQ ID NO: 34354 - RNA, 16 nt, Homo sapiens
gccggagccuccagcu

SEQ ID NO: 34355 - RNA, 17 nt, Homo sapiens
gccggagccuccagcug

SEQ ID NO: 34356 - RNA, 18 nt, Homo sapiens
gccggagccuccagcugc

SEQ ID NO: 34357 - RNA, 21 nt, Homo sapiens
gccggagccuccagcugcccc

SEQ ID NO: 34358 - RNA, 12 nt, Homo sapiens
gccggcgcgcuc

SEQ ID NO: 34359 - RNA, 13 nt, Homo sapiens
gccggcgcgcuca

SEQ ID NO: 34360 - RNA, 15 nt, Homo sapiens
gccggcgcgcucauc

SEQ ID NO: 34361 - RNA, 19 nt, Homo sapiens
gccgggaaagaagagccgg

SEQ ID NO: 34362 - RNA, 20 nt, Homo sapiens
gccgggaaagaagagccgga

SEQ ID NO: 34363 - RNA, 23 nt, Homo sapiens
gccgggaaagaagagccggagcc

SEQ ID NO: 34364 - RNA, 22 nt, Homo sapiens
gcccacagcuguaugauuccca

SEQ ID NO: 34365 - RNA, 16 nt, Homo sapiens
gcccaccgcaggguga

SEQ ID NO: 34366 - RNA, 19 nt, Homo sapiens
gcccacuuccucccggccg

SEQ ID NO: 34367 - RNA, 20 nt, Homo sapiens
gcccacuuccucccggccgc

SEQ ID NO: 34368 - RNA, 14 nt, Homo sapiens
gccaugaaucaccu

SEQ ID NO: 34369 - RNA, 14 nt, Homo sapiens
gcccccgggccgac

SEQ ID NO: 34370 - RNA, 19 nt, Homo sapiens
gcccccgggccgacggagc

SEQ ID NO: 34371 - RNA, 20 nt, Homo sapiens
gcccccgggccgacggagcc

SEQ ID NO: 34372 - RNA, 21 nt, Homo sapiens
gcccccgggccgacggagccg

SEQ ID NO: 34373 - RNA, 22 nt, Homo sapiens
gcccccgggccgacggagccgg

SEQ ID NO: 34374 - RNA, 15 nt, Homo sapiens
gccccaggcgggucc

SEQ ID NO: 34375 - RNA, 16 nt, Homo sapiens
gccccaggcggguccg

SEQ ID NO: 34376 - RNA, 17 nt, Homo sapiens
gccccaggcggguccgg

SEQ ID NO: 34377 - RNA, 22 nt, Homo sapiens
gccccaggcggguccgggucgc

SEQ ID NO: 34378 - RNA, 14 nt, Homo sapiens
gcgcgcccucuggc

SEQ ID NO: 34379 - RNA, 21 nt, Homo sapiens
gcgcgcccucuggcugcuggu

SEQ ID NO: 34380 - RNA, 11 nt, Homo sapiens
gcgcgccgcgc

SEQ ID NO: 34381 - RNA, 12 nt, Homo sapiens
gcgcgccgcgcu

SEQ ID NO: 34382 - RNA, 13 nt, Homo sapiens
gcgcgccgcgcuc

SEQ ID NO: 34383 - RNA, 13 nt, Homo sapiens
gcgcgccuccgcu

SEQ ID NO: 34384 - RNA, 11 nt, Homo sapiens
gcgccuccgcu

SEQ ID NO: 34385 - RNA, 19 nt, Homo sapiens
gcgccuccgcuacuuccag

SEQ ID NO: 34386 - RNA, 20 nt, Homo sapiens
gcgccuccgcuacuuccagg

SEQ ID NO: 34387 - RNA, 22 nt, Homo sapiens
gcgccuccgcuacuuccagggc

SEQ ID NO: 34388 - RNA, 23 nt, Homo sapiens
gcgccuccgcuacuuccagggcu

SEQ ID NO: 34389 - RNA, 12 nt, Homo sapiens
gcgcgcgcgccc

SEQ ID NO: 34390 - RNA, 14 nt, Homo sapiens
gcgcgcgcgcccuc

SEQ ID NO: 34391 - RNA, 22 nt, Homo sapiens
gcgcgcucaucccacccgccca

SEQ ID NO: 34392 - RNA, 23 nt, Homo sapiens
gcgcgcucaucccacccgcccac

SEQ ID NO: 34393 - RNA, 14 nt, Homo sapiens
gcgcgcuccgcgca

SEQ ID NO: 34394 - RNA, 16 nt, Homo sapiens
gcgcgcuccgcgcagc

SEQ ID NO: 34395 - RNA, 17 nt, Homo sapiens
gcgcgcuccgcgcagcu

SEQ ID NO: 34396 - RNA, 19 nt, Homo sapiens
gcgcgcuccgcgcagcuca

SEQ ID NO: 34397 - RNA, 23 nt, Homo sapiens
gcgcggcgggagggcgcggggcg

SEQ ID NO: 34398 - RNA, 20 nt, Homo sapiens
gcgcggggcggggagcgagc

SEQ ID NO: 34399 - RNA, 21 nt, Homo sapiens
gcgcggggcggggagcgagcc

SEQ ID NO: 34400 - RNA, 23 nt, Homo sapiens
gcgcggggcggggagcgagcccc

SEQ ID NO: 34401 - RNA, 14 nt, Homo sapiens
gcgcucaucccacc

SEQ ID NO: 34402 - RNA, 16 nt, Homo sapiens
gcgcucaucccacccg

SEQ ID NO: 34403 - RNA, 17 nt, Homo sapiens
gcgcucaucccacccgc

SEQ ID NO: 34404 - RNA, 18 nt, Homo sapiens
gcgcucaucccacccgcc

SEQ ID NO: 34405 - RNA, 20 nt, Homo sapiens
gcgcucaucccacccgccca

SEQ ID NO: 34406 - RNA, 13 nt, Homo sapiens
gcgcuccgcgcag

SEQ ID NO: 34407 - RNA, 15 nt, Homo sapiens
gcgcuccgcgcagcu

SEQ ID NO: 34408 - RNA, 18 nt, Homo sapiens
gcgcuccgcgcagcucag

SEQ ID NO: 34409 - RNA, 20 nt, Homo sapiens
gcgcuccucggacggcuccg

SEQ ID NO: 34410 - RNA, 12 nt, Homo sapiens
gcgcucgcuucc

SEQ ID NO: 34411 - RNA, 14 nt, Homo sapiens
gcgggagggcgcgg

SEQ ID NO: 34412 - RNA, 15 nt, Homo sapiens
gcgggagggcgcggg

SEQ ID NO: 34413 - RNA, 14 nt, Homo sapiens
gcggggagcgagcc

SEQ ID NO: 34414 - RNA, 23 nt, Homo sapiens
gcggggagcgagccccaggcggg

SEQ ID NO: 34415 - RNA, 17 nt, Homo sapiens
gcgcucgcuuccgcauc

SEQ ID NO: 34416 - RNA, 19 nt, Homo sapiens
gcgcucgcuuccgcauccu

SEQ ID NO: 34417 - RNA, 13 nt, Homo sapiens
gcgcucggccugc

SEQ ID NO: 34418 - RNA, 15 nt, Homo sapiens
gcgcucggccugcuc

SEQ ID NO: 34419 - RNA, 16 nt, Homo sapiens
gcgcucggccugcucg

SEQ ID NO: 34420 - RNA, 17 nt, Homo sapiens
gcgcucggccugcucgc

SEQ ID NO: 34421 - RNA, 21 nt, Homo sapiens
gcgcucggccugcucgcccac

SEQ ID NO: 34422 - RNA, 23 nt, Homo sapiens
gcgcucggccugcucgcccacuu

SEQ ID NO: 34423 - RNA, 14 nt, Homo sapiens
gcgcugcgcgccgc

SEQ ID NO: 34424 - RNA, 19 nt, Homo sapiens
gcgcugcgcgccgcgcucc

SEQ ID NO: 34425 - RNA, 15 nt, Homo sapiens
gcggcccugugcggc

SEQ ID NO: 34426 - RNA, 16 nt, Homo sapiens
gcggcccugugcggcc

SEQ ID NO: 34427 - RNA, 22 nt, Homo sapiens
gcggcccugugcggccuggucu

SEQ ID NO: 34428 - RNA, 13 nt, Homo sapiens
gcggccuggucua

SEQ ID NO: 34429 - RNA, 22 nt, Homo sapiens
gcggccuggucuaccuguucgc

SEQ ID NO: 34430 - RNA, 17 nt, Homo sapiens
gcggcggcccugugcgg

SEQ ID NO: 34431 - RNA, 17 nt, Homo sapiens
gcggcgggagggcgcgg

SEQ ID NO: 34432 - RNA, 18 nt, Homo sapiens
gcgcagcucaggcuggca

SEQ ID NO: 34433 - RNA, 19 nt, Homo sapiens
gcgaguacuucccgcuguu

SEQ ID NO: 34434 - RNA, 21 nt, Homo sapiens
gcgaguacuucccgcuguucc

SEQ ID NO: 34435 - RNA, 23 nt, Homo sapiens
gcgaguacuucccgcuguuccuc

SEQ ID NO: 34436 - RNA, 13 nt, Homo sapiens
gcgagccccaggc

SEQ ID NO: 34437 - RNA, 15 nt, Homo sapiens
gcgagcgcgcgcgcc

SEQ ID NO: 34438 - RNA, 17 nt, Homo sapiens
gcgagcgcgcgcgcccu

SEQ ID NO: 34439 - RNA, 12 nt, Homo sapiens
gcgaguacuucc

SEQ ID NO: 34440 - RNA, 16 nt, Homo sapiens
gcgcccucuggcugcu

SEQ ID NO: 34441 - RNA, 18 nt, Homo sapiens
gcgcccucuggcugcugg

SEQ ID NO: 34442 - RNA, 19 nt, Homo sapiens
gcgcccucuggcugcuggu

SEQ ID NO: 34443 - RNA, 20 nt, Homo sapiens
gcgcccucuggcugcuggug

SEQ ID NO: 34444 - RNA, 18 nt, Homo sapiens
gcgccgcgcuccucggac

SEQ ID NO: 34445 - RNA, 21 nt, Homo sapiens
gccuggucuaccuguucgcgc

SEQ ID NO: 34446 - RNA, 20 nt, Homo sapiens
gccugagaccaaggcccccg

SEQ ID NO: 34447 - RNA, 21 nt, Homo sapiens
gccugagaccaaggcccccgg

SEQ ID NO: 34448 - RNA, 23 nt, Homo sapiens
gccugagaccaaggcccccgggc

SEQ ID NO: 34449 - RNA, 13 nt, Homo sapiens
gccugcucgccca

SEQ ID NO: 34450 - RNA, 15 nt, Homo sapiens
gccugcucgcccacu

SEQ ID NO: 34451 - RNA, 23 nt, Homo sapiens
gccugcucgcccacuuccucccg

SEQ ID NO: 34452 - RNA, 11 nt, Homo sapiens
gccuccagcug

SEQ ID NO: 34453 - RNA, 15 nt, Homo sapiens
gccuccagcugcccc

SEQ ID NO: 34454 - RNA, 16 nt, Homo sapiens
gccuccagcugccccg

SEQ ID NO: 34455 - RNA, 19 nt, Homo sapiens
gccuccagcugccccgggg

SEQ ID NO: 34456 - RNA, 20 nt, Homo sapiens
gccuccagcugccccgggga

SEQ ID NO: 34457 - RNA, 21 nt, Homo sapiens
gccuccgcuacuuccagggcu

SEQ ID NO: 34458 - RNA, 14 nt, Homo sapiens
gccgcgcuccucgg

SEQ ID NO: 34459 - RNA, 19 nt, Homo sapiens
gccgcgcuccucggacggc

SEQ ID NO: 34460 - RNA, 12 nt, Homo sapiens
gccgcgcugcgc

SEQ ID NO: 34461 - RNA, 13 nt, Homo sapiens
gccgcgcugcgcg

SEQ ID NO: 34462 - RNA, 17 nt, Homo sapiens
gccgcgcugcgcgccgc

SEQ ID NO: 34463 - RNA, 19 nt, Homo sapiens
gccgcgcugcgcgccgcgc

SEQ ID NO: 34464 - RNA, 20 nt, Homo sapiens
gccgcgcugcgcgccgcgcu

SEQ ID NO: 34465 - RNA, 23 nt, Homo sapiens
gccgcgcugcgcgccgcgcuccu

SEQ ID NO: 34466 - RNA, 14 nt, Homo sapiens
gccccggggagggg

SEQ ID NO: 34467 - RNA, 12 nt, Homo sapiens
gccgugggccug

SEQ ID NO: 34468 - RNA, 11 nt, Homo sapiens
gaggggcgcuc

SEQ ID NO: 34469 - RNA, 12 nt, Homo sapiens
gaggggcgcucg

SEQ ID NO: 34470 - RNA, 13 nt, Homo sapiens
gaggggcgcucgc

SEQ ID NO: 34471 - RNA, 15 nt, Homo sapiens
gaggggcgcucgcuu

SEQ ID NO: 34472 - RNA, 18 nt, Homo sapiens
gaggggcgcucgcuuccg

SEQ ID NO: 34473 - RNA, 19 nt, Homo sapiens
gaggggcgcucgcuuccgc

SEQ ID NO: 34474 - RNA, 11 nt, Homo sapiens
gagcucguggg

SEQ ID NO: 34475 - RNA, 12 nt, Homo sapiens
gagcagucagga

SEQ ID NO: 34476 - RNA, 13 nt, Homo sapiens
gagcgagccccag

SEQ ID NO: 34477 - RNA, 15 nt, Homo sapiens
gagcgagccccaggc

SEQ ID NO: 34478 - RNA, 12 nt, Homo sapiens
gagcgcgcgcgc

SEQ ID NO: 34479 - RNA, 15 nt, Homo sapiens
gagcgcgcgcgcccu

SEQ ID NO: 34480 - RNA, 20 nt, Homo sapiens
gagcgcgcgcgcccucuggc

SEQ ID NO: 34481 - RNA, 14 nt, Homo sapiens
gagccggagccucc

SEQ ID NO: 34482 - RNA, 15 nt, Homo sapiens
gagccggagccucca

SEQ ID NO: 34483 - RNA, 16 nt, Homo sapiens
gagccggagccuccag

SEQ ID NO: 34484 - RNA, 17 nt, Homo sapiens
gagccggagccuccagc

SEQ ID NO: 34485 - RNA, 18 nt, Homo sapiens
gagccggagccuccagcu

SEQ ID NO: 34486 - RNA, 20 nt, Homo sapiens
gagccggagccuccagcugc

SEQ ID NO: 34487 - RNA, 22 nt, Homo sapiens
gagccggagccuccagcugccc

SEQ ID NO: 34488 - RNA, 13 nt, Homo sapiens
gagccgggaaaga

SEQ ID NO: 34489 - RNA, 17 nt, Homo sapiens
gagccgggaaagaagag

SEQ ID NO: 34490 - RNA, 22 nt, Homo sapiens
gcaccgcuguacgcgagcgcgc

SEQ ID NO: 34491 - RNA, 18 nt, Homo sapiens
gcagcauaaauguugaca

SEQ ID NO: 34492 - RNA, 21 nt, Homo sapiens
gaugguucccuugaugaagaa

SEQ ID NO: 34493 - RNA, 16 nt, Homo sapiens
gaugcaguucugaaga

SEQ ID NO: 34494 - RNA, 15 nt, Homo sapiens
gauguauagguugau

SEQ ID NO: 34495 - RNA, 22 nt, Homo sapiens
gcaaauugucacaggacagccc

SEQ ID NO: 34496 - RNA, 14 nt, Homo sapiens
gaccaaggcccccg

SEQ ID NO: 34497 - RNA, 15 nt, Homo sapiens
gaccaaggcccccgg

SEQ ID NO: 34498 - RNA, 17 nt, Homo sapiens
gaccaaggcccccgggc

SEQ ID NO: 34499 - RNA, 21 nt, Homo sapiens
gaccaaggcccccgggccgac

SEQ ID NO: 34500 - RNA, 22 nt, Homo sapiens
gaccaaggcccccgggccgacg

SEQ ID NO: 34501 - RNA, 24 nt, Homo sapiens
gaccaaggcccccgggccgacgga

SEQ ID NO: 34502 - RNA, 13 nt, Homo sapiens
gacacacaugaag

SEQ ID NO: 34503 - RNA, 14 nt, Homo sapiens
gacacacugaagaa

SEQ ID NO: 34504 - RNA, 12 nt, Homo sapiens
gaauuggagcuc

SEQ ID NO: 34505 - RNA, 18 nt, Homo sapiens
gaacaguuaccucugccu

SEQ ID NO: 34506 - RNA, 11 nt, Homo sapiens
gaagaacugaa

SEQ ID NO: 34507 - RNA, 18 nt, Homo sapiens
gaagaagcaccaaucaug

SEQ ID NO: 34508 - RNA, 20 nt, Homo sapiens
gaagagccggagccuccagc

SEQ ID NO: 34509 - RNA, 22 nt, Homo sapiens
gaagagccggagccuccagcug

SEQ ID NO: 34510 - RNA, 12 nt, Homo sapiens
gaaggggcggcg

SEQ ID NO: 34511 - RNA, 13 nt, Homo sapiens
gaaggggcggcgg

SEQ ID NO: 34512 - RNA, 14 nt, Homo sapiens
gaaggggcggcggc

SEQ ID NO: 34513 - RNA, 16 nt, Homo sapiens
gaaggggcggcggccc

SEQ ID NO: 34514 - RNA, 13 nt, Homo sapiens
gacgcugcugccg

SEQ ID NO: 34515 - RNA, 14 nt, Homo sapiens
gacgcugcugccgu

SEQ ID NO: 34516 - RNA, 15 nt, Homo sapiens
gacgcugcugccgug

SEQ ID NO: 34517 - RNA, 16 nt, Homo sapiens
gacgcugcugccgugg

SEQ ID NO: 34518 - RNA, 15 nt, Homo sapiens
gacggcuccggacgc

SEQ ID NO: 34519 - RNA, 19 nt, Homo sapiens
gacggcuccggacgcugcu

SEQ ID NO: 34520 - RNA, 20 nt, Homo sapiens
gacggcuccggacgcugcug

SEQ ID NO: 34521 - RNA, 12 nt, Homo sapiens
gaccaucccggc

SEQ ID NO: 34522 - RNA, 13 nt, Homo sapiens
gaccaucccggcc

SEQ ID NO: 34523 - RNA, 14 nt, Homo sapiens
gaccaucccggccg

SEQ ID NO: 34524 - RNA, 15 nt, Homo sapiens
gaccaucccggccgg

SEQ ID NO: 34525 - RNA, 19 nt, Homo sapiens
gaccaucccggccggcgcg

SEQ ID NO: 34526 - RNA, 22 nt, Homo sapiens
gaccaucccggccggcgcgcuc

SEQ ID NO: 34527 - RNA, 23 nt, Homo sapiens
gaccaucccggccggcgcgcuca

SEQ ID NO: 34528 - RNA, 12 nt, Homo sapiens
auggcuuccugg

SEQ ID NO: 34529 - RNA, 21 nt, Homo sapiens
augggacauuugcucauggaa

SEQ ID NO: 34530 - RNA, 16 nt, Homo sapiens
auuauagucacuaguu

SEQ ID NO: 34531 - RNA, 15 nt, Homo sapiens
caaggcccccgggcc

SEQ ID NO: 34532 - RNA, 16 nt, Homo sapiens
caaggcccccgggccg

SEQ ID NO: 34533 - RNA, 17 nt, Homo sapiens
caaggcccccgggccga

SEQ ID NO: 34534 - RNA, 14 nt, Homo sapiens
cacaggggacagga

SEQ ID NO: 34535 - RNA, 12 nt, Homo sapiens
cacacugaagaa

SEQ ID NO: 34536 - RNA, 13 nt, Homo sapiens
cacacugaagaag

SEQ ID NO: 34537 - RNA, 13 nt, Homo sapiens
cacccgcccaccg

SEQ ID NO: 34538 - RNA, 15 nt, Homo sapiens
cacccgcccaccgca

SEQ ID NO: 34539 - RNA, 18 nt, Homo sapiens
cacccgcccaccgcaggg

SEQ ID NO: 34540 - RNA, 22 nt, Homo sapiens
caccgcagggugaacugcagcg

SEQ ID NO: 34541 - RNA, 23 nt, Homo sapiens
caccgcagggugaacugcagcga

SEQ ID NO: 34542 - RNA, 20 nt, Homo sapiens
caccgcuguacgcgagcgcg

SEQ ID NO: 34543 - RNA, 23 nt, Homo sapiens
caccgcuguacgcgagcgcgcgc

SEQ ID NO: 34544 - RNA, 19 nt, Homo sapiens
cacgcucugggucgccggc

SEQ ID NO: 34545 - RNA, 20 nt, Homo sapiens
cacgcucugggucgccggca

SEQ ID NO: 34546 - RNA, 12 nt, Homo sapiens
aguguuggagaa

SEQ ID NO: 34547 - RNA, 24 nt, Homo sapiens
aguucugaagaagaugguaccacc

SEQ ID NO: 34548 - RNA, 13 nt, Homo sapiens
augaauaucaguu

SEQ ID NO: 34549 - RNA, 12 nt, Homo sapiens
augaaggggcgg

SEQ ID NO: 34550 - RNA, 13 nt, Homo sapiens
augaaggggcggc

SEQ ID NO: 34551 - RNA, 17 nt, Homo sapiens
augaaggggcggcggcc

SEQ ID NO: 34552 - RNA, 20 nt, Homo sapiens
augaaggggcggcggcccug

SEQ ID NO: 34553 - RNA, 16 nt, Homo sapiens
aucauuaaaguucuag

SEQ ID NO: 34554 - RNA, 12 nt, Homo sapiens
aucccggccggc

SEQ ID NO: 34555 - RNA, 13 nt, Homo sapiens
aucccggccggcg

SEQ ID NO: 34556 - RNA, 14 nt, Homo sapiens
aucccggccggcgc

SEQ ID NO: 34557 - RNA, 21 nt, Homo sapiens
aucagccuaguugaucagcuu

SEQ ID NO: 34558 - RNA, 12 nt, Homo sapiens
auauuugaaaua

SEQ ID NO: 34559 - RNA, 10 nt, Homo sapiens
aggaugguuc

SEQ ID NO: 34560 - RNA, 11 nt, Homo sapiens
aggaugguucc

SEQ ID NO: 34561 - RNA, 18 nt, Homo sapiens
aggaccaucccggccggc

SEQ ID NO: 34562 - RNA, 20 nt, Homo sapiens
aggaccaucccggccggcgc

SEQ ID NO: 34563 - RNA, 14 nt, Homo sapiens
aggcuggcaccgcu

SEQ ID NO: 34564 - RNA, 15 nt, Homo sapiens
aggcuggcaccgcug

SEQ ID NO: 34565 - RNA, 17 nt, Homo sapiens
aggcggguccgggucgc

SEQ ID NO: 34566 - RNA, 20 nt, Homo sapiens
aggcggguccgggucgcagg

SEQ ID NO: 34567 - RNA, 22 nt, Homo sapiens
aggcggguccgggucgcaggac

SEQ ID NO: 34568 - RNA, 13 nt, Homo sapiens
aggcccccgggcc

SEQ ID NO: 34569 - RNA, 15 nt, Homo sapiens
aggcccccgggccga

SEQ ID NO: 34570 - RNA, 17 nt, Homo sapiens
aggcccccgggccgacg

SEQ ID NO: 34571 - RNA, 19 nt, Homo sapiens
aggcccccgggccgacgga

SEQ ID NO: 34572 - RNA, 20 nt, Homo sapiens
aggcccccgggccgacggag

SEQ ID NO: 34573 - RNA, 15 nt, Homo sapiens
agcugccccggggag

SEQ ID NO: 34574 - RNA, 23 nt, Homo sapiens
agcugccccggggaggggcgcuc

SEQ ID NO: 34575 - RNA, 11 nt, Homo sapiens
agcgcgcgcgc

SEQ ID NO: 34576 - RNA, 13 nt, Homo sapiens
agcgcgcgcgccc

SEQ ID NO: 34577 - RNA, 15 nt, Homo sapiens
agcgcgcgcgcccuc

SEQ ID NO: 34578 - RNA, 14 nt, Homo sapiens
agcgagccccaggc

SEQ ID NO: 34579 - RNA, 21 nt, Homo sapiens
agcgagccccaggcggguccg

SEQ ID NO: 34580 - RNA, 14 nt, Homo sapiens
agcgaguacuuccc

SEQ ID NO: 34581 - RNA, 13 nt, Homo sapiens
agcucaggcuggc

SEQ ID NO: 34582 - RNA, 16 nt, Homo sapiens
agcucaggcuggcacc

SEQ ID NO: 34583 - RNA, 19 nt, Homo sapiens
agcucaggcuggcaccgcu

SEQ ID NO: 34584 - RNA, 20 nt, Homo sapiens
agcucaggcuggcaccgcug

SEQ ID NO: 34585 - RNA, 23 nt, Homo sapiens
agcucaggcuggcaccgcuguac

SEQ ID NO: 34586 - RNA, 13 nt, Homo sapiens
agcucgugggaca

SEQ ID NO: 34587 - RNA, 11 nt, Homo sapiens
aggggcgcucg

SEQ ID NO: 34588 - RNA, 12 nt, Homo sapiens
aggggcgcucgc

SEQ ID NO: 34589 - RNA, 15 nt, Homo sapiens
agggcgcggggcggg

SEQ ID NO: 34590 - RNA, 16 nt, Homo sapiens
agggcgcggggcgggg

SEQ ID NO: 34591 - RNA, 18 nt, Homo sapiens
agggcgcggggcggggag

SEQ ID NO: 34592 - RNA, 15 nt, Homo sapiens
agggcuacgcgcgcu

SEQ ID NO: 34593 - RNA, 16 nt, Homo sapiens
agggcuacgcgcgcuc

SEQ ID NO: 34594 - RNA, 17 nt, Homo sapiens
agggcuacgcgcgcucc

SEQ ID NO: 34595 - RNA, 20 nt, Homo sapiens
agggcuacgcgcgcuccgcg

SEQ ID NO: 34596 - RNA, 21 nt, Homo sapiens
agggcuacgcgcgcuccgcgc

SEQ ID NO: 34597 - RNA, 15 nt, Homo sapiens
agggugaacugcagc

SEQ ID NO: 34598 - RNA, 13 nt, Homo sapiens
aggggcgcucgcu

SEQ ID NO: 34599 - RNA, 14 nt, Homo sapiens
aggggcgcucgcuu

SEQ ID NO: 34600 - RNA, 17 nt, Homo sapiens
aggggcgcucgcuuccg

SEQ ID NO: 34601 - RNA, 18 nt, Homo sapiens
aggggcgcucgcuuccgc

SEQ ID NO: 34602 - RNA, 22 nt, Homo sapiens
aggggcgcucgcuuccgcaucc

SEQ ID NO: 34603 - RNA, 14 nt, Homo sapiens
aggggcggcggccc

SEQ ID NO: 34604 - RNA, 20 nt, Homo sapiens
aggggcggcggcccugugcg

SEQ ID NO: 34605 - RNA, 15 nt, Homo sapiens
agucaccucauggaa

SEQ ID NO: 34606 - RNA, 22 nt, Homo sapiens
agucucuaucauuaaaguucua

SEQ ID NO: 34607 - RNA, 23 nt, Homo sapiens
agucucuaucauuaaaguucuag

SEQ ID NO: 34608 - RNA, 22 nt, Homo sapiens
aguacuucccgcuguuccucgc

SEQ ID NO: 34609 - RNA, 23 nt, Homo sapiens
aguacuucccgcuguuccucgcc

SEQ ID NO: 34610 - RNA, 13 nt, Homo sapiens
accuguucgcgcg

SEQ ID NO: 34611 - RNA, 14 nt, Homo sapiens
accuguucgcgcgc

SEQ ID NO: 34612 - RNA, 22 nt, Homo sapiens
uuugaacuagaguuuagcugga

SEQ ID NO: 34613 - RNA, 14 nt, Homo sapiens
acgcgagcgcgcgc

SEQ ID NO: 34614 - RNA, 15 nt, Homo sapiens
acgcgagcgcgcgcg

SEQ ID NO: 34615 - RNA, 16 nt, Homo sapiens
acgcgagcgcgcgcgc

SEQ ID NO: 34616 - RNA, 17 nt, Homo sapiens
acgcgagcgcgcgcgcc

SEQ ID NO: 34617 - RNA, 19 nt, Homo sapiens
acgcgagcgcgcgcgcccu

SEQ ID NO: 34618 - RNA, 14 nt, Homo sapiens
acgcgcgcuccgcg

SEQ ID NO: 34619 - RNA, 15 nt, Homo sapiens
acgcgcgcuccgcgc

SEQ ID NO: 34620 - RNA, 16 nt, Homo sapiens
acgcgcgcuccgcgca

SEQ ID NO: 34621 - RNA, 17 nt, Homo sapiens
acgcgcgcuccgcgcag

SEQ ID NO: 34622 - RNA, 18 nt, Homo sapiens
acgcgcgcuccgcgcagc

SEQ ID NO: 34623 - RNA, 20 nt, Homo sapiens
acgcgcgcuccgcgcagcuc

SEQ ID NO: 34624 - RNA, 16 nt, Homo sapiens
acgcucugggucgccg

SEQ ID NO: 34625 - RNA, 17 nt, Homo sapiens
acgcucugggucgccgg

SEQ ID NO: 34626 - RNA, 19 nt, Homo sapiens
acgcucugggucgccggca

SEQ ID NO: 34627 - RNA, 20 nt, Homo sapiens
acgcucugggucgccggcau

SEQ ID NO: 34628 - RNA, 21 nt, Homo sapiens
acgcucugggucgccggcauc

SEQ ID NO: 34629 - RNA, 13 nt, Homo sapiens
acgcugcugccgu

SEQ ID NO: 34630 - RNA, 13 nt, Homo sapiens
acggagccgggaa

SEQ ID NO: 34631 - RNA, 12 nt, Homo sapiens
acggcuccggac

SEQ ID NO: 34632 - RNA, 14 nt, Homo sapiens
acggcuccggacgc

SEQ ID NO: 34633 - RNA, 18 nt, Homo sapiens
acggcuccggacgcugcu

SEQ ID NO: 34634 - RNA, 15 nt, Homo sapiens
acuccaaacugacuc

SEQ ID NO: 34635 - RNA, 17 nt, Homo sapiens
acuccaaacugacucuu

SEQ ID NO: 34636 - RNA, 9 nt, Homo sapiens
acugggaca

SEQ ID NO: 34637 - RNA, 11 nt, Homo sapiens
uuugugaagca

SEQ ID NO: 34638 - RNA, 12 nt, Homo sapiens
uuugugaagcaa

SEQ ID NO: 34639 - RNA, 23 nt, Homo sapiens
accgcuguacgcgagcgcgcgcg

SEQ ID NO: 34640 - RNA, 22 nt, Homo sapiens
accgcagggugaacugcagcga

SEQ ID NO: 34641 - RNA, 17 nt, Homo sapiens
accgcuguacgcgagcg

SEQ ID NO: 34642 - RNA, 20 nt, Homo sapiens
accgcuguacgcgagcgcgc

SEQ ID NO: 34643 - RNA, 22 nt, Homo sapiens
accgcuguacgcgagcgcgcgc

SEQ ID NO: 34644 - RNA, 15 nt, Homo sapiens
uuggggcugaugcag

SEQ ID NO: 34645 - RNA, 16 nt, Homo sapiens
uuucaugaaggggcgg

SEQ ID NO: 34646 - RNA, 19 nt, Homo sapiens
uuucaugaaggggcggcgg

SEQ ID NO: 34647 - RNA, 12 nt, Homo sapiens
agccggagccuc

SEQ ID NO: 34648 - RNA, 16 nt, Homo sapiens
agccggagccuccagc

SEQ ID NO: 34649 - RNA, 17 nt, Homo sapiens
agccggagccuccagcu

SEQ ID NO: 34650 - RNA, 18 nt, Homo sapiens
agccggagccuccagcug

SEQ ID NO: 34651 - RNA, 19 nt, Homo sapiens
agccggagccuccagcugc

SEQ ID NO: 34652 - RNA, 20 nt, Homo sapiens
agccggagccuccagcugcc

SEQ ID NO: 34653 - RNA, 23 nt, Homo sapiens
agccggagccuccagcugccccg

SEQ ID NO: 34654 - RNA, 13 nt, Homo sapiens
agccgggaaagaa

SEQ ID NO: 34655 - RNA, 23 nt, Homo sapiens
agccuuggggcugaugcaguugu

SEQ ID NO: 34656 - RNA, 21 nt, Homo sapiens
agccgggaaagaagagccgga

SEQ ID NO: 34657 - RNA, 23 nt, Homo sapiens
agccgggaaagaagagccggagc

SEQ ID NO: 34658 - RNA, 15 nt, Homo sapiens
agccuaguugaucag

SEQ ID NO: 34659 - RNA, 14 nt, Homo sapiens
agccuccagcugcc

SEQ ID NO: 34660 - RNA, 16 nt, Homo sapiens
agccuccagcugcccc

SEQ ID NO: 34661 - RNA, 17 nt, Homo sapiens
agccuccagcugccccg

SEQ ID NO: 34662 - RNA, 18 nt, Homo sapiens
agccuccagcugccccgg

SEQ ID NO: 34663 - RNA, 16 nt, Homo sapiens
agauguauguacuuca

SEQ ID NO: 34664 - RNA, 10 nt, Homo sapiens
agccccaggc

SEQ ID NO: 34665 - RNA, 11 nt, Homo sapiens
agccccaggcg

SEQ ID NO: 34666 - RNA, 12 nt, Homo sapiens
agccccaggcgg

SEQ ID NO: 34667 - RNA, 22 nt, Homo sapiens
agccccaggcggguccgggucg

SEQ ID NO: 34668 - RNA, 15 nt, Homo sapiens
agccagcacagccuc

SEQ ID NO: 34669 - RNA, 12 nt, Homo sapiens
agaagagccgga

SEQ ID NO: 34670 - RNA, 14 nt, Homo sapiens
agaagagccggagc

SEQ ID NO: 34671 - RNA, 15 nt, Homo sapiens
agaagagccggagcc

SEQ ID NO: 34672 - RNA, 21 nt, Homo sapiens
agaagaugguaccaccagucu

SEQ ID NO: 34673 - RNA, 20 nt, Homo sapiens
acuuccagggcuacgcgcgc

SEQ ID NO: 34674 - RNA, 21 nt, Homo sapiens
acuuccagggcuacgcgcgcu

SEQ ID NO: 34675 - RNA, 20 nt, Homo sapiens
acuucccgcuguuccucgcc

SEQ ID NO: 34676 - RNA, 21 nt, Homo sapiens
acuucccgcuguuccucgcca

SEQ ID NO: 34677 - RNA, 13 nt, Homo sapiens
acuuccucccggc

SEQ ID NO: 34678 - RNA, 14 nt, Homo sapiens
acuuccucccggcc

SEQ ID NO: 34679 - RNA, 17 nt, Homo sapiens
acuuccucccggccgcg

SEQ ID NO: 34680 - RNA, 18 nt, Homo sapiens
acuuccucccggccgcgc

SEQ ID NO: 34681 - RNA, 19 nt, Homo sapiens
acuuccucccggccgcgcu

SEQ ID NO: 34682 - RNA, 23 nt, Homo sapiens
acuuccucccggccgcgcugcgc

SEQ ID NO: 34683 - RNA, 15 nt, Homo sapiens
agagaaugagagaca

SEQ ID NO: 34684 - RNA, 12 nt, Homo sapiens
agagccggagcc

SEQ ID NO: 34685 - RNA, 18 nt, Homo sapiens
agagccggagccuccagc

SEQ ID NO: 34686 - RNA, 14 nt, Homo sapiens
agauccuggaaauc

SEQ ID NO: 34687 - RNA, 21 nt, Homo sapiens
uuagaugcaguucugaagaag

SEQ ID NO: 34688 - RNA, 12 nt, Homo sapiens
uuagcuggaaaa

SEQ ID NO: 34689 - RNA, 15 nt, Homo sapiens
uucaugaaggggcgg

SEQ ID NO: 34690 - RNA, 17 nt, Homo sapiens
uucaugaaggggcggcg

SEQ ID NO: 34691 - RNA, 18 nt, Homo sapiens
uucaugaaggggcggcgg

SEQ ID NO: 34692 - RNA, 19 nt, Homo sapiens
uucaugaaggggcggcggc

SEQ ID NO: 34693 - RNA, 14 nt, Homo sapiens
uuccagauccugga

SEQ ID NO: 34694 - RNA, 17 nt, Homo sapiens
uuccagggcuacgcgcg

SEQ ID NO: 34695 - RNA, 18 nt, Homo sapiens
uuccagggcuacgcgcgc

SEQ ID NO: 34696 - RNA, 19 nt, Homo sapiens
uuccagggcuacgcgcgcu

SEQ ID NO: 34697 - RNA, 20 nt, Homo sapiens
uuccagggcuacgcgcgcuc

SEQ ID NO: 34698 - RNA, 18 nt, Homo sapiens
uuccaucaaggguacacu

SEQ ID NO: 34699 - RNA, 12 nt, Homo sapiens
uuccgcauccua

SEQ ID NO: 34700 - RNA, 14 nt, Homo sapiens
uuccucccggccgc

SEQ ID NO: 34701 - RNA, 15 nt, Homo sapiens
uuccucccggccgcg

SEQ ID NO: 34702 - RNA, 12 nt, Homo sapiens
uucgcgcgccuc

SEQ ID NO: 34703 - RNA, 13 nt, Homo sapiens
uucgcgcgccucc

SEQ ID NO: 34704 - RNA, 17 nt, Homo sapiens
acaguuaccucugccuc

SEQ ID NO: 34705 - RNA, 13 nt, Homo sapiens
uucuagugaccga

SEQ ID NO: 34706 - RNA, 18 nt, Homo sapiens
acagcccuucuuuccaca

SEQ ID NO: 34707 - RNA, 11 nt, Homo sapiens
accaucccggc

SEQ ID NO: 34708 - RNA, 12 nt, Homo sapiens
accaucccggcc

SEQ ID NO: 34709 - RNA, 15 nt, Homo sapiens
accaucccggccggc

SEQ ID NO: 34710 - RNA, 21 nt, Homo sapiens
accaucccggccggcgcgcuc

SEQ ID NO: 34711 - RNA, 15 nt, Homo sapiens
acccgcccaccgcag

SEQ ID NO: 34712 - RNA, 17 nt, Homo sapiens
accaaaccagagccuga

SEQ ID NO: 34713 - RNA, 19 nt, Homo sapiens
accaaggcccccgggccga

SEQ ID NO: 34714 - RNA, 20 nt, Homo sapiens
accaaggcccccgggccgac

SEQ ID NO: 34715 - RNA, 22 nt, Homo sapiens
accaaggcccccgggccgacgg

SEQ ID NO: 34716 - RNA, 16 nt, Homo sapiens
uggggcugaugcaguu

SEQ ID NO: 34717 - RNA, 18 nt, Homo sapiens
uggggcugaugcaguugu

SEQ ID NO: 34718 - RNA, 12 nt, Homo sapiens
ugggucgccggc

SEQ ID NO: 34719 - RNA, 13 nt, Homo sapiens
ugggucgccggca

SEQ ID NO: 34720 - RNA, 20 nt, Homo sapiens
uggucuaccuguucgcgcgc

SEQ ID NO: 34721 - RNA, 20 nt, Homo sapiens
uguacgcgagcgcgcgcgcc

SEQ ID NO: 34722 - RNA, 21 nt, Homo sapiens
uguacgcgagcgcgcgcgccc

SEQ ID NO: 34723 - RNA, 23 nt, Homo sapiens
uguacgcgagcgcgcgcgcccuc

SEQ ID NO: 34724 - RNA, 19 nt, Homo sapiens
ugugggcaauguucccccu

SEQ ID NO: 34725 - RNA, 11 nt, Homo sapiens
ugugcggccug

SEQ ID NO: 34726 - RNA, 14 nt, Homo sapiens
ugugcggccugguc

SEQ ID NO: 34727 - RNA, 15 nt, Homo sapiens
uguuccucgccacgc

SEQ ID NO: 34728 - RNA, 17 nt, Homo sapiens
uguucgcgcgccuccgc

SEQ ID NO: 34729 - RNA, 19 nt, Homo sapiens
uguucgcgcgccuccgcua

SEQ ID NO: 34730 - RNA, 15 nt, Homo sapiens
ugcugguggcgcugg

SEQ ID NO: 34731 - RNA, 16 nt, Homo sapiens
ugcugguggcgcuggc

SEQ ID NO: 34732 - RNA, 20 nt, Homo sapiens
ugcugguggcgcuggcugcg

SEQ ID NO: 34733 - RNA, 21 nt, Homo sapiens
ugcugguggcgcuggcugcgc

SEQ ID NO: 34734 - RNA, 11 nt, Homo sapiens
ugcugccgugg

SEQ ID NO: 34735 - RNA, 12 nt, Homo sapiens
ugcugccguggg

SEQ ID NO: 34736 - RNA, 14 nt, Homo sapiens
ugcugccgugggcc

SEQ ID NO: 34737 - RNA, 16 nt, Homo sapiens
ugcugccgugggccug

SEQ ID NO: 34738 - RNA, 19 nt, Homo sapiens
ugcugccgugggccugaga

SEQ ID NO: 34739 - RNA, 17 nt, Homo sapiens
uggaauuggagcucgug

SEQ ID NO: 34740 - RNA, 14 nt, Homo sapiens
uggcgcuggcugcg

SEQ ID NO: 34741 - RNA, 16 nt, Homo sapiens
uggcgcuggcugcgcu

SEQ ID NO: 34742 - RNA, 14 nt, Homo sapiens
uggcugcgcucggc

SEQ ID NO: 34743 - RNA, 18 nt, Homo sapiens
uggcugcgcucggccugc

SEQ ID NO: 34744 - RNA, 15 nt, Homo sapiens
uggcugcugguggcg

SEQ ID NO: 34745 - RNA, 19 nt, Homo sapiens
uggcugcugguggcgcugg

SEQ ID NO: 34746 - RNA, 22 nt, Homo sapiens
uggcugcugguggcgcuggcug

SEQ ID NO: 34747 - RNA, 15 nt, Homo sapiens
ugggacagucaccuc

SEQ ID NO: 34748 - RNA, 13 nt, Homo sapiens
cgccacgcucugg

SEQ ID NO: 34749 - RNA, 14 nt, Homo sapiens
cgccacgcucuggg

SEQ ID NO: 34750 - RNA, 18 nt, Homo sapiens
cgccacgcucugggucgc

SEQ ID NO: 34751 - RNA, 19 nt, Homo sapiens
cgccacgcucugggucgcc

SEQ ID NO: 34752 - RNA, 20 nt, Homo sapiens
cgccacgcucugggucgccg

SEQ ID NO: 34753 - RNA, 23 nt, Homo sapiens
cgccacgcucugggucgccggca

SEQ ID NO: 34754 - RNA, 13 nt, Homo sapiens
cgcccaccgcagg

SEQ ID NO: 34755 - RNA, 14 nt, Homo sapiens
cgcccacuuccucc

SEQ ID NO: 34756 - RNA, 17 nt, Homo sapiens
cgcccacuuccucccgg

SEQ ID NO: 34757 - RNA, 18 nt, Homo sapiens
cgcccacuuccucccggc

SEQ ID NO: 34758 - RNA, 19 nt, Homo sapiens
cgcccacuuccucccggcc

SEQ ID NO: 34759 - RNA, 21 nt, Homo sapiens
cgcccacuuccucccggccgc

SEQ ID NO: 34760 - RNA, 23 nt, Homo sapiens
cgcccacuuccucccggccgcgc

SEQ ID NO: 34761 - RNA, 11 nt, Homo sapiens
cgcccucuggc

SEQ ID NO: 34762 - RNA, 12 nt, Homo sapiens
cgcccucuggcu

SEQ ID NO: 34763 - RNA, 14 nt, Homo sapiens
cgcccucuggcugc

SEQ ID NO: 34764 - RNA, 17 nt, Homo sapiens
cgcccucuggcugcugg

SEQ ID NO: 34765 - RNA, 18 nt, Homo sapiens
cgcccucuggcugcuggu

SEQ ID NO: 34766 - RNA, 19 nt, Homo sapiens
cgcccucuggcugcuggug

SEQ ID NO: 34767 - RNA, 21 nt, Homo sapiens
cgcccucuggcugcugguggc

SEQ ID NO: 34768 - RNA, 16 nt, Homo sapiens
cgccgcgcuccucgga

SEQ ID NO: 34769 - RNA, 22 nt, Homo sapiens
cgccgcgcuccucggacggcuc

SEQ ID NO: 34770 - RNA, 14 nt, Homo sapiens
cgccggcaucuucu

SEQ ID NO: 34771 - RNA, 14 nt, Homo sapiens
cgacggagccggga

SEQ ID NO: 34772 - RNA, 16 nt, Homo sapiens
cgacggagccgggaaa

SEQ ID NO: 34773 - RNA, 23 nt, Homo sapiens
cgacggagccgggaaagaagagc

SEQ ID NO: 34774 - RNA, 15 nt, Homo sapiens
cgcagcucaggcugg

SEQ ID NO: 34775 - RNA, 17 nt, Homo sapiens
cgcagcucaggcuggca

SEQ ID NO: 34776 - RNA, 19 nt, Homo sapiens
cgcagcucaggcuggcacc

SEQ ID NO: 34777 - RNA, 22 nt, Homo sapiens
cgcaggaccaucccggccggcg

SEQ ID NO: 34778 - RNA, 12 nt, Homo sapiens
cgagccccaggc

SEQ ID NO: 34779 - RNA, 18 nt, Homo sapiens
cgagccccaggcgggucc

SEQ ID NO: 34780 - RNA, 13 nt, Homo sapiens
cgagcgcgcgcgc

SEQ ID NO: 34781 - RNA, 14 nt, Homo sapiens
cgagcgcgcgcgcc

SEQ ID NO: 34782 - RNA, 15 nt, Homo sapiens
cgagcgcgcgcgccc

SEQ ID NO: 34783 - RNA, 18 nt, Homo sapiens
cgagcgcgcgcgcccucu

SEQ ID NO: 34784 - RNA, 13 nt, Homo sapiens
cgcgcagcucagg

SEQ ID NO: 34785 - RNA, 14 nt, Homo sapiens
cgcgcagcucaggc

SEQ ID NO: 34786 - RNA, 19 nt, Homo sapiens
cgcgcagcucaggcuggca

SEQ ID NO: 34787 - RNA, 19 nt, Homo sapiens
cgcagggugaacugcagcg

SEQ ID NO: 34788 - RNA, 14 nt, Homo sapiens
cgcgagcgcgcgcg

SEQ ID NO: 34789 - RNA, 15 nt, Homo sapiens
cgcgagcgcgcgcgc

SEQ ID NO: 34790 - RNA, 16 nt, Homo sapiens
cgcgagcgcgcgcgcc

SEQ ID NO: 34791 - RNA, 17 nt, Homo sapiens
cgcgagcgcgcgcgccc

SEQ ID NO: 34792 - RNA, 18 nt, Homo sapiens
cgcgagcgcgcgcgcccu

SEQ ID NO: 34793 - RNA, 20 nt, Homo sapiens
cgcgagcgcgcgcgcccucu

SEQ ID NO: 34794 - RNA, 21 nt, Homo sapiens
cgcgcgcccucuggcugcugg

SEQ ID NO: 34795 - RNA, 10 nt, Homo sapiens
cgcgcgccuc

SEQ ID NO: 34796 - RNA, 13 nt, Homo sapiens
cgcgcgccuccgc

SEQ ID NO: 34797 - RNA, 17 nt, Homo sapiens
cgcgcgccuccgcuacu

SEQ ID NO: 34798 - RNA, 23 nt, Homo sapiens
cgcgcgccuccgcuacuuccagg

SEQ ID NO: 34799 - RNA, 11 nt, Homo sapiens
cgcgcgcuccg

SEQ ID NO: 34800 - RNA, 15 nt, Homo sapiens
cgcgcgcuccgcgca

SEQ ID NO: 34801 - RNA, 18 nt, Homo sapiens
cgcgcucaucccacccgc

SEQ ID NO: 34802 - RNA, 20 nt, Homo sapiens
cgcgcucaucccacccgccc

SEQ ID NO: 34803 - RNA, 21 nt, Homo sapiens
cgcgcucaucccacccgccca

SEQ ID NO: 34804 - RNA, 22 nt, Homo sapiens
cgcgcucaucccacccgcccac

SEQ ID NO: 34805 - RNA, 11 nt, Homo sapiens
cgcgcuccgcg

SEQ ID NO: 34806 - RNA, 15 nt, Homo sapiens
cgcgcuccgcgcagc

SEQ ID NO: 34807 - RNA, 17 nt, Homo sapiens
cgcgcuccgcgcagcuc

SEQ ID NO: 34808 - RNA, 15 nt, Homo sapiens
cgcgcuccucggacg

SEQ ID NO: 34809 - RNA, 16 nt, Homo sapiens
cgcgcuccucggacgg

SEQ ID NO: 34810 - RNA, 17 nt, Homo sapiens
cgcgcuccucggacggc

SEQ ID NO: 34811 - RNA, 12 nt, Homo sapiens
cgcgcugcgcgc

SEQ ID NO: 34812 - RNA, 14 nt, Homo sapiens
cgcgcugcgcgccg

SEQ ID NO: 34813 - RNA, 17 nt, Homo sapiens
cgcgcugcgcgccgcgc

SEQ ID NO: 34814 - RNA, 18 nt, Homo sapiens
cgcgcugcgcgccgcgcu

SEQ ID NO: 34815 - RNA, 19 nt, Homo sapiens
cgcgcugcgcgccgcgcuc

SEQ ID NO: 34816 - RNA, 20 nt, Homo sapiens
cgcgcugcgcgccgcgcucc

SEQ ID NO: 34817 - RNA, 19 nt, Homo sapiens
cgcggcgggagggcgcggg

SEQ ID NO: 34818 - RNA, 22 nt, Homo sapiens
cgcggcgggagggcgcggggcg

SEQ ID NO: 34819 - RNA, 12 nt, Homo sapiens
cgcggggcgggg

SEQ ID NO: 34820 - RNA, 15 nt, Homo sapiens
cgcggggcggggagc

SEQ ID NO: 34821 - RNA, 23 nt, Homo sapiens
cgcggggcggggagcgagcccca

SEQ ID NO: 34822 - RNA, 16 nt, Homo sapiens
cgcuacuuccagggcu

SEQ ID NO: 34823 - RNA, 22 nt, Homo sapiens
cgcuacuuccagggcuacgcgc

SEQ ID NO: 34824 - RNA, 13 nt, Homo sapiens
cgcgcccucuggc

SEQ ID NO: 34825 - RNA, 18 nt, Homo sapiens
cgcgcccucuggcugcug

SEQ ID NO: 34826 - RNA, 12 nt, Homo sapiens
cgcgccgcgcuc

SEQ ID NO: 34827 - RNA, 15 nt, Homo sapiens
cgcgccgcgcuccuc

SEQ ID NO: 34828 - RNA, 18 nt, Homo sapiens
cgcgccgcgcuccucgga

SEQ ID NO: 34829 - RNA, 22 nt, Homo sapiens
cgcgccgcgcuccucggacggc

SEQ ID NO: 34830 - RNA, 17 nt, Homo sapiens
cgcucaucccacccgcc

SEQ ID NO: 34831 - RNA, 18 nt, Homo sapiens
cgcucaucccacccgccc

SEQ ID NO: 34832 - RNA, 14 nt, Homo sapiens
cgcuccgcgcagcu

SEQ ID NO: 34833 - RNA, 19 nt, Homo sapiens
cgcuccgcgcagcucaggc

SEQ ID NO: 34834 - RNA, 20 nt, Homo sapiens
cgcuccgcgcagcucaggcu

SEQ ID NO: 34835 - RNA, 13 nt, Homo sapiens
cgcuccucggacg

SEQ ID NO: 34836 - RNA, 15 nt, Homo sapiens
cgcuccucggacggc

SEQ ID NO: 34837 - RNA, 20 nt, Homo sapiens
cgcuccucggacggcuccgg

SEQ ID NO: 34838 - RNA, 14 nt, Homo sapiens
cgcucgcuuccgca

SEQ ID NO: 34839 - RNA, 13 nt, Homo sapiens
cgcucugggucgc

SEQ ID NO: 34840 - RNA, 18 nt, Homo sapiens
cgcucugggucgccggca

SEQ ID NO: 34841 - RNA, 19 nt, Homo sapiens
cgcucugggucgccggcau

SEQ ID NO: 34842 - RNA, 20 nt, Homo sapiens
cgcucugggucgccggcauc

SEQ ID NO: 34843 - RNA, 13 nt, Homo sapiens
cgcugcgcgccgc

SEQ ID NO: 34844 - RNA, 16 nt, Homo sapiens
cgcugcgcgccgcgcu

SEQ ID NO: 34845 - RNA, 13 nt, Homo sapiens
cgcugcugccgug

SEQ ID NO: 34846 - RNA, 19 nt, Homo sapiens
cgcugcugccgugggccug

SEQ ID NO: 34847 - RNA, 11 nt, Homo sapiens
cgcuggcugcg

SEQ ID NO: 34848 - RNA, 12 nt, Homo sapiens
cgcuggcugcgc

SEQ ID NO: 34849 - RNA, 15 nt, Homo sapiens
cgcuggcugcgcucg

SEQ ID NO: 34850 - RNA, 18 nt, Homo sapiens
cgcuggcugcgcucggcc

SEQ ID NO: 34851 - RNA, 19 nt, Homo sapiens
cgcuggcugcgcucggccu

SEQ ID NO: 34852 - RNA, 20 nt, Homo sapiens
cgcuggcugcgcucggccug

SEQ ID NO: 34853 - RNA, 16 nt, Homo sapiens
cgcuguacgcgagcgc

SEQ ID NO: 34854 - RNA, 18 nt, Homo sapiens
cgcuguacgcgagcgcgc

SEQ ID NO: 34855 - RNA, 20 nt, Homo sapiens
cgcuguacgcgagcgcgcgc

SEQ ID NO: 34856 - RNA, 22 nt, Homo sapiens
cgcuguacgcgagcgcgcgcgc

SEQ ID NO: 34857 - RNA, 16 nt, Homo sapiens
cgcuguuccucgccac

SEQ ID NO: 34858 - RNA, 15 nt, Homo sapiens
cgcucgcuuccgcau

SEQ ID NO: 34859 - RNA, 16 nt, Homo sapiens
cgcucgcuuccgcauc

SEQ ID NO: 34860 - RNA, 17 nt, Homo sapiens
cgcucgcuuccgcaucc

SEQ ID NO: 34861 - RNA, 10 nt, Homo sapiens
cgcucggccu

SEQ ID NO: 34862 - RNA, 14 nt, Homo sapiens
cgcucggccugcuc

SEQ ID NO: 34863 - RNA, 16 nt, Homo sapiens
cgcucggccugcucgc

SEQ ID NO: 34864 - RNA, 18 nt, Homo sapiens
cgcucggccugcucgccc

SEQ ID NO: 34865 - RNA, 12 nt, Homo sapiens
cggacgcugcug

SEQ ID NO: 34866 - RNA, 13 nt, Homo sapiens
cggacgcugcugc

SEQ ID NO: 34867 - RNA, 16 nt, Homo sapiens
cggacgcugcugccgu

SEQ ID NO: 34868 - RNA, 20 nt, Homo sapiens
cggacgcugcugccgugggc

SEQ ID NO: 34869 - RNA, 21 nt, Homo sapiens
cggacgcugcugccgugggcc

SEQ ID NO: 34870 - RNA, 15 nt, Homo sapiens
cggacggcuccggac

SEQ ID NO: 34871 - RNA, 16 nt, Homo sapiens
cggacggcuccggacg

SEQ ID NO: 34872 - RNA, 12 nt, Homo sapiens
cggcccugugcg

SEQ ID NO: 34873 - RNA, 15 nt, Homo sapiens
cggcccugugcggcc

SEQ ID NO: 34874 - RNA, 17 nt, Homo sapiens
cggcccugugcggccug

SEQ ID NO: 34875 - RNA, 21 nt, Homo sapiens
cggcccugugcggccuggucu

SEQ ID NO: 34876 - RNA, 11 nt, Homo sapiens
cggccgcgcug

SEQ ID NO: 34877 - RNA, 12 nt, Homo sapiens
cggccgcgcugc

SEQ ID NO: 34878 - RNA, 13 nt, Homo sapiens
cggccgcgcugcg

SEQ ID NO: 34879 - RNA, 14 nt, Homo sapiens
cggccgcgcugcgc

SEQ ID NO: 34880 - RNA, 19 nt, Homo sapiens
cggccgcgcugcgcgccgc

SEQ ID NO: 34881 - RNA, 22 nt, Homo sapiens
cggccgcgcugcgcgccgcgcu

SEQ ID NO: 34882 - RNA, 14 nt, Homo sapiens
cggccggcgcgcuc

SEQ ID NO: 34883 - RNA, 16 nt, Homo sapiens
cggccggcgcgcucau

SEQ ID NO: 34884 - RNA, 22 nt, Homo sapiens
cggccuggucuaccuguucgcg

SEQ ID NO: 34885 - RNA, 23 nt, Homo sapiens
cggccuggucuaccuguucgcgc

SEQ ID NO: 34886 - RNA, 24 nt, Homo sapiens
cggccuggucuaccuguucgcgcg

SEQ ID NO: 34887 - RNA, 16 nt, Homo sapiens
cggcgcgcucauccca

SEQ ID NO: 34888 - RNA, 15 nt, Homo sapiens
cggcggcccugugcg

SEQ ID NO: 34889 - RNA, 16 nt, Homo sapiens
cggcggcccugugcgg

SEQ ID NO: 34890 - RNA, 17 nt, Homo sapiens
cggcggcccugugcggc

SEQ ID NO: 34891 - RNA, 18 nt, Homo sapiens
cggcggcccugugcggcc

SEQ ID NO: 34892 - RNA, 20 nt, Homo sapiens
cggcggcccugugcggccug

SEQ ID NO: 34893 - RNA, 23 nt, Homo sapiens
cggcggcccugugcggccugguc

SEQ ID NO: 34894 - RNA, 13 nt, Homo sapiens
cggcgggagggcg

SEQ ID NO: 34895 - RNA, 19 nt, Homo sapiens
cggcgggagggcgcggggc

SEQ ID NO: 34896 - RNA, 20 nt, Homo sapiens
cggcgggagggcgcggggcg

SEQ ID NO: 34897 - RNA, 17 nt, Homo sapiens
cggcuccggacgcugcu

SEQ ID NO: 34898 - RNA, 13 nt, Homo sapiens
cgggaaagaagag

SEQ ID NO: 34899 - RNA, 13 nt, Homo sapiens
cggguccgggucg

SEQ ID NO: 34900 - RNA, 14 nt, Homo sapiens
cggggagcgagccc

SEQ ID NO: 34901 - RNA, 15 nt, Homo sapiens
cggggagcgagcccc

SEQ ID NO: 34902 - RNA, 13 nt, Homo sapiens
cggggaggggcgc

SEQ ID NO: 34903 - RNA, 16 nt, Homo sapiens
cggggaggggcgcucg

SEQ ID NO: 34904 - RNA, 14 nt, Homo sapiens
cggggcggggagcg

SEQ ID NO: 34905 - RNA, 16 nt, Homo sapiens
cggggcggggagcgag

SEQ ID NO: 34906 - RNA, 17 nt, Homo sapiens
cggggcggggagcgagc

SEQ ID NO: 34907 - RNA, 18 nt, Homo sapiens
cggggcggggagcgagcc

SEQ ID NO: 34908 - RNA, 13 nt, Homo sapiens
cgugggccugaga

SEQ ID NO: 34909 - RNA, 14 nt, Homo sapiens
cgugggccugagac

SEQ ID NO: 34910 - RNA, 11 nt, Homo sapiens
cgggccgacgg

SEQ ID NO: 34911 - RNA, 12 nt, Homo sapiens
cgggccgacgga

SEQ ID NO: 34912 - RNA, 14 nt, Homo sapiens
cgggccgacggagc

SEQ ID NO: 34913 - RNA, 15 nt, Homo sapiens
cgggccgacggagcc

SEQ ID NO: 34914 - RNA, 18 nt, Homo sapiens
cgggccgacggagccggg

SEQ ID NO: 34915 - RNA, 19 nt, Homo sapiens
cgggccgacggagccggga

SEQ ID NO: 34916 - RNA, 13 nt, Homo sapiens
cgggagggcgcgg

SEQ ID NO: 34917 - RNA, 14 nt, Homo sapiens
cgggagggcgcggg

SEQ ID NO: 34918 - RNA, 17 nt, Homo sapiens
cgggagggcgcggggcg

SEQ ID NO: 34919 - RNA, 18 nt, Homo sapiens
cgggagggcgcggggcgg

SEQ ID NO: 34920 - RNA, 20 nt, Homo sapiens
cggagccgggaaagaagagc

SEQ ID NO: 34921 - RNA, 13 nt, Homo sapiens
cggagccuccagc

SEQ ID NO: 34922 - RNA, 15 nt, Homo sapiens
cggagccuccagcug

SEQ ID NO: 34923 - RNA, 17 nt, Homo sapiens
cggagccuccagcugcc

SEQ ID NO: 34924 - RNA, 18 nt, Homo sapiens
cggagccuccagcugccc

SEQ ID NO: 34925 - RNA, 22 nt, Homo sapiens
cggagccuccagcugccccggg

SEQ ID NO: 34926 - RNA, 18 nt, Homo sapiens
cgcuguuccucgccacgc

SEQ ID NO: 34927 - RNA, 22 nt, Homo sapiens
cgcuguuccucgccacgcucug

SEQ ID NO: 34928 - RNA, 15 nt, Homo sapiens
cgcuuccgcauccua

SEQ ID NO: 34929 - RNA, 16 nt, Homo sapiens
cgggaaagaagagccg

SEQ ID NO: 34930 - RNA, 20 nt, Homo sapiens
cgggaaagaagagccggagc

SEQ ID NO: 34931 - RNA, 21 nt, Homo sapiens
cgggaaagaagagccggagcc

SEQ ID NO: 34932 - RNA, 23 nt, Homo sapiens
cgggaaagaagagccggagccuc

SEQ ID NO: 34933 - RNA, 17 nt, Homo sapiens
cuaguaauuggaaaggc

SEQ ID NO: 34934 - RNA, 16 nt, Homo sapiens
cuacuuccagggcuac

SEQ ID NO: 34935 - RNA, 22 nt, Homo sapiens
cuacuuccagggcuacgcgcgc

SEQ ID NO: 34936 - RNA, 16 nt, Homo sapiens
cuaccuguucgcgcgc

SEQ ID NO: 34937 - RNA, 18 nt, Homo sapiens
cuaccuguucgcgcgccu

SEQ ID NO: 34938 - RNA, 19 nt, Homo sapiens
cuaccuguucgcgcgccuc

SEQ ID NO: 34939 - RNA, 22 nt, Homo sapiens
cuaccuguucgcgcgccuccgc

SEQ ID NO: 34940 - RNA, 10 nt, Homo sapiens
cuacgcgcgc

SEQ ID NO: 34941 - RNA, 12 nt, Homo sapiens
cuacgcgcgcuc

SEQ ID NO: 34942 - RNA, 18 nt, Homo sapiens
cuacgcgcgcuccgcgca

SEQ ID NO: 34943 - RNA, 21 nt, Homo sapiens
cuacgcgcgcuccgcgcagcu

SEQ ID NO: 34944 - RNA, 23 nt, Homo sapiens
cuacgcgcgcuccgcgcagcuca

SEQ ID NO: 34945 - RNA, 13 nt, Homo sapiens
cuaucucauuucc

SEQ ID NO: 34946 - RNA, 22 nt, Homo sapiens
cucauggaauuggagcucgugg

SEQ ID NO: 34947 - RNA, 23 nt, Homo sapiens
cucauggaauuggagcucgugga

SEQ ID NO: 34948 - RNA, 17 nt, Homo sapiens
cucaggcuggcaccgcu

SEQ ID NO: 34949 - RNA, 21 nt, Homo sapiens
cucaggcuggcaccgcuguac

SEQ ID NO: 34950 - RNA, 23 nt, Homo sapiens
cucaggcuggcaccgcuguacgc

SEQ ID NO: 34951 - RNA, 15 nt, Homo sapiens
cucaucccacccgcc

SEQ ID NO: 34952 - RNA, 16 nt, Homo sapiens
cucaucccacccgccc

SEQ ID NO: 34953 - RNA, 18 nt, Homo sapiens
cuugucaauaaaauccau

SEQ ID NO: 34954 - RNA, 17 nt, Homo sapiens
cuuuaaaacuuauccuc

SEQ ID NO: 34955 - RNA, 21 nt, Homo sapiens
cuuucaugaaggggcggcggc

SEQ ID NO: 34956 - RNA, 22 nt, Homo sapiens
cuuucaugaaggggcggcggcc

SEQ ID NO: 34957 - RNA, 13 nt, Homo sapiens
gaaagguacuuca

SEQ ID NO: 34958 - RNA, 14 nt, Homo sapiens
gaaagguacuucaa

SEQ ID NO: 34959 - RNA, 23 nt, Homo sapiens
gaaagggcuguuauaaucuuuca

SEQ ID NO: 34960 - RNA, 14 nt, Homo sapiens
gaaagaagagccgg

SEQ ID NO: 34961 - RNA, 13 nt, Homo sapiens
gaaaacaaggaug

SEQ ID NO: 34962 - RNA, 13 nt, Homo sapiens
cuugaugaagaag

SEQ ID NO: 34963 - RNA, 21 nt, Homo sapiens
cuucuuucaugaaggggcggc

SEQ ID NO: 34964 - RNA, 12 nt, Homo sapiens
cuucccgcuguu

SEQ ID NO: 34965 - RNA, 13 nt, Homo sapiens
cuucccgcuguuc

SEQ ID NO: 34966 - RNA, 14 nt, Homo sapiens
cuuccucccggccg

SEQ ID NO: 34967 - RNA, 15 nt, Homo sapiens
cuuccucccggccgc

SEQ ID NO: 34968 - RNA, 16 nt, Homo sapiens
cuuccucccggccgcg

SEQ ID NO: 34969 - RNA, 19 nt, Homo sapiens
cuuccucccggccgcgcug

SEQ ID NO: 34970 - RNA, 21 nt, Homo sapiens
cuuccagauccuggaaaucag

SEQ ID NO: 34971 - RNA, 16 nt, Homo sapiens
cuuccagggcuacgcg

SEQ ID NO: 34972 - RNA, 17 nt, Homo sapiens
cuuccagggcuacgcgc

SEQ ID NO: 34973 - RNA, 19 nt, Homo sapiens
cuuccagggcuacgcgcgc

SEQ ID NO: 34974 - RNA, 20 nt, Homo sapiens
cuuccagggcuacgcgcgcu

SEQ ID NO: 34975 - RNA, 22 nt, Homo sapiens
cuuccagggcuacgcgcgcucc

SEQ ID NO: 34976 - RNA, 23 nt, Homo sapiens
cuuccagggcuacgcgcgcuccg

SEQ ID NO: 34977 - RNA, 13 nt, Homo sapiens
cuguuccucgcca

SEQ ID NO: 34978 - RNA, 17 nt, Homo sapiens
cuguuccucgccacgcu

SEQ ID NO: 34979 - RNA, 22 nt, Homo sapiens
cuguuccucgccacgcucuggg

SEQ ID NO: 34980 - RNA, 13 nt, Homo sapiens
cuguucgcgcgcc

SEQ ID NO: 34981 - RNA, 19 nt, Homo sapiens
cuguucgcgcgccuccgcu

SEQ ID NO: 34982 - RNA, 11 nt, Homo sapiens
cugugcggccu

SEQ ID NO: 34983 - RNA, 12 nt, Homo sapiens
cugugcggccug

SEQ ID NO: 34984 - RNA, 13 nt, Homo sapiens
cugugcggccugg

SEQ ID NO: 34985 - RNA, 21 nt, Homo sapiens
cugguggcgcuggcugcgcuc

SEQ ID NO: 34986 - RNA, 22 nt, Homo sapiens
cugguggcgcuggcugcgcucg

SEQ ID NO: 34987 - RNA, 14 nt, Homo sapiens
cuguacgcgagcgc

SEQ ID NO: 34988 - RNA, 18 nt, Homo sapiens
cuguacgcgagcgcgcgc

SEQ ID NO: 34989 - RNA, 19 nt, Homo sapiens
cuguacgcgagcgcgcgcg

SEQ ID NO: 34990 - RNA, 22 nt, Homo sapiens
cuguacgcgagcgcgcgcgccc

SEQ ID NO: 34991 - RNA, 12 nt, Homo sapiens
cuggcaccgcug

SEQ ID NO: 34992 - RNA, 21 nt, Homo sapiens
cuggcaccgcuguacgcgagc

SEQ ID NO: 34993 - RNA, 12 nt, Homo sapiens
cuggcugcgcuc

SEQ ID NO: 34994 - RNA, 14 nt, Homo sapiens
cuggcugcgcucgg

SEQ ID NO: 34995 - RNA, 15 nt, Homo sapiens
cuggcugcgcucggc

SEQ ID NO: 34996 - RNA, 16 nt, Homo sapiens
cuggcugcgcucggcc

SEQ ID NO: 34997 - RNA, 17 nt, Homo sapiens
cuggcugcgcucggccu

SEQ ID NO: 34998 - RNA, 22 nt, Homo sapiens
cuggcugcgcucggccugcucg

SEQ ID NO: 34999 - RNA, 24 nt, Homo sapiens
cuggcugcgcucggccugcucgcc

SEQ ID NO: 35000 - RNA, 11 nt, Homo sapiens
cuggcugcugg

SEQ ID NO: 35001 - RNA, 14 nt, Homo sapiens
cuggcugcuggugg

SEQ ID NO: 35002 - RNA, 21 nt, Homo sapiens
cuggcugcugguggcgcuggc

SEQ ID NO: 35003 - RNA, 11 nt, Homo sapiens
cugggacaggg

SEQ ID NO: 35004 - RNA, 14 nt, Homo sapiens
cugggucgccggca

SEQ ID NO: 35005 - RNA, 15 nt, Homo sapiens
cugggucgccggcau

SEQ ID NO: 35006 - RNA, 18 nt, Homo sapiens
cuggucuaccuguucgcg

SEQ ID NO: 35007 - RNA, 21 nt, Homo sapiens
cuggucuaccuguucgcgcgc

SEQ ID NO: 35008 - RNA, 14 nt, Homo sapiens
cugacucuuaagaa

SEQ ID NO: 35009 - RNA, 19 nt, Homo sapiens
cugagaccaaggcccccgg

SEQ ID NO: 35010 - RNA, 22 nt, Homo sapiens
cugccccggggaggggcgcucg

SEQ ID NO: 35011 - RNA, 13 nt, Homo sapiens
cugccgugggccu

SEQ ID NO: 35012 - RNA, 17 nt, Homo sapiens
cugccgugggccugaga

SEQ ID NO: 35013 - RNA, 18 nt, Homo sapiens
cugccgugggccugagac

SEQ ID NO: 35014 - RNA, 12 nt, Homo sapiens
cugcgcgccgcg

SEQ ID NO: 35015 - RNA, 13 nt, Homo sapiens
cugcgcgccgcgc

SEQ ID NO: 35016 - RNA, 15 nt, Homo sapiens
cugcgcgccgcgcuc

SEQ ID NO: 35017 - RNA, 16 nt, Homo sapiens
cugcgcgccgcgcucc

SEQ ID NO: 35018 - RNA, 20 nt, Homo sapiens
cugcgcgccgcgcuccucgg

SEQ ID NO: 35019 - RNA, 12 nt, Homo sapiens
cugcgcucggcc

SEQ ID NO: 35020 - RNA, 14 nt, Homo sapiens
cugcgcucggccug

SEQ ID NO: 35021 - RNA, 18 nt, Homo sapiens
cugcgcucggccugcucg

SEQ ID NO: 35022 - RNA, 19 nt, Homo sapiens
cugcgcucggccugcucgc

SEQ ID NO: 35023 - RNA, 14 nt, Homo sapiens
cugcugguggcgcu

SEQ ID NO: 35024 - RNA, 16 nt, Homo sapiens
cugcugguggcgcugg

SEQ ID NO: 35025 - RNA, 17 nt, Homo sapiens
cugcugguggcgcuggc

SEQ ID NO: 35026 - RNA, 19 nt, Homo sapiens
cugcugguggcgcuggcug

SEQ ID NO: 35027 - RNA, 21 nt, Homo sapiens
cugcugguggcgcuggcugcg

SEQ ID NO: 35028 - RNA, 22 nt, Homo sapiens
cugcugguggcgcuggcugcgc

SEQ ID NO: 35029 - RNA, 22 nt, Homo sapiens
cugcucgcccacuuccucccgg

SEQ ID NO: 35030 - RNA, 14 nt, Homo sapiens
cugcugccgugggc

SEQ ID NO: 35031 - RNA, 18 nt, Homo sapiens
cugcugccgugggccuga

SEQ ID NO: 35032 - RNA, 12 nt, Homo sapiens
cucggccugcuc

SEQ ID NO: 35033 - RNA, 13 nt, Homo sapiens
cucggccugcucg

SEQ ID NO: 35034 - RNA, 14 nt, Homo sapiens
cucggccugcucgc

SEQ ID NO: 35035 - RNA, 15 nt, Homo sapiens
cucggccugcucgcc

SEQ ID NO: 35036 - RNA, 17 nt, Homo sapiens
cucggccugcucgccca

SEQ ID NO: 35037 - RNA, 14 nt, Homo sapiens
cucgcuuccgcauc

SEQ ID NO: 35038 - RNA, 22 nt, Homo sapiens
cucgcuuccgcauccuagucuc

SEQ ID NO: 35039 - RNA, 18 nt, Homo sapiens
cucggacggcuccggacg

SEQ ID NO: 35040 - RNA, 19 nt, Homo sapiens
cucggacggcuccggacgc

SEQ ID NO: 35041 - RNA, 13 nt, Homo sapiens
cucgccacgcucu

SEQ ID NO: 35042 - RNA, 19 nt, Homo sapiens
cucgccacgcucugggucg

SEQ ID NO: 35043 - RNA, 20 nt, Homo sapiens
cucgcccacuuccucccggc

SEQ ID NO: 35044 - RNA, 11 nt, Homo sapiens
cucgcuuccgc

SEQ ID NO: 35045 - RNA, 13 nt, Homo sapiens
cucuuaagaagac

SEQ ID NO: 35046 - RNA, 16 nt, Homo sapiens
cucuuaagaagacugc

SEQ ID NO: 35047 - RNA, 12 nt, Homo sapiens
cucuggcugcug

SEQ ID NO: 35048 - RNA, 13 nt, Homo sapiens
cucuggcugcugg

SEQ ID NO: 35049 - RNA, 20 nt, Homo sapiens
cucuggcugcugguggcgcu

SEQ ID NO: 35050 - RNA, 23 nt, Homo sapiens
cucuggcugcugguggcgcuggc

SEQ ID NO: 35051 - RNA, 14 nt, Homo sapiens
cucugggucgccgg

SEQ ID NO: 35052 - RNA, 16 nt, Homo sapiens
cucugggucgccggca

SEQ ID NO: 35053 - RNA, 14 nt, Homo sapiens
cucucuuccucccu

SEQ ID NO: 35054 - RNA, 13 nt, Homo sapiens
cuccucggacggc

SEQ ID NO: 35055 - RNA, 14 nt, Homo sapiens
cuccucggacggcu

SEQ ID NO: 35056 - RNA, 16 nt, Homo sapiens
cuccucggacggcucc

SEQ ID NO: 35057 - RNA, 14 nt, Homo sapiens
cuccgcgcagcuca

SEQ ID NO: 35058 - RNA, 19 nt, Homo sapiens
cuccgcgcagcucaggcug

SEQ ID NO: 35059 - RNA, 20 nt, Homo sapiens
cuccgcgcagcucaggcugg

SEQ ID NO: 35060 - RNA, 16 nt, Homo sapiens
cuccgcuacuuccagg

SEQ ID NO: 35061 - RNA, 21 nt, Homo sapiens
cuccgcuacuuccagggcuac

SEQ ID NO: 35062 - RNA, 13 nt, Homo sapiens
cucccggccgcgc

SEQ ID NO: 35063 - RNA, 14 nt, Homo sapiens
cucccggccgcgcu

SEQ ID NO: 35064 - RNA, 19 nt, Homo sapiens
cucccggccgcgcugcgcg

SEQ ID NO: 35065 - RNA, 23 nt, Homo sapiens
cucccggccgcgcugcgcgccgc

SEQ ID NO: 35066 - RNA, 12 nt, Homo sapiens
cuccagcugccc

SEQ ID NO: 35067 - RNA, 13 nt, Homo sapiens
cuccagcugcccc

SEQ ID NO: 35068 - RNA, 18 nt, Homo sapiens
cuccagcugccccgggga

SEQ ID NO: 35069 - RNA, 19 nt, Homo sapiens
ccugagaccaaggcccccg

SEQ ID NO: 35070 - RNA, 10 nt, Homo sapiens
ccucuggcug

SEQ ID NO: 35071 - RNA, 22 nt, Homo sapiens
ccucuggcugcugguggcgcug

SEQ ID NO: 35072 - RNA, 12 nt, Homo sapiens
ccucgccacgcu

SEQ ID NO: 35073 - RNA, 16 nt, Homo sapiens
ccucgccacgcucugg

SEQ ID NO: 35074 - RNA, 15 nt, Homo sapiens
ccucggacggcuccg

SEQ ID NO: 35075 - RNA, 17 nt, Homo sapiens
ccucggacggcuccgga

SEQ ID NO: 35076 - RNA, 19 nt, Homo sapiens
ccucggacggcuccggacg

SEQ ID NO: 35077 - RNA, 11 nt, Homo sapiens
ccucccggccg

SEQ ID NO: 35078 - RNA, 14 nt, Homo sapiens
ccucccggccgcgc

SEQ ID NO: 35079 - RNA, 15 nt, Homo sapiens
ccucccggccgcgcu

SEQ ID NO: 35080 - RNA, 16 nt, Homo sapiens
ccucccggccgcgcug

SEQ ID NO: 35081 - RNA, 22 nt, Homo sapiens
ccucccggccgcgcugcgcgcc

SEQ ID NO: 35082 - RNA, 19 nt, Homo sapiens
ccucauggaauuggagcuc

SEQ ID NO: 35083 - RNA, 22 nt, Homo sapiens
ccucauggaauuggagcucgug

SEQ ID NO: 35084 - RNA, 16 nt, Homo sapiens
ccuccagcugccccgg

SEQ ID NO: 35085 - RNA, 12 nt, Homo sapiens
ccugcucgccca

SEQ ID NO: 35086 - RNA, 13 nt, Homo sapiens
ccugcucgcccac

SEQ ID NO: 35087 - RNA, 18 nt, Homo sapiens
ccuggucuaccuguucgc

SEQ ID NO: 35088 - RNA, 20 nt, Homo sapiens
ccuggucuaccuguucgcgc

SEQ ID NO: 35089 - RNA, 23 nt, Homo sapiens
ccuggucuaccuguucgcgcgcc

SEQ ID NO: 35090 - RNA, 11 nt, Homo sapiens
ccugugcggcc

SEQ ID NO: 35091 - RNA, 13 nt, Homo sapiens
ccugugcggccug

SEQ ID NO: 35092 - RNA, 16 nt, Homo sapiens
ccugugcggccugguc

SEQ ID NO: 35093 - RNA, 13 nt, Homo sapiens
ccuguucgcgcgc

SEQ ID NO: 35094 - RNA, 17 nt, Homo sapiens
ccuguucgcgcgccucc

SEQ ID NO: 35095 - RNA, 16 nt, Homo sapiens
cccuugaugaagaagu

SEQ ID NO: 35096 - RNA, 12 nt, Homo sapiens
ccgggccgacgg

SEQ ID NO: 35097 - RNA, 14 nt, Homo sapiens
ccgggccgacggag

SEQ ID NO: 35098 - RNA, 16 nt, Homo sapiens
ccgggccgacggagcc

SEQ ID NO: 35099 - RNA, 17 nt, Homo sapiens
ccgggccgacggagccg

SEQ ID NO: 35100 - RNA, 18 nt, Homo sapiens
ccgggccgacggagccgg

SEQ ID NO: 35101 - RNA, 19 nt, Homo sapiens
ccgggccgacggagccggg

SEQ ID NO: 35102 - RNA, 20 nt, Homo sapiens
ccgggccgacggagccggga

SEQ ID NO: 35103 - RNA, 21 nt, Homo sapiens
ccgggccgacggagccgggaa

SEQ ID NO: 35104 - RNA, 17 nt, Homo sapiens
ccgcuguacgcgagcgc

SEQ ID NO: 35105 - RNA, 21 nt, Homo sapiens
ccgcuguacgcgagcgcgcgc

SEQ ID NO: 35106 - RNA, 22 nt, Homo sapiens
ccgcuguacgcgagcgcgcgcg

SEQ ID NO: 35107 - RNA, 23 nt, Homo sapiens
ccgcuguacgcgagcgcgcgcgc

SEQ ID NO: 35108 - RNA, 14 nt, Homo sapiens
ccgcuguuccucgc

SEQ ID NO: 35109 - RNA, 17 nt, Homo sapiens
ccgcuguuccucgccac

SEQ ID NO: 35110 - RNA, 20 nt, Homo sapiens
ccgcuguuccucgccacgcu

SEQ ID NO: 35111 - RNA, 14 nt, Homo sapiens
ccggacgcugcugc

SEQ ID NO: 35112 - RNA, 16 nt, Homo sapiens
ccggacgcugcugccg

SEQ ID NO: 35113 - RNA, 19 nt, Homo sapiens
ccggacgcugcugccgugg

SEQ ID NO: 35114 - RNA, 13 nt, Homo sapiens
ccggagccuccag

SEQ ID NO: 35115 - RNA, 14 nt, Homo sapiens
ccggagccuccagc

SEQ ID NO: 35116 - RNA, 17 nt, Homo sapiens
ccggagccuccagcugc

SEQ ID NO: 35117 - RNA, 21 nt, Homo sapiens
ccggagccuccagcugccccg

SEQ ID NO: 35118 - RNA, 22 nt, Homo sapiens
ccggagccuccagcugccccgg

SEQ ID NO: 35119 - RNA, 11 nt, Homo sapiens
ccggccgcgcu

SEQ ID NO: 35120 - RNA, 13 nt, Homo sapiens
ccggccgcgcugc

SEQ ID NO: 35121 - RNA, 17 nt, Homo sapiens
ccggccgcgcugcgcgc

SEQ ID NO: 35122 - RNA, 19 nt, Homo sapiens
ccggccgcgcugcgcgccg

SEQ ID NO: 35123 - RNA, 23 nt, Homo sapiens
ccggccgcgcugcgcgccgcgcu

SEQ ID NO: 35124 - RNA, 12 nt, Homo sapiens
ccggccggcgcg

SEQ ID NO: 35125 - RNA, 14 nt, Homo sapiens
ccggccggcgcgcu

SEQ ID NO: 35126 - RNA, 15 nt, Homo sapiens
ccggcgcgcucaucc

SEQ ID NO: 35127 - RNA, 18 nt, Homo sapiens
ccggcgcgcucaucccac

SEQ ID NO: 35128 - RNA, 17 nt, Homo sapiens
ccgggaaagaagagccg

SEQ ID NO: 35129 - RNA, 18 nt, Homo sapiens
ccgggaaagaagagccgg

SEQ ID NO: 35130 - RNA, 20 nt, Homo sapiens
ccgggaaagaagagccggag

SEQ ID NO: 35131 - RNA, 21 nt, Homo sapiens
ccgggaaagaagagccggagc

SEQ ID NO: 35132 - RNA, 23 nt, Homo sapiens
ccgggaaagaagagccggagccu

SEQ ID NO: 35133 - RNA, 13 nt, Homo sapiens
ccggggaggggcg

SEQ ID NO: 35134 - RNA, 15 nt, Homo sapiens
ccggggaggggcgcu

SEQ ID NO: 35135 - RNA, 19 nt, Homo sapiens
ccggggaggggcgcucgcu

SEQ ID NO: 35136 - RNA, 23 nt, Homo sapiens
ccggggaggggcgcucgcuuccg

SEQ ID NO: 35137 - RNA, 14 nt, Homo sapiens
ccgggucgcaggac

SEQ ID NO: 35138 - RNA, 11 nt, Homo sapiens
ccgugggccug

SEQ ID NO: 35139 - RNA, 12 nt, Homo sapiens
ccgugggccuga

SEQ ID NO: 35140 - RNA, 13 nt, Homo sapiens
ccgugggccugag

SEQ ID NO: 35141 - RNA, 11 nt, Homo sapiens
ccuagggugau

SEQ ID NO: 35142 - RNA, 21 nt, Homo sapiens
ccaacuaucucauuuccaagc

SEQ ID NO: 35143 - RNA, 22 nt, Homo sapiens
ccaucaaggguacacugccuuc

SEQ ID NO: 35144 - RNA, 12 nt, Homo sapiens
ccaucccggccg

SEQ ID NO: 35145 - RNA, 13 nt, Homo sapiens
ccaucccggccgg

SEQ ID NO: 35146 - RNA, 18 nt, Homo sapiens
ccaucccggccggcgcgc

SEQ ID NO: 35147 - RNA, 20 nt, Homo sapiens
ccaucccggccggcgcgcuc

SEQ ID NO: 35148 - RNA, 17 nt, Homo sapiens
ccaggcggguccggguc

SEQ ID NO: 35149 - RNA, 18 nt, Homo sapiens
ccaggcggguccgggucg

SEQ ID NO: 35150 - RNA, 20 nt, Homo sapiens
ccaggcggguccgggucgca

SEQ ID NO: 35151 - RNA, 11 nt, Homo sapiens
ccagggcuacg

SEQ ID NO: 35152 - RNA, 18 nt, Homo sapiens
ccagggcuacgcgcgcuc

SEQ ID NO: 35153 - RNA, 19 nt, Homo sapiens
ccagggcuacgcgcgcucc

SEQ ID NO: 35154 - RNA, 20 nt, Homo sapiens
ccagggcuacgcgcgcuccg

SEQ ID NO: 35155 - RNA, 22 nt, Homo sapiens
ccagggcuacgcgcgcuccgcg

SEQ ID NO: 35156 - RNA, 23 nt, Homo sapiens
ccagggcuacgcgcgcuccgcgc

SEQ ID NO: 35157 - RNA, 24 nt, Homo sapiens
ccagggcuacgcgcgcuccgcgca

SEQ ID NO: 35158 - RNA, 22 nt, Homo sapiens
ccaggucuaccaaaaaucucaa

SEQ ID NO: 35159 - RNA, 17 nt, Homo sapiens
ccagcugccccggggag

SEQ ID NO: 35160 - RNA, 15 nt, Homo sapiens
ccacuuccucccggc

SEQ ID NO: 35161 - RNA, 16 nt, Homo sapiens
ccacuuccucccggcc

SEQ ID NO: 35162 - RNA, 17 nt, Homo sapiens
ccacuuccucccggccg

SEQ ID NO: 35163 - RNA, 18 nt, Homo sapiens
ccacuuccucccggccgc

SEQ ID NO: 35164 - RNA, 19 nt, Homo sapiens
ccacuuccucccggccgcg

SEQ ID NO: 35165 - RNA, 16 nt, Homo sapiens
cccacuuccucccggc

SEQ ID NO: 35166 - RNA, 18 nt, Homo sapiens
cccacuuccucccggccg

SEQ ID NO: 35167 - RNA, 14 nt, Homo sapiens
cccaggcggguccg

SEQ ID NO: 35168 - RNA, 16 nt, Homo sapiens
ccaugggcacuguggg

SEQ ID NO: 35169 - RNA, 12 nt, Homo sapiens
cccacccgccca

SEQ ID NO: 35170 - RNA, 14 nt, Homo sapiens
cccacccgcccacc

SEQ ID NO: 35171 - RNA, 12 nt, Homo sapiens
cccgggccgacg

SEQ ID NO: 35172 - RNA, 13 nt, Homo sapiens
cccgggccgacgg

SEQ ID NO: 35173 - RNA, 14 nt, Homo sapiens
cccgggccgacgga

SEQ ID NO: 35174 - RNA, 18 nt, Homo sapiens
cccgggccgacggagccg

SEQ ID NO: 35175 - RNA, 20 nt, Homo sapiens
cccgggccgacggagccggg

SEQ ID NO: 35176 - RNA, 21 nt, Homo sapiens
cccgggccgacggagccggga

SEQ ID NO: 35177 - RNA, 13 nt, Homo sapiens
cccggggaggggc

SEQ ID NO: 35178 - RNA, 14 nt, Homo sapiens
cccggggaggggcg

SEQ ID NO: 35179 - RNA, 17 nt, Homo sapiens
cccggggaggggcgcuc

SEQ ID NO: 35180 - RNA, 18 nt, Homo sapiens
cccggggaggggcgcucg

SEQ ID NO: 35181 - RNA, 19 nt, Homo sapiens
cccggggaggggcgcucgc

SEQ ID NO: 35182 - RNA, 13 nt, Homo sapiens
cccgcccaccgca

SEQ ID NO: 35183 - RNA, 15 nt, Homo sapiens
cccgcuguuccucgc

SEQ ID NO: 35184 - RNA, 17 nt, Homo sapiens
cccgcuguuccucgcca

SEQ ID NO: 35185 - RNA, 17 nt, Homo sapiens
cccggccgcgcugcgcg

SEQ ID NO: 35186 - RNA, 22 nt, Homo sapiens
cccggccgcgcugcgcgccgcg

SEQ ID NO: 35187 - RNA, 24 nt, Homo sapiens
cccggccgcgcugcgcgccgcgcu

SEQ ID NO: 35188 - RNA, 11 nt, Homo sapiens
cccggccggcg

SEQ ID NO: 35189 - RNA, 12 nt, Homo sapiens
cccggccggcgc

SEQ ID NO: 35190 - RNA, 13 nt, Homo sapiens
cccggccggcgcg

SEQ ID NO: 35191 - RNA, 15 nt, Homo sapiens
cccggccggcgcgcu

SEQ ID NO: 35192 - RNA, 17 nt, Homo sapiens
ccccgggccgacggagc

SEQ ID NO: 35193 - RNA, 20 nt, Homo sapiens
ccccggggaggggcgcucgc

SEQ ID NO: 35194 - RNA, 23 nt, Homo sapiens
ccccaggcggguccgggucgcag

SEQ ID NO: 35195 - RNA, 11 nt, Homo sapiens
cccccgggccg

SEQ ID NO: 35196 - RNA, 18 nt, Homo sapiens
cccucuggcugcuggugg

SEQ ID NO: 35197 - RNA, 13 nt, Homo sapiens
ccgacggagccgg

SEQ ID NO: 35198 - RNA, 15 nt, Homo sapiens
ccgacggagccggga

SEQ ID NO: 35199 - RNA, 19 nt, Homo sapiens
ccgcagggugaacugcagc

SEQ ID NO: 35200 - RNA, 20 nt, Homo sapiens
ccgcagggugaacugcagcg

SEQ ID NO: 35201 - RNA, 20 nt, Homo sapiens
ccgcauccuagucucuauca

SEQ ID NO: 35202 - RNA, 15 nt, Homo sapiens
ccgcccaccgcaggg

SEQ ID NO: 35203 - RNA, 18 nt, Homo sapiens
ccgcccaccgcaggguga

SEQ ID NO: 35204 - RNA, 15 nt, Homo sapiens
ccgcgcagcucaggc

SEQ ID NO: 35205 - RNA, 17 nt, Homo sapiens
ccgcgcagcucaggcug

SEQ ID NO: 35206 - RNA, 19 nt, Homo sapiens
ccgcgcagcucaggcuggc

SEQ ID NO: 35207 - RNA, 20 nt, Homo sapiens
ccgcgcagcucaggcuggca

SEQ ID NO: 35208 - RNA, 21 nt, Homo sapiens
ccgcgcagcucaggcuggcac

SEQ ID NO: 35209 - RNA, 13 nt, Homo sapiens
ccgcgcuccucgg

SEQ ID NO: 35210 - RNA, 18 nt, Homo sapiens
ccgcgcuccucggacggc

SEQ ID NO: 35211 - RNA, 22 nt, Homo sapiens
ccgcgcuccucggacggcuccg

SEQ ID NO: 35212 - RNA, 13 nt, Homo sapiens
ccgcgcugcgcgc

SEQ ID NO: 35213 - RNA, 14 nt, Homo sapiens
ccgcgcugcgcgcc

SEQ ID NO: 35214 - RNA, 17 nt, Homo sapiens
ccgcgcugcgcgccgcg

SEQ ID NO: 35215 - RNA, 18 nt, Homo sapiens
ccgcgcugcgcgccgcgc

SEQ ID NO: 35216 - RNA, 21 nt, Homo sapiens
ccgcgcugcgcgccgcgcucc

SEQ ID NO: 35217 - RNA, 23 nt, Homo sapiens
ccgcgcugcgcgccgcgcuccuc

SEQ ID NO: 35218 - RNA, 14 nt, Homo sapiens
ccgcuacuuccagg

SEQ ID NO: 35219 - RNA, 17 nt, Homo sapiens
cauggaauuggagcucg

SEQ ID NO: 35220 - RNA, 15 nt, Homo sapiens
cauuugcucauggaa

SEQ ID NO: 35221 - RNA, 24 nt, Homo sapiens
cauuauauuuauuacuguaagaaa

SEQ ID NO: 35222 - RNA, 20 nt, Homo sapiens
cauuaaaguucuagugaccg

SEQ ID NO: 35223 - RNA, 18 nt, Homo sapiens
ccacagcuguaugauucc

SEQ ID NO: 35224 - RNA, 19 nt, Homo sapiens
ccacagcuguaugauuccc

SEQ ID NO: 35225 - RNA, 12 nt, Homo sapiens
ccacccgcccac

SEQ ID NO: 35226 - RNA, 15 nt, Homo sapiens
ccacccgcccaccgc

SEQ ID NO: 35227 - RNA, 18 nt, Homo sapiens
ccacgcucugggucgccg

SEQ ID NO: 35228 - RNA, 19 nt, Homo sapiens
ccacgcucugggucgccgg

SEQ ID NO: 35229 - RNA, 20 nt, Homo sapiens
ccacgcucugggucgccggc

SEQ ID NO: 35230 - RNA, 20 nt, Homo sapiens
ccaagcauuuagauguauag

SEQ ID NO: 35231 - RNA, 14 nt, Homo sapiens
ccaaggcccccggg

SEQ ID NO: 35232 - RNA, 15 nt, Homo sapiens
ccaaggcccccgggc

SEQ ID NO: 35233 - RNA, 16 nt, Homo sapiens
ccaaggcccccgggcc

SEQ ID NO: 35234 - RNA, 19 nt, Homo sapiens
ccaaggcccccgggccgac

SEQ ID NO: 35235 - RNA, 13 nt, Homo sapiens
caugaaggggcgg

SEQ ID NO: 35236 - RNA, 20 nt, Homo sapiens
caugaaggggcggcggcccu

SEQ ID NO: 35237 - RNA, 21 nt, Homo sapiens
caugaaggggcggcggcccug

SEQ ID NO: 35238 - RNA, 12 nt, Homo sapiens
caucccacccgc

SEQ ID NO: 35239 - RNA, 15 nt, Homo sapiens
caucccacccgccca

SEQ ID NO: 35240 - RNA, 12 nt, Homo sapiens
caucccggccgg

SEQ ID NO: 35241 - RNA, 19 nt, Homo sapiens
caucaaggguacacugccu

SEQ ID NO: 35242 - RNA, 20 nt, Homo sapiens
caucaaggguacacugccuu

SEQ ID NO: 35243 - RNA, 15 nt, Homo sapiens
caguucugaagaaga

SEQ ID NO: 35244 - RNA, 19 nt, Homo sapiens
caggcggguccgggucgca

SEQ ID NO: 35245 - RNA, 22 nt, Homo sapiens
caggcggguccgggucgcagga

SEQ ID NO: 35246 - RNA, 23 nt, Homo sapiens
caggaaagagaacuuccagaucc

SEQ ID NO: 35247 - RNA, 24 nt, Homo sapiens
caggaaagagaacuuccagauccu

SEQ ID NO: 35248 - RNA, 18 nt, Homo sapiens
caggaaccacaagacugc

SEQ ID NO: 35249 - RNA, 18 nt, Homo sapiens
caggaccaucccggccgg

SEQ ID NO: 35250 - RNA, 19 nt, Homo sapiens
caggaccaucccggccggc

SEQ ID NO: 35251 - RNA, 20 nt, Homo sapiens
caggaccaucccggccggcg

SEQ ID NO: 35252 - RNA, 21 nt, Homo sapiens
caggaccaucccggccggcgc

SEQ ID NO: 35253 - RNA, 22 nt, Homo sapiens
caggaccaucccggccggcgcg

SEQ ID NO: 35254 - RNA, 24 nt, Homo sapiens
caggaccaucccggccggcgcgcu

SEQ ID NO: 35255 - RNA, 14 nt, Homo sapiens
caggcuggcaccgc

SEQ ID NO: 35256 - RNA, 16 nt, Homo sapiens
caggcuggcaccgcug

SEQ ID NO: 35257 - RNA, 13 nt, Homo sapiens
cagggcuacgcgc

SEQ ID NO: 35258 - RNA, 15 nt, Homo sapiens
cagggcuacgcgcgc

SEQ ID NO: 35259 - RNA, 16 nt, Homo sapiens
cagggcuacgcgcgcu

SEQ ID NO: 35260 - RNA, 19 nt, Homo sapiens
cagggcuacgcgcgcuccg

SEQ ID NO: 35261 - RNA, 21 nt, Homo sapiens
cagggcuacgcgcgcuccgcg

SEQ ID NO: 35262 - RNA, 22 nt, Homo sapiens
cagggcuacgcgcgcuccgcgc

SEQ ID NO: 35263 - RNA, 16 nt, Homo sapiens
cagggugaacugcagc

SEQ ID NO: 35264 - RNA, 20 nt, Homo sapiens
cagggugaacugcagcgagu

SEQ ID NO: 35265 - RNA, 23 nt, Homo sapiens
caggguuaguauuguccaggucu

SEQ ID NO: 35266 - RNA, 18 nt, Homo sapiens
cagaagcuccagguagag

SEQ ID NO: 35267 - RNA, 12 nt, Homo sapiens
cacuugucaaua

SEQ ID NO: 35268 - RNA, 14 nt, Homo sapiens
cacuuccucccggc

SEQ ID NO: 35269 - RNA, 15 nt, Homo sapiens
cacuuccucccggcc

SEQ ID NO: 35270 - RNA, 18 nt, Homo sapiens
cacuuccucccggccgcg

SEQ ID NO: 35271 - RNA, 19 nt, Homo sapiens
cacuuccucccggccgcgc

SEQ ID NO: 35272 - RNA, 20 nt, Homo sapiens
cacuuccucccggccgcgcu

SEQ ID NO: 35273 - RNA, 14 nt, Homo sapiens
cagcacagccucuu

SEQ ID NO: 35274 - RNA, 17 nt, Homo sapiens
cagcgaguacuucccgc

SEQ ID NO: 35275 - RNA, 23 nt, Homo sapiens
cagcgaguacuucccgcuguucc

SEQ ID NO: 35276 - RNA, 20 nt, Homo sapiens
cagccucuuagaugcaguuc

SEQ ID NO: 35277 - RNA, 21 nt, Homo sapiens
cagccucuuagaugcaguucu

SEQ ID NO: 35278 - RNA, 16 nt, Homo sapiens
cagcccuucuuuccac

SEQ ID NO: 35279 - RNA, 19 nt, Homo sapiens
cagcucaggcuggcaccgc

SEQ ID NO: 35280 - RNA, 18 nt, Homo sapiens
cagcucuaaaugucaauc

SEQ ID NO: 35281 - RNA, 13 nt, Homo sapiens
cagcugccccggg

SEQ ID NO: 35282 - RNA, 15 nt, Homo sapiens
cagcugccccgggga

SEQ ID NO: 35283 - RNA, 21 nt, Homo sapiens
cagcugccccggggaggggcg

SEQ ID NO: 35284 - RNA, 13 nt, Homo sapiens
guucgcgcgccuc

SEQ ID NO: 35285 - RNA, 17 nt, Homo sapiens
guucgcgcgccuccgcu

SEQ ID NO: 35286 - RNA, 11 nt, Homo sapiens
guucugaagaa

SEQ ID NO: 35287 - RNA, 12 nt, Homo sapiens
guucugaagaag

SEQ ID NO: 35288 - RNA, 13 nt, Homo sapiens
guucugaagaaga

SEQ ID NO: 35289 - RNA, 20 nt, Homo sapiens
gugggccugagaccaaggcc

SEQ ID NO: 35290 - RNA, 12 nt, Homo sapiens
gugcggccuggu

SEQ ID NO: 35291 - RNA, 13 nt, Homo sapiens
gugcggccugguc

SEQ ID NO: 35292 - RNA, 23 nt, Homo sapiens
gugcggccuggucuaccuguucg

SEQ ID NO: 35293 - RNA, 16 nt, Homo sapiens
guggaacaguuaccuc

SEQ ID NO: 35294 - RNA, 12 nt, Homo sapiens
guggcgcuggcu

SEQ ID NO: 35295 - RNA, 13 nt, Homo sapiens
guggcgcuggcug

SEQ ID NO: 35296 - RNA, 16 nt, Homo sapiens
guggcgcuggcugcgc

SEQ ID NO: 35297 - RNA, 23 nt, Homo sapiens
guggcgcuggcugcgcucggccu

SEQ ID NO: 35298 - RNA, 17 nt, Homo sapiens
guccgggucgcaggacc

SEQ ID NO: 35299 - RNA, 18 nt, Homo sapiens
guccgggucgcaggacca

SEQ ID NO: 35300 - RNA, 21 nt, Homo sapiens
guccgggucgcaggaccaucc

SEQ ID NO: 35301 - RNA, 18 nt, Homo sapiens
gucgcaggaccaucccgg

SEQ ID NO: 35302 - RNA, 21 nt, Homo sapiens
gucgcaggaccaucccggccg

SEQ ID NO: 35303 - RNA, 23 nt, Homo sapiens
gucgcaggaccaucccggccggc

SEQ ID NO: 35304 - RNA, 12 nt, Homo sapiens
gucgccggcauc

SEQ ID NO: 35305 - RNA, 17 nt, Homo sapiens
gucuaccuguucgcgcg

SEQ ID NO: 35306 - RNA, 19 nt, Homo sapiens
gucuaccuguucgcgcgcc

SEQ ID NO: 35307 - RNA, 20 nt, Homo sapiens
gucuaccuguucgcgcgccu

SEQ ID NO: 35308 - RNA, 12 nt, Homo sapiens
uacuguaagaaa

SEQ ID NO: 35309 - RNA, 12 nt, Homo sapiens
uacuuccagggc

SEQ ID NO: 35310 - RNA, 13 nt, Homo sapiens
uacuuccagggcu

SEQ ID NO: 35311 - RNA, 18 nt, Homo sapiens
uaccuguucgcgcgccuc

SEQ ID NO: 35312 - RNA, 21 nt, Homo sapiens
uaccuguucgcgcgccuccgc

SEQ ID NO: 35313 - RNA, 22 nt, Homo sapiens
uaccuguucgcgcgccuccgcu

SEQ ID NO: 35314 - RNA, 18 nt, Homo sapiens
uaccacaggaaccacaag

SEQ ID NO: 35315 - RNA, 14 nt, Homo sapiens
uacgcgagcgcgcg

SEQ ID NO: 35316 - RNA, 15 nt, Homo sapiens
uacgcgagcgcgcgc

SEQ ID NO: 35317 - RNA, 16 nt, Homo sapiens
uacgcgagcgcgcgcg

SEQ ID NO: 35318 - RNA, 17 nt, Homo sapiens
uacgcgagcgcgcgcgc

SEQ ID NO: 35319 - RNA, 20 nt, Homo sapiens
uacgcgagcgcgcgcgcccu

SEQ ID NO: 35320 - RNA, 14 nt, Homo sapiens
uacgcgcgcuccgc

SEQ ID NO: 35321 - RNA, 16 nt, Homo sapiens
uaaugauaacuggaaa

SEQ ID NO: 35322 - RNA, 11 nt, Homo sapiens
uaaaacuggga

SEQ ID NO: 35323 - RNA, 20 nt, Homo sapiens
ucaccucauggaauuggagc

SEQ ID NO: 35324 - RNA, 16 nt, Homo sapiens
uauuguuugcuaagca

SEQ ID NO: 35325 - RNA, 15 nt, Homo sapiens
ucaggcuggcaccgc

SEQ ID NO: 35326 - RNA, 13 nt, Homo sapiens
ucaucccacccgc

SEQ ID NO: 35327 - RNA, 14 nt, Homo sapiens
ucaucccacccgcc

SEQ ID NO: 35328 - RNA, 15 nt, Homo sapiens
ucaucccacccgccc

SEQ ID NO: 35329 - RNA, 15 nt, Homo sapiens
ucaugaaggggcggc

SEQ ID NO: 35330 - RNA, 20 nt, Homo sapiens
ucaugaaggggcggcggccc

SEQ ID NO: 35331 - RNA, 19 nt, Homo sapiens
ucauuaaaguucuagugac

SEQ ID NO: 35332 - RNA, 11 nt, Homo sapiens
uccagcugccc

SEQ ID NO: 35333 - RNA, 17 nt, Homo sapiens
uccagcugccccgggga

SEQ ID NO: 35334 - RNA, 20 nt, Homo sapiens
uccagggcuacgcgcgcucc

SEQ ID NO: 35335 - RNA, 21 nt, Homo sapiens
uccagggcuacgcgcgcuccg

SEQ ID NO: 35336 - RNA, 22 nt, Homo sapiens
uccagggcuacgcgcgcuccgc

SEQ ID NO: 35337 - RNA, 13 nt, Homo sapiens
ucauuuccaagca

SEQ ID NO: 35338 - RNA, 17 nt, Homo sapiens
ucccacccgcccaccgc

SEQ ID NO: 35339 - RNA, 18 nt, Homo sapiens
ucccacccgcccaccgca

SEQ ID NO: 35340 - RNA, 16 nt, Homo sapiens
ucccgcuguuccucgc

SEQ ID NO: 35341 - RNA, 17 nt, Homo sapiens
ucccgcuguuccucgcc

SEQ ID NO: 35342 - RNA, 19 nt, Homo sapiens
ucccgcuguuccucgccac

SEQ ID NO: 35343 - RNA, 11 nt, Homo sapiens
ucccggccgcg

SEQ ID NO: 35344 - RNA, 13 nt, Homo sapiens
ucccggccgcgcu

SEQ ID NO: 35345 - RNA, 14 nt, Homo sapiens
ucccggccgcgcug

SEQ ID NO: 35346 - RNA, 15 nt, Homo sapiens
ucccggccgcgcugc

SEQ ID NO: 35347 - RNA, 18 nt, Homo sapiens
ucccggccgcgcugcgcg

SEQ ID NO: 35348 - RNA, 20 nt, Homo sapiens
ucccggccgcgcugcgcgcc

SEQ ID NO: 35349 - RNA, 21 nt, Homo sapiens
ucccggccgcgcugcgcgccg

SEQ ID NO: 35350 - RNA, 24 nt, Homo sapiens
ucccggccgcgcugcgcgccgcgc

SEQ ID NO: 35351 - RNA, 16 nt, Homo sapiens
ucccggccggcgcgcu

SEQ ID NO: 35352 - RNA, 13 nt, Homo sapiens
ucccuuaccuggg

SEQ ID NO: 35353 - RNA, 12 nt, Homo sapiens
uccgcuacuucc

SEQ ID NO: 35354 - RNA, 17 nt, Homo sapiens
uccgcuacuuccagggc

SEQ ID NO: 35355 - RNA, 18 nt, Homo sapiens
uccgcuacuuccagggcu

SEQ ID NO: 35356 - RNA, 12 nt, Homo sapiens
uccggacgcugc

SEQ ID NO: 35357 - RNA, 13 nt, Homo sapiens
uccgggucgcagg

SEQ ID NO: 35358 - RNA, 12 nt, Homo sapiens
uccucgccacgc

SEQ ID NO: 35359 - RNA, 18 nt, Homo sapiens
uccucgccacgcucuggg

SEQ ID NO: 35360 - RNA, 12 nt, Homo sapiens
uccucggacggc

SEQ ID NO: 35361 - RNA, 11 nt, Homo sapiens
uccucccggcc

SEQ ID NO: 35362 - RNA, 13 nt, Homo sapiens
uccucccggccgc

SEQ ID NO: 35363 - RNA, 15 nt, Homo sapiens
uccucccggccgcgc

SEQ ID NO: 35364 - RNA, 16 nt, Homo sapiens
uccucccggccgcgcu

SEQ ID NO: 35365 - RNA, 17 nt, Homo sapiens
uccucccggccgcgcug

SEQ ID NO: 35366 - RNA, 17 nt, Homo sapiens
uccuugaagauuuacca

SEQ ID NO: 35367 - RNA, 12 nt, Homo sapiens
ucgcccacuucc

SEQ ID NO: 35368 - RNA, 21 nt, Homo sapiens
ucgcccacuuccucccggccg

SEQ ID NO: 35369 - RNA, 19 nt, Homo sapiens
ucgcaggaccaucccggcc

SEQ ID NO: 35370 - RNA, 21 nt, Homo sapiens
ucgcaggaccaucccggccgg

SEQ ID NO: 35371 - RNA, 13 nt, Homo sapiens
ucgccacgcucug

SEQ ID NO: 35372 - RNA, 14 nt, Homo sapiens
ucgccacgcucugg

SEQ ID NO: 35373 - RNA, 15 nt, Homo sapiens
ucgccacgcucuggg

SEQ ID NO: 35374 - RNA, 21 nt, Homo sapiens
ucgccacgcucugggucgccg

SEQ ID NO: 35375 - RNA, 13 nt, Homo sapiens
ucgcuuccgcauc

SEQ ID NO: 35376 - RNA, 14 nt, Homo sapiens
ucgcgcgccuccgc

SEQ ID NO: 35377 - RNA, 17 nt, Homo sapiens
ucuaccuguucgcgcgc

SEQ ID NO: 35378 - RNA, 18 nt, Homo sapiens
ucuaccuguucgcgcgcc

SEQ ID NO: 35379 - RNA, 19 nt, Homo sapiens
ucuaccuguucgcgcgccu

SEQ ID NO: 35380 - RNA, 23 nt, Homo sapiens
ucuaccuguucgcgcgccuccgc

SEQ ID NO: 35381 - RNA, 18 nt, Homo sapiens
ugccccggggaggggcgc

SEQ ID NO: 35382 - RNA, 20 nt, Homo sapiens
ugccccggggaggggcgcuc

SEQ ID NO: 35383 - RNA, 21 nt, Homo sapiens
ugccccggggaggggcgcucg

SEQ ID NO: 35384 - RNA, 23 nt, Homo sapiens
ugccccggggaggggcgcucgcu

SEQ ID NO: 35385 - RNA, 16 nt, Homo sapiens
ugccucagaaaacaag

SEQ ID NO: 35386 - RNA, 22 nt, Homo sapiens
ugcucgcccacuuccucccggc

SEQ ID NO: 35387 - RNA, 20 nt, Homo sapiens
ugcucauggaauuggagcuc

SEQ ID NO: 35388 - RNA, 11 nt, Homo sapiens
ugcgcgccgcg

SEQ ID NO: 35389 - RNA, 20 nt, Homo sapiens
ugcgcgccgcgcuccucgga

SEQ ID NO: 35390 - RNA, 21 nt, Homo sapiens
ugcgcgccgcgcuccucggac

SEQ ID NO: 35391 - RNA, 13 nt, Homo sapiens
ugcgcucggccug

SEQ ID NO: 35392 - RNA, 17 nt, Homo sapiens
ugcgcucggccugcucg

SEQ ID NO: 35393 - RNA, 19 nt, Homo sapiens
ugcgcucggccugcucgcc

SEQ ID NO: 35394 - RNA, 20 nt, Homo sapiens
ugcgcucggccugcucgccc

SEQ ID NO: 35395 - RNA, 15 nt, Homo sapiens
ugcuaguaauuggaa

SEQ ID NO: 35396 - RNA, 15 nt, Homo sapiens
ugcaguucugaagaa

SEQ ID NO: 35397 - RNA, 16 nt, Homo sapiens
ugcaguucugaagaag

SEQ ID NO: 35398 - RNA, 18 nt, Homo sapiens
ugcagcgaguacuucccg

SEQ ID NO: 35399 - RNA, 19 nt, Homo sapiens
ugcagcgaguacuucccgc

SEQ ID NO: 35400 - RNA, 15 nt, Homo sapiens
ugaaggggcggcggc

SEQ ID NO: 35401 - RNA, 16 nt, Homo sapiens
ugaaggggcggcggcc

SEQ ID NO: 35402 - RNA, 20 nt, Homo sapiens
ugagagacacacugaagaag

SEQ ID NO: 35403 - RNA, 12 nt, Homo sapiens
ugagaccaaggc

SEQ ID NO: 35404 - RNA, 22 nt, Homo sapiens
ucuggcugcugguggcgcuggc

SEQ ID NO: 35405 - RNA, 14 nt, Homo sapiens
ucugggucgccggc

SEQ ID NO: 35406 - RNA, 22 nt, Homo sapiens
ucuucuuucaugaaggggcggc

SEQ ID NO: 35407 - RNA, 13 nt, Homo sapiens
ucucuaggaaaua

SEQ ID NO: 35408 - RNA, 12 nt, Homo sapiens
ucggccugcucg

SEQ ID NO: 35409 - RNA, 14 nt, Homo sapiens
ucggccugcucgcc

SEQ ID NO: 35410 - RNA, 13 nt, Homo sapiens
ucggacggcuccg

SEQ ID NO: 35411 - RNA, 18 nt, Homo sapiens
ucggacggcuccggacgc

SEQ ID NO: 35412 - RNA, 20 nt, Homo sapiens
ucggacggcuccggacgcug

SEQ ID NO: 35413 - RNA, 17 nt, Homo sapiens
ggggcgcucgcuuccgc

SEQ ID NO: 35414 - RNA, 10 nt, Homo sapiens
ggggcggcgg

SEQ ID NO: 35415 - RNA, 11 nt, Homo sapiens
ggggcggcggc

SEQ ID NO: 35416 - RNA, 15 nt, Homo sapiens
ggggcggcggcccug

SEQ ID NO: 35417 - RNA, 17 nt, Homo sapiens
ggggcggggagcgagcc

SEQ ID NO: 35418 - RNA, 12 nt, Homo sapiens
ggggagcgagcc

SEQ ID NO: 35419 - RNA, 10 nt, Homo sapiens
gggcggcggc

SEQ ID NO: 35420 - RNA, 11 nt, Homo sapiens
gggcggcggcc

SEQ ID NO: 35421 - RNA, 12 nt, Homo sapiens
gggcggcggccc

SEQ ID NO: 35422 - RNA, 13 nt, Homo sapiens
gggcggcggcccu

SEQ ID NO: 35423 - RNA, 16 nt, Homo sapiens
gggcggggagcgagcc

SEQ ID NO: 35424 - RNA, 12 nt, Homo sapiens
gggcuacgcgcg

SEQ ID NO: 35425 - RNA, 13 nt, Homo sapiens
gggcuacgcgcgc

SEQ ID NO: 35426 - RNA, 14 nt, Homo sapiens
gggcuacgcgcgcu

SEQ ID NO: 35427 - RNA, 20 nt, Homo sapiens
gggcuacgcgcgcuccgcgc

SEQ ID NO: 35428 - RNA, 15 nt, Homo sapiens
gggcgcucgcuuccg

SEQ ID NO: 35429 - RNA, 20 nt, Homo sapiens
gggcgcucgcuuccgcaucc

SEQ ID NO: 35430 - RNA, 21 nt, Homo sapiens
gggcgcucgcuuccgcauccu

SEQ ID NO: 35431 - RNA, 12 nt, Homo sapiens
gggcgcggggcg

SEQ ID NO: 35432 - RNA, 13 nt, Homo sapiens
gggcgcggggcgg

SEQ ID NO: 35433 - RNA, 12 nt, Homo sapiens
gggccgacggag

SEQ ID NO: 35434 - RNA, 14 nt, Homo sapiens
gggccgacggagcc

SEQ ID NO: 35435 - RNA, 15 nt, Homo sapiens
gggccgacggagccg

SEQ ID NO: 35436 - RNA, 19 nt, Homo sapiens
gggccgacggagccgggaa

SEQ ID NO: 35437 - RNA, 11 nt, Homo sapiens
gggucgccggc

SEQ ID NO: 35438 - RNA, 12 nt, Homo sapiens
gggucgccggca

SEQ ID NO: 35439 - RNA, 11 nt, Homo sapiens
gggugaacugc

SEQ ID NO: 35440 - RNA, 15 nt, Homo sapiens
gggugaacugcagcg

SEQ ID NO: 35441 - RNA, 16 nt, Homo sapiens
ggucuaccuguucgcg

SEQ ID NO: 35442 - RNA, 23 nt, Homo sapiens
ggucuaccuguucgcgcgccucc

SEQ ID NO: 35443 - RNA, 17 nt, Homo sapiens
ggugaacugcagcgagu

SEQ ID NO: 35444 - RNA, 14 nt, Homo sapiens
gguccgggucgcag

SEQ ID NO: 35445 - RNA, 15 nt, Homo sapiens
gguccgggucgcagg

SEQ ID NO: 35446 - RNA, 19 nt, Homo sapiens
gguccgggucgcaggacca

SEQ ID NO: 35447 - RNA, 13 nt, Homo sapiens
ggucgcaggacca

SEQ ID NO: 35448 - RNA, 18 nt, Homo sapiens
ggucgcaggaccaucccg

SEQ ID NO: 35449 - RNA, 22 nt, Homo sapiens
ggucgcaggaccaucccggccg

SEQ ID NO: 35450 - RNA, 16 nt, Homo sapiens
ggucgccggcaucuuc

SEQ ID NO: 35451 - RNA, 12 nt, Homo sapiens
gguggcgcuggc

SEQ ID NO: 35452 - RNA, 14 nt, Homo sapiens
gguggcgcuggcug

SEQ ID NO: 35453 - RNA, 19 nt, Homo sapiens
gguggcgcuggcugcgcuc

SEQ ID NO: 35454 - RNA, 22 nt, Homo sapiens
gguggcgcuggcugcgcucggc

SEQ ID NO: 35455 - RNA, 23 nt, Homo sapiens
gguggcgcuggcugcgcucggcc

SEQ ID NO: 35456 - RNA, 13 nt, Homo sapiens
guacgcgagcgcg

SEQ ID NO: 35457 - RNA, 18 nt, Homo sapiens
guacgcgagcgcgcgcgc

SEQ ID NO: 35458 - RNA, 20 nt, Homo sapiens
guacgcgagcgcgcgcgccc

SEQ ID NO: 35459 - RNA, 15 nt, Homo sapiens
ggcuuccuggcaaua

SEQ ID NO: 35460 - RNA, 13 nt, Homo sapiens
ggcuggcaccgcu

SEQ ID NO: 35461 - RNA, 19 nt, Homo sapiens
ggcugcgcucggccugcuc

SEQ ID NO: 35462 - RNA, 13 nt, Homo sapiens
ggcugcugguggc

SEQ ID NO: 35463 - RNA, 15 nt, Homo sapiens
ggcugcugguggcgc

SEQ ID NO: 35464 - RNA, 14 nt, Homo sapiens
ggcuccggacgcug

SEQ ID NO: 35465 - RNA, 18 nt, Homo sapiens
ggcuccggacgcugcugc

SEQ ID NO: 35466 - RNA, 19 nt, Homo sapiens
ggcuccggacgcugcugcc

SEQ ID NO: 35467 - RNA, 19 nt, Homo sapiens
gggagcgagccccaggcgg

SEQ ID NO: 35468 - RNA, 14 nt, Homo sapiens
gggaggggcgcucg

SEQ ID NO: 35469 - RNA, 15 nt, Homo sapiens
gggaggggcgcucgc

SEQ ID NO: 35470 - RNA, 16 nt, Homo sapiens
gggaggggcgcucgcu

SEQ ID NO: 35471 - RNA, 19 nt, Homo sapiens
gggacagucaccucaugga

SEQ ID NO: 35472 - RNA, 18 nt, Homo sapiens
gggacauuugcucaugga

SEQ ID NO: 35473 - RNA, 16 nt, Homo sapiens
gggaaagaagagccgg

SEQ ID NO: 35474 - RNA, 14 nt, Homo sapiens
gggaaagggcuguu

SEQ ID NO: 35475 - RNA, 21 nt, Homo sapiens
gggaaauccacacugagcuga

SEQ ID NO: 35476 - RNA, 23 nt, Homo sapiens
ggcgcggcgggagggcgcggggc

SEQ ID NO: 35477 - RNA, 11 nt, Homo sapiens
ggcgcggggcg

SEQ ID NO: 35478 - RNA, 12 nt, Homo sapiens
ggcgcggggcgg

SEQ ID NO: 35479 - RNA, 13 nt, Homo sapiens
ggcgcggggcggg

SEQ ID NO: 35480 - RNA, 15 nt, Homo sapiens
ggcgcggggcgggga

SEQ ID NO: 35481 - RNA, 22 nt, Homo sapiens
ggcgcggggcggggagcgagcc

SEQ ID NO: 35482 - RNA, 18 nt, Homo sapiens
ggccuggucuaccuguuc

SEQ ID NO: 35483 - RNA, 20 nt, Homo sapiens
ggccuggucuaccuguucgc

SEQ ID NO: 35484 - RNA, 21 nt, Homo sapiens
ggccuggucuaccuguucgcg

SEQ ID NO: 35485 - RNA, 12 nt, Homo sapiens
ggcuacgcgcgc

SEQ ID NO: 35486 - RNA, 13 nt, Homo sapiens
ggcuacgcgcgcu

SEQ ID NO: 35487 - RNA, 14 nt, Homo sapiens
ggcuacgcgcgcuc

SEQ ID NO: 35488 - RNA, 15 nt, Homo sapiens
ggcuacgcgcgcucc

SEQ ID NO: 35489 - RNA, 17 nt, Homo sapiens
ggcuacgcgcgcuccgc

SEQ ID NO: 35490 - RNA, 18 nt, Homo sapiens
ggcuacgcgcgcuccgcg

SEQ ID NO: 35491 - RNA, 22 nt, Homo sapiens
ggcuacgcgcgcuccgcgcagc

SEQ ID NO: 35492 - RNA, 15 nt, Homo sapiens
ggcaccgcuguacgc

SEQ ID NO: 35493 - RNA, 16 nt, Homo sapiens
ggcaccgcuguacgcg

SEQ ID NO: 35494 - RNA, 20 nt, Homo sapiens
ggcaccgcuguacgcgagcg

SEQ ID NO: 35495 - RNA, 21 nt, Homo sapiens
ggcaccgcuguacgcgagcgc

SEQ ID NO: 35496 - RNA, 11 nt, Homo sapiens
ggcccugugcg

SEQ ID NO: 35497 - RNA, 12 nt, Homo sapiens
ggcccugugcgg

SEQ ID NO: 35498 - RNA, 16 nt, Homo sapiens
ggcccugugcggccug

SEQ ID NO: 35499 - RNA, 17 nt, Homo sapiens
ggcccugugcggccugg

SEQ ID NO: 35500 - RNA, 14 nt, Homo sapiens
ggccgacggagccg

SEQ ID NO: 35501 - RNA, 17 nt, Homo sapiens
ggccgacggagccggga

SEQ ID NO: 35502 - RNA, 18 nt, Homo sapiens
ggccgacggagccgggaa

SEQ ID NO: 35503 - RNA, 10 nt, Homo sapiens
ggccgcgcug

SEQ ID NO: 35504 - RNA, 13 nt, Homo sapiens
ggccgcgcugcgc

SEQ ID NO: 35505 - RNA, 15 nt, Homo sapiens
ggccgcgcugcgcgc

SEQ ID NO: 35506 - RNA, 18 nt, Homo sapiens
ggccgcgcugcgcgccgc

SEQ ID NO: 35507 - RNA, 20 nt, Homo sapiens
ggccgcgcugcgcgccgcgc

SEQ ID NO: 35508 - RNA, 21 nt, Homo sapiens
ggccgcgcugcgcgccgcgcu

SEQ ID NO: 35509 - RNA, 11 nt, Homo sapiens
ggccggcgcgc

SEQ ID NO: 35510 - RNA, 12 nt, Homo sapiens
ggccggcgcgcu

SEQ ID NO: 35511 - RNA, 13 nt, Homo sapiens
ggcccccgggccg

SEQ ID NO: 35512 - RNA, 15 nt, Homo sapiens
ggcccccgggccgac

SEQ ID NO: 35513 - RNA, 20 nt, Homo sapiens
ggcccccgggccgacggagc

SEQ ID NO: 35514 - RNA, 17 nt, Homo sapiens
ggccugagaccaaggcc

SEQ ID NO: 35515 - RNA, 21 nt, Homo sapiens
ggccugagaccaaggcccccg

SEQ ID NO: 35516 - RNA, 15 nt, Homo sapiens
ggccugcucgcccac

SEQ ID NO: 35517 - RNA, 14 nt, Homo sapiens
ggcgcucgcuuccg

SEQ ID NO: 35518 - RNA, 16 nt, Homo sapiens
ggcgcucgcuuccgca

SEQ ID NO: 35519 - RNA, 17 nt, Homo sapiens
ggcgcucgcuuccgcau

SEQ ID NO: 35520 - RNA, 19 nt, Homo sapiens
ggcgcucgcuuccgcaucc

SEQ ID NO: 35521 - RNA, 14 nt, Homo sapiens
ggcgcuggcugcgc

SEQ ID NO: 35522 - RNA, 16 nt, Homo sapiens
ggcgcuggcugcgcuc

SEQ ID NO: 35523 - RNA, 17 nt, Homo sapiens
ggcgcuggcugcgcucg

SEQ ID NO: 35524 - RNA, 22 nt, Homo sapiens
ggcgcuggcugcgcucggccug

SEQ ID NO: 35525 - RNA, 23 nt, Homo sapiens
ggcgcuggcugcgcucggccugc

SEQ ID NO: 35526 - RNA, 13 nt, Homo sapiens
ggcggcccugugc

SEQ ID NO: 35527 - RNA, 16 nt, Homo sapiens
ggcggcccugugcggc

SEQ ID NO: 35528 - RNA, 19 nt, Homo sapiens
ggcggcccugugcggccug

SEQ ID NO: 35529 - RNA, 20 nt, Homo sapiens
ggcggcccugugcggccugg

SEQ ID NO: 35530 - RNA, 10 nt, Homo sapiens
ggcggcggcc

SEQ ID NO: 35531 - RNA, 20 nt, Homo sapiens
ggcgggagggcgcggggcgg

SEQ ID NO: 35532 - RNA, 11 nt, Homo sapiens
ggcggguccgg

SEQ ID NO: 35533 - RNA, 15 nt, Homo sapiens
ggcggguccgggucg

SEQ ID NO: 35534 - RNA, 20 nt, Homo sapiens
ggcggguccgggucgcagga

SEQ ID NO: 35535 - RNA, 21 nt, Homo sapiens
ggcggguccgggucgcaggac

SEQ ID NO: 35536 - RNA, 22 nt, Homo sapiens
gccuggucuaccuguucgcgcg

SEQ ID NO: 35537 - RNA, 13 nt, Homo sapiens
gcgcgcgcccucu

SEQ ID NO: 35538 - RNA, 13 nt, Homo sapiens
gcgcgcgcgcccu

SEQ ID NO: 35539 - RNA, 15 nt, Homo sapiens
gcgcgcgcgcccucu

SEQ ID NO: 35540 - RNA, 20 nt, Homo sapiens
gcgcgcucaucccacccgcc

SEQ ID NO: 35541 - RNA, 21 nt, Homo sapiens
gcgcgcucaucccacccgccc

SEQ ID NO: 35542 - RNA, 11 nt, Homo sapiens
gcgcgcuccgc

SEQ ID NO: 35543 - RNA, 12 nt, Homo sapiens
gcgcgcuccgcg

SEQ ID NO: 35544 - RNA, 13 nt, Homo sapiens
gcgcgcuccgcgc

SEQ ID NO: 35545 - RNA, 15 nt, Homo sapiens
gcgcgcuccgcgcag

SEQ ID NO: 35546 - RNA, 22 nt, Homo sapiens
gcgcgcuccgcgcagcucaggc

SEQ ID NO: 35547 - RNA, 12 nt, Homo sapiens
gcgcggggcggg

SEQ ID NO: 35548 - RNA, 14 nt, Homo sapiens
gcgcggggcgggga

SEQ ID NO: 35549 - RNA, 15 nt, Homo sapiens
gcgcggggcggggag

SEQ ID NO: 35550 - RNA, 16 nt, Homo sapiens
gcgcggggcggggagc

SEQ ID NO: 35551 - RNA, 19 nt, Homo sapiens
gcgcucaucccacccgccc

SEQ ID NO: 35552 - RNA, 21 nt, Homo sapiens
gcgcucaucccacccgcccac

SEQ ID NO: 35553 - RNA, 12 nt, Homo sapiens
gcgcuccgcgca

SEQ ID NO: 35554 - RNA, 14 nt, Homo sapiens
gcgcuccgcgcagc

SEQ ID NO: 35555 - RNA, 16 nt, Homo sapiens
gcgcuccucggacggc

SEQ ID NO: 35556 - RNA, 17 nt, Homo sapiens
gcgcuccucggacggcu

SEQ ID NO: 35557 - RNA, 13 nt, Homo sapiens
gcgcucgcuuccg

SEQ ID NO: 35558 - RNA, 14 nt, Homo sapiens
gcgcucgcuuccgc

SEQ ID NO: 35559 - RNA, 18 nt, Homo sapiens
gcgcucgcuuccgcaucc

SEQ ID NO: 35560 - RNA, 14 nt, Homo sapiens
gcgcucggccugcu

SEQ ID NO: 35561 - RNA, 18 nt, Homo sapiens
gcgcucggccugcucgcc

SEQ ID NO: 35562 - RNA, 19 nt, Homo sapiens
gcgcucggccugcucgccc

SEQ ID NO: 35563 - RNA, 11 nt, Homo sapiens
gcgcugcgcgc

SEQ ID NO: 35564 - RNA, 12 nt, Homo sapiens
gcgcugcgcgcc

SEQ ID NO: 35565 - RNA, 13 nt, Homo sapiens
gcgcugcgcgccg

SEQ ID NO: 35566 - RNA, 15 nt, Homo sapiens
gcgcugcgcgccgcg

SEQ ID NO: 35567 - RNA, 16 nt, Homo sapiens
gcgcugcgcgccgcgc

SEQ ID NO: 35568 - RNA, 17 nt, Homo sapiens
gcgcugcgcgccgcgcu

SEQ ID NO: 35569 - RNA, 22 nt, Homo sapiens
gcgcugcgcgccgcgcuccucg

SEQ ID NO: 35570 - RNA, 12 nt, Homo sapiens
gcgcuggcugcg

SEQ ID NO: 35571 - RNA, 13 nt, Homo sapiens
gcgcuggcugcgc

SEQ ID NO: 35572 - RNA, 14 nt, Homo sapiens
gcgcuggcugcgcu

SEQ ID NO: 35573 - RNA, 16 nt, Homo sapiens
gcgcuggcugcgcucg

SEQ ID NO: 35574 - RNA, 23 nt, Homo sapiens
gcgcuggcugcgcucggccugcu

SEQ ID NO: 35575 - RNA, 17 nt, Homo sapiens
gcgggagggcgcggggc

SEQ ID NO: 35576 - RNA, 13 nt, Homo sapiens
gcggggagcgagc

SEQ ID NO: 35577 - RNA, 21 nt, Homo sapiens
gcggggagcgagccccaggcg

SEQ ID NO: 35578 - RNA, 22 nt, Homo sapiens
gcggggagcgagccccaggcgg

SEQ ID NO: 35579 - RNA, 11 nt, Homo sapiens
gcggguccggg

SEQ ID NO: 35580 - RNA, 22 nt, Homo sapiens
gcggguccgggucgcaggacca

SEQ ID NO: 35581 - RNA, 13 nt, Homo sapiens
gcggcccugugcg

SEQ ID NO: 35582 - RNA, 17 nt, Homo sapiens
gcggcccugugcggccu

SEQ ID NO: 35583 - RNA, 18 nt, Homo sapiens
gcggcccugugcggccug

SEQ ID NO: 35584 - RNA, 19 nt, Homo sapiens
gcggcccugugcggccugg

SEQ ID NO: 35585 - RNA, 21 nt, Homo sapiens
gcggcccugugcggccugguc

SEQ ID NO: 35586 - RNA, 21 nt, Homo sapiens
gcggccuggucuaccuguucg

SEQ ID NO: 35587 - RNA, 11 nt, Homo sapiens
gcggcggcccu

SEQ ID NO: 35588 - RNA, 12 nt, Homo sapiens
gcggcggcccug

SEQ ID NO: 35589 - RNA, 13 nt, Homo sapiens
gcggcggcccugu

SEQ ID NO: 35590 - RNA, 14 nt, Homo sapiens
gcggcggcccugug

SEQ ID NO: 35591 - RNA, 22 nt, Homo sapiens
gcggcggcccugugcggccugg

SEQ ID NO: 35592 - RNA, 23 nt, Homo sapiens
gcggcggcccugugcggccuggu

SEQ ID NO: 35593 - RNA, 18 nt, Homo sapiens
gcggcgggagggcgcggg

SEQ ID NO: 35594 - RNA, 14 nt, Homo sapiens
gcuaagcauuccaa

SEQ ID NO: 35595 - RNA, 12 nt, Homo sapiens
gcuacgcgcgcu

SEQ ID NO: 35596 - RNA, 14 nt, Homo sapiens
gcuacgcgcgcucc

SEQ ID NO: 35597 - RNA, 15 nt, Homo sapiens
gcuacgcgcgcuccg

SEQ ID NO: 35598 - RNA, 16 nt, Homo sapiens
gcuacgcgcgcuccgc

SEQ ID NO: 35599 - RNA, 17 nt, Homo sapiens
gcuacgcgcgcuccgcg

SEQ ID NO: 35600 - RNA, 18 nt, Homo sapiens
gcuacgcgcgcuccgcgc

SEQ ID NO: 35601 - RNA, 21 nt, Homo sapiens
gcuacgcgcgcuccgcgcagc

SEQ ID NO: 35602 - RNA, 14 nt, Homo sapiens
gcucugggucgccg

SEQ ID NO: 35603 - RNA, 15 nt, Homo sapiens
gcucugggucgccgg

SEQ ID NO: 35604 - RNA, 18 nt, Homo sapiens
gcucugggucgccggcau

SEQ ID NO: 35605 - RNA, 19 nt, Homo sapiens
gcucugggucgccggcauc

SEQ ID NO: 35606 - RNA, 19 nt, Homo sapiens
gcucauggaauuggagcuc

SEQ ID NO: 35607 - RNA, 14 nt, Homo sapiens
gcugccccggggag

SEQ ID NO: 35608 - RNA, 15 nt, Homo sapiens
gcugccccggggagg

SEQ ID NO: 35609 - RNA, 19 nt, Homo sapiens
gcugccccggggaggggcg

SEQ ID NO: 35610 - RNA, 22 nt, Homo sapiens
gcugccccggggaggggcgcuc

SEQ ID NO: 35611 - RNA, 23 nt, Homo sapiens
gcugccccggggaggggcgcucg

SEQ ID NO: 35612 - RNA, 14 nt, Homo sapiens
gcugccgugggccu

SEQ ID NO: 35613 - RNA, 16 nt, Homo sapiens
gcugccgugggccuga

SEQ ID NO: 35614 - RNA, 20 nt, Homo sapiens
gcugcgcgccgcgcuccucg

SEQ ID NO: 35615 - RNA, 11 nt, Homo sapiens
gcugcgcucgg

SEQ ID NO: 35616 - RNA, 13 nt, Homo sapiens
gcugcgcucggcc

SEQ ID NO: 35617 - RNA, 15 nt, Homo sapiens
gcugcgcucggccug

SEQ ID NO: 35618 - RNA, 14 nt, Homo sapiens
gcuacuuccagggc

SEQ ID NO: 35619 - RNA, 13 nt, Homo sapiens
gcucaggcuggca

SEQ ID NO: 35620 - RNA, 14 nt, Homo sapiens
gcucaggcuggcac

SEQ ID NO: 35621 - RNA, 15 nt, Homo sapiens
gcucaggcuggcacc

SEQ ID NO: 35622 - RNA, 19 nt, Homo sapiens
gcucaggcuggcaccgcug

SEQ ID NO: 35623 - RNA, 20 nt, Homo sapiens
gcucaggcuggcaccgcugu

SEQ ID NO: 35624 - RNA, 15 nt, Homo sapiens
gcucaucccacccgc

SEQ ID NO: 35625 - RNA, 16 nt, Homo sapiens
gcucaucccacccgcc

SEQ ID NO: 35626 - RNA, 17 nt, Homo sapiens
gcucaucccacccgccc

SEQ ID NO: 35627 - RNA, 18 nt, Homo sapiens
gcucaucccacccgccca

SEQ ID NO: 35628 - RNA, 19 nt, Homo sapiens
gcucaucccacccgcccac

SEQ ID NO: 35629 - RNA, 13 nt, Homo sapiens
gcuccgcgcagcu

SEQ ID NO: 35630 - RNA, 18 nt, Homo sapiens
gcuccgcgcagcucaggc

SEQ ID NO: 35631 - RNA, 15 nt, Homo sapiens
gcuccggacgcugcu

SEQ ID NO: 35632 - RNA, 17 nt, Homo sapiens
gcuccggacgcugcugc

SEQ ID NO: 35633 - RNA, 18 nt, Homo sapiens
gcuccggacgcugcugcc

SEQ ID NO: 35634 - RNA, 24 nt, Homo sapiens
gcuccggacgcugcugccgugggc

SEQ ID NO: 35635 - RNA, 18 nt, Homo sapiens
gcuccucggacggcuccg

SEQ ID NO: 35636 - RNA, 14 nt, Homo sapiens
gcucgcccacuucc

SEQ ID NO: 35637 - RNA, 16 nt, Homo sapiens
gcucgcccacuuccuc

SEQ ID NO: 35638 - RNA, 17 nt, Homo sapiens
gcucgcccacuuccucc

SEQ ID NO: 35639 - RNA, 21 nt, Homo sapiens
gcucgcccacuuccucccggc

SEQ ID NO: 35640 - RNA, 22 nt, Homo sapiens
gcucgcccacuuccucccggcc

SEQ ID NO: 35641 - RNA, 14 nt, Homo sapiens
gcucgcuuccgcau

SEQ ID NO: 35642 - RNA, 16 nt, Homo sapiens
gcucgcuuccgcaucc

SEQ ID NO: 35643 - RNA, 19 nt, Homo sapiens
gcucgcuuccgcauccuag

SEQ ID NO: 35644 - RNA, 11 nt, Homo sapiens
gcucggccugc

SEQ ID NO: 35645 - RNA, 12 nt, Homo sapiens
gcucggccugcu

SEQ ID NO: 35646 - RNA, 15 nt, Homo sapiens
gcucggccugcucgc

SEQ ID NO: 35647 - RNA, 16 nt, Homo sapiens
gcucggccugcucgcc

SEQ ID NO: 35648 - RNA, 20 nt, Homo sapiens
gcucggccugcucgcccacu

SEQ ID NO: 35649 - RNA, 21 nt, Homo sapiens
gcucuaaaugucaaucagccu

SEQ ID NO: 35650 - RNA, 12 nt, Homo sapiens
gcuguuccucgc

SEQ ID NO: 35651 - RNA, 16 nt, Homo sapiens
gcuguuccucgccacg

SEQ ID NO: 35652 - RNA, 17 nt, Homo sapiens
gcuguuccucgccacgc

SEQ ID NO: 35653 - RNA, 18 nt, Homo sapiens
ggaaagaagagccggagc

SEQ ID NO: 35654 - RNA, 20 nt, Homo sapiens
ggaaagaagagccggagccu

SEQ ID NO: 35655 - RNA, 14 nt, Homo sapiens
gcugcgcgccgcgc

SEQ ID NO: 35656 - RNA, 13 nt, Homo sapiens
gcugcugguggcg

SEQ ID NO: 35657 - RNA, 17 nt, Homo sapiens
gcugcugguggcgcugg

SEQ ID NO: 35658 - RNA, 19 nt, Homo sapiens
gcugcugguggcgcuggcu

SEQ ID NO: 35659 - RNA, 20 nt, Homo sapiens
gcugcugguggcgcuggcug

SEQ ID NO: 35660 - RNA, 23 nt, Homo sapiens
gcugcugguggcgcuggcugcgc

SEQ ID NO: 35661 - RNA, 22 nt, Homo sapiens
gcuggcaccgcuguacgcgagc

SEQ ID NO: 35662 - RNA, 14 nt, Homo sapiens
gcuggcugcgcucg

SEQ ID NO: 35663 - RNA, 15 nt, Homo sapiens
gcuggcugcgcucgg

SEQ ID NO: 35664 - RNA, 16 nt, Homo sapiens
gcuggcugcgcucggc

SEQ ID NO: 35665 - RNA, 17 nt, Homo sapiens
gcuggcugcgcucggcc

SEQ ID NO: 35666 - RNA, 18 nt, Homo sapiens
gcuggcugcgcucggccu

SEQ ID NO: 35667 - RNA, 21 nt, Homo sapiens
gcuggcugcgcucggccugcu

SEQ ID NO: 35668 - RNA, 19 nt, Homo sapiens
gcugucuacacuaagagag

SEQ ID NO: 35669 - RNA, 13 nt, Homo sapiens
gcugguggcgcug

SEQ ID NO: 35670 - RNA, 17 nt, Homo sapiens
gcugguggcgcuggcug

SEQ ID NO: 35671 - RNA, 18 nt, Homo sapiens
gcugguggcgcuggcugc

SEQ ID NO: 35672 - RNA, 13 nt, Homo sapiens
gcuguacgcgagc

SEQ ID NO: 35673 - RNA, 17 nt, Homo sapiens
gcuguacgcgagcgcgc

SEQ ID NO: 35674 - RNA, 21 nt, Homo sapiens
gcuguacgcgagcgcgcgcgc

SEQ ID NO: 35675 - RNA, 16 nt, Homo sapiens
ggacauuugcucaugg

SEQ ID NO: 35676 - RNA, 16 nt, Homo sapiens
ggaccaucccggccgg

SEQ ID NO: 35677 - RNA, 17 nt, Homo sapiens
ggaccaucccggccggc

SEQ ID NO: 35678 - RNA, 19 nt, Homo sapiens
ggaccaucccggccggcgc

SEQ ID NO: 35679 - RNA, 20 nt, Homo sapiens
ggaccaucccggccggcgcg

SEQ ID NO: 35680 - RNA, 21 nt, Homo sapiens
ggaccaucccggccggcgcgc

SEQ ID NO: 35681 - RNA, 10 nt, Homo sapiens
ggagaagaac

SEQ ID NO: 35682 - RNA, 19 nt, Homo sapiens
ggacgcugcugccgugggc

SEQ ID NO: 35683 - RNA, 11 nt, Homo sapiens
ggacggcuccg

SEQ ID NO: 35684 - RNA, 14 nt, Homo sapiens
ggacggcuccggac

SEQ ID NO: 35685 - RNA, 12 nt, Homo sapiens
ggagggcgcggg

SEQ ID NO: 35686 - RNA, 14 nt, Homo sapiens
ggagggcgcggggc

SEQ ID NO: 35687 - RNA, 14 nt, Homo sapiens
ggaggggcgcucgc

SEQ ID NO: 35688 - RNA, 17 nt, Homo sapiens
ggagccgggaaagaaga

SEQ ID NO: 35689 - RNA, 21 nt, Homo sapiens
ggagccgggaaagaagagccg

SEQ ID NO: 35690 - RNA, 12 nt, Homo sapiens
ggagccuccagc

SEQ ID NO: 35691 - RNA, 13 nt, Homo sapiens
ggagccuccagcu

SEQ ID NO: 35692 - RNA, 15 nt, Homo sapiens
ggagccuccagcugc

SEQ ID NO: 35693 - RNA, 17 nt, Homo sapiens
ggagccuccagcugccc

SEQ ID NO: 35694 - RNA, 18 nt, Homo sapiens
ggagccuccagcugcccc

SEQ ID NO: 35695 - RNA, 19 nt, Homo sapiens
ggagccuccagcugccccg

SEQ ID NO: 35696 - RNA, 16 nt, Homo sapiens
ggagcgagccccaggc

SEQ ID NO: 35697 - RNA, 17 nt, Homo sapiens
ggagcgagccccaggcg

SEQ ID NO: 35698 - RNA, 19 nt, Homo sapiens
ggagcgagccccaggcggg

SEQ ID NO: 35699 - RNA, 11 nt, Homo sapiens
ggagcucgugg

SEQ ID NO: 35700 - RNA, 15 nt, Homo sapiens
ggagcucguggaaca

SEQ ID NO: 35701 - RNA, 12 nt, Homo sapiens
ggagcucguggg

SEQ ID NO: 35702 - RNA, 15 nt, Homo sapiens
gaaagagaacuucca

SEQ ID NO: 35703 - RNA, 22 nt, Homo sapiens
cuuugugcagauucuuuacccc

SEQ ID NO: 35704 - RNA, 23 nt, Homo sapiens
cuuugugcagauucuuuaccccc

SEQ ID NO: 35705 - RNA, 17 nt, Homo sapiens
gaaagaagagccggagc

SEQ ID NO: 35706 - RNA, 19 nt, Homo sapiens
gaaagaagagccggagccu

SEQ ID NO: 35707 - RNA, 19 nt, Homo sapiens
cuuucaugaaggggcggcg

SEQ ID NO: 35708 - RNA, 16 nt, Homo sapiens
cuggucuaccuguucg

SEQ ID NO: 35709 - RNA, 22 nt, Homo sapiens
cuggucuaccuguucgcgcgcc

SEQ ID NO: 35710 - RNA, 12 nt, Homo sapiens
cugguggcgcug

SEQ ID NO: 35711 - RNA, 13 nt, Homo sapiens
cugguggcgcugg

SEQ ID NO: 35712 - RNA, 14 nt, Homo sapiens
cugguggcgcuggc

SEQ ID NO: 35713 - RNA, 15 nt, Homo sapiens
cugguggcgcuggcu

SEQ ID NO: 35714 - RNA, 16 nt, Homo sapiens
cugguggcgcuggcug

SEQ ID NO: 35715 - RNA, 18 nt, Homo sapiens
cugguggcgcuggcugcg

SEQ ID NO: 35716 - RNA, 19 nt, Homo sapiens
cugguggcgcuggcugcgc

SEQ ID NO: 35717 - RNA, 20 nt, Homo sapiens
cugguggcgcuggcugcgcu

SEQ ID NO: 35718 - RNA, 12 nt, Homo sapiens
cuguacgcgagc

SEQ ID NO: 35719 - RNA, 16 nt, Homo sapiens
cuguacgcgagcgcgc

SEQ ID NO: 35720 - RNA, 17 nt, Homo sapiens
cuguacgcgagcgcgcg

SEQ ID NO: 35721 - RNA, 20 nt, Homo sapiens
cuguacgcgagcgcgcgcgc

SEQ ID NO: 35722 - RNA, 21 nt, Homo sapiens
cuguacgcgagcgcgcgcgcc

SEQ ID NO: 35723 - RNA, 23 nt, Homo sapiens
cuguacgcgagcgcgcgcgcccu

SEQ ID NO: 35724 - RNA, 14 nt, Homo sapiens
cuguucgcgcgccu

SEQ ID NO: 35725 - RNA, 15 nt, Homo sapiens
cuguucgcgcgccuc

SEQ ID NO: 35726 - RNA, 18 nt, Homo sapiens
cuguucgcgcgccuccgc

SEQ ID NO: 35727 - RNA, 21 nt, Homo sapiens
cuuccagggcuacgcgcgcuc

SEQ ID NO: 35728 - RNA, 24 nt, Homo sapiens
cuuccagggcuacgcgcgcuccgc

SEQ ID NO: 35729 - RNA, 14 nt, Homo sapiens
cuucccgcuguucc

SEQ ID NO: 35730 - RNA, 15 nt, Homo sapiens
cuucccgcuguuccu

SEQ ID NO: 35731 - RNA, 19 nt, Homo sapiens
cuucccgcuguuccucgcc

SEQ ID NO: 35732 - RNA, 17 nt, Homo sapiens
cuuccucccggccgcgc

SEQ ID NO: 35733 - RNA, 18 nt, Homo sapiens
cuuccucccggccgcgcu

SEQ ID NO: 35734 - RNA, 22 nt, Homo sapiens
cuuccucccggccgcgcugcgc

SEQ ID NO: 35735 - RNA, 20 nt, Homo sapiens
cuucuuucaugaaggggcgg

SEQ ID NO: 35736 - RNA, 14 nt, Homo sapiens
cucgugggacaguc

SEQ ID NO: 35737 - RNA, 14 nt, Homo sapiens
cuccagcugccccg

SEQ ID NO: 35738 - RNA, 15 nt, Homo sapiens
cuccagcugccccgg

SEQ ID NO: 35739 - RNA, 12 nt, Homo sapiens
cucgccacgcuc

SEQ ID NO: 35740 - RNA, 15 nt, Homo sapiens
cucgccacgcucugg

SEQ ID NO: 35741 - RNA, 22 nt, Homo sapiens
cucgccacgcucugggucgccg

SEQ ID NO: 35742 - RNA, 21 nt, Homo sapiens
cucgcccacuuccucccggcc

SEQ ID NO: 35743 - RNA, 22 nt, Homo sapiens
cucgcccacuuccucccggccg

SEQ ID NO: 35744 - RNA, 12 nt, Homo sapiens
cucgcuuccgca

SEQ ID NO: 35745 - RNA, 14 nt, Homo sapiens
cucggacggcuccg

SEQ ID NO: 35746 - RNA, 15 nt, Homo sapiens
cucggacggcuccgg

SEQ ID NO: 35747 - RNA, 16 nt, Homo sapiens
cucggccugcucgccc

SEQ ID NO: 35748 - RNA, 18 nt, Homo sapiens
cucggccugcucgcccac

SEQ ID NO: 35749 - RNA, 21 nt, Homo sapiens
cucggccugcucgcccacuuc

SEQ ID NO: 35750 - RNA, 22 nt, Homo sapiens
cucggccugcucgcccacuucc

SEQ ID NO: 35751 - RNA, 13 nt, Homo sapiens
cucucuuccuccc

SEQ ID NO: 35752 - RNA, 14 nt, Homo sapiens
cucuggcugcuggu

SEQ ID NO: 35753 - RNA, 21 nt, Homo sapiens
cucuggcugcugguggcgcug

SEQ ID NO: 35754 - RNA, 22 nt, Homo sapiens
cucuggcugcugguggcgcugg

SEQ ID NO: 35755 - RNA, 15 nt, Homo sapiens
cucugggucgccggc

SEQ ID NO: 35756 - RNA, 18 nt, Homo sapiens
cucugggucgccggcauc

SEQ ID NO: 35757 - RNA, 15 nt, Homo sapiens
cugccgugggccuga

SEQ ID NO: 35758 - RNA, 20 nt, Homo sapiens
cugcagcgaguacuucccgc

SEQ ID NO: 35759 - RNA, 22 nt, Homo sapiens
cugcagcgaguacuucccgcug

SEQ ID NO: 35760 - RNA, 11 nt, Homo sapiens
cugccccgggg

SEQ ID NO: 35761 - RNA, 16 nt, Homo sapiens
cugccccggggagggg

SEQ ID NO: 35762 - RNA, 20 nt, Homo sapiens
cugccccggggaggggcgcu

SEQ ID NO: 35763 - RNA, 23 nt, Homo sapiens
cugccccggggaggggcgcucgc

SEQ ID NO: 35764 - RNA, 24 nt, Homo sapiens
cugccccggggaggggcgcucgcu

SEQ ID NO: 35765 - RNA, 18 nt, Homo sapiens
cugagaccaaggcccccg

SEQ ID NO: 35766 - RNA, 20 nt, Homo sapiens
cugagaccaaggcccccggg

SEQ ID NO: 35767 - RNA, 21 nt, Homo sapiens
cugagaccaaggcccccgggc

SEQ ID NO: 35768 - RNA, 22 nt, Homo sapiens
cugagaccaaggcccccgggcc

SEQ ID NO: 35769 - RNA, 23 nt, Homo sapiens
cugagaccaaggcccccgggccg

SEQ ID NO: 35770 - RNA, 13 nt, Homo sapiens
cugcugguggcgc

SEQ ID NO: 35771 - RNA, 15 nt, Homo sapiens
cugcugguggcgcug

SEQ ID NO: 35772 - RNA, 24 nt, Homo sapiens
cugcugguggcgcuggcugcgcuc

SEQ ID NO: 35773 - RNA, 14 nt, Homo sapiens
cugcgcgccgcgcu

SEQ ID NO: 35774 - RNA, 17 nt, Homo sapiens
cugcgcgccgcgcuccu

SEQ ID NO: 35775 - RNA, 18 nt, Homo sapiens
cugcgcgccgcgcuccuc

SEQ ID NO: 35776 - RNA, 15 nt, Homo sapiens
cugcgcucggccugc

SEQ ID NO: 35777 - RNA, 19 nt, Homo sapiens
cugcucgcccacuuccucc

SEQ ID NO: 35778 - RNA, 20 nt, Homo sapiens
cugcucgcccacuuccuccc

SEQ ID NO: 35779 - RNA, 23 nt, Homo sapiens
cugcucgcccacuuccucccggc

SEQ ID NO: 35780 - RNA, 15 nt, Homo sapiens
cugcugccgugggcc

SEQ ID NO: 35781 - RNA, 17 nt, Homo sapiens
cugcugccgugggccug

SEQ ID NO: 35782 - RNA, 19 nt, Homo sapiens
cugcugccgugggccugag

SEQ ID NO: 35783 - RNA, 13 nt, Homo sapiens
cugggucgccggc

SEQ ID NO: 35784 - RNA, 16 nt, Homo sapiens
cugggucgccggcauc

SEQ ID NO: 35785 - RNA, 13 nt, Homo sapiens
cuggcugcgcucg

SEQ ID NO: 35786 - RNA, 18 nt, Homo sapiens
cuggcugcgcucggccug

SEQ ID NO: 35787 - RNA, 19 nt, Homo sapiens
cuggcugcgcucggccugc

SEQ ID NO: 35788 - RNA, 20 nt, Homo sapiens
cuggcugcgcucggccugcu

SEQ ID NO: 35789 - RNA, 23 nt, Homo sapiens
cuggcugcgcucggccugcucgc

SEQ ID NO: 35790 - RNA, 15 nt, Homo sapiens
cuggcugcugguggc

SEQ ID NO: 35791 - RNA, 16 nt, Homo sapiens
cuggcugcugguggcg

SEQ ID NO: 35792 - RNA, 17 nt, Homo sapiens
cuggcugcugguggcgc

SEQ ID NO: 35793 - RNA, 18 nt, Homo sapiens
cuggcugcugguggcgcu

SEQ ID NO: 35794 - RNA, 19 nt, Homo sapiens
cuggcugcugguggcgcug

SEQ ID NO: 35795 - RNA, 20 nt, Homo sapiens
cuggcugcugguggcgcugg

SEQ ID NO: 35796 - RNA, 22 nt, Homo sapiens
cuggcugcugguggcgcuggcu

SEQ ID NO: 35797 - RNA, 24 nt, Homo sapiens
cuggcugcugguggcgcuggcugc

SEQ ID NO: 35798 - RNA, 20 nt, Homo sapiens
cgcgcagcucaggcuggcac

SEQ ID NO: 35799 - RNA, 21 nt, Homo sapiens
cgcgcagcucaggcuggcacc

SEQ ID NO: 35800 - RNA, 17 nt, Homo sapiens
cgcauccuagucucuau

SEQ ID NO: 35801 - RNA, 12 nt, Homo sapiens
cgcgcccucugg

SEQ ID NO: 35802 - RNA, 15 nt, Homo sapiens
cgcgcccucuggcug

SEQ ID NO: 35803 - RNA, 16 nt, Homo sapiens
cgcgcccucuggcugc

SEQ ID NO: 35804 - RNA, 19 nt, Homo sapiens
cgcgcccucuggcugcugg

SEQ ID NO: 35805 - RNA, 20 nt, Homo sapiens
cgcgcccucuggcugcuggu

SEQ ID NO: 35806 - RNA, 22 nt, Homo sapiens
cgcgcccucuggcugcuggugg

SEQ ID NO: 35807 - RNA, 23 nt, Homo sapiens
cgcgcccucuggcugcugguggc

SEQ ID NO: 35808 - RNA, 24 nt, Homo sapiens
cgcgcccucuggcugcugguggcg

SEQ ID NO: 35809 - RNA, 13 nt, Homo sapiens
cgcgccgcgcucc

SEQ ID NO: 35810 - RNA, 14 nt, Homo sapiens
cgcgccgcgcuccu

SEQ ID NO: 35811 - RNA, 16 nt, Homo sapiens
cgcgccgcgcuccucg

SEQ ID NO: 35812 - RNA, 19 nt, Homo sapiens
cgcgccgcgcuccucggac

SEQ ID NO: 35813 - RNA, 13 nt, Homo sapiens
cgcgccuccgcua

SEQ ID NO: 35814 - RNA, 11 nt, Homo sapiens
cgcucggccug

SEQ ID NO: 35815 - RNA, 12 nt, Homo sapiens
cgcucggccugc

SEQ ID NO: 35816 - RNA, 15 nt, Homo sapiens
cgcucggccugcucg

SEQ ID NO: 35817 - RNA, 14 nt, Homo sapiens
cgcucugggucgcc

SEQ ID NO: 35818 - RNA, 17 nt, Homo sapiens
cgcucugggucgccggc

SEQ ID NO: 35819 - RNA, 11 nt, Homo sapiens
cgcugcgcgcc

SEQ ID NO: 35820 - RNA, 12 nt, Homo sapiens
cgcugcgcgccg

SEQ ID NO: 35821 - RNA, 14 nt, Homo sapiens
cgcugcgcgccgcg

SEQ ID NO: 35822 - RNA, 15 nt, Homo sapiens
cgcugcgcgccgcgc

SEQ ID NO: 35823 - RNA, 17 nt, Homo sapiens
cgcugcgcgccgcgcuc

SEQ ID NO: 35824 - RNA, 19 nt, Homo sapiens
cgcugcgcgccgcgcuccu

SEQ ID NO: 35825 - RNA, 15 nt, Homo sapiens
cgcugcugccguggg

SEQ ID NO: 35826 - RNA, 13 nt, Homo sapiens
cgcuggcugcgcu

SEQ ID NO: 35827 - RNA, 14 nt, Homo sapiens
cgcuggcugcgcuc

SEQ ID NO: 35828 - RNA, 16 nt, Homo sapiens
cgcuggcugcgcucgg

SEQ ID NO: 35829 - RNA, 17 nt, Homo sapiens
cgcuggcugcgcucggc

SEQ ID NO: 35830 - RNA, 21 nt, Homo sapiens
cgcuggcugcgcucggccugc

SEQ ID NO: 35831 - RNA, 22 nt, Homo sapiens
cgcuggcugcgcucggccugcu

SEQ ID NO: 35832 - RNA, 14 nt, Homo sapiens
cgcuguacgcgagc

SEQ ID NO: 35833 - RNA, 12 nt, Homo sapiens
cgcuguuccucg

SEQ ID NO: 35834 - RNA, 13 nt, Homo sapiens
cgcuguuccucgc

SEQ ID NO: 35835 - RNA, 14 nt, Homo sapiens
cgcuguuccucgcc

SEQ ID NO: 35836 - RNA, 15 nt, Homo sapiens
cgcuguuccucgcca

SEQ ID NO: 35837 - RNA, 17 nt, Homo sapiens
cgcuguuccucgccacg

SEQ ID NO: 35838 - RNA, 19 nt, Homo sapiens
cgcuguuccucgccacgcu

SEQ ID NO: 35839 - RNA, 20 nt, Homo sapiens
cgcuguuccucgccacgcuc

SEQ ID NO: 35840 - RNA, 21 nt, Homo sapiens
cgcuguuccucgccacgcucu

SEQ ID NO: 35841 - RNA, 23 nt, Homo sapiens
cgcuguuccucgccacgcucugg

SEQ ID NO: 35842 - RNA, 16 nt, Homo sapiens
cgcuuccgcauccuag

SEQ ID NO: 35843 - RNA, 11 nt, Homo sapiens
cgcgcgcccuc

SEQ ID NO: 35844 - RNA, 13 nt, Homo sapiens
cgcgcgcccucug

SEQ ID NO: 35845 - RNA, 14 nt, Homo sapiens
cgcgcgcccucugg

SEQ ID NO: 35846 - RNA, 16 nt, Homo sapiens
cgcgcgcccucuggcu

SEQ ID NO: 35847 - RNA, 11 nt, Homo sapiens
cgcgcgccucc

SEQ ID NO: 35848 - RNA, 14 nt, Homo sapiens
cgcgcgccuccgcu

SEQ ID NO: 35849 - RNA, 18 nt, Homo sapiens
cgcgcgccuccgcuacuu

SEQ ID NO: 35850 - RNA, 12 nt, Homo sapiens
cgcgcgcgcccu

SEQ ID NO: 35851 - RNA, 13 nt, Homo sapiens
cgcgcgcgcccuc

SEQ ID NO: 35852 - RNA, 12 nt, Homo sapiens
cgcgcgcuccgc

SEQ ID NO: 35853 - RNA, 13 nt, Homo sapiens
cgcgcgcuccgcg

SEQ ID NO: 35854 - RNA, 14 nt, Homo sapiens
cgcgcgcuccgcgc

SEQ ID NO: 35855 - RNA, 17 nt, Homo sapiens
cgcgcgcuccgcgcagc

SEQ ID NO: 35856 - RNA, 18 nt, Homo sapiens
cgcgcgcuccgcgcagcu

SEQ ID NO: 35857 - RNA, 12 nt, Homo sapiens
cgcgcucauccc

SEQ ID NO: 35858 - RNA, 15 nt, Homo sapiens
cgcgcucaucccacc

SEQ ID NO: 35859 - RNA, 12 nt, Homo sapiens
cgcgcuccgcgc

SEQ ID NO: 35860 - RNA, 13 nt, Homo sapiens
cgcgcuccgcgca

SEQ ID NO: 35861 - RNA, 16 nt, Homo sapiens
cgcgcuccgcgcagcu

SEQ ID NO: 35862 - RNA, 20 nt, Homo sapiens
cgcgcuccucggacggcucc

SEQ ID NO: 35863 - RNA, 11 nt, Homo sapiens
cgcgcugcgcg

SEQ ID NO: 35864 - RNA, 13 nt, Homo sapiens
cgcgcugcgcgcc

SEQ ID NO: 35865 - RNA, 15 nt, Homo sapiens
cgcgcugcgcgccgc

SEQ ID NO: 35866 - RNA, 16 nt, Homo sapiens
cgcgcugcgcgccgcg

SEQ ID NO: 35867 - RNA, 18 nt, Homo sapiens
cgcggcgggagggcgcgg

SEQ ID NO: 35868 - RNA, 20 nt, Homo sapiens
cgcggcgggagggcgcgggg

SEQ ID NO: 35869 - RNA, 21 nt, Homo sapiens
cgcggcgggagggcgcggggc

SEQ ID NO: 35870 - RNA, 23 nt, Homo sapiens
cgcggcgggagggcgcggggcgg

SEQ ID NO: 35871 - RNA, 11 nt, Homo sapiens
cgcggggcggg

SEQ ID NO: 35872 - RNA, 16 nt, Homo sapiens
cgcggggcggggagcg

SEQ ID NO: 35873 - RNA, 14 nt, Homo sapiens
cggacgcugcugcc

SEQ ID NO: 35874 - RNA, 18 nt, Homo sapiens
cggacgcugcugccgugg

SEQ ID NO: 35875 - RNA, 23 nt, Homo sapiens
cggacgcugcugccgugggccug

SEQ ID NO: 35876 - RNA, 13 nt, Homo sapiens
cggacggcuccgg

SEQ ID NO: 35877 - RNA, 17 nt, Homo sapiens
cggacggcuccggacgc

SEQ ID NO: 35878 - RNA, 17 nt, Homo sapiens
cgcuacuuccagggcua

SEQ ID NO: 35879 - RNA, 22 nt, Homo sapiens
cgcucaucccacccgcccaccg

SEQ ID NO: 35880 - RNA, 23 nt, Homo sapiens
cgcucaucccacccgcccaccgc

SEQ ID NO: 35881 - RNA, 13 nt, Homo sapiens
cgcuccgcgcagc

SEQ ID NO: 35882 - RNA, 12 nt, Homo sapiens
cgcuccucggac

SEQ ID NO: 35883 - RNA, 16 nt, Homo sapiens
cgcuccucggacggcu

SEQ ID NO: 35884 - RNA, 18 nt, Homo sapiens
cgcuccucggacggcucc

SEQ ID NO: 35885 - RNA, 13 nt, Homo sapiens
cgcucgcuuccgc

SEQ ID NO: 35886 - RNA, 16 nt, Homo sapiens
cgggccgacggagccg

SEQ ID NO: 35887 - RNA, 17 nt, Homo sapiens
cgggccgacggagccgg

SEQ ID NO: 35888 - RNA, 20 nt, Homo sapiens
cgggccgacggagccgggaa

SEQ ID NO: 35889 - RNA, 21 nt, Homo sapiens
cgggccgacggagccgggaaa

SEQ ID NO: 35890 - RNA, 12 nt, Homo sapiens
cggggagcgagc

SEQ ID NO: 35891 - RNA, 13 nt, Homo sapiens
cggggagcgagcc

SEQ ID NO: 35892 - RNA, 19 nt, Homo sapiens
cggggagcgagccccaggc

SEQ ID NO: 35893 - RNA, 21 nt, Homo sapiens
cggggagcgagccccaggcgg

SEQ ID NO: 35894 - RNA, 22 nt, Homo sapiens
cggggagcgagccccaggcggg

SEQ ID NO: 35895 - RNA, 14 nt, Homo sapiens
cggggaggggcgcu

SEQ ID NO: 35896 - RNA, 15 nt, Homo sapiens
cggggaggggcgcuc

SEQ ID NO: 35897 - RNA, 17 nt, Homo sapiens
cggggaggggcgcucgc

SEQ ID NO: 35898 - RNA, 18 nt, Homo sapiens
cggggaggggcgcucgcu

SEQ ID NO: 35899 - RNA, 19 nt, Homo sapiens
cggggaggggcgcucgcuu

SEQ ID NO: 35900 - RNA, 20 nt, Homo sapiens
cggggaggggcgcucgcuuc

SEQ ID NO: 35901 - RNA, 21 nt, Homo sapiens
cggggaggggcgcucgcuucc

SEQ ID NO: 35902 - RNA, 22 nt, Homo sapiens
cggggaggggcgcucgcuuccg

SEQ ID NO: 35903 - RNA, 19 nt, Homo sapiens
cggggcggggagcgagccc

SEQ ID NO: 35904 - RNA, 20 nt, Homo sapiens
cggggcggggagcgagcccc

SEQ ID NO: 35905 - RNA, 17 nt, Homo sapiens
cggagccgggaaagaag

SEQ ID NO: 35906 - RNA, 14 nt, Homo sapiens
cggagccuccagcu

SEQ ID NO: 35907 - RNA, 16 nt, Homo sapiens
cggagccuccagcugc

SEQ ID NO: 35908 - RNA, 19 nt, Homo sapiens
cggagccuccagcugcccc

SEQ ID NO: 35909 - RNA, 20 nt, Homo sapiens
cggagccuccagcugccccg

SEQ ID NO: 35910 - RNA, 21 nt, Homo sapiens
cggagccuccagcugccccgg

SEQ ID NO: 35911 - RNA, 14 nt, Homo sapiens
cggcccugugcggc

SEQ ID NO: 35912 - RNA, 16 nt, Homo sapiens
cggcccugugcggccu

SEQ ID NO: 35913 - RNA, 18 nt, Homo sapiens
cggcccugugcggccugg

SEQ ID NO: 35914 - RNA, 19 nt, Homo sapiens
cggcccugugcggccuggu

SEQ ID NO: 35915 - RNA, 15 nt, Homo sapiens
cggccgcgcugcgcg

SEQ ID NO: 35916 - RNA, 16 nt, Homo sapiens
cggccgcgcugcgcgc

SEQ ID NO: 35917 - RNA, 17 nt, Homo sapiens
cggccgcgcugcgcgcc

SEQ ID NO: 35918 - RNA, 18 nt, Homo sapiens
cggccgcgcugcgcgccg

SEQ ID NO: 35919 - RNA, 20 nt, Homo sapiens
cggccgcgcugcgcgccgcg

SEQ ID NO: 35920 - RNA, 21 nt, Homo sapiens
cggccgcgcugcgcgccgcgc

SEQ ID NO: 35921 - RNA, 11 nt, Homo sapiens
cggccggcgcg

SEQ ID NO: 35922 - RNA, 12 nt, Homo sapiens
cggccggcgcgc

SEQ ID NO: 35923 - RNA, 13 nt, Homo sapiens
cggccggcgcgcu

SEQ ID NO: 35924 - RNA, 15 nt, Homo sapiens
cggccggcgcgcuca

SEQ ID NO: 35925 - RNA, 12 nt, Homo sapiens
cggccugcucgc

SEQ ID NO: 35926 - RNA, 13 nt, Homo sapiens
cggccugcucgcc

SEQ ID NO: 35927 - RNA, 14 nt, Homo sapiens
cggccugcucgccc

SEQ ID NO: 35928 - RNA, 15 nt, Homo sapiens
cggccugcucgccca

SEQ ID NO: 35929 - RNA, 21 nt, Homo sapiens
cggccugcucgcccacuuccu

SEQ ID NO: 35930 - RNA, 20 nt, Homo sapiens
cggccuggucuaccuguucg

SEQ ID NO: 35931 - RNA, 21 nt, Homo sapiens
cggccuggucuaccuguucgc

SEQ ID NO: 35932 - RNA, 21 nt, Homo sapiens
cggcgcgcucaucccacccgc

SEQ ID NO: 35933 - RNA, 10 nt, Homo sapiens
cggcggcccu

SEQ ID NO: 35934 - RNA, 11 nt, Homo sapiens
cggcggcccug

SEQ ID NO: 35935 - RNA, 12 nt, Homo sapiens
cggcggcccugu

SEQ ID NO: 35936 - RNA, 13 nt, Homo sapiens
cggcggcccugug

SEQ ID NO: 35937 - RNA, 14 nt, Homo sapiens
cggcggcccugugc

SEQ ID NO: 35938 - RNA, 21 nt, Homo sapiens
cggcggcccugugcggccugg

SEQ ID NO: 35939 - RNA, 22 nt, Homo sapiens
cggcggcccugugcggccuggu

SEQ ID NO: 35940 - RNA, 16 nt, Homo sapiens
cggcgggagggcgcgg

SEQ ID NO: 35941 - RNA, 17 nt, Homo sapiens
cggcgggagggcgcggg

SEQ ID NO: 35942 - RNA, 18 nt, Homo sapiens
cggcgggagggcgcgggg

SEQ ID NO: 35943 - RNA, 22 nt, Homo sapiens
cggcgggagggcgcggggcggg

SEQ ID NO: 35944 - RNA, 14 nt, Homo sapiens
cggcuccggacgcu

SEQ ID NO: 35945 - RNA, 16 nt, Homo sapiens
cggcuccggacgcugc

SEQ ID NO: 35946 - RNA, 18 nt, Homo sapiens
cggcuccggacgcugcug

SEQ ID NO: 35947 - RNA, 19 nt, Homo sapiens
cggcuccggacgcugcugc

SEQ ID NO: 35948 - RNA, 20 nt, Homo sapiens
cggcuccggacgcugcugcc

SEQ ID NO: 35949 - RNA, 21 nt, Homo sapiens
cggcuccggacgcugcugccg

SEQ ID NO: 35950 - RNA, 15 nt, Homo sapiens
cgggaaagaagagcc

SEQ ID NO: 35951 - RNA, 17 nt, Homo sapiens
cgggaaagaagagccgg

SEQ ID NO: 35952 - RNA, 22 nt, Homo sapiens
cgggaaagaagagccggagccu

SEQ ID NO: 35953 - RNA, 20 nt, Homo sapiens
cuaggaaauauuuauuuuaa

SEQ ID NO: 35954 - RNA, 23 nt, Homo sapiens
cucauggaauuggagcucguggg

SEQ ID NO: 35955 - RNA, 12 nt, Homo sapiens
cuccgcgcagcu

SEQ ID NO: 35956 - RNA, 17 nt, Homo sapiens
cuccgcuacuuccaggg

SEQ ID NO: 35957 - RNA, 13 nt, Homo sapiens
cuccggacgcugc

SEQ ID NO: 35958 - RNA, 14 nt, Homo sapiens
cuccggacgcugcu

SEQ ID NO: 35959 - RNA, 15 nt, Homo sapiens
cuccggacgcugcug

SEQ ID NO: 35960 - RNA, 16 nt, Homo sapiens
cuccggacgcugcugc

SEQ ID NO: 35961 - RNA, 17 nt, Homo sapiens
cuccggacgcugcugcc

SEQ ID NO: 35962 - RNA, 18 nt, Homo sapiens
cuccggacgcugcugccg

SEQ ID NO: 35963 - RNA, 19 nt, Homo sapiens
cuccggacgcugcugccgu

SEQ ID NO: 35964 - RNA, 20 nt, Homo sapiens
cuccggacgcugcugccgug

SEQ ID NO: 35965 - RNA, 23 nt, Homo sapiens
cuccggacgcugcugccgugggc

SEQ ID NO: 35966 - RNA, 22 nt, Homo sapiens
cuccucggacggcuccggacgc

SEQ ID NO: 35967 - RNA, 11 nt, Homo sapiens
cucccggccgc

SEQ ID NO: 35968 - RNA, 12 nt, Homo sapiens
cucccggccgcg

SEQ ID NO: 35969 - RNA, 16 nt, Homo sapiens
cucccggccgcgcugc

SEQ ID NO: 35970 - RNA, 17 nt, Homo sapiens
cucccggccgcgcugcg

SEQ ID NO: 35971 - RNA, 18 nt, Homo sapiens
cucccggccgcgcugcgc

SEQ ID NO: 35972 - RNA, 20 nt, Homo sapiens
cucccggccgcgcugcgcgc

SEQ ID NO: 35973 - RNA, 15 nt, Homo sapiens
cuaucucauuuccaa

SEQ ID NO: 35974 - RNA, 13 nt, Homo sapiens
cuagugaccgaga

SEQ ID NO: 35975 - RNA, 12 nt, Homo sapiens
cuaguauuucua

SEQ ID NO: 35976 - RNA, 13 nt, Homo sapiens
cuaguauuucuau

SEQ ID NO: 35977 - RNA, 14 nt, Homo sapiens
cucaucccacccgc

SEQ ID NO: 35978 - RNA, 13 nt, Homo sapiens
cucaggcuggcac

SEQ ID NO: 35979 - RNA, 15 nt, Homo sapiens
cucaggcuggcaccg

SEQ ID NO: 35980 - RNA, 20 nt, Homo sapiens
cucaggcuggcaccgcugua

SEQ ID NO: 35981 - RNA, 22 nt, Homo sapiens
cucaggcuggcaccgcuguacg

SEQ ID NO: 35982 - RNA, 16 nt, Homo sapiens
cgggagggcgcggggc

SEQ ID NO: 35983 - RNA, 19 nt, Homo sapiens
cgggagggcgcggggcggg

SEQ ID NO: 35984 - RNA, 21 nt, Homo sapiens
cgggagggcgcggggcgggga

SEQ ID NO: 35985 - RNA, 14 nt, Homo sapiens
cggguccgggucgc

SEQ ID NO: 35986 - RNA, 15 nt, Homo sapiens
cggguccgggucgca

SEQ ID NO: 35987 - RNA, 19 nt, Homo sapiens
cggguccgggucgcaggac

SEQ ID NO: 35988 - RNA, 21 nt, Homo sapiens
cggguccgggucgcaggacca

SEQ ID NO: 35989 - RNA, 22 nt, Homo sapiens
cgggucgcaggaccaucccggc

SEQ ID NO: 35990 - RNA, 17 nt, Homo sapiens
cuaccuguucgcgcgcc

SEQ ID NO: 35991 - RNA, 20 nt, Homo sapiens
cuaccuguucgcgcgccucc

SEQ ID NO: 35992 - RNA, 11 nt, Homo sapiens
cuacgcgcgcu

SEQ ID NO: 35993 - RNA, 13 nt, Homo sapiens
cuacgcgcgcucc

SEQ ID NO: 35994 - RNA, 14 nt, Homo sapiens
cuacgcgcgcuccg

SEQ ID NO: 35995 - RNA, 15 nt, Homo sapiens
cuacgcgcgcuccgc

SEQ ID NO: 35996 - RNA, 16 nt, Homo sapiens
cuacgcgcgcuccgcg

SEQ ID NO: 35997 - RNA, 17 nt, Homo sapiens
cuacgcgcgcuccgcgc

SEQ ID NO: 35998 - RNA, 20 nt, Homo sapiens
cuacgcgcgcuccgcgcagc

SEQ ID NO: 35999 - RNA, 19 nt, Homo sapiens
cuacuuccagggcuacgcg

SEQ ID NO: 36000 - RNA, 9 nt, Homo sapiens
gaaggggcg

SEQ ID NO: 36001 - RNA, 15 nt, Homo sapiens
gaaggggcggcggcc

SEQ ID NO: 36002 - RNA, 17 nt, Homo sapiens
gaaggggcggcggcccu

SEQ ID NO: 36003 - RNA, 13 nt, Homo sapiens
gacacacugaaga

SEQ ID NO: 36004 - RNA, 18 nt, Homo sapiens
gaccaaggcccccgggcc

SEQ ID NO: 36005 - RNA, 20 nt, Homo sapiens
gaccaaggcccccgggccga

SEQ ID NO: 36006 - RNA, 23 nt, Homo sapiens
gaccaaggcccccgggccgacgg

SEQ ID NO: 36007 - RNA, 16 nt, Homo sapiens
gaccaucccggccggc

SEQ ID NO: 36008 - RNA, 17 nt, Homo sapiens
gaccaucccggccggcg

SEQ ID NO: 36009 - RNA, 18 nt, Homo sapiens
gaccaucccggccggcgc

SEQ ID NO: 36010 - RNA, 20 nt, Homo sapiens
gaccaucccggccggcgcgc

SEQ ID NO: 36011 - RNA, 21 nt, Homo sapiens
gaccaucccggccggcgcgcu

SEQ ID NO: 36012 - RNA, 15 nt, Homo sapiens
gacacacugaagaag

SEQ ID NO: 36013 - RNA, 19 nt, Homo sapiens
gacagucaccucauggaau

SEQ ID NO: 36014 - RNA, 12 nt, Homo sapiens
gaagaacugaaa

SEQ ID NO: 36015 - RNA, 12 nt, Homo sapiens
gaagagccggag

SEQ ID NO: 36016 - RNA, 14 nt, Homo sapiens
gaagagccggagcc

SEQ ID NO: 36017 - RNA, 15 nt, Homo sapiens
gaagagccggagccu

SEQ ID NO: 36018 - RNA, 19 nt, Homo sapiens
gaagagccggagccuccag

SEQ ID NO: 36019 - RNA, 21 nt, Homo sapiens
gaagagccggagccuccagcu

SEQ ID NO: 36020 - RNA, 11 nt, Homo sapiens
gacggcuccgg

SEQ ID NO: 36021 - RNA, 13 nt, Homo sapiens
gacggcuccggac

SEQ ID NO: 36022 - RNA, 14 nt, Homo sapiens
gacggcuccggacg

SEQ ID NO: 36023 - RNA, 17 nt, Homo sapiens
gacggcuccggacgcug

SEQ ID NO: 36024 - RNA, 17 nt, Homo sapiens
gacgcugcugccguggg

SEQ ID NO: 36025 - RNA, 13 nt, Homo sapiens
gacggagccggga

SEQ ID NO: 36026 - RNA, 14 nt, Homo sapiens
gacggagccgggaa

SEQ ID NO: 36027 - RNA, 13 nt, Homo sapiens
gagagaaugagag

SEQ ID NO: 36028 - RNA, 17 nt, Homo sapiens
gagagacacacugaaga

SEQ ID NO: 36029 - RNA, 18 nt, Homo sapiens
gagagacacacugaagaa

SEQ ID NO: 36030 - RNA, 16 nt, Homo sapiens
gagaccaaggcccccg

SEQ ID NO: 36031 - RNA, 19 nt, Homo sapiens
gagaccaaggcccccgggc

SEQ ID NO: 36032 - RNA, 11 nt, Homo sapiens
gagcucgugga

SEQ ID NO: 36033 - RNA, 14 nt, Homo sapiens
gaggggcgcucgcu

SEQ ID NO: 36034 - RNA, 23 nt, Homo sapiens
gaggggcgcucgcuuccgcaucc

SEQ ID NO: 36035 - RNA, 19 nt, Homo sapiens
gagggaagccuuggggcug

SEQ ID NO: 36036 - RNA, 16 nt, Homo sapiens
gagggcgcggggcggg

SEQ ID NO: 36037 - RNA, 18 nt, Homo sapiens
gagggcgcggggcgggga

SEQ ID NO: 36038 - RNA, 11 nt, Homo sapiens
gagccggagcc

SEQ ID NO: 36039 - RNA, 13 nt, Homo sapiens
gagccggagccuc

SEQ ID NO: 36040 - RNA, 21 nt, Homo sapiens
gagccggagccuccagcugcc

SEQ ID NO: 36041 - RNA, 18 nt, Homo sapiens
gagccgggaaagaagagc

SEQ ID NO: 36042 - RNA, 21 nt, Homo sapiens
gagccgggaaagaagagccgg

SEQ ID NO: 36043 - RNA, 23 nt, Homo sapiens
gagccgggaaagaagagccggag

SEQ ID NO: 36044 - RNA, 13 nt, Homo sapiens
gagccuccagcug

SEQ ID NO: 36045 - RNA, 16 nt, Homo sapiens
gagccuccagcugccc

SEQ ID NO: 36046 - RNA, 18 nt, Homo sapiens
gagccuccagcugccccg

SEQ ID NO: 36047 - RNA, 19 nt, Homo sapiens
gagccuccagcugccccgg

SEQ ID NO: 36048 - RNA, 20 nt, Homo sapiens
gagccuccagcugccccggg

SEQ ID NO: 36049 - RNA, 22 nt, Homo sapiens
gagccuccagcugccccgggga

SEQ ID NO: 36050 - RNA, 14 nt, Homo sapiens
gagcgagccccagg

SEQ ID NO: 36051 - RNA, 16 nt, Homo sapiens
gagcgagccccaggcg

SEQ ID NO: 36052 - RNA, 20 nt, Homo sapiens
gagcgagccccaggcggguc

SEQ ID NO: 36053 - RNA, 13 nt, Homo sapiens
gagcgcgcgcgcc

SEQ ID NO: 36054 - RNA, 14 nt, Homo sapiens
gagcgcgcgcgccc

SEQ ID NO: 36055 - RNA, 16 nt, Homo sapiens
gagcgcgcgcgcccuc

SEQ ID NO: 36056 - RNA, 18 nt, Homo sapiens
gagcgcgcgcgcccucug

SEQ ID NO: 36057 - RNA, 19 nt, Homo sapiens
gagcgcgcgcgcccucugg

SEQ ID NO: 36058 - RNA, 21 nt, Homo sapiens
gauucccagccagcacagccu

SEQ ID NO: 36059 - RNA, 11 nt, Homo sapiens
gaguacuuccc

SEQ ID NO: 36060 - RNA, 16 nt, Homo sapiens
gaguacuucccgcugu

SEQ ID NO: 36061 - RNA, 22 nt, Homo sapiens
gaguacuucccgcuguuccucg

SEQ ID NO: 36062 - RNA, 14 nt, Homo sapiens
gccccaggcggguc

SEQ ID NO: 36063 - RNA, 15 nt, Homo sapiens
gcccacuuccucccg

SEQ ID NO: 36064 - RNA, 17 nt, Homo sapiens
gcccacuuccucccggc

SEQ ID NO: 36065 - RNA, 18 nt, Homo sapiens
gcccacuuccucccggcc

SEQ ID NO: 36066 - RNA, 21 nt, Homo sapiens
gcccacuuccucccggccgcg

SEQ ID NO: 36067 - RNA, 22 nt, Homo sapiens
gcccacuuccucccggccgcgc

SEQ ID NO: 36068 - RNA, 23 nt, Homo sapiens
gcccacuuccucccggccgcgcu

SEQ ID NO: 36069 - RNA, 11 nt, Homo sapiens
gcccccgggcc

SEQ ID NO: 36070 - RNA, 12 nt, Homo sapiens
gcccccgggccg

SEQ ID NO: 36071 - RNA, 13 nt, Homo sapiens
gcccccgggccga

SEQ ID NO: 36072 - RNA, 15 nt, Homo sapiens
gcccccgggccgacg

SEQ ID NO: 36073 - RNA, 16 nt, Homo sapiens
gcccccgggccgacgg

SEQ ID NO: 36074 - RNA, 17 nt, Homo sapiens
gcccccgggccgacgga

SEQ ID NO: 36075 - RNA, 12 nt, Homo sapiens
gccccggggagg

SEQ ID NO: 36076 - RNA, 13 nt, Homo sapiens
gccccggggaggg

SEQ ID NO: 36077 - RNA, 17 nt, Homo sapiens
gccccggggaggggcgc

SEQ ID NO: 36078 - RNA, 18 nt, Homo sapiens
gccccggggaggggcgcu

SEQ ID NO: 36079 - RNA, 19 nt, Homo sapiens
gccccggggaggggcgcuc

SEQ ID NO: 36080 - RNA, 20 nt, Homo sapiens
gccccggggaggggcgcucg

SEQ ID NO: 36081 - RNA, 21 nt, Homo sapiens
gccccggggaggggcgcucgc

SEQ ID NO: 36082 - RNA, 22 nt, Homo sapiens
gccccggggaggggcgcucgcu

SEQ ID NO: 36083 - RNA, 12 nt, Homo sapiens
gccgacggagcc

SEQ ID NO: 36084 - RNA, 14 nt, Homo sapiens
gccgacggagccgg

SEQ ID NO: 36085 - RNA, 17 nt, Homo sapiens
gccgacggagccgggaa

SEQ ID NO: 36086 - RNA, 21 nt, Homo sapiens
gccgacggagccgggaaagaa

SEQ ID NO: 36087 - RNA, 12 nt, Homo sapiens
gcccugugcggc

SEQ ID NO: 36088 - RNA, 13 nt, Homo sapiens
gcccugugcggcc

SEQ ID NO: 36089 - RNA, 15 nt, Homo sapiens
gcccugugcggccug

SEQ ID NO: 36090 - RNA, 16 nt, Homo sapiens
gcccugugcggccugg

SEQ ID NO: 36091 - RNA, 15 nt, Homo sapiens
gcccucuggcugcug

SEQ ID NO: 36092 - RNA, 20 nt, Homo sapiens
gcccucuggcugcugguggc

SEQ ID NO: 36093 - RNA, 22 nt, Homo sapiens
gcccucuggcugcugguggcgc

SEQ ID NO: 36094 - RNA, 19 nt, Homo sapiens
gccggagccuccagcugcc

SEQ ID NO: 36095 - RNA, 20 nt, Homo sapiens
gccggagccuccagcugccc

SEQ ID NO: 36096 - RNA, 22 nt, Homo sapiens
gccggagccuccagcugccccg

SEQ ID NO: 36097 - RNA, 23 nt, Homo sapiens
gccggagccuccagcugccccgg

SEQ ID NO: 36098 - RNA, 14 nt, Homo sapiens
gccggcgcgcucau

SEQ ID NO: 36099 - RNA, 16 nt, Homo sapiens
gccggcgcgcucaucc

SEQ ID NO: 36100 - RNA, 22 nt, Homo sapiens
gccggcgcgcucaucccacccg

SEQ ID NO: 36101 - RNA, 23 nt, Homo sapiens
gccggcgcgcucaucccacccgc

SEQ ID NO: 36102 - RNA, 16 nt, Homo sapiens
gccgggaaagaagagc

SEQ ID NO: 36103 - RNA, 17 nt, Homo sapiens
gccgggaaagaagagcc

SEQ ID NO: 36104 - RNA, 18 nt, Homo sapiens
gccgggaaagaagagccg

SEQ ID NO: 36105 - RNA, 21 nt, Homo sapiens
gccgggaaagaagagccggag

SEQ ID NO: 36106 - RNA, 22 nt, Homo sapiens
gccgggaaagaagagccggagc

SEQ ID NO: 36107 - RNA, 13 nt, Homo sapiens
gccgcgcuccucg

SEQ ID NO: 36108 - RNA, 21 nt, Homo sapiens
gccgcgcuccucggacggcuc

SEQ ID NO: 36109 - RNA, 22 nt, Homo sapiens
gccgcgcuccucggacggcucc

SEQ ID NO: 36110 - RNA, 11 nt, Homo sapiens
gccgcgcugcg

SEQ ID NO: 36111 - RNA, 14 nt, Homo sapiens
gccgcgcugcgcgc

SEQ ID NO: 36112 - RNA, 15 nt, Homo sapiens
gccgcgcugcgcgcc

SEQ ID NO: 36113 - RNA, 16 nt, Homo sapiens
gccgcgcugcgcgccg

SEQ ID NO: 36114 - RNA, 18 nt, Homo sapiens
gccgcgcugcgcgccgcg

SEQ ID NO: 36115 - RNA, 15 nt, Homo sapiens
gccugagaccaaggc

SEQ ID NO: 36116 - RNA, 16 nt, Homo sapiens
gccugagaccaaggcc

SEQ ID NO: 36117 - RNA, 12 nt, Homo sapiens
gccuccgcuacu

SEQ ID NO: 36118 - RNA, 20 nt, Homo sapiens
gccuccgcuacuuccagggc

SEQ ID NO: 36119 - RNA, 12 nt, Homo sapiens
gccugcucgccc

SEQ ID NO: 36120 - RNA, 14 nt, Homo sapiens
gccugcucgcccac

SEQ ID NO: 36121 - RNA, 21 nt, Homo sapiens
gccugcucgcccacuuccucc

SEQ ID NO: 36122 - RNA, 22 nt, Homo sapiens
gccugcucgcccacuuccuccc

SEQ ID NO: 36123 - RNA, 13 nt, Homo sapiens
gccuccagcugcc

SEQ ID NO: 36124 - RNA, 17 nt, Homo sapiens
gccuccagcugccccgg

SEQ ID NO: 36125 - RNA, 18 nt, Homo sapiens
gccuccagcugccccggg

SEQ ID NO: 36126 - RNA, 14 nt, Homo sapiens
gccgugggccugag

SEQ ID NO: 36127 - RNA, 23 nt, Homo sapiens
gccgugggccugagaccaaggcc

SEQ ID NO: 36128 - RNA, 18 nt, Homo sapiens
gcgcgcccucuggcugcu

SEQ ID NO: 36129 - RNA, 19 nt, Homo sapiens
gcgcgcccucuggcugcug

SEQ ID NO: 36130 - RNA, 20 nt, Homo sapiens
gcgcgcccucuggcugcugg

SEQ ID NO: 36131 - RNA, 14 nt, Homo sapiens
gcgcgccgcgcucc

SEQ ID NO: 36132 - RNA, 15 nt, Homo sapiens
gcgcgccgcgcuccu

SEQ ID NO: 36133 - RNA, 16 nt, Homo sapiens
gcgcgccgcgcuccuc

SEQ ID NO: 36134 - RNA, 18 nt, Homo sapiens
gcgcgccgcgcuccucgg

SEQ ID NO: 36135 - RNA, 11 nt, Homo sapiens
gcgcgccuccg

SEQ ID NO: 36136 - RNA, 12 nt, Homo sapiens
gcgcgccuccgc

SEQ ID NO: 36137 - RNA, 14 nt, Homo sapiens
gcgcgccuccgcua

SEQ ID NO: 36138 - RNA, 17 nt, Homo sapiens
gcgcgccuccgcuacuu

SEQ ID NO: 36139 - RNA, 14 nt, Homo sapiens
gcgagccccaggcg

SEQ ID NO: 36140 - RNA, 15 nt, Homo sapiens
gcgagccccaggcgg

SEQ ID NO: 36141 - RNA, 16 nt, Homo sapiens
gcgagccccaggcggg

SEQ ID NO: 36142 - RNA, 11 nt, Homo sapiens
gcgagcgcgcg

SEQ ID NO: 36143 - RNA, 12 nt, Homo sapiens
gcgagcgcgcgc

SEQ ID NO: 36144 - RNA, 13 nt, Homo sapiens
gcgagcgcgcgcg

SEQ ID NO: 36145 - RNA, 14 nt, Homo sapiens
gcgagcgcgcgcgc

SEQ ID NO: 36146 - RNA, 16 nt, Homo sapiens
gcgagcgcgcgcgccc

SEQ ID NO: 36147 - RNA, 19 nt, Homo sapiens
gcgagcgcgcgcgcccucu

SEQ ID NO: 36148 - RNA, 16 nt, Homo sapiens
gcgaguacuucccgcu

SEQ ID NO: 36149 - RNA, 18 nt, Homo sapiens
gcgaguacuucccgcugu

SEQ ID NO: 36150 - RNA, 22 nt, Homo sapiens
gcgaguacuucccgcuguuccu

SEQ ID NO: 36151 - RNA, 13 nt, Homo sapiens
gcgcagcucaggc

SEQ ID NO: 36152 - RNA, 16 nt, Homo sapiens
gcgcagcucaggcugg

SEQ ID NO: 36153 - RNA, 14 nt, Homo sapiens
gcgcccucuggcug

SEQ ID NO: 36154 - RNA, 17 nt, Homo sapiens
gcgcccucuggcugcug

SEQ ID NO: 36155 - RNA, 23 nt, Homo sapiens
gcgcccucuggcugcugguggcg

SEQ ID NO: 36156 - RNA, 12 nt, Homo sapiens
gcgccgcgcucc

SEQ ID NO: 36157 - RNA, 13 nt, Homo sapiens
gcgccgcgcuccu

SEQ ID NO: 36158 - RNA, 20 nt, Homo sapiens
gcgccgcgcuccucggacgg

SEQ ID NO: 36159 - RNA, 23 nt, Homo sapiens
gcgccgcgcuccucggacggcuc

SEQ ID NO: 36160 - RNA, 17 nt, Homo sapiens
gcgccuccgcuacuucc

SEQ ID NO: 36161 - RNA, 14 nt, Homo sapiens
gcaguucugaagaa

SEQ ID NO: 36162 - RNA, 18 nt, Homo sapiens
gcaguucugaagaagaug

SEQ ID NO: 36163 - RNA, 17 nt, Homo sapiens
gccacgcucugggucgc

SEQ ID NO: 36164 - RNA, 18 nt, Homo sapiens
gccacgcucugggucgcc

SEQ ID NO: 36165 - RNA, 19 nt, Homo sapiens
gccacgcucugggucgccg

SEQ ID NO: 36166 - RNA, 20 nt, Homo sapiens
gccacgcucugggucgccgg

SEQ ID NO: 36167 - RNA, 21 nt, Homo sapiens
gccacgcucugggucgccggc

SEQ ID NO: 36168 - RNA, 15 nt, Homo sapiens
gcagcgaguacuucc

SEQ ID NO: 36169 - RNA, 20 nt, Homo sapiens
gcagcgaguacuucccgcug

SEQ ID NO: 36170 - RNA, 13 nt, Homo sapiens
gcagcucaggcug

SEQ ID NO: 36171 - RNA, 14 nt, Homo sapiens
gcagcucaggcugg

SEQ ID NO: 36172 - RNA, 15 nt, Homo sapiens
gcagcucaggcuggc

SEQ ID NO: 36173 - RNA, 16 nt, Homo sapiens
gcagcucaggcuggca

SEQ ID NO: 36174 - RNA, 17 nt, Homo sapiens
gcagcucaggcuggcac

SEQ ID NO: 36175 - RNA, 16 nt, Homo sapiens
gcaggaccaucccggc

SEQ ID NO: 36176 - RNA, 17 nt, Homo sapiens
gcaggaccaucccggcc

SEQ ID NO: 36177 - RNA, 20 nt, Homo sapiens
gcaggaccaucccggccggc

SEQ ID NO: 36178 - RNA, 21 nt, Homo sapiens
gcaggaccaucccggccggcg

SEQ ID NO: 36179 - RNA, 23 nt, Homo sapiens
gcaggaccaucccggccggcgcg

SEQ ID NO: 36180 - RNA, 18 nt, Homo sapiens
gcagggugaacugcagcg

SEQ ID NO: 36181 - RNA, 20 nt, Homo sapiens
gcaccgcuguacgcgagcgc

SEQ ID NO: 36182 - RNA, 23 nt, Homo sapiens
gcaccgcuguacgcgagcgcgcg

SEQ ID NO: 36183 - RNA, 17 nt, Homo sapiens
gaugcaguucugaagaa

SEQ ID NO: 36184 - RNA, 20 nt, Homo sapiens
gcaaaauuuuuucucuagga

SEQ ID NO: 36185 - RNA, 21 nt, Homo sapiens
agcacagccucuuagaugcag

SEQ ID NO: 36186 - RNA, 15 nt, Homo sapiens
agcaccaaucaugaa

SEQ ID NO: 36187 - RNA, 11 nt, Homo sapiens
agccggagccu

SEQ ID NO: 36188 - RNA, 15 nt, Homo sapiens
agccggagccuccag

SEQ ID NO: 36189 - RNA, 17 nt, Homo sapiens
agccgggaaagaagagc

SEQ ID NO: 36190 - RNA, 18 nt, Homo sapiens
agccgggaaagaagagcc

SEQ ID NO: 36191 - RNA, 19 nt, Homo sapiens
agccgggaaagaagagccg

SEQ ID NO: 36192 - RNA, 20 nt, Homo sapiens
agccgggaaagaagagccgg

SEQ ID NO: 36193 - RNA, 22 nt, Homo sapiens
agccgggaaagaagagccggag

SEQ ID NO: 36194 - RNA, 15 nt, Homo sapiens
agccuccagcugccc

SEQ ID NO: 36195 - RNA, 20 nt, Homo sapiens
agccccaggcggguccgggu

SEQ ID NO: 36196 - RNA, 23 nt, Homo sapiens
agccccaggcggguccgggucgc

SEQ ID NO: 36197 - RNA, 11 nt, Homo sapiens
agagccggagc

SEQ ID NO: 36198 - RNA, 19 nt, Homo sapiens
agagccggagccuccagcu

SEQ ID NO: 36199 - RNA, 23 nt, Homo sapiens
agagccggagccuccagcugccc

SEQ ID NO: 36200 - RNA, 15 nt, Homo sapiens
agauccuggaaauca

SEQ ID NO: 36201 - RNA, 14 nt, Homo sapiens
aggaccaucccggc

SEQ ID NO: 36202 - RNA, 15 nt, Homo sapiens
aggaccaucccggcc

SEQ ID NO: 36203 - RNA, 22 nt, Homo sapiens
aggaccaucccggccggcgcgc

SEQ ID NO: 36204 - RNA, 12 nt, Homo sapiens
aggaugguuccc

SEQ ID NO: 36205 - RNA, 12 nt, Homo sapiens
aggcggguccgg

SEQ ID NO: 36206 - RNA, 14 nt, Homo sapiens
aggcggguccgggu

SEQ ID NO: 36207 - RNA, 18 nt, Homo sapiens
aggcggguccgggucgca

SEQ ID NO: 36208 - RNA, 21 nt, Homo sapiens
aggcggguccgggucgcagga

SEQ ID NO: 36209 - RNA, 14 nt, Homo sapiens
aggcccccgggccg

SEQ ID NO: 36210 - RNA, 16 nt, Homo sapiens
aggcccccgggccgac

SEQ ID NO: 36211 - RNA, 18 nt, Homo sapiens
aggcccccgggccgacgg

SEQ ID NO: 36212 - RNA, 23 nt, Homo sapiens
aggcccccgggccgacggagccg

SEQ ID NO: 36213 - RNA, 18 nt, Homo sapiens
agcgaguacuucccgcug

SEQ ID NO: 36214 - RNA, 12 nt, Homo sapiens
agcgcgcgcgcc

SEQ ID NO: 36215 - RNA, 14 nt, Homo sapiens
agcgcgcgcgcccu

SEQ ID NO: 36216 - RNA, 24 nt, Homo sapiens
agccuuggggcugaugcaguuguu

SEQ ID NO: 36217 - RNA, 16 nt, Homo sapiens
agcgagccccaggcgg

SEQ ID NO: 36218 - RNA, 17 nt, Homo sapiens
agcgagccccaggcggg

SEQ ID NO: 36219 - RNA, 16 nt, Homo sapiens
agcugccccggggagg

SEQ ID NO: 36220 - RNA, 19 nt, Homo sapiens
agcugccccggggaggggc

SEQ ID NO: 36221 - RNA, 22 nt, Homo sapiens
agcugccccggggaggggcgcu

SEQ ID NO: 36222 - RNA, 11 nt, Homo sapiens
agcucaggcug

SEQ ID NO: 36223 - RNA, 14 nt, Homo sapiens
agcucaggcuggca

SEQ ID NO: 36224 - RNA, 15 nt, Homo sapiens
agcucaggcuggcac

SEQ ID NO: 36225 - RNA, 13 nt, Homo sapiens
agcucguggaaca

SEQ ID NO: 36226 - RNA, 14 nt, Homo sapiens
agcuguaugauucc

SEQ ID NO: 36227 - RNA, 21 nt, Homo sapiens
accgcagggugaacugcagcg

SEQ ID NO: 36228 - RNA, 13 nt, Homo sapiens
accgcuguacgcg

SEQ ID NO: 36229 - RNA, 16 nt, Homo sapiens
accgcuguacgcgagc

SEQ ID NO: 36230 - RNA, 18 nt, Homo sapiens
accgcuguacgcgagcgc

SEQ ID NO: 36231 - RNA, 21 nt, Homo sapiens
accgcuguacgcgagcgcgcg

SEQ ID NO: 36232 - RNA, 15 nt, Homo sapiens
accuguucgcgcgcc

SEQ ID NO: 36233 - RNA, 16 nt, Homo sapiens
accuguucgcgcgccu

SEQ ID NO: 36234 - RNA, 17 nt, Homo sapiens
accuguucgcgcgccuc

SEQ ID NO: 36235 - RNA, 18 nt, Homo sapiens
accuguucgcgcgccucc

SEQ ID NO: 36236 - RNA, 20 nt, Homo sapiens
accuguucgcgcgccuccgc

SEQ ID NO: 36237 - RNA, 21 nt, Homo sapiens
acggcuccggacgcugcugcc

SEQ ID NO: 36238 - RNA, 22 nt, Homo sapiens
acggcuccggacgcugcugccg

SEQ ID NO: 36239 - RNA, 18 nt, Homo sapiens
acgcgagcgcgcgcgccc

SEQ ID NO: 36240 - RNA, 20 nt, Homo sapiens
acgcgagcgcgcgcgcccuc

SEQ ID NO: 36241 - RNA, 12 nt, Homo sapiens
acgcgcgcuccg

SEQ ID NO: 36242 - RNA, 13 nt, Homo sapiens
acgcgcgcuccgc

SEQ ID NO: 36243 - RNA, 19 nt, Homo sapiens
acgcgcgcuccgcgcagcu

SEQ ID NO: 36244 - RNA, 18 nt, Homo sapiens
acgcucugggucgccggc

SEQ ID NO: 36245 - RNA, 12 nt, Homo sapiens
acgcugcugccg

SEQ ID NO: 36246 - RNA, 12 nt, Homo sapiens
acggagccggga

SEQ ID NO: 36247 - RNA, 11 nt, Homo sapiens
acggcuccgga

SEQ ID NO: 36248 - RNA, 13 nt, Homo sapiens
agaagagccggag

SEQ ID NO: 36249 - RNA, 16 nt, Homo sapiens
agaagagccggagccu

SEQ ID NO: 36250 - RNA, 23 nt, Homo sapiens
agaagagccggagccuccagcug

SEQ ID NO: 36251 - RNA, 22 nt, Homo sapiens
acuuccagggcuacgcgcgcuc

SEQ ID NO: 36252 - RNA, 23 nt, Homo sapiens
acuuccagggcuacgcgcgcucc

SEQ ID NO: 36253 - RNA, 18 nt, Homo sapiens
acuucccgcuguuccucg

SEQ ID NO: 36254 - RNA, 22 nt, Homo sapiens
acuuccucccggccgcgcugcg

SEQ ID NO: 36255 - RNA, 21 nt, Homo sapiens
acugcagcgaguacuucccgc

SEQ ID NO: 36256 - RNA, 15 nt, Homo sapiens
acugacucuuaagaa

SEQ ID NO: 36257 - RNA, 17 nt, Homo sapiens
aaguucuagugaccgag

SEQ ID NO: 36258 - RNA, 18 nt, Homo sapiens
accaaggcccccgggccg

SEQ ID NO: 36259 - RNA, 21 nt, Homo sapiens
accaaggcccccgggccgacg

SEQ ID NO: 36260 - RNA, 23 nt, Homo sapiens
accaaggcccccgggccgacgga

SEQ ID NO: 36261 - RNA, 22 nt, Homo sapiens
accagucugacuguuuccauca

SEQ ID NO: 36262 - RNA, 16 nt, Homo sapiens
accaucccggccggcg

SEQ ID NO: 36263 - RNA, 17 nt, Homo sapiens
accaucccggccggcgc

SEQ ID NO: 36264 - RNA, 19 nt, Homo sapiens
accaucccggccggcgcgc

SEQ ID NO: 36265 - RNA, 20 nt, Homo sapiens
accaucccggccggcgcgcu

SEQ ID NO: 36266 - RNA, 15 nt, Homo sapiens
acaucuagugagcag

SEQ ID NO: 36267 - RNA, 10 nt, Homo sapiens
acaugggaca

SEQ ID NO: 36268 - RNA, 23 nt, Homo sapiens
acaggaugguucccuugaugaag

SEQ ID NO: 36269 - RNA, 14 nt, Homo sapiens
acaauacaucccuu

SEQ ID NO: 36270 - RNA, 21 nt, Homo sapiens
aaggggcggcggcccugugcg

SEQ ID NO: 36271 - RNA, 16 nt, Homo sapiens
aaguucuagugaccga

SEQ ID NO: 36272 - RNA, 20 nt, Homo sapiens
aaggcccccgggccgacgga

SEQ ID NO: 36273 - RNA, 15 nt, Homo sapiens
aacugcagcgaguac

SEQ ID NO: 36274 - RNA, 23 nt, Homo sapiens
aacugcagcgaguacuucccgcu

SEQ ID NO: 36275 - RNA, 11 nt, Homo sapiens
aagagccggag

SEQ ID NO: 36276 - RNA, 12 nt, Homo sapiens
aagagccggagc

SEQ ID NO: 36277 - RNA, 13 nt, Homo sapiens
aagagccggagcc

SEQ ID NO: 36278 - RNA, 15 nt, Homo sapiens
aagagaacuuccaga

SEQ ID NO: 36279 - RNA, 15 nt, Homo sapiens
aagaagagccggagc

SEQ ID NO: 36280 - RNA, 16 nt, Homo sapiens
aacuaucucauuucca

SEQ ID NO: 36281 - RNA, 20 nt, Homo sapiens
aacuaucucauuuccaagca

SEQ ID NO: 36282 - RNA, 20 nt, Homo sapiens
aagagccggagccuccagcu

SEQ ID NO: 36283 - RNA, 21 nt, Homo sapiens
aagagccggagccuccagcug

SEQ ID NO: 36284 - RNA, 23 nt, Homo sapiens
aagagccggagccuccagcugcc

SEQ ID NO: 36285 - RNA, 14 nt, Homo sapiens
aaggggcggcggcc

SEQ ID NO: 36286 - RNA, 15 nt, Homo sapiens
aaggggcggcggccc

SEQ ID NO: 36287 - RNA, 22 nt, Homo sapiens
aaggggcggcggcccugugcgg

SEQ ID NO: 36288 - RNA, 10 nt, Homo sapiens
aaggcccccg

SEQ ID NO: 36289 - RNA, 18 nt, Homo sapiens
aaggcccccgggccgacg

SEQ ID NO: 36290 - RNA, 19 nt, Homo sapiens
aaggcccccgggccgacgg

SEQ ID NO: 36291 - RNA, 23 nt, Homo sapiens
aaggcccccgggccgacggagcc

SEQ ID NO: 36292 - RNA, 24 nt, Homo sapiens
aaggcccccgggccgacggagccg

SEQ ID NO: 36293 - RNA, 17 nt, Homo sapiens
aucccacccgcccaccg

SEQ ID NO: 36294 - RNA, 15 nt, Homo sapiens
aucccggccggcgcg

SEQ ID NO: 36295 - RNA, 16 nt, Homo sapiens
aucccggccggcgcgc

SEQ ID NO: 36296 - RNA, 17 nt, Homo sapiens
aucccggccggcgcgcu

SEQ ID NO: 36297 - RNA, 18 nt, Homo sapiens
aucccggccggcgcgcuc

SEQ ID NO: 36298 - RNA, 19 nt, Homo sapiens
aucccggccggcgcgcuca

SEQ ID NO: 36299 - RNA, 21 nt, Homo sapiens
augaagaaguugauaugccuu

SEQ ID NO: 36300 - RNA, 16 nt, Homo sapiens
augaaggggcggcggc

SEQ ID NO: 36301 - RNA, 17 nt, Homo sapiens
auggcuuccuggcaaua

SEQ ID NO: 36302 - RNA, 15 nt, Homo sapiens
aguucuagugaccga

SEQ ID NO: 36303 - RNA, 21 nt, Homo sapiens
aguucugaagaagaugguacc

SEQ ID NO: 36304 - RNA, 14 nt, Homo sapiens
aguacuucccgcug

SEQ ID NO: 36305 - RNA, 19 nt, Homo sapiens
agugacaagcucacagacc

SEQ ID NO: 36306 - RNA, 20 nt, Homo sapiens
agugacaagcucacagaccu

SEQ ID NO: 36307 - RNA, 15 nt, Homo sapiens
aggguacacugccuu

SEQ ID NO: 36308 - RNA, 16 nt, Homo sapiens
aggggcgcucgcuucc

SEQ ID NO: 36309 - RNA, 11 nt, Homo sapiens
aggggcggcgg

SEQ ID NO: 36310 - RNA, 12 nt, Homo sapiens
aggggcggcggc

SEQ ID NO: 36311 - RNA, 13 nt, Homo sapiens
aggggcggcggcc

SEQ ID NO: 36312 - RNA, 15 nt, Homo sapiens
aggggcggcggcccu

SEQ ID NO: 36313 - RNA, 21 nt, Homo sapiens
aggggcggcggcccugugcgg

SEQ ID NO: 36314 - RNA, 9 nt, Homo sapiens
agggcgcgg

SEQ ID NO: 36315 - RNA, 12 nt, Homo sapiens
agggcgcggggc

SEQ ID NO: 36316 - RNA, 14 nt, Homo sapiens
agggcgcggggcgg

SEQ ID NO: 36317 - RNA, 14 nt, Homo sapiens
agggcuacgcgcgc

SEQ ID NO: 36318 - RNA, 18 nt, Homo sapiens
agggcuacgcgcgcuccg

SEQ ID NO: 36319 - RNA, 19 nt, Homo sapiens
cagcucuaaaugucaauca

SEQ ID NO: 36320 - RNA, 14 nt, Homo sapiens
cagcucaggcuggc

SEQ ID NO: 36321 - RNA, 16 nt, Homo sapiens
cagcucaggcuggcac

SEQ ID NO: 36322 - RNA, 20 nt, Homo sapiens
cagcucaggcuggcaccgcu

SEQ ID NO: 36323 - RNA, 12 nt, Homo sapiens
cagcugccccgg

SEQ ID NO: 36324 - RNA, 22 nt, Homo sapiens
cagcugccccggggaggggcgc

SEQ ID NO: 36325 - RNA, 15 nt, Homo sapiens
cagccuaguugauca

SEQ ID NO: 36326 - RNA, 19 nt, Homo sapiens
cagccucuuagaugcaguu

SEQ ID NO: 36327 - RNA, 16 nt, Homo sapiens
cacuuccucccggccg

SEQ ID NO: 36328 - RNA, 17 nt, Homo sapiens
cacuuccucccggccgc

SEQ ID NO: 36329 - RNA, 22 nt, Homo sapiens
cacuuccucccggccgcgcugc

SEQ ID NO: 36330 - RNA, 13 nt, Homo sapiens
cacuugucaauaa

SEQ ID NO: 36331 - RNA, 19 nt, Homo sapiens
cacuuguguuuugcaagcc

SEQ ID NO: 36332 - RNA, 20 nt, Homo sapiens
cacuuguguuuugcaagcca

SEQ ID NO: 36333 - RNA, 17 nt, Homo sapiens
caccgcagggugaacug

SEQ ID NO: 36334 - RNA, 14 nt, Homo sapiens
caccgcuguacgcg

SEQ ID NO: 36335 - RNA, 18 nt, Homo sapiens
caccgcuguacgcgagcg

SEQ ID NO: 36336 - RNA, 19 nt, Homo sapiens
caccgcuguacgcgagcgc

SEQ ID NO: 36337 - RNA, 21 nt, Homo sapiens
caccgcuguacgcgagcgcgc

SEQ ID NO: 36338 - RNA, 22 nt, Homo sapiens
caccgcuguacgcgagcgcgcg

SEQ ID NO: 36339 - RNA, 16 nt, Homo sapiens
caccuuuuggucugga

SEQ ID NO: 36340 - RNA, 15 nt, Homo sapiens
cacgcucugggucgc

SEQ ID NO: 36341 - RNA, 17 nt, Homo sapiens
cacgcucugggucgccg

SEQ ID NO: 36342 - RNA, 22 nt, Homo sapiens
cacgcucugggucgccggcauc

SEQ ID NO: 36343 - RNA, 14 nt, Homo sapiens
cacacugaagaagc

SEQ ID NO: 36344 - RNA, 16 nt, Homo sapiens
caaugcuguauuuuaa

SEQ ID NO: 36345 - RNA, 11 nt, Homo sapiens
cacaggacagc

SEQ ID NO: 36346 - RNA, 12 nt, Homo sapiens
cacaggacagcc

SEQ ID NO: 36347 - RNA, 23 nt, Homo sapiens
caacuaucucauuuccaagcaag

SEQ ID NO: 36348 - RNA, 11 nt, Homo sapiens
caagccagauu

SEQ ID NO: 36349 - RNA, 12 nt, Homo sapiens
caagccagauuu

SEQ ID NO: 36350 - RNA, 14 nt, Homo sapiens
caaggcccccgggc

SEQ ID NO: 36351 - RNA, 18 nt, Homo sapiens
caaggcccccgggccgac

SEQ ID NO: 36352 - RNA, 19 nt, Homo sapiens
caaggcccccgggccgacg

SEQ ID NO: 36353 - RNA, 20 nt, Homo sapiens
caaggcccccgggccgacgg

SEQ ID NO: 36354 - RNA, 21 nt, Homo sapiens
caaggcccccgggccgacgga

SEQ ID NO: 36355 - RNA, 22 nt, Homo sapiens
caaggcccccgggccgacggag

SEQ ID NO: 36356 - RNA, 23 nt, Homo sapiens
caaggcccccgggccgacggagc

SEQ ID NO: 36357 - RNA, 22 nt, Homo sapiens
caaggguacacugccuucucaa

SEQ ID NO: 36358 - RNA, 14 nt, Homo sapiens
auuucuaugaaaua

SEQ ID NO: 36359 - RNA, 15 nt, Homo sapiens
auuugcucauggaau

SEQ ID NO: 36360 - RNA, 21 nt, Homo sapiens
auuaaguuuuuuuuuaaaaaa

SEQ ID NO: 36361 - RNA, 20 nt, Homo sapiens
cauggaauuggagcucgugg

SEQ ID NO: 36362 - RNA, 17 nt, Homo sapiens
caugaaguccaagcauu

SEQ ID NO: 36363 - RNA, 16 nt, Homo sapiens
cauggaauuggagcuc

SEQ ID NO: 36364 - RNA, 14 nt, Homo sapiens
caugaaggggcggc

SEQ ID NO: 36365 - RNA, 15 nt, Homo sapiens
caugaaggggcggcg

SEQ ID NO: 36366 - RNA, 16 nt, Homo sapiens
caugaaggggcggcgg

SEQ ID NO: 36367 - RNA, 17 nt, Homo sapiens
caugaaggggcggcggc

SEQ ID NO: 36368 - RNA, 18 nt, Homo sapiens
caugaaggggcggcggcc

SEQ ID NO: 36369 - RNA, 15 nt, Homo sapiens
caugaaguccaagca

SEQ ID NO: 36370 - RNA, 16 nt, Homo sapiens
caucccacccgcccac

SEQ ID NO: 36371 - RNA, 17 nt, Homo sapiens
caucccacccgcccacc

SEQ ID NO: 36372 - RNA, 13 nt, Homo sapiens
caucccggccggc

SEQ ID NO: 36373 - RNA, 14 nt, Homo sapiens
caucccggccggcg

SEQ ID NO: 36374 - RNA, 15 nt, Homo sapiens
caucccggccggcgc

SEQ ID NO: 36375 - RNA, 16 nt, Homo sapiens
caucccggccggcgcg

SEQ ID NO: 36376 - RNA, 17 nt, Homo sapiens
caucccggccggcgcgc

SEQ ID NO: 36377 - RNA, 18 nt, Homo sapiens
caucccggccggcgcgcu

SEQ ID NO: 36378 - RNA, 20 nt, Homo sapiens
caucccggccggcgcgcuca

SEQ ID NO: 36379 - RNA, 22 nt, Homo sapiens
caucccggccggcgcgcucauc

SEQ ID NO: 36380 - RNA, 19 nt, Homo sapiens
caggcuggcaccgcuguac

SEQ ID NO: 36381 - RNA, 20 nt, Homo sapiens
caggcuggcaccgcuguacg

SEQ ID NO: 36382 - RNA, 13 nt, Homo sapiens
caggcuggcaccg

SEQ ID NO: 36383 - RNA, 15 nt, Homo sapiens
caggcuggcaccgcu

SEQ ID NO: 36384 - RNA, 15 nt, Homo sapiens
caggaccaucccggc

SEQ ID NO: 36385 - RNA, 16 nt, Homo sapiens
caggaccaucccggcc

SEQ ID NO: 36386 - RNA, 17 nt, Homo sapiens
caggaccaucccggccg

SEQ ID NO: 36387 - RNA, 23 nt, Homo sapiens
caggaccaucccggccggcgcgc

SEQ ID NO: 36388 - RNA, 18 nt, Homo sapiens
caggcggguccgggucgc

SEQ ID NO: 36389 - RNA, 16 nt, Homo sapiens
cagucaccucauggaa

SEQ ID NO: 36390 - RNA, 14 nt, Homo sapiens
cagggcuacgcgcg

SEQ ID NO: 36391 - RNA, 17 nt, Homo sapiens
cagggcuacgcgcgcuc

SEQ ID NO: 36392 - RNA, 18 nt, Homo sapiens
cagggcuacgcgcgcucc

SEQ ID NO: 36393 - RNA, 20 nt, Homo sapiens
cagggcuacgcgcgcuccgc

SEQ ID NO: 36394 - RNA, 17 nt, Homo sapiens
cagggugaacugcagcg

SEQ ID NO: 36395 - RNA, 22 nt, Homo sapiens
cagggugaacugcagcgaguac

SEQ ID NO: 36396 - RNA, 21 nt, Homo sapiens
ccaucaaggguacacugccuu

SEQ ID NO: 36397 - RNA, 11 nt, Homo sapiens
ccaucccggcc

SEQ ID NO: 36398 - RNA, 14 nt, Homo sapiens
ccaucccggccggc

SEQ ID NO: 36399 - RNA, 15 nt, Homo sapiens
ccaucccggccggcg

SEQ ID NO: 36400 - RNA, 16 nt, Homo sapiens
ccaucccggccggcgc

SEQ ID NO: 36401 - RNA, 17 nt, Homo sapiens
ccaucccggccggcgcg

SEQ ID NO: 36402 - RNA, 21 nt, Homo sapiens
ccaucccggccggcgcgcuca

SEQ ID NO: 36403 - RNA, 22 nt, Homo sapiens
ccaucccggccggcgcgcucau

SEQ ID NO: 36404 - RNA, 17 nt, Homo sapiens
cccacuuccucccggcc

SEQ ID NO: 36405 - RNA, 19 nt, Homo sapiens
cccacuuccucccggccgc

SEQ ID NO: 36406 - RNA, 20 nt, Homo sapiens
cccacuuccucccggccgcg

SEQ ID NO: 36407 - RNA, 21 nt, Homo sapiens
cccacuuccucccggccgcgc

SEQ ID NO: 36408 - RNA, 17 nt, Homo sapiens
ccagauuuuccugaaaa

SEQ ID NO: 36409 - RNA, 14 nt, Homo sapiens
ccagcugccccggg

SEQ ID NO: 36410 - RNA, 13 nt, Homo sapiens
ccaggcggguccg

SEQ ID NO: 36411 - RNA, 14 nt, Homo sapiens
ccaggcggguccgg

SEQ ID NO: 36412 - RNA, 15 nt, Homo sapiens
ccaggcggguccggg

SEQ ID NO: 36413 - RNA, 19 nt, Homo sapiens
ccaggcggguccgggucgc

SEQ ID NO: 36414 - RNA, 21 nt, Homo sapiens
ccaggcggguccgggucgcag

SEQ ID NO: 36415 - RNA, 22 nt, Homo sapiens
ccaggcggguccgggucgcagg

SEQ ID NO: 36416 - RNA, 17 nt, Homo sapiens
ccagguagagggugugu

SEQ ID NO: 36417 - RNA, 20 nt, Homo sapiens
ccagucugacuguuuccauc

SEQ ID NO: 36418 - RNA, 12 nt, Homo sapiens
ccagggcuacgc

SEQ ID NO: 36419 - RNA, 13 nt, Homo sapiens
ccagggcuacgcg

SEQ ID NO: 36420 - RNA, 14 nt, Homo sapiens
ccagggcuacgcgc

SEQ ID NO: 36421 - RNA, 15 nt, Homo sapiens
ccagggcuacgcgcg

SEQ ID NO: 36422 - RNA, 16 nt, Homo sapiens
ccagggcuacgcgcgc

SEQ ID NO: 36423 - RNA, 17 nt, Homo sapiens
ccagggcuacgcgcgcu

SEQ ID NO: 36424 - RNA, 17 nt, Homo sapiens
ccaaggcccccgggccg

SEQ ID NO: 36425 - RNA, 18 nt, Homo sapiens
ccaaggcccccgggccga

SEQ ID NO: 36426 - RNA, 20 nt, Homo sapiens
ccaaggcccccgggccgacg

SEQ ID NO: 36427 - RNA, 21 nt, Homo sapiens
ccaaggcccccgggccgacgg

SEQ ID NO: 36428 - RNA, 22 nt, Homo sapiens
ccacagcuguaugauucccagc

SEQ ID NO: 36429 - RNA, 20 nt, Homo sapiens
ccaccagucugacuguuucc

SEQ ID NO: 36430 - RNA, 21 nt, Homo sapiens
ccaccagucugacuguuucca

SEQ ID NO: 36431 - RNA, 13 nt, Homo sapiens
ccacccgcccacc

SEQ ID NO: 36432 - RNA, 14 nt, Homo sapiens
ccacccgcccaccg

SEQ ID NO: 36433 - RNA, 23 nt, Homo sapiens
ccaccgcagggugaacugcagcg

SEQ ID NO: 36434 - RNA, 14 nt, Homo sapiens
ccacgcucuggguc

SEQ ID NO: 36435 - RNA, 16 nt, Homo sapiens
ccacgcucugggucgc

SEQ ID NO: 36436 - RNA, 17 nt, Homo sapiens
ccacgcucugggucgcc

SEQ ID NO: 36437 - RNA, 21 nt, Homo sapiens
ccacgcucugggucgccggca

SEQ ID NO: 36438 - RNA, 23 nt, Homo sapiens
ccacgcucugggucgccggcauc

SEQ ID NO: 36439 - RNA, 20 nt, Homo sapiens
ccacuuccucccggccgcgc

SEQ ID NO: 36440 - RNA, 21 nt, Homo sapiens
ccacuuccucccggccgcgcu

SEQ ID NO: 36441 - RNA, 22 nt, Homo sapiens
ccacuuccucccggccgcgcug

SEQ ID NO: 36442 - RNA, 12 nt, Homo sapiens
cccccgggccga

SEQ ID NO: 36443 - RNA, 13 nt, Homo sapiens
cccccgggccgac

SEQ ID NO: 36444 - RNA, 18 nt, Homo sapiens
cccccgggccgacggagc

SEQ ID NO: 36445 - RNA, 19 nt, Homo sapiens
cccccgggccgacggagcc

SEQ ID NO: 36446 - RNA, 21 nt, Homo sapiens
cccccgggccgacggagccgg

SEQ ID NO: 36447 - RNA, 23 nt, Homo sapiens
cccccgggccgacggagccggga

SEQ ID NO: 36448 - RNA, 13 nt, Homo sapiens
cccaggcgggucc

SEQ ID NO: 36449 - RNA, 19 nt, Homo sapiens
cccaggcggguccgggucg

SEQ ID NO: 36450 - RNA, 20 nt, Homo sapiens
cccaggcggguccgggucgc

SEQ ID NO: 36451 - RNA, 12 nt, Homo sapiens
cccgcccaccgc

SEQ ID NO: 36452 - RNA, 16 nt, Homo sapiens
cccgcuguuccucgcc

SEQ ID NO: 36453 - RNA, 18 nt, Homo sapiens
cccgcuguuccucgccac

SEQ ID NO: 36454 - RNA, 19 nt, Homo sapiens
cccgcuguuccucgccacg

SEQ ID NO: 36455 - RNA, 20 nt, Homo sapiens
cccgcuguuccucgccacgc

SEQ ID NO: 36456 - RNA, 21 nt, Homo sapiens
cccgcuguuccucgccacgcu

SEQ ID NO: 36457 - RNA, 11 nt, Homo sapiens
cccggccgcgc

SEQ ID NO: 36458 - RNA, 12 nt, Homo sapiens
cccggccgcgcu

SEQ ID NO: 36459 - RNA, 13 nt, Homo sapiens
cccggccgcgcug

SEQ ID NO: 36460 - RNA, 14 nt, Homo sapiens
cccggccgcgcugc

SEQ ID NO: 36461 - RNA, 15 nt, Homo sapiens
cccggccgcgcugcg

SEQ ID NO: 36462 - RNA, 16 nt, Homo sapiens
cccggccgcgcugcgc

SEQ ID NO: 36463 - RNA, 18 nt, Homo sapiens
cccggccgcgcugcgcgc

SEQ ID NO: 36464 - RNA, 20 nt, Homo sapiens
cccggccgcgcugcgcgccg

SEQ ID NO: 36465 - RNA, 21 nt, Homo sapiens
cccggccgcgcugcgcgccgc

SEQ ID NO: 36466 - RNA, 14 nt, Homo sapiens
cccggccggcgcgc

SEQ ID NO: 36467 - RNA, 17 nt, Homo sapiens
cccggccggcgcgcuca

SEQ ID NO: 36468 - RNA, 19 nt, Homo sapiens
cccggccggcgcgcucauc

SEQ ID NO: 36469 - RNA, 13 nt, Homo sapiens
cccucuggcugcu

SEQ ID NO: 36470 - RNA, 15 nt, Homo sapiens
cccucuggcugcugg

SEQ ID NO: 36471 - RNA, 17 nt, Homo sapiens
cccucuggcugcuggug

SEQ ID NO: 36472 - RNA, 11 nt, Homo sapiens
ccccgggccga

SEQ ID NO: 36473 - RNA, 14 nt, Homo sapiens
ccccgggccgacgg

SEQ ID NO: 36474 - RNA, 18 nt, Homo sapiens
ccccgggccgacggagcc

SEQ ID NO: 36475 - RNA, 18 nt, Homo sapiens
ccccggggaggggcgcuc

SEQ ID NO: 36476 - RNA, 19 nt, Homo sapiens
ccccggggaggggcgcucg

SEQ ID NO: 36477 - RNA, 21 nt, Homo sapiens
ccccggggaggggcgcucgcu

SEQ ID NO: 36478 - RNA, 16 nt, Homo sapiens
cccgggccgacggagc

SEQ ID NO: 36479 - RNA, 17 nt, Homo sapiens
cccgggccgacggagcc

SEQ ID NO: 36480 - RNA, 19 nt, Homo sapiens
cccgggccgacggagccgg

SEQ ID NO: 36481 - RNA, 15 nt, Homo sapiens
cccggggaggggcgc

SEQ ID NO: 36482 - RNA, 15 nt, Homo sapiens
ccggagccuccagcu

SEQ ID NO: 36483 - RNA, 16 nt, Homo sapiens
ccggagccuccagcug

SEQ ID NO: 36484 - RNA, 18 nt, Homo sapiens
ccggagccuccagcugcc

SEQ ID NO: 36485 - RNA, 12 nt, Homo sapiens
ccggccgcgcug

SEQ ID NO: 36486 - RNA, 14 nt, Homo sapiens
ccggccgcgcugcg

SEQ ID NO: 36487 - RNA, 15 nt, Homo sapiens
ccggccgcgcugcgc

SEQ ID NO: 36488 - RNA, 16 nt, Homo sapiens
ccggccgcgcugcgcg

SEQ ID NO: 36489 - RNA, 20 nt, Homo sapiens
ccggccgcgcugcgcgccgc

SEQ ID NO: 36490 - RNA, 21 nt, Homo sapiens
ccggccgcgcugcgcgccgcg

SEQ ID NO: 36491 - RNA, 22 nt, Homo sapiens
ccggccgcgcugcgcgccgcgc

SEQ ID NO: 36492 - RNA, 13 nt, Homo sapiens
ccggccggcgcgc

SEQ ID NO: 36493 - RNA, 15 nt, Homo sapiens
ccggccggcgcgcuc

SEQ ID NO: 36494 - RNA, 16 nt, Homo sapiens
ccggccggcgcgcuca

SEQ ID NO: 36495 - RNA, 11 nt, Homo sapiens
ccggcgcgcuc

SEQ ID NO: 36496 - RNA, 12 nt, Homo sapiens
ccggcgcgcuca

SEQ ID NO: 36497 - RNA, 11 nt, Homo sapiens
ccgggccgacg

SEQ ID NO: 36498 - RNA, 13 nt, Homo sapiens
ccgggccgacgga

SEQ ID NO: 36499 - RNA, 15 nt, Homo sapiens
ccgggccgacggagc

SEQ ID NO: 36500 - RNA, 19 nt, Homo sapiens
ccggcgcgcucaucccacc

SEQ ID NO: 36501 - RNA, 20 nt, Homo sapiens
ccggcgcgcucaucccaccc

SEQ ID NO: 36502 - RNA, 22 nt, Homo sapiens
ccggcgcgcucaucccacccgc

SEQ ID NO: 36503 - RNA, 16 nt, Homo sapiens
ccgggaaagaagagcc

SEQ ID NO: 36504 - RNA, 19 nt, Homo sapiens
ccgggaaagaagagccgga

SEQ ID NO: 36505 - RNA, 22 nt, Homo sapiens
ccgggaaagaagagccggagcc

SEQ ID NO: 36506 - RNA, 12 nt, Homo sapiens
cccugugcggcc

SEQ ID NO: 36507 - RNA, 14 nt, Homo sapiens
cccugugcggccug

SEQ ID NO: 36508 - RNA, 15 nt, Homo sapiens
cccugugcggccugg

SEQ ID NO: 36509 - RNA, 12 nt, Homo sapiens
ccggacgcugcu

SEQ ID NO: 36510 - RNA, 15 nt, Homo sapiens
ccggacgcugcugcc

SEQ ID NO: 36511 - RNA, 22 nt, Homo sapiens
ccggacgcugcugccgugggcc

SEQ ID NO: 36512 - RNA, 18 nt, Homo sapiens
ccgcgcagcucaggcugg

SEQ ID NO: 36513 - RNA, 22 nt, Homo sapiens
ccgcgcagcucaggcuggcacc

SEQ ID NO: 36514 - RNA, 23 nt, Homo sapiens
ccgcgcagcucaggcuggcaccg

SEQ ID NO: 36515 - RNA, 11 nt, Homo sapiens
ccgcgcuccuc

SEQ ID NO: 36516 - RNA, 21 nt, Homo sapiens
ccgcgcuccucggacggcucc

SEQ ID NO: 36517 - RNA, 23 nt, Homo sapiens
ccgcgcuccucggacggcuccgg

SEQ ID NO: 36518 - RNA, 11 nt, Homo sapiens
ccgcgcugcgc

SEQ ID NO: 36519 - RNA, 12 nt, Homo sapiens
ccgcgcugcgcg

SEQ ID NO: 36520 - RNA, 15 nt, Homo sapiens
ccgcgcugcgcgccg

SEQ ID NO: 36521 - RNA, 16 nt, Homo sapiens
ccgcgcugcgcgccgc

SEQ ID NO: 36522 - RNA, 19 nt, Homo sapiens
ccgcgcugcgcgccgcgcu

SEQ ID NO: 36523 - RNA, 20 nt, Homo sapiens
ccgcgcugcgcgccgcgcuc

SEQ ID NO: 36524 - RNA, 22 nt, Homo sapiens
ccgcgcugcgcgccgcgcuccu

SEQ ID NO: 36525 - RNA, 13 nt, Homo sapiens
ccgcuacuuccag

SEQ ID NO: 36526 - RNA, 15 nt, Homo sapiens
ccgcuacuuccaggg

SEQ ID NO: 36527 - RNA, 15 nt, Homo sapiens
ccgcuguacgcgagc

SEQ ID NO: 36528 - RNA, 16 nt, Homo sapiens
ccgcuguacgcgagcg

SEQ ID NO: 36529 - RNA, 18 nt, Homo sapiens
ccgcuguacgcgagcgcg

SEQ ID NO: 36530 - RNA, 19 nt, Homo sapiens
ccgcuguacgcgagcgcgc

SEQ ID NO: 36531 - RNA, 20 nt, Homo sapiens
ccgcuguacgcgagcgcgcg

SEQ ID NO: 36532 - RNA, 24 nt, Homo sapiens
ccgcuguacgcgagcgcgcgcgcc

SEQ ID NO: 36533 - RNA, 15 nt, Homo sapiens
ccgcuguuccucgcc

SEQ ID NO: 36534 - RNA, 16 nt, Homo sapiens
ccgcuguuccucgcca

SEQ ID NO: 36535 - RNA, 18 nt, Homo sapiens
ccgcuguuccucgccacg

SEQ ID NO: 36536 - RNA, 19 nt, Homo sapiens
ccgcuguuccucgccacgc

SEQ ID NO: 36537 - RNA, 21 nt, Homo sapiens
ccgcuguuccucgccacgcuc

SEQ ID NO: 36538 - RNA, 23 nt, Homo sapiens
ccgcuguuccucgccacgcucug

SEQ ID NO: 36539 - RNA, 12 nt, Homo sapiens
ccgacggagccg

SEQ ID NO: 36540 - RNA, 14 nt, Homo sapiens
ccgacggagccggg

SEQ ID NO: 36541 - RNA, 16 nt, Homo sapiens
ccgacggagccgggaa

SEQ ID NO: 36542 - RNA, 17 nt, Homo sapiens
ccgacggagccgggaaa

SEQ ID NO: 36543 - RNA, 19 nt, Homo sapiens
ccgacggagccgggaaaga

SEQ ID NO: 36544 - RNA, 20 nt, Homo sapiens
ccuggaaaucaggguuagua

SEQ ID NO: 36545 - RNA, 15 nt, Homo sapiens
ccucgccacgcucug

SEQ ID NO: 36546 - RNA, 23 nt, Homo sapiens
ccucgccacgcucugggucgccg

SEQ ID NO: 36547 - RNA, 16 nt, Homo sapiens
ccucggacggcuccgg

SEQ ID NO: 36548 - RNA, 20 nt, Homo sapiens
ccucggacggcuccggacgc

SEQ ID NO: 36549 - RNA, 22 nt, Homo sapiens
ccucggacggcuccggacgcug

SEQ ID NO: 36550 - RNA, 12 nt, Homo sapiens
ccucccggccgc

SEQ ID NO: 36551 - RNA, 13 nt, Homo sapiens
ccucccggccgcg

SEQ ID NO: 36552 - RNA, 20 nt, Homo sapiens
ccucccggccgcgcugcgcg

SEQ ID NO: 36553 - RNA, 21 nt, Homo sapiens
ccucccggccgcgcugcgcgc

SEQ ID NO: 36554 - RNA, 23 nt, Homo sapiens
ccucccggccgcgcugcgcgccg

SEQ ID NO: 36555 - RNA, 13 nt, Homo sapiens
ccuccgcuacuuc

SEQ ID NO: 36556 - RNA, 15 nt, Homo sapiens
ccugagaccaaggcc

SEQ ID NO: 36557 - RNA, 18 nt, Homo sapiens
ccugagaccaaggccccc

SEQ ID NO: 36558 - RNA, 23 nt, Homo sapiens
ccugagaccaaggcccccgggcc

SEQ ID NO: 36559 - RNA, 13 nt, Homo sapiens
ccucuggcugcug

SEQ ID NO: 36560 - RNA, 14 nt, Homo sapiens
ccucuggcugcugg

SEQ ID NO: 36561 - RNA, 17 nt, Homo sapiens
ccucuggcugcuggugg

SEQ ID NO: 36562 - RNA, 12 nt, Homo sapiens
ccuccagcugcc

SEQ ID NO: 36563 - RNA, 13 nt, Homo sapiens
ccuccagcugccc

SEQ ID NO: 36564 - RNA, 15 nt, Homo sapiens
ccuccagcugccccg

SEQ ID NO: 36565 - RNA, 17 nt, Homo sapiens
ccuccagcugccccggg

SEQ ID NO: 36566 - RNA, 12 nt, Homo sapiens
ccggggaggggc

SEQ ID NO: 36567 - RNA, 14 nt, Homo sapiens
ccggggaggggcgc

SEQ ID NO: 36568 - RNA, 16 nt, Homo sapiens
ccggggaggggcgcuc

SEQ ID NO: 36569 - RNA, 17 nt, Homo sapiens
ccggggaggggcgcucg

SEQ ID NO: 36570 - RNA, 18 nt, Homo sapiens
ccggggaggggcgcucgc

SEQ ID NO: 36571 - RNA, 15 nt, Homo sapiens
ccgggucgcaggacc

SEQ ID NO: 36572 - RNA, 22 nt, Homo sapiens
ccgggucgcaggaccaucccgg

SEQ ID NO: 36573 - RNA, 11 nt, Homo sapiens
ccgcccaccgc

SEQ ID NO: 36574 - RNA, 13 nt, Homo sapiens
cgcgagcgcgcgc

SEQ ID NO: 36575 - RNA, 21 nt, Homo sapiens
cgcgagcgcgcgcgcccucug

SEQ ID NO: 36576 - RNA, 13 nt, Homo sapiens
cgcagcucaggcu

SEQ ID NO: 36577 - RNA, 16 nt, Homo sapiens
cgcagcucaggcuggc

SEQ ID NO: 36578 - RNA, 18 nt, Homo sapiens
cgcagcucaggcuggcac

SEQ ID NO: 36579 - RNA, 20 nt, Homo sapiens
cgcagcucaggcuggcaccg

SEQ ID NO: 36580 - RNA, 18 nt, Homo sapiens
cgcaggaccaucccggcc

SEQ ID NO: 36581 - RNA, 19 nt, Homo sapiens
cgcaggaccaucccggccg

SEQ ID NO: 36582 - RNA, 20 nt, Homo sapiens
cgcaggaccaucccggccgg

SEQ ID NO: 36583 - RNA, 21 nt, Homo sapiens
cgcaggaccaucccggccggc

SEQ ID NO: 36584 - RNA, 23 nt, Homo sapiens
cgcaggaccaucccggccggcgc

SEQ ID NO: 36585 - RNA, 17 nt, Homo sapiens
cgccacgcucugggucg

SEQ ID NO: 36586 - RNA, 21 nt, Homo sapiens
cgccacgcucugggucgccgg

SEQ ID NO: 36587 - RNA, 22 nt, Homo sapiens
cgccacgcucugggucgccggc

SEQ ID NO: 36588 - RNA, 14 nt, Homo sapiens
cgcccaccgcaggg

SEQ ID NO: 36589 - RNA, 15 nt, Homo sapiens
cgcccacuuccuccc

SEQ ID NO: 36590 - RNA, 16 nt, Homo sapiens
cgcccacuuccucccg

SEQ ID NO: 36591 - RNA, 20 nt, Homo sapiens
cgcccacuuccucccggccg

SEQ ID NO: 36592 - RNA, 22 nt, Homo sapiens
cgcccacuuccucccggccgcg

SEQ ID NO: 36593 - RNA, 13 nt, Homo sapiens
cgcccucuggcug

SEQ ID NO: 36594 - RNA, 16 nt, Homo sapiens
cgcccucuggcugcug

SEQ ID NO: 36595 - RNA, 22 nt, Homo sapiens
cgcccucuggcugcugguggcg

SEQ ID NO: 36596 - RNA, 14 nt, Homo sapiens
cgccgcgcuccucg

SEQ ID NO: 36597 - RNA, 15 nt, Homo sapiens
cgccgcgcuccucgg

SEQ ID NO: 36598 - RNA, 18 nt, Homo sapiens
cgccgcgcuccucggacg

SEQ ID NO: 36599 - RNA, 20 nt, Homo sapiens
cgccgcgcuccucggacggc

SEQ ID NO: 36600 - RNA, 23 nt, Homo sapiens
cgccgcgcuccucggacggcucc

SEQ ID NO: 36601 - RNA, 17 nt, Homo sapiens
ccuuggggcugaugcag

SEQ ID NO: 36602 - RNA, 13 nt, Homo sapiens
cgacggagccggg

SEQ ID NO: 36603 - RNA, 15 nt, Homo sapiens
cgacggagccgggaa

SEQ ID NO: 36604 - RNA, 13 nt, Homo sapiens
cgagccccaggcg

SEQ ID NO: 36605 - RNA, 14 nt, Homo sapiens
cgagccccaggcgg

SEQ ID NO: 36606 - RNA, 15 nt, Homo sapiens
cgagccccaggcggg

SEQ ID NO: 36607 - RNA, 17 nt, Homo sapiens
cgagccccaggcggguc

SEQ ID NO: 36608 - RNA, 19 nt, Homo sapiens
cgagccccaggcggguccg

SEQ ID NO: 36609 - RNA, 22 nt, Homo sapiens
cgagccccaggcggguccgggu

SEQ ID NO: 36610 - RNA, 11 nt, Homo sapiens
cgagcgcgcgc

SEQ ID NO: 36611 - RNA, 17 nt, Homo sapiens
cgagcgcgcgcgcccuc

SEQ ID NO: 36612 - RNA, 14 nt, Homo sapiens
ccuguucgcgcgcc

SEQ ID NO: 36613 - RNA, 15 nt, Homo sapiens
ccuguucgcgcgccu

SEQ ID NO: 36614 - RNA, 16 nt, Homo sapiens
ccuguucgcgcgccuc

SEQ ID NO: 36615 - RNA, 18 nt, Homo sapiens
ccuguucgcgcgccuccg

SEQ ID NO: 36616 - RNA, 20 nt, Homo sapiens
ccuguucgcgcgccuccgcu

SEQ ID NO: 36617 - RNA, 13 nt, Homo sapiens
ccuugaugaagaa

SEQ ID NO: 36618 - RNA, 14 nt, Homo sapiens
ccuugaugaagaag

SEQ ID NO: 36619 - RNA, 14 nt, Homo sapiens
ccugugcggccugg

SEQ ID NO: 36620 - RNA, 17 nt, Homo sapiens
ccuggucuaccuguucg

SEQ ID NO: 36621 - RNA, 22 nt, Homo sapiens
ccuggucuaccuguucgcgcgc

SEQ ID NO: 36622 - RNA, 17 nt, Homo sapiens
uccagcugccccgggga

SEQ ID NO: 36623 - RNA, 15 nt, Homo sapiens
gccccaauucgaucc

SEQ ID NO: 36624 - RNA, 20 nt, Homo sapiens
agccggagccuccagcugcc

SEQ ID NO: 36625 - RNA, 21 nt, Homo sapiens
agagccugaguguugccuaau

SEQ ID NO: 36626 - RNA, 13 nt, Homo sapiens
uaucaguccaaag

SEQ ID NO: 36627 - RNA, 19 nt, Homo sapiens
auugaggcuuuaaaacuua

SEQ ID NO: 36628 - RNA, 12 nt, Homo sapiens
aaagaagagccg

SEQ ID NO: 36629 - RNA, 23 nt, Homo sapiens
uccccugucacgugugggcaaug

SEQ ID NO: 36630 - RNA, 21 nt, Homo sapiens
aaccagagccugaguguugcc

SEQ ID NO: 36631 - RNA, 16 nt, Homo sapiens
gccuccgcuacuucca

SEQ ID NO: 36632 - RNA, 21 nt, Homo sapiens
cauuguucuugugaacccaaa

SEQ ID NO: 36633 - RNA, 19 nt, Homo sapiens
accauuuuugaaaccaaac

SEQ ID NO: 36634 - RNA, 12 nt, Homo sapiens
accucauuauca

SEQ ID NO: 36635 - RNA, 13 nt, Homo sapiens
cgcgcuccgcgca

SEQ ID NO: 36636 - RNA, 12 nt, Homo sapiens
augcauucugag

SEQ ID NO: 36637 - RNA, 15 nt, Homo sapiens
cagcgaguacuuccc

SEQ ID NO: 36638 - RNA, 18 nt, Homo sapiens
ucuaucauuaaaguucua

SEQ ID NO: 36639 - RNA, 17 nt, Homo sapiens
gaauacauaaaguaugu

SEQ ID NO: 36640 - RNA, 20 nt, Homo sapiens
cauuguucuugugaacccaa

SEQ ID NO: 36641 - RNA, 22 nt, Homo sapiens
uaaaaaaaaaacguauugcauu

SEQ ID NO: 36642 - RNA, 17 nt, Homo sapiens
aaccagagccugagugu

SEQ ID NO: 36643 - RNA, 18 nt, Homo sapiens
gcccacuuccucccggcc

SEQ ID NO: 36644 - RNA, 14 nt, Homo sapiens
cuccgcuacuucca

SEQ ID NO: 36645 - RNA, 18 nt, Homo sapiens
aguaugaaaaugucauug

SEQ ID NO: 36646 - RNA, 22 nt, Homo sapiens
cauccuagucucuaucauuaaa

SEQ ID NO: 36647 - RNA, 14 nt, Homo sapiens
uaaaguucuaguga

SEQ ID NO: 36648 - RNA, 23 nt, Homo sapiens
gggcgcucgcuuccgcauccuag

SEQ ID NO: 36649 - RNA, 22 nt, Homo sapiens
cuaauuuguuuucccuucuuac

SEQ ID NO: 36650 - RNA, 16 nt, Homo sapiens
cucaggcuggcaccgc

SEQ ID NO: 36651 - RNA, 11 nt, Homo sapiens
gcauccuaguc

SEQ ID NO: 36652 - RNA, 15 nt, Homo sapiens
gacgcugcugccgug

SEQ ID NO: 36653 - RNA, 19 nt, Homo sapiens
ggcuuuaaaacuuauccuc

SEQ ID NO: 36654 - RNA, 19 nt, Homo sapiens
gcauccuagucucuaucau

SEQ ID NO: 36655 - RNA, 16 nt, Homo sapiens
ccggagccuccagcug

SEQ ID NO: 36656 - RNA, 15 nt, Homo sapiens
cggagccuccagcug

SEQ ID NO: 36657 - RNA, 17 nt, Homo sapiens
cccaaagugugacucau

SEQ ID NO: 36658 - RNA, 11 nt, Homo sapiens
cgcaggaccau

SEQ ID NO: 36659 - RNA, 15 nt, Homo sapiens
uacauaaaguaugug

SEQ ID NO: 36660 - RNA, 23 nt, Homo sapiens
cuaguuguaauuuuuuuguggga

SEQ ID NO: 36661 - RNA, 14 nt, Homo sapiens
cucaucccacccgc

SEQ ID NO: 36662 - RNA, 16 nt, Homo sapiens
uaaagcuuugugcaga

SEQ ID NO: 36663 - RNA, 17 nt, Homo sapiens
cacacugagcugagggg

SEQ ID NO: 36664 - RNA, 19 nt, Homo sapiens
aggaauacauaaaguaugu

SEQ ID NO: 36665 - RNA, 20 nt, Homo sapiens
uuacaaugcauucugaggua

SEQ ID NO: 36666 - RNA, 22 nt, Homo sapiens
uccuccaugaauaucaguuauu

SEQ ID NO: 36667 - RNA, 18 nt, Homo sapiens
cugcagcgaguacuuccc

SEQ ID NO: 36668 - RNA, 20 nt, Homo sapiens
ugcauauuuuauuauaguca

SEQ ID NO: 36669 - RNA, 23 nt, Homo sapiens
uaaaaaaaaaacguauugcauuu

SEQ ID NO: 36670 - RNA, 17 nt, Homo sapiens
caggaccaucccggccg

SEQ ID NO: 36671 - RNA, 19 nt, Homo sapiens
agccgggaaagaagagccg

SEQ ID NO: 36672 - RNA, 13 nt, Homo sapiens
ggggaggggcgcu

SEQ ID NO: 36673 - RNA, 14 nt, Homo sapiens
ggagccuccagcug

SEQ ID NO: 36674 - RNA, 12 nt, Homo sapiens
ucucuaucauua

SEQ ID NO: 36675 - RNA, 15 nt, Homo sapiens
cuuuaaaacuuaucc

SEQ ID NO: 36676 - RNA, 16 nt, Homo sapiens
caugaauaucaguuau

SEQ ID NO: 36677 - RNA, 13 nt, Homo sapiens
augaaaaugucau

SEQ ID NO: 36678 - RNA, 21 nt, Homo sapiens
aagagccggagccuccagcug

SEQ ID NO: 36679 - RNA, 17 nt, Homo sapiens
ucauuaaaguucuagug

SEQ ID NO: 36680 - RNA, 13 nt, Homo sapiens
gaccaucccggcc

SEQ ID NO: 36681 - RNA, 15 nt, Homo sapiens
uaugaaaaugucauu

SEQ ID NO: 36682 - RNA, 19 nt, Homo sapiens
cuuuaaaacuuauccucca

SEQ ID NO: 36683 - RNA, 15 nt, Homo sapiens
gcgcgcucaucccac

SEQ ID NO: 36684 - RNA, 24 nt, Homo sapiens
aauacauaaaguaugugcauauuu

SEQ ID NO: 36685 - RNA, 17 nt, Homo sapiens
uuugaaaccaaaccaga

SEQ ID NO: 36686 - RNA, 20 nt, Homo sapiens
ccgcagggugaacugcagcg

SEQ ID NO: 36687 - RNA, 19 nt, Homo sapiens
auauuuuauuauagucacu

SEQ ID NO: 36688 - RNA, 14 nt, Homo sapiens
aaagguccuggcaa

SEQ ID NO: 36689 - RNA, 16 nt, Homo sapiens
cgugugggcaauguuc

SEQ ID NO: 36690 - RNA, 17 nt, Homo sapiens
uuugugggaaauccaca

SEQ ID NO: 36691 - RNA, 18 nt, Homo sapiens
cuaucauuaaaguucuag

SEQ ID NO: 36692 - RNA, 17 nt, Homo sapiens
ugcauuuaauuuauuga

SEQ ID NO: 36693 - RNA, 17 nt, Homo sapiens
cauccuagucucuauca

SEQ ID NO: 36694 - RNA, 17 nt, Homo sapiens
ccauuuuugaaaccaaa

SEQ ID NO: 36695 - RNA, 15 nt, Homo sapiens
uaaaguucuagugac

SEQ ID NO: 36696 - RNA, 14 nt, Homo sapiens
aaagcuuugugcag

SEQ ID NO: 36697 - RNA, 16 nt, Homo sapiens
aaagcuuugugcagau

SEQ ID NO: 36698 - RNA, 17 nt, Homo sapiens
cgugggccugagaccaa

SEQ ID NO: 36699 - RNA, 13 nt, Homo sapiens
gccgacggagccg

SEQ ID NO: 36700 - RNA, 14 nt, Homo sapiens
gugugacucauuaa

SEQ ID NO: 36701 - RNA, 17 nt, Homo sapiens
caguaugaaaaugucau

SEQ ID NO: 36702 - RNA, 19 nt, Homo sapiens
ccuccaugaauaucaguua

SEQ ID NO: 36703 - RNA, 14 nt, Homo sapiens
cacugagcugaggg

SEQ ID NO: 36704 - RNA, 15 nt, Homo sapiens
aaaaacguauugcau

SEQ ID NO: 36705 - RNA, 16 nt, Homo sapiens
ccuucuuacaaugcau

SEQ ID NO: 36706 - RNA, 15 nt, Homo sapiens
ccuccgcuacuucca

SEQ ID NO: 36707 - RNA, 20 nt, Homo sapiens
uuaauuuauugaggcuuuaa

SEQ ID NO: 36708 - RNA, 20 nt, Homo sapiens
cucgcuuccgcauccuaguc

SEQ ID NO: 36709 - RNA, 18 nt, Homo sapiens
agagccggagccuccagc

SEQ ID NO: 36710 - RNA, 19 nt, Homo sapiens
gccugcucgcccacuuccu

SEQ ID NO: 36711 - RNA, 20 nt, Homo sapiens
aaacuuauccuccaugaaua

SEQ ID NO: 36712 - RNA, 22 nt, Homo sapiens
gagggcgcggggcggggagcga

SEQ ID NO: 36713 - RNA, 24 nt, Homo sapiens
ggcuuuaaaacuuauccuccauga

SEQ ID NO: 36714 - RNA, 18 nt, Homo sapiens
agucacuaguuguaauuu

SEQ ID NO: 36715 - RNA, 15 nt, Homo sapiens
cuuccagggcuacgc

SEQ ID NO: 36716 - RNA, 12 nt, Homo sapiens
uguucuugugaa

SEQ ID NO: 36717 - RNA, 20 nt, Homo sapiens
aacugcagcgaguacuuccc

SEQ ID NO: 36718 - RNA, 12 nt, Homo sapiens
aaaaaaacguau

SEQ ID NO: 36719 - RNA, 16 nt, Homo sapiens
ccauuuuugaaaccaa

SEQ ID NO: 36720 - RNA, 15 nt, Homo sapiens
cuccgcuacuuccag

SEQ ID NO: 36721 - RNA, 15 nt, Homo sapiens
ucauuaaaguucuag

SEQ ID NO: 36722 - RNA, 15 nt, Homo sapiens
cuugugaacccaaag

SEQ ID NO: 36723 - RNA, 20 nt, Homo sapiens
aaaaaacguauugcauuuaa

SEQ ID NO: 36724 - RNA, 15 nt, Homo sapiens
cagcugccccgggga

SEQ ID NO: 36725 - RNA, 14 nt, Homo sapiens
ucuuccucccugga

SEQ ID NO: 36726 - RNA, 13 nt, Homo sapiens
uagucucuaucau

SEQ ID NO: 36727 - RNA, 13 nt, Homo sapiens
cauuaucagucca

SEQ ID NO: 36728 - RNA, 16 nt, Homo sapiens
guaaagcuuugugcag

SEQ ID NO: 36729 - RNA, 21 nt, Homo sapiens
acuguaaagcuuugugcagau

SEQ ID NO: 36730 - RNA, 17 nt, Homo sapiens
uaaagcuuugugcagau

SEQ ID NO: 36731 - RNA, 17 nt, Homo sapiens
auccuagucucuaucau

SEQ ID NO: 36732 - RNA, 22 nt, Homo sapiens
cucuaucauuaaaguucuagug

SEQ ID NO: 36733 - RNA, 16 nt, Homo sapiens
uuaaaguucuagugac

SEQ ID NO: 36734 - RNA, 22 nt, Homo sapiens
gcucgcuuccgcauccuagucu

SEQ ID NO: 36735 - RNA, 14 nt, Homo sapiens
auuuuugaaaccaa

SEQ ID NO: 36736 - RNA, 16 nt, Homo sapiens
ugugaacccaaagugu

SEQ ID NO: 36737 - RNA, 16 nt, Homo sapiens
auucgauccccuguca

SEQ ID NO: 36738 - RNA, 23 nt, Homo sapiens
uacuucccgcuguuccucgccac

SEQ ID NO: 36739 - RNA, 20 nt, Homo sapiens
uguuguuuuaggaauacaua

SEQ ID NO: 36740 - RNA, 18 nt, Homo sapiens
auucuuuacccccuggga

SEQ ID NO: 36741 - RNA, 16 nt, Homo sapiens
ucuuccucccuggaau

SEQ ID NO: 36742 - RNA, 19 nt, Homo sapiens
cggcgggagggcgcggggc

SEQ ID NO: 36743 - RNA, 20 nt, Homo sapiens
gcgcgccuccgcuacuucca

SEQ ID NO: 36744 - RNA, 15 nt, Homo sapiens
cucgcccacuuccuc

SEQ ID NO: 36745 - RNA, 19 nt, Homo sapiens
cagcgaguacuucccgcug

SEQ ID NO: 36746 - RNA, 13 nt, Homo sapiens
uuguucuugugaa

SEQ ID NO: 36747 - RNA, 16 nt, Homo sapiens
cuucuuacaaugcauu

SEQ ID NO: 36748 - RNA, 22 nt, Homo sapiens
gcugccgugggccugagaccaa

SEQ ID NO: 36749 - RNA, 14 nt, Homo sapiens
agccccaauucgau

SEQ ID NO: 36750 - RNA, 15 nt, Homo sapiens
ugugggaaauccaca

SEQ ID NO: 36751 - RNA, 15 nt, Homo sapiens
caggcggguccgggu

SEQ ID NO: 36752 - RNA, 17 nt, Homo sapiens
ugcagcgaguacuuccc

SEQ ID NO: 36753 - RNA, 15 nt, Homo sapiens
cuuauccuccaugaa

SEQ ID NO: 36754 - RNA, 23 nt, Homo sapiens
aacccaaagugugacucauuaaa

SEQ ID NO: 36755 - RNA, 14 nt, Homo sapiens
aaaguucuagugac

SEQ ID NO: 36756 - RNA, 17 nt, Homo sapiens
ucaguccaaagggcaug

SEQ ID NO: 36757 - RNA, 20 nt, Homo sapiens
ggcggguccgggucgcagga

SEQ ID NO: 36758 - RNA, 19 nt, Homo sapiens
cccucuccucucuuccucc

SEQ ID NO: 36759 - RNA, 13 nt, Homo sapiens
aaaguucuaguga

SEQ ID NO: 36760 - RNA, 14 nt, Homo sapiens
uggcgcuggcugcg

SEQ ID NO: 36761 - RNA, 16 nt, Homo sapiens
gggugaacugcagcga

SEQ ID NO: 36762 - RNA, 22 nt, Homo sapiens
aauguuguuuuaggaauacaua

SEQ ID NO: 36763 - RNA, 20 nt, Homo sapiens
ugcgcucggccugcucgccc

SEQ ID NO: 36764 - RNA, 11 nt, Homo sapiens
acaaugcauuc

SEQ ID NO: 36765 - RNA, 19 nt, Homo sapiens
ucuuacaaugcauucugag

SEQ ID NO: 36766 - RNA, 15 nt, Homo sapiens
gcucgcccacuuccu

SEQ ID NO: 36767 - RNA, 16 nt, Homo sapiens
ggcugcugguggcgcu

SEQ ID NO: 36768 - RNA, 17 nt, Homo sapiens
cgccuccgcuacuucca

SEQ ID NO: 36769 - RNA, 19 nt, Homo sapiens
aaauguuguuuuaggaaua

SEQ ID NO: 36770 - RNA, 15 nt, Homo sapiens
agccgggaaagaaga

SEQ ID NO: 36771 - RNA, 18 nt, Homo sapiens
accauuuuugaaaccaaa

SEQ ID NO: 36772 - RNA, 17 nt, Homo sapiens
cauaaaguaugugcaua

SEQ ID NO: 36773 - RNA, 13 nt, Homo sapiens
uccgcuacuucca

SEQ ID NO: 36774 - RNA, 21 nt, Homo sapiens
uccaaagggcauggguuuuau

SEQ ID NO: 36775 - RNA, 21 nt, Homo sapiens
cgccuccgcuacuuccagggc

SEQ ID NO: 36776 - RNA, 16 nt, Homo sapiens
uuccgcauccuagucu

SEQ ID NO: 36777 - RNA, 14 nt, Homo sapiens
agcugccccgggga

SEQ ID NO: 36778 - RNA, 18 nt, Homo sapiens
uagucucuaucauuaaag

SEQ ID NO: 36779 - RNA, 12 nt, Homo sapiens
gcauccuagucu

SEQ ID NO: 36780 - RNA, 16 nt, Homo sapiens
auccacacugagcuga

SEQ ID NO: 36781 - RNA, 22 nt, Homo sapiens
gagaccaaggcccccgggccga

SEQ ID NO: 36782 - RNA, 14 nt, Homo sapiens
augaucaguaugaa

SEQ ID NO: 36783 - RNA, 16 nt, Homo sapiens
ccgcauccuagucucu

SEQ ID NO: 36784 - RNA, 16 nt, Homo sapiens
caaugcauucugaggu

SEQ ID NO: 36785 - RNA, 15 nt, Homo sapiens
aaccucauuaucagu

SEQ ID NO: 36786 - RNA, 23 nt, Homo sapiens
ugcauucugagguaaccucauua

SEQ ID NO: 36787 - RNA, 23 nt, Homo sapiens
agcgcgcgcgcccucuggcugcu

SEQ ID NO: 36788 - RNA, 16 nt, Homo sapiens
ucuaucauuaaaguuc

SEQ ID NO: 36789 - RNA, 20 nt, Homo sapiens
uuacccccugggagccccaa

SEQ ID NO: 36790 - RNA, 17 nt, Homo sapiens
agagccggagccuccag

SEQ ID NO: 36791 - RNA, 13 nt, Homo sapiens
uuccucgccacgc

SEQ ID NO: 36792 - RNA, 19 nt, Homo sapiens
gcuuuaaaacuuauccucc

SEQ ID NO: 36793 - RNA, 13 nt, Homo sapiens
gccccaauucgau

SEQ ID NO: 36794 - RNA, 17 nt, Homo sapiens
aucaguccaaagggcau

SEQ ID NO: 36795 - RNA, 21 nt, Homo sapiens
uguuguuuuaggaauacauaa

SEQ ID NO: 36796 - RNA, 16 nt, Homo sapiens
ugcauauuuuauuaua

SEQ ID NO: 36797 - RNA, 15 nt, Homo sapiens
uccgcauccuagucu

SEQ ID NO: 36798 - RNA, 20 nt, Homo sapiens
uacauaaaguaugugcauau

SEQ ID NO: 36799 - RNA, 23 nt, Homo sapiens
gugaacugcagcgaguacuuccc

SEQ ID NO: 36800 - RNA, 15 nt, Homo sapiens
agugugacucauuaa

SEQ ID NO: 36801 - RNA, 21 nt, Homo sapiens
ugugcggccuggucuaccugu

SEQ ID NO: 36802 - RNA, 14 nt, Homo sapiens
aaaacguauugcau

SEQ ID NO: 36803 - RNA, 21 nt, Homo sapiens
gcucgcuuccgcauccuaguc

SEQ ID NO: 36804 - RNA, 16 nt, Homo sapiens
agucucuaucauuaaa

SEQ ID NO: 36805 - RNA, 16 nt, Homo sapiens
gcauccuagucucuau

SEQ ID NO: 36806 - RNA, 22 nt, Homo sapiens
ucuaucauuaaaguucuaguga

SEQ ID NO: 36807 - RNA, 21 nt, Homo sapiens
auucugagguaaccucauuau

SEQ ID NO: 36808 - RNA, 14 nt, Homo sapiens
uaaaguaugugcau

SEQ ID NO: 36809 - RNA, 22 nt, Homo sapiens
ugaggcuuuaaaacuuauccuc

SEQ ID NO: 36810 - RNA, 21 nt, Homo sapiens
cuggcugcgcucggccugcuc

SEQ ID NO: 36811 - RNA, 13 nt, Homo sapiens
aucaguccaaagg

SEQ ID NO: 36812 - RNA, 18 nt, Homo sapiens
ugaucaguaugaaaaugu

SEQ ID NO: 36813 - RNA, 18 nt, Homo sapiens
uauccuccaugaauauca

SEQ ID NO: 36814 - RNA, 11 nt, Homo sapiens
aacccaaagug

SEQ ID NO: 36815 - RNA, 18 nt, Homo sapiens
aagagccggagccuccag

SEQ ID NO: 36816 - RNA, 17 nt, Homo sapiens
uauagucacuaguugua

SEQ ID NO: 36817 - RNA, 17 nt, Homo sapiens
aaacguauugcauuuaa

SEQ ID NO: 36818 - RNA, 23 nt, Homo sapiens
uugcauuuaauuuauugaggcuu

SEQ ID NO: 36819 - RNA, 19 nt, Homo sapiens
cauauuuuauuauagucac

SEQ ID NO: 36820 - RNA, 23 nt, Homo sapiens
auucugagguaaccucauuauca

SEQ ID NO: 36821 - RNA, 13 nt, Homo sapiens
uccgcauccuagu

SEQ ID NO: 36822 - RNA, 17 nt, Homo sapiens
guaaagcuuugugcaga

SEQ ID NO: 36823 - RNA, 23 nt, Homo sapiens
uaauuuuuuugugggaaauccac

SEQ ID NO: 36824 - RNA, 12 nt, Homo sapiens
uuaucaguccaa

SEQ ID NO: 36825 - RNA, 19 nt, Homo sapiens
uacaaugcauucugaggua

SEQ ID NO: 36826 - RNA, 17 nt, Homo sapiens
ucauuguucuugugaac

SEQ ID NO: 36827 - RNA, 21 nt, Homo sapiens
ccuggcaaagaugaucaguau

SEQ ID NO: 36828 - RNA, 22 nt, Homo sapiens
ugaacugcagcgaguacuuccc

SEQ ID NO: 36829 - RNA, 22 nt, Homo sapiens
ucauuguucuugugaacccaaa

SEQ ID NO: 36830 - RNA, 17 nt, Homo sapiens
cggagccuccagcugcc

SEQ ID NO: 36831 - RNA, 14 nt, Homo sapiens
aaaaacguauugca

SEQ ID NO: 36832 - RNA, 11 nt, Homo sapiens
cgcuacuucca

SEQ ID NO: 36833 - RNA, 21 nt, Homo sapiens
ucgauccccugucacgugugg

SEQ ID NO: 36834 - RNA, 14 nt, Homo sapiens
cgauccccugucac

SEQ ID NO: 36835 - RNA, 20 nt, Homo sapiens
caguuauuuuuaaacuguaa

SEQ ID NO: 36836 - RNA, 16 nt, Homo sapiens
cauaaaguaugugcau

SEQ ID NO: 36837 - RNA, 12 nt, Homo sapiens
caucuucuuuca

SEQ ID NO: 36838 - RNA, 23 nt, Homo sapiens
uucgcgcgccuccgcuacuucca

SEQ ID NO: 36839 - RNA, 16 nt, Homo sapiens
uaaaguaugugcauau

SEQ ID NO: 36840 - RNA, 19 nt, Homo sapiens
cccuucuuacaaugcauuc

SEQ ID NO: 36841 - RNA, 12 nt, Homo sapiens
ugagguaaccuc

SEQ ID NO: 36842 - RNA, 16 nt, Homo sapiens
aucuucuuucaugaag

SEQ ID NO: 36843 - RNA, 22 nt, Homo sapiens
auuuuuuugugggaaauccaca

SEQ ID NO: 36844 - RNA, 18 nt, Homo sapiens
gaagagccggagccucca

SEQ ID NO: 36845 - RNA, 23 nt, Homo sapiens
agguccuggcaaagaugaucagu

SEQ ID NO: 36846 - RNA, 20 nt, Homo sapiens
ugcauucugagguaaccuca

SEQ ID NO: 36847 - RNA, 19 nt, Homo sapiens
cgcucaucccacccgccca

SEQ ID NO: 36848 - RNA, 18 nt, Homo sapiens
gcuuccgcauccuagucu

SEQ ID NO: 36849 - RNA, 22 nt, Homo sapiens
aaaugucauuguucuugugaac

SEQ ID NO: 36850 - RNA, 19 nt, Homo sapiens
cuuugugcagauucuuuac

SEQ ID NO: 36851 - RNA, 12 nt, Homo sapiens
ccgcuacuucca

SEQ ID NO: 36852 - RNA, 15 nt, Homo sapiens
gaauacauaaaguau

SEQ ID NO: 36853 - RNA, 17 nt, Homo sapiens
gguccgggucgcaggac

SEQ ID NO: 36854 - RNA, 15 nt, Homo sapiens
ugaauaucaguuauu

SEQ ID NO: 36855 - RNA, 18 nt, Homo sapiens
ugugaacccaaaguguga

SEQ ID NO: 36856 - RNA, 13 nt, Homo sapiens
uuuauuauauaua

SEQ ID NO: 36857 - RNA, 11 nt, Homo sapiens
agccggagccu

SEQ ID NO: 36858 - RNA, 23 nt, Homo sapiens
uccuggcaaagaugaucaguaug

SEQ ID NO: 36859 - RNA, 13 nt, Homo sapiens
agccuccagcugc

SEQ ID NO: 36860 - RNA, 17 nt, Homo sapiens
gcaaagaugaucaguau

SEQ ID NO: 36861 - RNA, 15 nt, Homo sapiens
uaaaguaugugcaua

SEQ ID NO: 36862 - RNA, 21 nt, Homo sapiens
ggcaauguucccccucuccuc

SEQ ID NO: 36863 - RNA, 20 nt, Homo sapiens
ggccugcucgcccacuuccu

SEQ ID NO: 36864 - RNA, 13 nt, Homo sapiens
uggaaucuuguaa

SEQ ID NO: 36865 - RNA, 23 nt, Homo sapiens
agaagagccggagccuccagcug

SEQ ID NO: 36866 - RNA, 22 nt, Homo sapiens
agucucuaucauuaaaguucua

SEQ ID NO: 36867 - RNA, 21 nt, Homo sapiens
gcuccucggacggcuccggac

SEQ ID NO: 36868 - RNA, 15 nt, Homo sapiens
agccuccagcugccc

SEQ ID NO: 36869 - RNA, 13 nt, Homo sapiens
aguaugugcauau

SEQ ID NO: 36870 - RNA, 14 nt, Homo sapiens
cuagucucuaucau

SEQ ID NO: 36871 - RNA, 16 nt, Homo sapiens
auuaaaguucuaguga

SEQ ID NO: 36872 - RNA, 16 nt, Homo sapiens
cauuuuugaaaccaaa

SEQ ID NO: 36873 - RNA, 19 nt, Homo sapiens
uuucccuucuuacaaugca

SEQ ID NO: 36874 - RNA, 13 nt, Homo sapiens
gagccuccagcug

SEQ ID NO: 36875 - RNA, 16 nt, Homo sapiens
aguaugaaaaugucau

SEQ ID NO: 36876 - RNA, 19 nt, Homo sapiens
uggcaaagaugaucaguau

SEQ ID NO: 36877 - RNA, 23 nt, Homo sapiens
aaaaugucauuguucuugugaac

SEQ ID NO: 36878 - RNA, 22 nt, Homo sapiens
auccuagucucuaucauuaaag

SEQ ID NO: 36879 - RNA, 17 nt, Homo sapiens
cuuccgcauccuagucu

SEQ ID NO: 36880 - RNA, 17 nt, Homo sapiens
uaaagguccuggcaaag

SEQ ID NO: 36881 - RNA, 15 nt, Homo sapiens
cggccugcucgccca

SEQ ID NO: 36882 - RNA, 22 nt, Homo sapiens
uaguuguaauuuuuuuguggga

SEQ ID NO: 36883 - RNA, 20 nt, Homo sapiens
aauacauaaaguaugugcau

SEQ ID NO: 36884 - RNA, 14 nt, Homo sapiens
aaguaugugcauau

SEQ ID NO: 36885 - RNA, 22 nt, Homo sapiens
ucuuguaaagguccuggcaaag

SEQ ID NO: 36886 - RNA, 19 nt, Homo sapiens
caaagaugaucaguaugaa

SEQ ID NO: 36887 - RNA, 20 nt, Homo sapiens
cuguaaagcuuugugcagau

SEQ ID NO: 36888 - RNA, 15 nt, Homo sapiens
auaaaguaugugcau

SEQ ID NO: 36889 - RNA, 17 nt, Homo sapiens
ucauuaucaguccaaag

SEQ ID NO: 36890 - RNA, 15 nt, Homo sapiens
uaaagcuuugugcag

SEQ ID NO: 36891 - RNA, 19 nt, Homo sapiens
uacauaaaguaugugcaua

SEQ ID NO: 36892 - RNA, 19 nt, Homo sapiens
aacccaaagugugacucau

SEQ ID NO: 36893 - RNA, 22 nt, Homo sapiens
aauacauaaaguaugugcauau

SEQ ID NO: 36894 - RNA, 20 nt, Homo sapiens
cggggaggggcgcucgcuuc

SEQ ID NO: 36895 - RNA, 11 nt, Homo sapiens
caaagugugac

SEQ ID NO: 36896 - RNA, 16 nt, Homo sapiens
uucugagguaaccuca

SEQ ID NO: 36897 - RNA, 18 nt, Homo sapiens
cugucacgugugggcaau

SEQ ID NO: 36898 - RNA, 19 nt, Homo sapiens
augucauuguucuugugaa

SEQ ID NO: 36899 - RNA, 13 nt, Homo sapiens
uuuuauuuaaccu

SEQ ID NO: 36900 - RNA, 19 nt, Homo sapiens
ugggagcuuuuguagaagu

SEQ ID NO: 36901 - RNA, 15 nt, Homo sapiens
uguaguguuggagaa

SEQ ID NO: 36902 - RNA, 20 nt, Homo sapiens
uguauaaaauaauuuuuaua

SEQ ID NO: 36903 - RNA, 15 nt, Homo sapiens
uguauuccuuuuucu

SEQ ID NO: 36904 - RNA, 18 nt, Homo sapiens
ugugcuaguaauuggaaa

SEQ ID NO: 36905 - RNA, 19 nt, Homo sapiens
ugugcuaguaauuggaaag

SEQ ID NO: 36906 - RNA, 13 nt, Homo sapiens
ugugaagcaaaau

SEQ ID NO: 36907 - RNA, 20 nt, Homo sapiens
uguccauucuuccucccauu

SEQ ID NO: 36908 - RNA, 18 nt, Homo sapiens
uggagcugccucucucau

SEQ ID NO: 36909 - RNA, 19 nt, Homo sapiens
uggagcugccucucucauc

SEQ ID NO: 36910 - RNA, 11 nt, Homo sapiens
uuucugaaauu

SEQ ID NO: 36911 - RNA, 12 nt, Homo sapiens
uuucugaaauuu

SEQ ID NO: 36912 - RNA, 23 nt, Homo sapiens
uuucauuuuagggguagcauuug

SEQ ID NO: 36913 - RNA, 23 nt, Homo sapiens
uuuuaaagcuuccauuguugucu

SEQ ID NO: 36914 - RNA, 19 nt, Homo sapiens
uuugcucauggaauuggag

SEQ ID NO: 36915 - RNA, 13 nt, Homo sapiens
uucuagugaccga

SEQ ID NO: 36916 - RNA, 15 nt, Homo sapiens
uucuguuuuauaauu

SEQ ID NO: 36917 - RNA, 19 nt, Homo sapiens
uugaagagguuuuaaagcu

SEQ ID NO: 36918 - RNA, 21 nt, Homo sapiens
uucuaggacugaauuaugaaa

SEQ ID NO: 36919 - RNA, 16 nt, Homo sapiens
uuccugggagcuuuug

SEQ ID NO: 36920 - RNA, 17 nt, Homo sapiens
uuggacaaaauggaaua

SEQ ID NO: 36921 - RNA, 18 nt, Homo sapiens
uugauggugguauguuuu

SEQ ID NO: 36922 - RNA, 12 nt, Homo sapiens
uguuuccaucaa

SEQ ID NO: 36923 - RNA, 16 nt, Homo sapiens
uuaaaagaaugauuau

SEQ ID NO: 36924 - RNA, 19 nt, Homo sapiens
uuaaguuuuuuuuuaaaaa

SEQ ID NO: 36925 - RNA, 12 nt, Homo sapiens
uuauuguagcau

SEQ ID NO: 36926 - RNA, 15 nt, Homo sapiens
uacauuuguauaaaa

SEQ ID NO: 36927 - RNA, 20 nt, Homo sapiens
uacauuuguauaaaauaauu

SEQ ID NO: 36928 - RNA, 21 nt, Homo sapiens
uacaucccuuaccugggaaag

SEQ ID NO: 36929 - RNA, 20 nt, Homo sapiens
uacaguggggaaugaagaua

SEQ ID NO: 36930 - RNA, 13 nt, Homo sapiens
uacucuuauaucu

SEQ ID NO: 36931 - RNA, 19 nt, Homo sapiens
uacuuauuguagcauccug

SEQ ID NO: 36932 - RNA, 18 nt, Homo sapiens
uagcauccuggaauaucu

SEQ ID NO: 36933 - RNA, 18 nt, Homo sapiens
uaggaaauauuuauuuua

SEQ ID NO: 36934 - RNA, 14 nt, Homo sapiens
uagcuuuuuucucu

SEQ ID NO: 36935 - RNA, 13 nt, Homo sapiens
uaucacuugucaa

SEQ ID NO: 36936 - RNA, 18 nt, Homo sapiens
uaucacuugucaauaaaa

SEQ ID NO: 36937 - RNA, 19 nt, Homo sapiens
uaucacuugucaauaaaau

SEQ ID NO: 36938 - RNA, 22 nt, Homo sapiens
uagugaaacucguuaauuugua

SEQ ID NO: 36939 - RNA, 20 nt, Homo sapiens
uauaguuacccaaauuaaga

SEQ ID NO: 36940 - RNA, 14 nt, Homo sapiens
uauauaagcuugua

SEQ ID NO: 36941 - RNA, 12 nt, Homo sapiens
uauauauauuuu

SEQ ID NO: 36942 - RNA, 14 nt, Homo sapiens
uauaucuauauuuu

SEQ ID NO: 36943 - RNA, 11 nt, Homo sapiens
uaauuggaaag

SEQ ID NO: 36944 - RNA, 12 nt, Homo sapiens
uaauuggaaagg

SEQ ID NO: 36945 - RNA, 15 nt, Homo sapiens
uaauuugguuuucac

SEQ ID NO: 36946 - RNA, 21 nt, Homo sapiens
uaauuuguaguguuggagaag

SEQ ID NO: 36947 - RNA, 15 nt, Homo sapiens
uaaugauaacuggaa

SEQ ID NO: 36948 - RNA, 16 nt, Homo sapiens
uacacugccuucucaa

SEQ ID NO: 36949 - RNA, 17 nt, Homo sapiens
uacagaaaaguugaauu

SEQ ID NO: 36950 - RNA, 14 nt, Homo sapiens
uaagagagucuauu

SEQ ID NO: 36951 - RNA, 23 nt, Homo sapiens
uaagaagacugcauuauauuuau

SEQ ID NO: 36952 - RNA, 21 nt, Homo sapiens
uaagacaaaaagcuacuuauu

SEQ ID NO: 36953 - RNA, 14 nt, Homo sapiens
uaaaguaugugcau

SEQ ID NO: 36954 - RNA, 13 nt, Homo sapiens
uaaauagcuuuuu

SEQ ID NO: 36955 - RNA, 23 nt, Homo sapiens
uaacaaugcuguauuuuaaaaga

SEQ ID NO: 36956 - RNA, 14 nt, Homo sapiens
ucaauauuucagau

SEQ ID NO: 36957 - RNA, 16 nt, Homo sapiens
ucaaugccccugaauu

SEQ ID NO: 36958 - RNA, 17 nt, Homo sapiens
ucaaugccccugaauuu

SEQ ID NO: 36959 - RNA, 19 nt, Homo sapiens
ucacuugucaauaaaaucc

SEQ ID NO: 36960 - RNA, 14 nt, Homo sapiens
ucagcgguuuauau

SEQ ID NO: 36961 - RNA, 22 nt, Homo sapiens
uaugaaacuuuuggaagguauu

SEQ ID NO: 36962 - RNA, 13 nt, Homo sapiens
uauauuguuugcu

SEQ ID NO: 36963 - RNA, 14 nt, Homo sapiens
uauauuguuugcua

SEQ ID NO: 36964 - RNA, 15 nt, Homo sapiens
uaugcuucuguuuua

SEQ ID NO: 36965 - RNA, 14 nt, Homo sapiens
uaugugcauauuuu

SEQ ID NO: 36966 - RNA, 20 nt, Homo sapiens
uauuguagcauccuggaaua

SEQ ID NO: 36967 - RNA, 16 nt, Homo sapiens
uauugaggcuuuaaaa

SEQ ID NO: 36968 - RNA, 16 nt, Homo sapiens
ucaacucauauuuuca

SEQ ID NO: 36969 - RNA, 15 nt, Homo sapiens
ucaaauccuugaaga

SEQ ID NO: 36970 - RNA, 14 nt, Homo sapiens
ucaacucauauuuu

SEQ ID NO: 36971 - RNA, 19 nt, Homo sapiens
uauuuuaauaauguuucaa

SEQ ID NO: 36972 - RNA, 17 nt, Homo sapiens
uauuuucaugcuguuca

SEQ ID NO: 36973 - RNA, 14 nt, Homo sapiens
uauuuuuaaacugu

SEQ ID NO: 36974 - RNA, 19 nt, Homo sapiens
uauuuaaccucuaaauucu

SEQ ID NO: 36975 - RNA, 19 nt, Homo sapiens
uauuucagauaaucacaau

SEQ ID NO: 36976 - RNA, 16 nt, Homo sapiens
uccacuuuccaauaaa

SEQ ID NO: 36977 - RNA, 16 nt, Homo sapiens
ucaugaauuaguuuua

SEQ ID NO: 36978 - RNA, 13 nt, Homo sapiens
ucauccacuuucc

SEQ ID NO: 36979 - RNA, 14 nt, Homo sapiens
ucauccacuuucca

SEQ ID NO: 36980 - RNA, 13 nt, Homo sapiens
ucaguuauuuuua

SEQ ID NO: 36981 - RNA, 20 nt, Homo sapiens
ucauucagauaugauucaaa

SEQ ID NO: 36982 - RNA, 16 nt, Homo sapiens
ugaagauacugaaaua

SEQ ID NO: 36983 - RNA, 17 nt, Homo sapiens
ugaacaggauauucuca

SEQ ID NO: 36984 - RNA, 18 nt, Homo sapiens
ugaacuagaguuuagcug

SEQ ID NO: 36985 - RNA, 14 nt, Homo sapiens
ugaauuaugaaacu

SEQ ID NO: 36986 - RNA, 21 nt, Homo sapiens
ugaaguccaagcauuuagaug

SEQ ID NO: 36987 - RNA, 15 nt, Homo sapiens
ugaagcaaaauuuuu

SEQ ID NO: 36988 - RNA, 17 nt, Homo sapiens
ugaaauauugacuuuuu

SEQ ID NO: 36989 - RNA, 12 nt, Homo sapiens
ugauacagaaaa

SEQ ID NO: 36990 - RNA, 12 nt, Homo sapiens
ugacucuuaaga

SEQ ID NO: 36991 - RNA, 20 nt, Homo sapiens
ugcccuuccccuucccacac

SEQ ID NO: 36992 - RNA, 19 nt, Homo sapiens
ugauggugguauguuuuca

SEQ ID NO: 36993 - RNA, 13 nt, Homo sapiens
uccuagucucuau

SEQ ID NO: 36994 - RNA, 14 nt, Homo sapiens
uccuagucucuauc

SEQ ID NO: 36995 - RNA, 19 nt, Homo sapiens
uccuagucucuaucauuaa

SEQ ID NO: 36996 - RNA, 15 nt, Homo sapiens
ucucauccacuuucc

SEQ ID NO: 36997 - RNA, 18 nt, Homo sapiens
ucugaaggguaauuauau

SEQ ID NO: 36998 - RNA, 16 nt, Homo sapiens
ucuugauaaauggcuu

SEQ ID NO: 36999 - RNA, 18 nt, Homo sapiens
ucuuauaucuauauuuua

SEQ ID NO: 37000 - RNA, 11 nt, Homo sapiens
gacuuuuuaug

SEQ ID NO: 37001 - RNA, 23 nt, Homo sapiens
gaaugauuaugaauuacauuugu

SEQ ID NO: 37002 - RNA, 17 nt, Homo sapiens
gaaagugacaagcucac

SEQ ID NO: 37003 - RNA, 16 nt, Homo sapiens
gacaugggacauuugc

SEQ ID NO: 37004 - RNA, 20 nt, Homo sapiens
gauuauauauauuuuuuucu

SEQ ID NO: 37005 - RNA, 21 nt, Homo sapiens
gauguuuagaaacacaacuau

SEQ ID NO: 37006 - RNA, 23 nt, Homo sapiens
gauguuuagaaacacaacuauau

SEQ ID NO: 37007 - RNA, 19 nt, Homo sapiens
gcacagugaucaaguuauu

SEQ ID NO: 37008 - RNA, 17 nt, Homo sapiens
gcacuaguauuucuaug

SEQ ID NO: 37009 - RNA, 12 nt, Homo sapiens
gcaacucugaag

SEQ ID NO: 37010 - RNA, 11 nt, Homo sapiens
gauacagaaaa

SEQ ID NO: 37011 - RNA, 21 nt, Homo sapiens
gauaugccuuuucccaacucc

SEQ ID NO: 37012 - RNA, 19 nt, Homo sapiens
gccugaguguugccuaauu

SEQ ID NO: 37013 - RNA, 12 nt, Homo sapiens
gcauucaaaugu

SEQ ID NO: 37014 - RNA, 14 nt, Homo sapiens
gcauucaaauguau

SEQ ID NO: 37015 - RNA, 15 nt, Homo sapiens
gcauuccaacuaucu

SEQ ID NO: 37016 - RNA, 21 nt, Homo sapiens
gcauccuagucucuaucauua

SEQ ID NO: 37017 - RNA, 14 nt, Homo sapiens
gcauccuagucucu

SEQ ID NO: 37018 - RNA, 12 nt, Homo sapiens
ggagccccaauu

SEQ ID NO: 37019 - RNA, 19 nt, Homo sapiens
ggaaugaagauacugaaau

SEQ ID NO: 37020 - RNA, 13 nt, Homo sapiens
gcuagaauuugau

SEQ ID NO: 37021 - RNA, 14 nt, Homo sapiens
gcuagaauuugaua

SEQ ID NO: 37022 - RNA, 15 nt, Homo sapiens
gcuagaauuugauau

SEQ ID NO: 37023 - RNA, 12 nt, Homo sapiens
gguaaccucauu

SEQ ID NO: 37024 - RNA, 20 nt, Homo sapiens
gggaaugaagauacugaaau

SEQ ID NO: 37025 - RNA, 13 nt, Homo sapiens
gggccgacggagc

SEQ ID NO: 37026 - RNA, 22 nt, Homo sapiens
gucuaccaaaaaucucaauauu

SEQ ID NO: 37027 - RNA, 14 nt, Homo sapiens
guaugaaaauguca

SEQ ID NO: 37028 - RNA, 19 nt, Homo sapiens
guauuucuaugaaauauua

SEQ ID NO: 37029 - RNA, 20 nt, Homo sapiens
guauuuuaaaagaaugauua

SEQ ID NO: 37030 - RNA, 15 nt, Homo sapiens
gugaaagguacuuca

SEQ ID NO: 37031 - RNA, 15 nt, Homo sapiens
gugcagauucuuuac

SEQ ID NO: 37032 - RNA, 17 nt, Homo sapiens
guuauuuuuaaacugua

SEQ ID NO: 37033 - RNA, 18 nt, Homo sapiens
guuauuuuuaauuugguu

SEQ ID NO: 37034 - RNA, 23 nt, Homo sapiens
guuauuuuuaauuugguuuucac

SEQ ID NO: 37035 - RNA, 16 nt, Homo sapiens
guugaagagguuuuaa

SEQ ID NO: 37036 - RNA, 16 nt, Homo sapiens
gaugcaguucugaaga

SEQ ID NO: 37037 - RNA, 17 nt, Homo sapiens
gaugguucccuugauga

SEQ ID NO: 37038 - RNA, 22 nt, Homo sapiens
gauguuuagaaacacaacuaua

SEQ ID NO: 37039 - RNA, 22 nt, Homo sapiens
gcacuaguauuucuaugaaaua

SEQ ID NO: 37040 - RNA, 13 nt, Homo sapiens
gcaccaaucauga

SEQ ID NO: 37041 - RNA, 13 nt, Homo sapiens
gcauuccaacuau

SEQ ID NO: 37042 - RNA, 14 nt, Homo sapiens
gcauuccaacuauc

SEQ ID NO: 37043 - RNA, 17 nt, Homo sapiens
gaucaguaugaaaaugu

SEQ ID NO: 37044 - RNA, 15 nt, Homo sapiens
gagacacacugaaga

SEQ ID NO: 37045 - RNA, 16 nt, Homo sapiens
gaagaagcaccaauca

SEQ ID NO: 37046 - RNA, 14 nt, Homo sapiens
gaacugaaaucaua

SEQ ID NO: 37047 - RNA, 23 nt, Homo sapiens
acacacaugaaguccaagcauuu

SEQ ID NO: 37048 - RNA, 20 nt, Homo sapiens
acaaggaugaauuaaguuuu

SEQ ID NO: 37049 - RNA, 21 nt, Homo sapiens
acaaggaugaauuaaguuuuu

SEQ ID NO: 37050 - RNA, 18 nt, Homo sapiens
aauuuugugaagcaaaau

SEQ ID NO: 37051 - RNA, 16 nt, Homo sapiens
aauuuuuucucuagga

SEQ ID NO: 37052 - RNA, 22 nt, Homo sapiens
aaucaugaauuaguuuuauaug

SEQ ID NO: 37053 - RNA, 16 nt, Homo sapiens
aauuugguuuucacau

SEQ ID NO: 37054 - RNA, 17 nt, Homo sapiens
aauuuaaauagcuuuuu

SEQ ID NO: 37055 - RNA, 17 nt, Homo sapiens
aauuacauuuguauaaa

SEQ ID NO: 37056 - RNA, 15 nt, Homo sapiens
aaugauuaugaauua

SEQ ID NO: 37057 - RNA, 21 nt, Homo sapiens
aaugauuaugaauuacauuug

SEQ ID NO: 37058 - RNA, 21 nt, Homo sapiens
aauguugacaugggacauuug

SEQ ID NO: 37059 - RNA, 15 nt, Homo sapiens
gaauuaguuuuauau

SEQ ID NO: 37060 - RNA, 13 nt, Homo sapiens
gaagauacugaaa

SEQ ID NO: 37061 - RNA, 14 nt, Homo sapiens
gaauaucaguuauu

SEQ ID NO: 37062 - RNA, 21 nt, Homo sapiens
cgcucgcuuccgcauccuagu

SEQ ID NO: 37063 - RNA, 16 nt, Homo sapiens
cguauugcauuuaauu

SEQ ID NO: 37064 - RNA, 17 nt, Homo sapiens
cuagucucuaucauuaa

SEQ ID NO: 37065 - RNA, 13 nt, Homo sapiens
cuaggaaauauuu

SEQ ID NO: 37066 - RNA, 17 nt, Homo sapiens
cuaguuguaauuuuuuu

SEQ ID NO: 37067 - RNA, 18 nt, Homo sapiens
cuauaaaccgaacugaug

SEQ ID NO: 37068 - RNA, 15 nt, Homo sapiens
cuauauuguuugcua

SEQ ID NO: 37069 - RNA, 22 nt, Homo sapiens
cgcuuccgcauccuagucucua

SEQ ID NO: 37070 - RNA, 15 nt, Homo sapiens
cugggagccccaauu

SEQ ID NO: 37071 - RNA, 17 nt, Homo sapiens
cugaauuuaaauagcuu

SEQ ID NO: 37072 - RNA, 18 nt, Homo sapiens
cucuaggaaauauuuauu

SEQ ID NO: 37073 - RNA, 21 nt, Homo sapiens
cucuaggaaauauuuauuuua

SEQ ID NO: 37074 - RNA, 21 nt, Homo sapiens
cuccaugaauaucaguuauuu

SEQ ID NO: 37075 - RNA, 20 nt, Homo sapiens
cuucuguuuuauaauuuugu

SEQ ID NO: 37076 - RNA, 15 nt, Homo sapiens
cuucagcgguuuaua

SEQ ID NO: 37077 - RNA, 14 nt, Homo sapiens
cuuccucccauuca

SEQ ID NO: 37078 - RNA, 15 nt, Homo sapiens
cuuccucccauucag

SEQ ID NO: 37079 - RNA, 17 nt, Homo sapiens
gaaauauuuauuuuaau

SEQ ID NO: 37080 - RNA, 17 nt, Homo sapiens
aauaucaguuauuuuua

SEQ ID NO: 37081 - RNA, 18 nt, Homo sapiens
aauaucaguuauuuuuaa

SEQ ID NO: 37082 - RNA, 19 nt, Homo sapiens
aauaucuccgucaacucau

SEQ ID NO: 37083 - RNA, 14 nt, Homo sapiens
aauauuauguuaaa

SEQ ID NO: 37084 - RNA, 21 nt, Homo sapiens
aauauuuauuuuaauaauguu

SEQ ID NO: 37085 - RNA, 15 nt, Homo sapiens
aauccuugaagauuu

SEQ ID NO: 37086 - RNA, 14 nt, Homo sapiens
gguuuggacaaaau

SEQ ID NO: 37087 - RNA, 17 nt, Homo sapiens
guaaacggucucucacu

SEQ ID NO: 37088 - RNA, 18 nt, Homo sapiens
guaaacggucucucacuu

SEQ ID NO: 37089 - RNA, 16 nt, Homo sapiens
gucaaauugugugaaa

SEQ ID NO: 37090 - RNA, 11 nt, Homo sapiens
guauguuuuca

SEQ ID NO: 37091 - RNA, 13 nt, Homo sapiens
guaugaaaauguc

SEQ ID NO: 37092 - RNA, 16 nt, Homo sapiens
ucuaaauucuuucauu

SEQ ID NO: 37093 - RNA, 13 nt, Homo sapiens
ucucauccacuuu

SEQ ID NO: 37094 - RNA, 17 nt, Homo sapiens
ucuguuuuauaauuuug

SEQ ID NO: 37095 - RNA, 12 nt, Homo sapiens
ugaaaaugucau

SEQ ID NO: 37096 - RNA, 17 nt, Homo sapiens
ugaaaaugucauuguuc

SEQ ID NO: 37097 - RNA, 21 nt, Homo sapiens
ugaacaguuguguuugaagca

SEQ ID NO: 37098 - RNA, 19 nt, Homo sapiens
ugaacuagaguuuagcugg

SEQ ID NO: 37099 - RNA, 22 nt, Homo sapiens
ugaauuuaaauagcuuuuuucu

SEQ ID NO: 37100 - RNA, 15 nt, Homo sapiens
ugaauuaugaaacuu

SEQ ID NO: 37101 - RNA, 15 nt, Homo sapiens
ugaagauacugaaau

SEQ ID NO: 37102 - RNA, 21 nt, Homo sapiens
ugaagauacugaaauaaacgu

SEQ ID NO: 37103 - RNA, 12 nt, Homo sapiens
ugauuaaguaau

SEQ ID NO: 37104 - RNA, 13 nt, Homo sapiens
ugauuaaguaaug

SEQ ID NO: 37105 - RNA, 12 nt, Homo sapiens
ugauucaaaugu

SEQ ID NO: 37106 - RNA, 17 nt, Homo sapiens
ugcauauuuuauuauag

SEQ ID NO: 37107 - RNA, 19 nt, Homo sapiens
ugauaugggucuugauaaa

SEQ ID NO: 37108 - RNA, 20 nt, Homo sapiens
ugagguaaccucauuaucag

SEQ ID NO: 37109 - RNA, 18 nt, Homo sapiens
ugccaugugcuaguaauu

SEQ ID NO: 37110 - RNA, 18 nt, Homo sapiens
ucuaggacugaauuauga

SEQ ID NO: 37111 - RNA, 12 nt, Homo sapiens
ucggacggcucc

SEQ ID NO: 37112 - RNA, 14 nt, Homo sapiens
ucgcuuccgcaucc

SEQ ID NO: 37113 - RNA, 15 nt, Homo sapiens
uccgucaacucauau

SEQ ID NO: 37114 - RNA, 16 nt, Homo sapiens
uccccaugauguuuag

SEQ ID NO: 37115 - RNA, 22 nt, Homo sapiens
uccaaacugacucuuaagaaga

SEQ ID NO: 37116 - RNA, 14 nt, Homo sapiens
uccaagcaaguauu

SEQ ID NO: 37117 - RNA, 19 nt, Homo sapiens
ucaugaauuaguuuuauau

SEQ ID NO: 37118 - RNA, 12 nt, Homo sapiens
ucauauuuucau

SEQ ID NO: 37119 - RNA, 12 nt, Homo sapiens
ucacuuguuuua

SEQ ID NO: 37120 - RNA, 13 nt, Homo sapiens
ucacuuguuuuau

SEQ ID NO: 37121 - RNA, 17 nt, Homo sapiens
uauuuacggaacucaaa

SEQ ID NO: 37122 - RNA, 22 nt, Homo sapiens
uauuuacggaacucaaauacgu

SEQ ID NO: 37123 - RNA, 14 nt, Homo sapiens
uaguuguaauuuuu

SEQ ID NO: 37124 - RNA, 16 nt, Homo sapiens
uauuuauuuuaauaau

SEQ ID NO: 37125 - RNA, 18 nt, Homo sapiens
uauuuuaauaauguuuca

SEQ ID NO: 37126 - RNA, 12 nt, Homo sapiens
uauuuuguuuca

SEQ ID NO: 37127 - RNA, 14 nt, Homo sapiens
uaucucauuuccaa

SEQ ID NO: 37128 - RNA, 15 nt, Homo sapiens
uagucucuaucauua

SEQ ID NO: 37129 - RNA, 16 nt, Homo sapiens
uagucucuaucauuaa

SEQ ID NO: 37130 - RNA, 17 nt, Homo sapiens
uagucucuaucauuaaa

SEQ ID NO: 37131 - RNA, 20 nt, Homo sapiens
uauggcacuaguauuucuau

SEQ ID NO: 37132 - RNA, 15 nt, Homo sapiens
uaugccuuuucccaa

SEQ ID NO: 37133 - RNA, 15 nt, Homo sapiens
uaugugcauauuuua

SEQ ID NO: 37134 - RNA, 12 nt, Homo sapiens
uaauguuucaaa

SEQ ID NO: 37135 - RNA, 14 nt, Homo sapiens
uaauuugguuuuca

SEQ ID NO: 37136 - RNA, 12 nt, Homo sapiens
uaaucuuucaca

SEQ ID NO: 37137 - RNA, 13 nt, Homo sapiens
uaaucuuucacag

SEQ ID NO: 37138 - RNA, 14 nt, Homo sapiens
uaauaauguuucaa

SEQ ID NO: 37139 - RNA, 24 nt, Homo sapiens
uaacaaugcuguauuuuaaaagaa

SEQ ID NO: 37140 - RNA, 17 nt, Homo sapiens
uaaauggaaguaaaugu

SEQ ID NO: 37141 - RNA, 16 nt, Homo sapiens
uaaauucuuucauuuu

SEQ ID NO: 37142 - RNA, 22 nt, Homo sapiens
uacgugggcauucaaauguauu

SEQ ID NO: 37143 - RNA, 11 nt, Homo sapiens
uacucuuauau

SEQ ID NO: 37144 - RNA, 16 nt, Homo sapiens
uacauggcuggagcua

SEQ ID NO: 37145 - RNA, 18 nt, Homo sapiens
uaccucugccucagaaaa

SEQ ID NO: 37146 - RNA, 13 nt, Homo sapiens
uaccaaaaaucuc

SEQ ID NO: 37147 - RNA, 14 nt, Homo sapiens
uaggaaauauuuau

SEQ ID NO: 37148 - RNA, 11 nt, Homo sapiens
gucuagugaaa

SEQ ID NO: 37149 - RNA, 14 nt, Homo sapiens
gugcauauuuuauu

SEQ ID NO: 37150 - RNA, 21 nt, Homo sapiens
guuauuuuuaauuugguuuuc

SEQ ID NO: 37151 - RNA, 18 nt, Homo sapiens
guugccuaauuuguuuuc

SEQ ID NO: 37152 - RNA, 20 nt, Homo sapiens
guuuuaggaauacauaaagu

SEQ ID NO: 37153 - RNA, 22 nt, Homo sapiens
guuuuauaugcuucuguuuuau

SEQ ID NO: 37154 - RNA, 15 nt, Homo sapiens
uaaaauaauuuuuau

SEQ ID NO: 37155 - RNA, 17 nt, Homo sapiens
uaaaauaauuuuuauau

SEQ ID NO: 37156 - RNA, 19 nt, Homo sapiens
cagcuguaugauucccagc

SEQ ID NO: 37157 - RNA, 15 nt, Homo sapiens
cagauaugauucaaa

SEQ ID NO: 37158 - RNA, 21 nt, Homo sapiens
cagaccuuugaacuagaguuu

SEQ ID NO: 37159 - RNA, 19 nt, Homo sapiens
cagucauucagauaugauu

SEQ ID NO: 37160 - RNA, 17 nt, Homo sapiens
caugaauuaguuuuaua

SEQ ID NO: 37161 - RNA, 12 nt, Homo sapiens
cauggaauugga

SEQ ID NO: 37162 - RNA, 13 nt, Homo sapiens
cauggaauuggag

SEQ ID NO: 37163 - RNA, 14 nt, Homo sapiens
ccaagcaaguauua

SEQ ID NO: 37164 - RNA, 15 nt, Homo sapiens
ccacagcuguaugau

SEQ ID NO: 37165 - RNA, 22 nt, Homo sapiens
cauuaaauggaaguaaauguug

SEQ ID NO: 37166 - RNA, 10 nt, Homo sapiens
cauuugguaa

SEQ ID NO: 37167 - RNA, 11 nt, Homo sapiens
cauuuaauuua

SEQ ID NO: 37168 - RNA, 18 nt, Homo sapiens
caugugcuaguaauugga

SEQ ID NO: 37169 - RNA, 19 nt, Homo sapiens
caugugcuaguaauuggaa

SEQ ID NO: 37170 - RNA, 18 nt, Homo sapiens
cauuauauuuauuacugu

SEQ ID NO: 37171 - RNA, 16 nt, Homo sapiens
cccagagcuacaggcc

SEQ ID NO: 37172 - RNA, 12 nt, Homo sapiens
ccuuuucccaac

SEQ ID NO: 37173 - RNA, 13 nt, Homo sapiens
cgaacugauguaa

SEQ ID NO: 37174 - RNA, 20 nt, Homo sapiens
cuccaugaauaucaguuauu

SEQ ID NO: 37175 - RNA, 20 nt, Homo sapiens
cucucacuuguuuuauuuaa

SEQ ID NO: 37176 - RNA, 17 nt, Homo sapiens
cugaaaacccuugccau

SEQ ID NO: 37177 - RNA, 21 nt, Homo sapiens
cugaguguugccuaauuuguu

SEQ ID NO: 37178 - RNA, 18 nt, Homo sapiens
cugauaugggucuugaua

SEQ ID NO: 37179 - RNA, 19 nt, Homo sapiens
cuugaugaagaaguugaua

SEQ ID NO: 37180 - RNA, 13 nt, Homo sapiens
cuucuguuuuaua

SEQ ID NO: 37181 - RNA, 16 nt, Homo sapiens
gaaauauuauguuaaa

SEQ ID NO: 37182 - RNA, 14 nt, Homo sapiens
cuaguuguaauuuu

SEQ ID NO: 37183 - RNA, 15 nt, Homo sapiens
cuaguuguaauuuuu

SEQ ID NO: 37184 - RNA, 14 nt, Homo sapiens
uggaaguaaauguu

SEQ ID NO: 37185 - RNA, 13 nt, Homo sapiens
uggagcuagaauu

SEQ ID NO: 37186 - RNA, 15 nt, Homo sapiens
ugugcauauuuuauu

SEQ ID NO: 37187 - RNA, 14 nt, Homo sapiens
uguguuugaagcac

SEQ ID NO: 37188 - RNA, 14 nt, Homo sapiens
ugugaacccaaagu

SEQ ID NO: 37189 - RNA, 17 nt, Homo sapiens
uguauaaaauaauuuuu

SEQ ID NO: 37190 - RNA, 18 nt, Homo sapiens
uguauaaaauaauuuuua

SEQ ID NO: 37191 - RNA, 20 nt, Homo sapiens
ugucaauaaaauccauacau

SEQ ID NO: 37192 - RNA, 15 nt, Homo sapiens
ugggucgccggcauc

SEQ ID NO: 37193 - RNA, 16 nt, Homo sapiens
ugggucgccggcaucu

SEQ ID NO: 37194 - RNA, 19 nt, Homo sapiens
accaaaaaucucaauauuu

SEQ ID NO: 37195 - RNA, 16 nt, Homo sapiens
acaugggacauuugcu

SEQ ID NO: 37196 - RNA, 16 nt, Homo sapiens
uugcauuuaauuuauu

SEQ ID NO: 37197 - RNA, 15 nt, Homo sapiens
acaggauauucucac

SEQ ID NO: 37198 - RNA, 15 nt, Homo sapiens
uucuaggacugaauu

SEQ ID NO: 37199 - RNA, 14 nt, Homo sapiens
uugaagagguuuua

SEQ ID NO: 37200 - RNA, 18 nt, Homo sapiens
uucaugcuguucaugaaa

SEQ ID NO: 37201 - RNA, 14 nt, Homo sapiens
uuagggguagcauu

SEQ ID NO: 37202 - RNA, 15 nt, Homo sapiens
uuaugauuaaguaau

SEQ ID NO: 37203 - RNA, 13 nt, Homo sapiens
uuauuguagcauc

SEQ ID NO: 37204 - RNA, 13 nt, Homo sapiens
uucacauuggaaa

SEQ ID NO: 37205 - RNA, 14 nt, Homo sapiens
uucacauuggaaac

SEQ ID NO: 37206 - RNA, 15 nt, Homo sapiens
uucacauuggaaaca

SEQ ID NO: 37207 - RNA, 14 nt, Homo sapiens
uuaaccucuaaauu

SEQ ID NO: 37208 - RNA, 20 nt, Homo sapiens
uuaaguuuuuuuuuaaaaaa

SEQ ID NO: 37209 - RNA, 22 nt, Homo sapiens
uguuuuauuuaaccucuaaauu

SEQ ID NO: 37210 - RNA, 18 nt, Homo sapiens
uuaaauggaaguaaaugu

SEQ ID NO: 37211 - RNA, 18 nt, Homo sapiens
uuacuguaagaaaauauc

SEQ ID NO: 37212 - RNA, 20 nt, Homo sapiens
agauacugaaauaaacgucu

SEQ ID NO: 37213 - RNA, 15 nt, Homo sapiens
acuguaagaaaauau

SEQ ID NO: 37214 - RNA, 13 nt, Homo sapiens
acuuuccaauaaa

SEQ ID NO: 37215 - RNA, 15 nt, Homo sapiens
acuuuccaauaaaga

SEQ ID NO: 37216 - RNA, 21 nt, Homo sapiens
acuuuuggaagguauuuaaua

SEQ ID NO: 37217 - RNA, 16 nt, Homo sapiens
agcauuccaacuaucu

SEQ ID NO: 37218 - RNA, 21 nt, Homo sapiens
agauuuaccacuuguguuuug

SEQ ID NO: 37219 - RNA, 13 nt, Homo sapiens
agccuccagcugc

SEQ ID NO: 37220 - RNA, 18 nt, Homo sapiens
uuuaauagguuuggacaa

SEQ ID NO: 37221 - RNA, 19 nt, Homo sapiens
uuuaauagguuuggacaaa

SEQ ID NO: 37222 - RNA, 13 nt, Homo sapiens
uuuagcuggaaaa

SEQ ID NO: 37223 - RNA, 14 nt, Homo sapiens
uuguauaaaauaau

SEQ ID NO: 37224 - RNA, 17 nt, Homo sapiens
uuuaaaaaaaaaacgua

SEQ ID NO: 37225 - RNA, 22 nt, Homo sapiens
accgcagggugaacugcagcga

SEQ ID NO: 37226 - RNA, 18 nt, Homo sapiens
uuugcucauggaauugga

SEQ ID NO: 37227 - RNA, 10 nt, Homo sapiens
uuucugaaau

SEQ ID NO: 37228 - RNA, 22 nt, Homo sapiens
uuugugaagcaaaauuuuuucu

SEQ ID NO: 37229 - RNA, 13 nt, Homo sapiens
accucauggaauu

SEQ ID NO: 37230 - RNA, 11 nt, Homo sapiens
accucuaaauu

SEQ ID NO: 37231 - RNA, 21 nt, Homo sapiens
accugggaaagggcuguuaua

SEQ ID NO: 37232 - RNA, 22 nt, Homo sapiens
acugccuucucaacuccaaacu

SEQ ID NO: 37233 - RNA, 15 nt, Homo sapiens
acugcacaucaaaau

SEQ ID NO: 37234 - RNA, 12 nt, Homo sapiens
acugacucuuaa

SEQ ID NO: 37235 - RNA, 21 nt, Homo sapiens
acuagaguuuagcuggaaaag

SEQ ID NO: 37236 - RNA, 15 nt, Homo sapiens
acucuuauaucuaua

SEQ ID NO: 37237 - RNA, 14 nt, Homo sapiens
acugaaaucauacu

SEQ ID NO: 37238 - RNA, 20 nt, Homo sapiens
acguauugcauuuaauuuau

SEQ ID NO: 37239 - RNA, 14 nt, Homo sapiens
acgucuuaaauauu

SEQ ID NO: 37240 - RNA, 18 nt, Homo sapiens
aguauuucuaugaaauau

SEQ ID NO: 37241 - RNA, 18 nt, Homo sapiens
agucucuaucauuaaagu

SEQ ID NO: 37242 - RNA, 16 nt, Homo sapiens
agucauucagauauga

SEQ ID NO: 37243 - RNA, 17 nt, Homo sapiens
agucauucagauaugau

SEQ ID NO: 37244 - RNA, 20 nt, Homo sapiens
aggucuaccaaaaaucucaa

SEQ ID NO: 37245 - RNA, 21 nt, Homo sapiens
agggagccgguccuugcugca

SEQ ID NO: 37246 - RNA, 17 nt, Homo sapiens
agcuacuuauuguagca

SEQ ID NO: 37247 - RNA, 13 nt, Homo sapiens
agcgguuuauaua

SEQ ID NO: 37248 - RNA, 16 nt, Homo sapiens
agcuggaaaaguaugu

SEQ ID NO: 37249 - RNA, 17 nt, Homo sapiens
agcuggaaaaguauguu

SEQ ID NO: 37250 - RNA, 20 nt, Homo sapiens
agcuuuuuucucugauacag

SEQ ID NO: 37251 - RNA, 14 nt, Homo sapiens
aggaaauauuuauu

SEQ ID NO: 37252 - RNA, 17 nt, Homo sapiens
aggaauacauaaaguau

SEQ ID NO: 37253 - RNA, 15 nt, Homo sapiens
auauuuuuuuuuuua

SEQ ID NO: 37254 - RNA, 16 nt, Homo sapiens
auauuuuuuuuuuuaa

SEQ ID NO: 37255 - RNA, 17 nt, Homo sapiens
auauuuuuuuuuuuaaa

SEQ ID NO: 37256 - RNA, 18 nt, Homo sapiens
auauuuuuuuuuuuaaaa

SEQ ID NO: 37257 - RNA, 20 nt, Homo sapiens
auaugcuucuguuuuauaau

SEQ ID NO: 37258 - RNA, 23 nt, Homo sapiens
auauucucacagcuccaagaauu

SEQ ID NO: 37259 - RNA, 16 nt, Homo sapiens
aucaguaugaaaaugu

SEQ ID NO: 37260 - RNA, 17 nt, Homo sapiens
aucaguaugaaaauguc

SEQ ID NO: 37261 - RNA, 18 nt, Homo sapiens
aucaguuauuuuuaaacu

SEQ ID NO: 37262 - RNA, 23 nt, Homo sapiens
aucauacuucuuaggguuaugau

SEQ ID NO: 37263 - RNA, 21 nt, Homo sapiens
augaauuaaguuuuuuuuuaa

SEQ ID NO: 37264 - RNA, 15 nt, Homo sapiens
augaauuacauuugu

SEQ ID NO: 37265 - RNA, 14 nt, Homo sapiens
aucucaauauuuca

SEQ ID NO: 37266 - RNA, 13 nt, Homo sapiens
aucuauauuuuac

SEQ ID NO: 37267 - RNA, 12 nt, Homo sapiens
aucucaauauuu

SEQ ID NO: 37268 - RNA, 11 nt, Homo sapiens
aucucaauauu

SEQ ID NO: 37269 - RNA, 19 nt, Homo sapiens
auccacuuuccaauaaaga

SEQ ID NO: 37270 - RNA, 16 nt, Homo sapiens
auccuggaauaucucc

SEQ ID NO: 37271 - RNA, 12 nt, Homo sapiens
aguugaucagcu

SEQ ID NO: 37272 - RNA, 17 nt, Homo sapiens
aguuuuauaugcuucug

SEQ ID NO: 37273 - RNA, 21 nt, Homo sapiens
aguuuuauaugcuucuguuuu

SEQ ID NO: 37274 - RNA, 19 nt, Homo sapiens
auaaaauccauacauuugu

SEQ ID NO: 37275 - RNA, 17 nt, Homo sapiens
aguuauuuuuaauuugg

SEQ ID NO: 37276 - RNA, 21 nt, Homo sapiens
agugaucaaguuauuuuuaau

SEQ ID NO: 37277 - RNA, 14 nt, Homo sapiens
auacauaaaguaug

SEQ ID NO: 37278 - RNA, 20 nt, Homo sapiens
auaaauguugacaugggaca

SEQ ID NO: 37279 - RNA, 21 nt, Homo sapiens
auacuucuuaggguuaugauu

SEQ ID NO: 37280 - RNA, 18 nt, Homo sapiens
auacugaaauaaacgucu

SEQ ID NO: 37281 - RNA, 13 nt, Homo sapiens
auaugauucaaau

SEQ ID NO: 37282 - RNA, 15 nt, Homo sapiens
auaugauucaaaugu

SEQ ID NO: 37283 - RNA, 11 nt, Homo sapiens
cacuaguauuu

SEQ ID NO: 37284 - RNA, 14 nt, Homo sapiens
cacuaguauuucua

SEQ ID NO: 37285 - RNA, 21 nt, Homo sapiens
cacaucaaaauaugccccauu

SEQ ID NO: 37286 - RNA, 21 nt, Homo sapiens
cacauuccugaacaggauauu

SEQ ID NO: 37287 - RNA, 17 nt, Homo sapiens
cacaagacugcacauca

SEQ ID NO: 37288 - RNA, 15 nt, Homo sapiens
caaugcuguauuuua

SEQ ID NO: 37289 - RNA, 17 nt, Homo sapiens
caagcauuuagauguau

SEQ ID NO: 37290 - RNA, 21 nt, Homo sapiens
caauagucaaauugugugaaa

SEQ ID NO: 37291 - RNA, 20 nt, Homo sapiens
caaauacgugggcauucaaa

SEQ ID NO: 37292 - RNA, 23 nt, Homo sapiens
caaauccuugaagauuuaccacu

SEQ ID NO: 37293 - RNA, 22 nt, Homo sapiens
caaaccagagccugaguguugc

SEQ ID NO: 37294 - RNA, 21 nt, Homo sapiens
auuuuuaaacuguaaagcuuu

SEQ ID NO: 37295 - RNA, 16 nt, Homo sapiens
auuuuuuucugaaauu

SEQ ID NO: 37296 - RNA, 15 nt, Homo sapiens
auuaugaauuacauu

SEQ ID NO: 37297 - RNA, 13 nt, Homo sapiens
auuaaguaaugau

SEQ ID NO: 37298 - RNA, 20 nt, Homo sapiens
auuaaauggaaguaaauguu

SEQ ID NO: 37299 - RNA, 15 nt, Homo sapiens
auucuuccucccauu

SEQ ID NO: 37300 - RNA, 17 nt, Homo sapiens
auuccaacuaucucauu

SEQ ID NO: 37301 - RNA, 16 nt, Homo sapiens
auucaacaucuaguga

SEQ ID NO: 37302 - RNA, 20 nt, Homo sapiens
auucaaugccccugaauuua

SEQ ID NO: 37303 - RNA, 17 nt, Homo sapiens
auugaggcuuuaaaacu

SEQ ID NO: 37304 - RNA, 17 nt, Homo sapiens
auugcauuuaauuuauu

SEQ ID NO: 37305 - RNA, 18 nt, Homo sapiens
auugcauuuaauuuauug

SEQ ID NO: 37306 - RNA, 23 nt, Homo sapiens
auuguuugcuaagcauuccaacu

SEQ ID NO: 37307 - RNA, 22 nt, Homo sapiens
auuuaaccucuaaauucuuuca

SEQ ID NO: 37308 - RNA, 13 nt, Homo sapiens
auuucuaugaaau

SEQ ID NO: 37309 - RNA, 11 nt, Homo sapiens
auuuauuuuaa

SEQ ID NO: 37310 - RNA, 14 nt, Homo sapiens
auuuuacauaaauu

SEQ ID NO: 37311 - RNA, 22 nt, Homo sapiens
auuuuagggguagcauuugugu

SEQ ID NO: 37312 - RNA, 21 nt, Homo sapiens
auuugaaauauugacuuuuua

SEQ ID NO: 37313 - RNA, 19 nt, Homo sapiens
auuuacggaacucaaauac

SEQ ID NO: 37314 - RNA, 22 nt, Homo sapiens
auguauuacaguggggaaugaa

SEQ ID NO: 37315 - RNA, 17 nt, Homo sapiens
auggcacuaguauuucu

SEQ ID NO: 37316 - RNA, 18 nt, Homo sapiens
auggcacuaguauuucua

SEQ ID NO: 37317 - RNA, 23 nt, Homo sapiens
auguuucaaacauauauaacaau

SEQ ID NO: 37318 - RNA, 19 nt, Homo sapiens
auguuuucaggcuagaugu

SEQ ID NO: 37319 - RNA, 14 nt, Homo sapiens
auuaaaguucuagu

SEQ ID NO: 37320 - RNA, 14 nt, Homo sapiens
augcuguauuuuaa

SEQ ID NO: 37321 - RNA, 17 nt, Homo sapiens
augcuucuguuuuauaa

SEQ ID NO: 37322 - RNA, 13 nt, Homo sapiens
auggaauuggagc

SEQ ID NO: 37323 - RNA, 20 nt, Homo sapiens
augauguuuagaaacacaac

SEQ ID NO: 37324 - RNA, 14 nt, Homo sapiens
ccuugaugaagaag

SEQ ID NO: 37325 - RNA, 11 nt, Homo sapiens
cgacggagccg

SEQ ID NO: 37326 - RNA, 15 nt, Homo sapiens
cgcauccuagucucu

SEQ ID NO: 37327 - RNA, 15 nt, Homo sapiens
ccgguccuugcugca

SEQ ID NO: 37328 - RNA, 16 nt, Homo sapiens
ccgguccuugcugcac

SEQ ID NO: 37329 - RNA, 16 nt, Homo sapiens
cccugaauuuaaauag

SEQ ID NO: 37330 - RNA, 13 nt, Homo sapiens
ccaagcaaguauu

SEQ ID NO: 37331 - RNA, 21 nt, Homo sapiens
ccaaagugugacucauuaaau

SEQ ID NO: 37332 - RNA, 11 nt, Homo sapiens
cauuugguaag

SEQ ID NO: 37333 - RNA, 18 nt, Homo sapiens
cauuuccaagcaaguauu

SEQ ID NO: 37334 - RNA, 16 nt, Homo sapiens
ccauucaggaugccca

SEQ ID NO: 37335 - RNA, 17 nt, Homo sapiens
ccauucaggaugcccac

SEQ ID NO: 37336 - RNA, 17 nt, Homo sapiens
cagucugacuguuucca

SEQ ID NO: 37337 - RNA, 19 nt, Homo sapiens
cagucugacuguuuccauc

SEQ ID NO: 37338 - RNA, 21 nt, Homo sapiens
caguaugaaaaugucauuguu

SEQ ID NO: 37339 - RNA, 23 nt, Homo sapiens
cagugaucaaguuauuuuuaauu

SEQ ID NO: 37340 - RNA, 14 nt, Homo sapiens
caggcuagauguau

SEQ ID NO: 37341 - RNA, 22 nt, Homo sapiens
cauccuagucucuaucauuaaa

SEQ ID NO: 37342 - RNA, 13 nt, Homo sapiens
cauacauuugugu

SEQ ID NO: 37343 - RNA, 16 nt, Homo sapiens
caugcugucuacacua

SEQ ID NO: 37344 - RNA, 18 nt, Homo sapiens
caugaaguccaagcauuu

SEQ ID NO: 37345 - RNA, 20 nt, Homo sapiens
caugugcuaguaauuggaaa

SEQ ID NO: 37346 - RNA, 22 nt, Homo sapiens
auuaaguuuuuuuuuaaaaaag

SEQ ID NO: 37347 - RNA, 12 nt, Homo sapiens
auuaguuuuaua

SEQ ID NO: 37348 - RNA, 14 nt, Homo sapiens
auucuuccucccau

SEQ ID NO: 37349 - RNA, 18 nt, Homo sapiens
auuacauuuguauaaaau

SEQ ID NO: 37350 - RNA, 15 nt, Homo sapiens
auuauauuuauuacu

SEQ ID NO: 37351 - RNA, 22 nt, Homo sapiens
auucagauaugauucaaauguc

SEQ ID NO: 37352 - RNA, 19 nt, Homo sapiens
auuaugaauuacauuugua

SEQ ID NO: 37353 - RNA, 16 nt, Homo sapiens
auuuccaagcaaguau

SEQ ID NO: 37354 - RNA, 15 nt, Homo sapiens
auuugguuuucacau

SEQ ID NO: 37355 - RNA, 13 nt, Homo sapiens
auuuguauaaaau

SEQ ID NO: 37356 - RNA, 18 nt, Homo sapiens
auuuacggaacucaaaua

SEQ ID NO: 37357 - RNA, 18 nt, Homo sapiens
auuuaguauuuuguuuca

SEQ ID NO: 37358 - RNA, 15 nt, Homo sapiens
auuuauugaggcuuu

SEQ ID NO: 37359 - RNA, 13 nt, Homo sapiens
auugcauuuaauu

SEQ ID NO: 37360 - RNA, 14 nt, Homo sapiens
auugucuagugaaa

SEQ ID NO: 37361 - RNA, 16 nt, Homo sapiens
auuuucaugcuguuca

SEQ ID NO: 37362 - RNA, 13 nt, Homo sapiens
auuuuacauaaau

SEQ ID NO: 37363 - RNA, 23 nt, Homo sapiens
cacauuccugaacaggauauucu

SEQ ID NO: 37364 - RNA, 20 nt, Homo sapiens
caaugccccugaauuuaaau

SEQ ID NO: 37365 - RNA, 21 nt, Homo sapiens
caaugccccugaauuuaaaua

SEQ ID NO: 37366 - RNA, 17 nt, Homo sapiens
cacagaccuuugaacua

SEQ ID NO: 37367 - RNA, 15 nt, Homo sapiens
cacuaguauuucuau

SEQ ID NO: 37368 - RNA, 22 nt, Homo sapiens
cacuguggguagacacacauga

SEQ ID NO: 37369 - RNA, 23 nt, Homo sapiens
cacuguggguagacacacaugaa

SEQ ID NO: 37370 - RNA, 22 nt, Homo sapiens
cagcacagccucuuagaugcag

SEQ ID NO: 37371 - RNA, 23 nt, Homo sapiens
cagcacagccucuuagaugcagu

SEQ ID NO: 37372 - RNA, 19 nt, Homo sapiens
agugaucaaguuauuuuua

SEQ ID NO: 37373 - RNA, 13 nt, Homo sapiens
aguauuucuauga

SEQ ID NO: 37374 - RNA, 14 nt, Homo sapiens
auaaaauaauuuuu

SEQ ID NO: 37375 - RNA, 13 nt, Homo sapiens
aguuuuauaugcu

SEQ ID NO: 37376 - RNA, 22 nt, Homo sapiens
auaauuuugugaagcaaaauuu

SEQ ID NO: 37377 - RNA, 23 nt, Homo sapiens
auaauuuugugaagcaaaauuuu

SEQ ID NO: 37378 - RNA, 14 nt, Homo sapiens
auaauuuuuauauu

SEQ ID NO: 37379 - RNA, 23 nt, Homo sapiens
auaacuggaaacuucagcgguuu

SEQ ID NO: 37380 - RNA, 19 nt, Homo sapiens
auaaacgucuuaaauauuc

SEQ ID NO: 37381 - RNA, 19 nt, Homo sapiens
auauaguuacccaaauuaa

SEQ ID NO: 37382 - RNA, 17 nt, Homo sapiens
auaucaguuauuuuuaa

SEQ ID NO: 37383 - RNA, 18 nt, Homo sapiens
auaucaguuauuuuuaaa

SEQ ID NO: 37384 - RNA, 17 nt, Homo sapiens
auaucuauauuuuacau

SEQ ID NO: 37385 - RNA, 20 nt, Homo sapiens
auaucuccgucaacucauau

SEQ ID NO: 37386 - RNA, 21 nt, Homo sapiens
auaucuccgucaacucauauu

SEQ ID NO: 37387 - RNA, 18 nt, Homo sapiens
auacgugggcauucaaau

SEQ ID NO: 37388 - RNA, 20 nt, Homo sapiens
auacgugggcauucaaaugu

SEQ ID NO: 37389 - RNA, 22 nt, Homo sapiens
auggcuuccuggcaauagucaa

SEQ ID NO: 37390 - RNA, 14 nt, Homo sapiens
auguauguacuuca

SEQ ID NO: 37391 - RNA, 18 nt, Homo sapiens
auguauguacuucaugcu

SEQ ID NO: 37392 - RNA, 20 nt, Homo sapiens
augugcauauuuuauuauag

SEQ ID NO: 37393 - RNA, 16 nt, Homo sapiens
augcuucuguuuuaua

SEQ ID NO: 37394 - RNA, 18 nt, Homo sapiens
auggcuggagcuagaauu

SEQ ID NO: 37395 - RNA, 20 nt, Homo sapiens
augaauuaaguuuuuuuuua

SEQ ID NO: 37396 - RNA, 22 nt, Homo sapiens
augaauuaaguuuuuuuuuaaa

SEQ ID NO: 37397 - RNA, 12 nt, Homo sapiens
augaauuacauu

SEQ ID NO: 37398 - RNA, 14 nt, Homo sapiens
augaagauacugaa

SEQ ID NO: 37399 - RNA, 14 nt, Homo sapiens
augaaaaugucauu

SEQ ID NO: 37400 - RNA, 14 nt, Homo sapiens
augaaauauuaugu

SEQ ID NO: 37401 - RNA, 18 nt, Homo sapiens
augccccauucaacaucu

SEQ ID NO: 37402 - RNA, 13 nt, Homo sapiens
augcuguauuuua

SEQ ID NO: 37403 - RNA, 17 nt, Homo sapiens
augaucaguaugaaaau

SEQ ID NO: 37404 - RNA, 15 nt, Homo sapiens
auccuggaauaucuc

SEQ ID NO: 37405 - RNA, 21 nt, Homo sapiens
auccuagucucuaucauuaaa

SEQ ID NO: 37406 - RNA, 14 nt, Homo sapiens
aucuccgucaacuc

SEQ ID NO: 37407 - RNA, 17 nt, Homo sapiens
aucaugaauuaguuuua

SEQ ID NO: 37408 - RNA, 13 nt, Homo sapiens
aucauuaaaguuc

SEQ ID NO: 37409 - RNA, 13 nt, Homo sapiens
auauuuauuuuaa

SEQ ID NO: 37410 - RNA, 16 nt, Homo sapiens
auauuauguuaaaacu

SEQ ID NO: 37411 - RNA, 21 nt, Homo sapiens
auaugcuucuguuuuauaauu

SEQ ID NO: 37412 - RNA, 10 nt, Homo sapiens
auauuuuuuu

SEQ ID NO: 37413 - RNA, 13 nt, Homo sapiens
auauuugaaauau

SEQ ID NO: 37414 - RNA, 15 nt, Homo sapiens
auauuuuacauaaau

SEQ ID NO: 37415 - RNA, 14 nt, Homo sapiens
aaggguaauuauau

SEQ ID NO: 37416 - RNA, 19 nt, Homo sapiens
aaggcagcucuaaauguca

SEQ ID NO: 37417 - RNA, 14 nt, Homo sapiens
aagcaaguauuaga

SEQ ID NO: 37418 - RNA, 17 nt, Homo sapiens
aagagguuuuaaagcuu

SEQ ID NO: 37419 - RNA, 16 nt, Homo sapiens
aagaguuccuucugcu

SEQ ID NO: 37420 - RNA, 17 nt, Homo sapiens
aagagccggagccucca

SEQ ID NO: 37421 - RNA, 18 nt, Homo sapiens
aagagccggagccuccag

SEQ ID NO: 37422 - RNA, 14 nt, Homo sapiens
aagaaguugauaug

SEQ ID NO: 37423 - RNA, 13 nt, Homo sapiens
aagacaaaaagcu

SEQ ID NO: 37424 - RNA, 14 nt, Homo sapiens
aagacaaaaagcua

SEQ ID NO: 37425 - RNA, 16 nt, Homo sapiens
aagacugcacaucaaa

SEQ ID NO: 37426 - RNA, 15 nt, Homo sapiens
aacucauauuuucau

SEQ ID NO: 37427 - RNA, 24 nt, Homo sapiens
aacguauugcauuuaauuuauuga

SEQ ID NO: 37428 - RNA, 14 nt, Homo sapiens
aacucaaauacgug

SEQ ID NO: 37429 - RNA, 14 nt, Homo sapiens
aagaaugauuauga

SEQ ID NO: 37430 - RNA, 12 nt, Homo sapiens
aagacaaaaagc

SEQ ID NO: 37431 - RNA, 13 nt, Homo sapiens
aagaagacugcau

SEQ ID NO: 37432 - RNA, 17 nt, Homo sapiens
aagauacugaaauaaac

SEQ ID NO: 37433 - RNA, 14 nt, Homo sapiens
aagauuuaccacuu

SEQ ID NO: 37434 - RNA, 20 nt, Homo sapiens
aaguaaacggucucucacuu

SEQ ID NO: 37435 - RNA, 20 nt, Homo sapiens
aaggcagcucuaaaugucaa

SEQ ID NO: 37436 - RNA, 19 nt, Homo sapiens
aagccuuggggcugaugca

SEQ ID NO: 37437 - RNA, 13 nt, Homo sapiens
aagcauuuagaug

SEQ ID NO: 37438 - RNA, 12 nt, Homo sapiens
aaguucuaguga

SEQ ID NO: 37439 - RNA, 15 nt, Homo sapiens
aaguccaagcauuua

SEQ ID NO: 37440 - RNA, 20 nt, Homo sapiens
aaguccaagcauuuagaugu

SEQ ID NO: 37441 - RNA, 14 nt, Homo sapiens
aaguaaugauaacu

SEQ ID NO: 37442 - RNA, 14 nt, Homo sapiens
aagguacuucaaau

SEQ ID NO: 37443 - RNA, 11 nt, Homo sapiens
acagaaaaguu

SEQ ID NO: 37444 - RNA, 16 nt, Homo sapiens
acagccucuuagaugc

SEQ ID NO: 37445 - RNA, 17 nt, Homo sapiens
acagccucuuagaugca

SEQ ID NO: 37446 - RNA, 20 nt, Homo sapiens
acaugaaguccaagcauuua

SEQ ID NO: 37447 - RNA, 22 nt, Homo sapiens
acauauauaacaaugcuguauu

SEQ ID NO: 37448 - RNA, 18 nt, Homo sapiens
acauuugcucauggaauu

SEQ ID NO: 37449 - RNA, 15 nt, Homo sapiens
aauaauuuuuauauu

SEQ ID NO: 37450 - RNA, 22 nt, Homo sapiens
aauaauuuuuauauuugaaaua

SEQ ID NO: 37451 - RNA, 16 nt, Homo sapiens
aaguuauuuuuaauuu

SEQ ID NO: 37452 - RNA, 17 nt, Homo sapiens
aauauuauguuaaaacu

SEQ ID NO: 37453 - RNA, 12 nt, Homo sapiens
aaucaugaauua

SEQ ID NO: 37454 - RNA, 19 nt, Homo sapiens
aauacucuuauaucuauau

SEQ ID NO: 37455 - RNA, 20 nt, Homo sapiens
aauacucuuauaucuauauu

SEQ ID NO: 37456 - RNA, 18 nt, Homo sapiens
aauagguuuggacaaaau

SEQ ID NO: 37457 - RNA, 19 nt, Homo sapiens
aagucacauuccugaacag

SEQ ID NO: 37458 - RNA, 16 nt, Homo sapiens
aaguccaagcauuuag

SEQ ID NO: 37459 - RNA, 14 nt, Homo sapiens
aauuggagcucgug

SEQ ID NO: 37460 - RNA, 15 nt, Homo sapiens
aauuuaguauuuugu

SEQ ID NO: 37461 - RNA, 19 nt, Homo sapiens
aauuuccugggagcuuuug

SEQ ID NO: 37462 - RNA, 18 nt, Homo sapiens
aauuugauaugugaacag

SEQ ID NO: 37463 - RNA, 23 nt, Homo sapiens
aauuugguuuucacauuggaaac

SEQ ID NO: 37464 - RNA, 17 nt, Homo sapiens
aauuuuuauauuugaaa

SEQ ID NO: 37465 - RNA, 13 nt, Homo sapiens
aauguuucaaaca

SEQ ID NO: 37466 - RNA, 14 nt, Homo sapiens
aauguuucaaacau

SEQ ID NO: 37467 - RNA, 16 nt, Homo sapiens
aauuacauuuguauaa

SEQ ID NO: 37468 - RNA, 19 nt, Homo sapiens
aaugccccugaauuuaaau

SEQ ID NO: 37469 - RNA, 12 nt, Homo sapiens
aauggaauacuc

SEQ ID NO: 37470 - RNA, 22 nt, Homo sapiens
aaugagagacacacugaagaag

SEQ ID NO: 37471 - RNA, 22 nt, Homo sapiens
aaugauaacuggaaacuucagc

SEQ ID NO: 37472 - RNA, 17 nt, Homo sapiens
aaugaagauacugaaau

SEQ ID NO: 37473 - RNA, 18 nt, Homo sapiens
acugauaugggucuugau

SEQ ID NO: 37474 - RNA, 17 nt, Homo sapiens
acugcauuauauuuauu

SEQ ID NO: 37475 - RNA, 18 nt, Homo sapiens
acugcauuauauuuauua

SEQ ID NO: 37476 - RNA, 17 nt, Homo sapiens
acugccuucucaacucc

SEQ ID NO: 37477 - RNA, 15 nt, Homo sapiens
acuaucucauuucca

SEQ ID NO: 37478 - RNA, 20 nt, Homo sapiens
acucuuauaucuauauuuua

SEQ ID NO: 37479 - RNA, 15 nt, Homo sapiens
acugaaauaaacguc

SEQ ID NO: 37480 - RNA, 19 nt, Homo sapiens
acucugaaggguaauuaua

SEQ ID NO: 37481 - RNA, 21 nt, Homo sapiens
acucuuaagaagacugcauua

SEQ ID NO: 37482 - RNA, 15 nt, Homo sapiens
acuugucaauaaaau

SEQ ID NO: 37483 - RNA, 14 nt, Homo sapiens
acuuuccaauaaag

SEQ ID NO: 37484 - RNA, 17 nt, Homo sapiens
agaagaugguaccacca

SEQ ID NO: 37485 - RNA, 19 nt, Homo sapiens
acuuuuggaagguauuuaa

SEQ ID NO: 37486 - RNA, 13 nt, Homo sapiens
acuucaaauccuu

SEQ ID NO: 37487 - RNA, 20 nt, Homo sapiens
agaaaaguugaauuuuacau

SEQ ID NO: 37488 - RNA, 13 nt, Homo sapiens
acgucuuaaauau

SEQ ID NO: 37489 - RNA, 20 nt, Homo sapiens
accugggaaagggcuguuau

SEQ ID NO: 37490 - RNA, 17 nt, Homo sapiens
agcuuauugucuaguga

SEQ ID NO: 37491 - RNA, 18 nt, Homo sapiens
agcuuauugucuagugaa

SEQ ID NO: 37492 - RNA, 12 nt, Homo sapiens
agcuuuuguaga

SEQ ID NO: 37493 - RNA, 13 nt, Homo sapiens
agcuuuuguagaa

SEQ ID NO: 37494 - RNA, 13 nt, Homo sapiens
agcuagaauuuga

SEQ ID NO: 37495 - RNA, 19 nt, Homo sapiens
agaugcaguucugaagaag

SEQ ID NO: 37496 - RNA, 21 nt, Homo sapiens
agcaaguauuagaauaccaca

SEQ ID NO: 37497 - RNA, 20 nt, Homo sapiens
agagcuacaggccccaucug

SEQ ID NO: 37498 - RNA, 21 nt, Homo sapiens
agagcuacaggccccaucugg

SEQ ID NO: 37499 - RNA, 15 nt, Homo sapiens
agauacugaaauaaa

SEQ ID NO: 37500 - RNA, 21 nt, Homo sapiens
agauacugaaauaaacgucuu

SEQ ID NO: 37501 - RNA, 19 nt, Homo sapiens
agauaugauucaaaugucu

SEQ ID NO: 37502 - RNA, 13 nt, Homo sapiens
agagccggagccu

SEQ ID NO: 37503 - RNA, 15 nt, Homo sapiens
agacugcauuauauu

SEQ ID NO: 37504 - RNA, 15 nt, Homo sapiens
aaaaguugaauuuua

SEQ ID NO: 37505 - RNA, 20 nt, Homo sapiens
aaaauaauuuuuauauuuga

SEQ ID NO: 37506 - RNA, 19 nt, Homo sapiens
aaaaucucaauauuucaga

SEQ ID NO: 37507 - RNA, 15 nt, Homo sapiens
aaagaagagccggag

SEQ ID NO: 37508 - RNA, 14 nt, Homo sapiens
aaacuuuuggaagg

SEQ ID NO: 37509 - RNA, 13 nt, Homo sapiens
aaagaaacauuug

SEQ ID NO: 37510 - RNA, 17 nt, Homo sapiens
aaacgucuuaaauauuc

SEQ ID NO: 37511 - RNA, 14 nt, Homo sapiens
aaacauuugguaag

SEQ ID NO: 37512 - RNA, 14 nt, Homo sapiens
aaacguauugcauu

SEQ ID NO: 37513 - RNA, 22 nt, Homo sapiens
aaauuuuuucucuaggaaauau

SEQ ID NO: 37514 - RNA, 15 nt, Homo sapiens
aaauccauacauuug

SEQ ID NO: 37515 - RNA, 18 nt, Homo sapiens
aaauggaauacucuuaua

SEQ ID NO: 37516 - RNA, 20 nt, Homo sapiens
aaaguauguuagugcaaauu

SEQ ID NO: 37517 - RNA, 18 nt, Homo sapiens
aaagggcuguuauaaucu

SEQ ID NO: 37518 - RNA, 21 nt, Homo sapiens
aaauaauuuuuauauuugaaa

SEQ ID NO: 37519 - RNA, 23 nt, Homo sapiens
aaauauugacuuuuuauggcacu

SEQ ID NO: 37520 - RNA, 24 nt, Homo sapiens
aaauauugacuuuuuauggcacua

SEQ ID NO: 37521 - RNA, 15 nt, Homo sapiens
aacaaggaugaauua

SEQ ID NO: 37522 - RNA, 16 nt, Homo sapiens
aaagggcuguuauaau

SEQ ID NO: 37523 - RNA, 20 nt, Homo sapiens
aaaguaugugcauauuuuau

SEQ ID NO: 37524 - RNA, 20 nt, Homo sapiens
aaagcuuugugcagauucuu

SEQ ID NO: 37525 - RNA, 13 nt, Homo sapiens
aaacuuuuggaag

SEQ ID NO: 37526 - RNA, 16 nt, Homo sapiens
aaaaguugaauuuuac

SEQ ID NO: 37527 - RNA, 16 nt, Homo sapiens
aaaauaauuuuuauau

SEQ ID NO: 37528 - RNA, 14 nt, Homo sapiens
aaaacguauugcau

SEQ ID NO: 37529 - RNA, 19 nt, Homo sapiens
aaaacguauugcauuuaau

SEQ ID NO: 37530 - RNA, 20 nt, Homo sapiens
aaaacguauugcauuuaauu

SEQ ID NO: 37531 - RNA, 22 nt, Homo sapiens
aaaacuuauccuccaugaauau

SEQ ID NO: 37532 - RNA, 15 nt, Homo sapiens
aaaagaaacauuugg

SEQ ID NO: 37533 - RNA, 17 nt, Homo sapiens
aacaaugcuguauuuua

SEQ ID NO: 37534 - RNA, 17 nt, Homo sapiens
aaaauccauacauuugu

SEQ ID NO: 37535 - RNA, 14 nt, Homo sapiens
aaaauggaauacuc

SEQ ID NO: 37536 - RNA, 23 nt, Homo sapiens
aaaacguauugcauuuaauuuau

SEQ ID NO: 37537 - RNA, 20 nt, Homo sapiens
aauacauaaaguaugugcau

SEQ ID NO: 37538 - RNA, 21 nt, Homo sapiens
ccucucucauccacuuuccaa

SEQ ID NO: 37539 - RNA, 16 nt, Homo sapiens
gcauccuagucucuau

SEQ ID NO: 37540 - RNA, 14 nt, Homo sapiens
cucucucauccacu

SEQ ID NO: 37541 - RNA, 13 nt, Homo sapiens
aucaguccaaagg

SEQ ID NO: 37542 - RNA, 12 nt, Homo sapiens
gauaugauucaa

SEQ ID NO: 37543 - RNA, 15 nt, Homo sapiens
uaaaguaugugcaua

SEQ ID NO: 37544 - RNA, 13 nt, Homo sapiens
agcuagaauuuga

SEQ ID NO: 37545 - RNA, 17 nt, Homo sapiens
gguccgggucgcaggac

SEQ ID NO: 37546 - RNA, 23 nt, Homo sapiens
uaauuuuuuugugggaaauccac

SEQ ID NO: 37547 - RNA, 17 nt, Homo sapiens
ucaguccaaagggcaug

SEQ ID NO: 37548 - RNA, 15 nt, Homo sapiens
auccuggaauaucuc

SEQ ID NO: 37549 - RNA, 13 nt, Homo sapiens
cugcaacucugaa

SEQ ID NO: 37550 - RNA, 17 nt, Homo sapiens
cggagccuccagcugcc

SEQ ID NO: 37551 - RNA, 15 nt, Homo sapiens
aguuccuucugcucc

SEQ ID NO: 37552 - RNA, 15 nt, Homo sapiens
uccccagagcuacag

SEQ ID NO: 37553 - RNA, 12 nt, Homo sapiens
gcauccuagucu

SEQ ID NO: 37554 - RNA, 19 nt, Homo sapiens
agccgggaaagaagagccg

SEQ ID NO: 37555 - RNA, 17 nt, Homo sapiens
aaacguauugcauuuaa

SEQ ID NO: 37556 - RNA, 21 nt, Homo sapiens
gagcuuuuguagaagucacau

SEQ ID NO: 37557 - RNA, 17 nt, Homo sapiens
guccccagagcuacagg

SEQ ID NO: 37558 - RNA, 13 nt, Homo sapiens
cccacacugucca

SEQ ID NO: 37559 - RNA, 19 nt, Homo sapiens
cauauuuuauuauagucac

SEQ ID NO: 37560 - RNA, 16 nt, Homo sapiens
ccuuccccuucccaca

SEQ ID NO: 37561 - RNA, 14 nt, Homo sapiens
uaaaguaugugcau

SEQ ID NO: 37562 - RNA, 21 nt, Homo sapiens
ggcaauguucccccucuccuc

SEQ ID NO: 37563 - RNA, 17 nt, Homo sapiens
ugcagcgaguacuuccc

SEQ ID NO: 37564 - RNA, 15 nt, Homo sapiens
uccgcauccuagucu

SEQ ID NO: 37565 - RNA, 15 nt, Homo sapiens
caggcggguccgggu

SEQ ID NO: 37566 - RNA, 12 nt, Homo sapiens
ucucuaucauua

SEQ ID NO: 37567 - RNA, 20 nt, Homo sapiens
ugcauucugagguaaccuca

SEQ ID NO: 37568 - RNA, 17 nt, Homo sapiens
uuuaauuugguuuucac

SEQ ID NO: 37569 - RNA, 19 nt, Homo sapiens
cuuuaaaacuuauccucca

SEQ ID NO: 37570 - RNA, 20 nt, Homo sapiens
aaacuuauccuccaugaaua

SEQ ID NO: 37571 - RNA, 17 nt, Homo sapiens
uucagauaugauucaaa

SEQ ID NO: 37572 - RNA, 17 nt, Homo sapiens
cauaaaguaugugcaua

SEQ ID NO: 37573 - RNA, 17 nt, Homo sapiens
caguaugaaaaugucau

SEQ ID NO: 37574 - RNA, 16 nt, Homo sapiens
ucuaucauuaaaguuc

SEQ ID NO: 37575 - RNA, 13 nt, Homo sapiens
augaaaaugucau

SEQ ID NO: 37576 - RNA, 13 nt, Homo sapiens
gccgacggagccg

SEQ ID NO: 37577 - RNA, 14 nt, Homo sapiens
gaagcacagugauc

SEQ ID NO: 37578 - RNA, 23 nt, Homo sapiens
uaaaaaaaaaacguauugcauuu

SEQ ID NO: 37579 - RNA, 23 nt, Homo sapiens
cuaaauucuuucauuuuaggggu

SEQ ID NO: 37580 - RNA, 15 nt, Homo sapiens
cagcgaguacuuccc

SEQ ID NO: 37581 - RNA, 17 nt, Homo sapiens
uuguuucagugcacuaa

SEQ ID NO: 37582 - RNA, 18 nt, Homo sapiens
gaagagccggagccucca

SEQ ID NO: 37583 - RNA, 23 nt, Homo sapiens
agauucaaugccccugaauuuaa

SEQ ID NO: 37584 - RNA, 12 nt, Homo sapiens
ugagguaaccuc

SEQ ID NO: 37585 - RNA, 11 nt, Homo sapiens
aacccaaagug

SEQ ID NO: 37586 - RNA, 15 nt, Homo sapiens
acgugggcauucaaa

SEQ ID NO: 37587 - RNA, 18 nt, Homo sapiens
cuaucauuaaaguucuag

SEQ ID NO: 37588 - RNA, 18 nt, Homo sapiens
uuucaugcuguucaugaa

SEQ ID NO: 37589 - RNA, 22 nt, Homo sapiens
uuuguagaagucacauuccuga

SEQ ID NO: 37590 - RNA, 23 nt, Homo sapiens
uucgcgcgccuccgcuacuucca

SEQ ID NO: 37591 - RNA, 19 nt, Homo sapiens
uagaagucacauuccugaa

SEQ ID NO: 37592 - RNA, 17 nt, Homo sapiens
cauccuggaauaucucc

SEQ ID NO: 37593 - RNA, 17 nt, Homo sapiens
ccucuaaauucuuucau

SEQ ID NO: 37594 - RNA, 14 nt, Homo sapiens
aaaaacguauugca

SEQ ID NO: 37595 - RNA, 20 nt, Homo sapiens
cggggaggggcgcucgcuuc

SEQ ID NO: 37596 - RNA, 18 nt, Homo sapiens
cuauuuacggaacucaaa

SEQ ID NO: 37597 - RNA, 14 nt, Homo sapiens
cugauguaaguaaa

SEQ ID NO: 37598 - RNA, 17 nt, Homo sapiens
uuugaaaccaaaccaga

SEQ ID NO: 37599 - RNA, 16 nt, Homo sapiens
aaagcuuugugcagau

SEQ ID NO: 37600 - RNA, 17 nt, Homo sapiens
ucauuaucaguccaaag

SEQ ID NO: 37601 - RNA, 16 nt, Homo sapiens
caugaauaucaguuau

SEQ ID NO: 37602 - RNA, 20 nt, Homo sapiens
caguuauuuuuaaacuguaa

SEQ ID NO: 37603 - RNA, 17 nt, Homo sapiens
uccagcugccccgggga

SEQ ID NO: 37604 - RNA, 13 nt, Homo sapiens
aacggucucucac

SEQ ID NO: 37605 - RNA, 16 nt, Homo sapiens
cauaaaguaugugcau

SEQ ID NO: 37606 - RNA, 23 nt, Homo sapiens
gagagucuauuuacggaacucaa

SEQ ID NO: 37607 - RNA, 14 nt, Homo sapiens
aaaauggaauacuc

SEQ ID NO: 37608 - RNA, 16 nt, Homo sapiens
aauguguaagacaaaa

SEQ ID NO: 37609 - RNA, 22 nt, Homo sapiens
acuuauuguagcauccuggaau

SEQ ID NO: 37610 - RNA, 16 nt, Homo sapiens
cuucuuacaaugcauu

SEQ ID NO: 37611 - RNA, 18 nt, Homo sapiens
gcuuccgcauccuagucu

SEQ ID NO: 37612 - RNA, 23 nt, Homo sapiens
cucaaauacgugggcauucaaau

SEQ ID NO: 37613 - RNA, 17 nt, Homo sapiens
ugaacaggauauucuca

SEQ ID NO: 37614 - RNA, 23 nt, Homo sapiens
agagucuauuuacggaacucaaa

SEQ ID NO: 37615 - RNA, 20 nt, Homo sapiens
ggccugcucgcccacuuccu

SEQ ID NO: 37616 - RNA, 18 nt, Homo sapiens
aguaugaaaaugucauug

SEQ ID NO: 37617 - RNA, 16 nt, Homo sapiens
auucgauccccuguca

SEQ ID NO: 37618 - RNA, 19 nt, Homo sapiens
auauuuuauuauagucacu

SEQ ID NO: 37619 - RNA, 21 nt, Homo sapiens
aaguugaauuuuacauggcug

SEQ ID NO: 37620 - RNA, 14 nt, Homo sapiens
agcuuuuguagaag

SEQ ID NO: 37621 - RNA, 18 nt, Homo sapiens
ugugaacccaaaguguga

SEQ ID NO: 37622 - RNA, 21 nt, Homo sapiens
gggaaugaagauacugaaaua

SEQ ID NO: 37623 - RNA, 13 nt, Homo sapiens
ucucauccacuuu

SEQ ID NO: 37624 - RNA, 15 nt, Homo sapiens
gcgcgcucaucccac

SEQ ID NO: 37625 - RNA, 14 nt, Homo sapiens
cacugagcugaggg

SEQ ID NO: 37626 - RNA, 16 nt, Homo sapiens
ccuucuuacaaugcau

SEQ ID NO: 37627 - RNA, 20 nt, Homo sapiens
uuaauuugguuuucacauug

SEQ ID NO: 37628 - RNA, 13 nt, Homo sapiens
uuguucuugugaa

SEQ ID NO: 37629 - RNA, 22 nt, Homo sapiens
ugaggcuuuaaaacuuauccuc

SEQ ID NO: 37630 - RNA, 22 nt, Homo sapiens
gcucgcuuccgcauccuagucu

SEQ ID NO: 37631 - RNA, 22 nt, Homo sapiens
gcugccgugggccugagaccaa

SEQ ID NO: 37632 - RNA, 22 nt, Homo sapiens
uuaaauagcuuuuuucucugau

SEQ ID NO: 37633 - RNA, 19 nt, Homo sapiens
ccuccaugaauaucaguua

SEQ ID NO: 37634 - RNA, 22 nt, Homo sapiens
gagggcgcggggcggggagcga

SEQ ID NO: 37635 - RNA, 13 nt, Homo sapiens
aaaaagcuacuua

SEQ ID NO: 37636 - RNA, 14 nt, Homo sapiens
aaagcuuugugcag

SEQ ID NO: 37637 - RNA, 20 nt, Homo sapiens
uuacaaugcauucugaggua

SEQ ID NO: 37638 - RNA, 21 nt, Homo sapiens
aaaagcuacuuauuguagcau

SEQ ID NO: 37639 - RNA, 21 nt, Homo sapiens
auucugagguaaccucauuau

SEQ ID NO: 37640 - RNA, 16 nt, Homo sapiens
uuguguuugaagcaca

SEQ ID NO: 37641 - RNA, 14 nt, Homo sapiens
uagguuuggacaaa

SEQ ID NO: 37642 - RNA, 22 nt, Homo sapiens
gaucaaguuauuuuuaauuugg

SEQ ID NO: 37643 - RNA, 12 nt, Homo sapiens
auccuggaauau

SEQ ID NO: 37644 - RNA, 17 nt, Homo sapiens
gaauacauaaaguaugu

SEQ ID NO: 37645 - RNA, 22 nt, Homo sapiens
cuaauuuguuuucccuucuuac

SEQ ID NO: 37646 - RNA, 15 nt, Homo sapiens
agccgggaaagaaga

SEQ ID NO: 37647 - RNA, 14 nt, Homo sapiens
gugcacuaaugugu

SEQ ID NO: 37648 - RNA, 13 nt, Homo sapiens
ugcugcaccugug

SEQ ID NO: 37649 - RNA, 22 nt, Homo sapiens
ugaacugcagcgaguacuuccc

SEQ ID NO: 37650 - RNA, 20 nt, Homo sapiens
uacauaaaguaugugcauau

SEQ ID NO: 37651 - RNA, 22 nt, Homo sapiens
cucuaucauuaaaguucuagug

SEQ ID NO: 37652 - RNA, 22 nt, Homo sapiens
aauguuguuuuaggaauacaua

SEQ ID NO: 37653 - RNA, 17 nt, Homo sapiens
auccuagucucuaucau

SEQ ID NO: 37654 - RNA, 13 nt, Homo sapiens
cauuaucagucca

SEQ ID NO: 37655 - RNA, 14 nt, Homo sapiens
agauaugauucaaa

SEQ ID NO: 37656 - RNA, 18 nt, Homo sapiens
ugaucaguaugaaaaugu

SEQ ID NO: 37657 - RNA, 14 nt, Homo sapiens
cucaucccacccgc

SEQ ID NO: 37658 - RNA, 19 nt, Homo sapiens
ucuuacaaugcauucugag

SEQ ID NO: 37659 - RNA, 17 nt, Homo sapiens
uucaaugccccugaauu

SEQ ID NO: 37660 - RNA, 23 nt, Homo sapiens
agcgcgcgcgcccucuggcugcu

SEQ ID NO: 37661 - RNA, 21 nt, Homo sapiens
gcucgcuuccgcauccuaguc

SEQ ID NO: 37662 - RNA, 17 nt, Homo sapiens
cacacugagcugagggg

SEQ ID NO: 37663 - RNA, 14 nt, Homo sapiens
ucuuccucccugga

SEQ ID NO: 37664 - RNA, 20 nt, Homo sapiens
aaaaaacguauugcauuuaa

SEQ ID NO: 37665 - RNA, 14 nt, Homo sapiens
agguuuggacaaaa

SEQ ID NO: 37666 - RNA, 17 nt, Homo sapiens
aucaguccaaagggcau

SEQ ID NO: 37667 - RNA, 22 nt, Homo sapiens
uggaaacaagucagucauucag

SEQ ID NO: 37668 - RNA, 17 nt, Homo sapiens
agagccggagccuccag

SEQ ID NO: 37669 - RNA, 23 nt, Homo sapiens
auucugagguaaccucauuauca

SEQ ID NO: 37670 - RNA, 16 nt, Homo sapiens
ugcauauuuuauuaua

SEQ ID NO: 37671 - RNA, 23 nt, Homo sapiens
ugcauucugagguaaccucauua

SEQ ID NO: 37672 - RNA, 17 nt, Homo sapiens
uauuuuuuucugaaauu

SEQ ID NO: 37673 - RNA, 20 nt, Homo sapiens
gggagcuuuuguagaaguca

SEQ ID NO: 37674 - RNA, 17 nt, Homo sapiens
uaaagcuuugugcagau

SEQ ID NO: 37675 - RNA, 23 nt, Homo sapiens
gugaacugcagcgaguacuuccc

SEQ ID NO: 37676 - RNA, 17 nt, Homo sapiens
augaagauacugaaaua

SEQ ID NO: 37677 - RNA, 15 nt, Homo sapiens
cuuccagggcuacgc

SEQ ID NO: 37678 - RNA, 23 nt, Homo sapiens
uagguuuggacaaaauggaauac

SEQ ID NO: 37679 - RNA, 17 nt, Homo sapiens
cugcaacucugaagggu

SEQ ID NO: 37680 - RNA, 11 nt, Homo sapiens
cgcuacuucca

SEQ ID NO: 37681 - RNA, 15 nt, Homo sapiens
uuggaagguauuuaa

SEQ ID NO: 37682 - RNA, 13 nt, Homo sapiens
uucccacacuguc

SEQ ID NO: 37683 - RNA, 19 nt, Homo sapiens
cagcgaguacuucccgcug

SEQ ID NO: 37684 - RNA, 15 nt, Homo sapiens
aaccucauuaucagu

SEQ ID NO: 37685 - RNA, 14 nt, Homo sapiens
augaucaguaugaa

SEQ ID NO: 37686 - RNA, 15 nt, Homo sapiens
ugugggaaauccaca

SEQ ID NO: 37687 - RNA, 21 nt, Homo sapiens
cuggcugcgcucggccugcuc

SEQ ID NO: 37688 - RNA, 21 nt, Homo sapiens
gucuauuuacggaacucaaau

SEQ ID NO: 37689 - RNA, 23 nt, Homo sapiens
agcauccuggaauaucuccguca

SEQ ID NO: 37690 - RNA, 15 nt, Homo sapiens
agugugacucauuaa

SEQ ID NO: 37691 - RNA, 20 nt, Homo sapiens
ucuauaaaccgaacugaugu

SEQ ID NO: 37692 - RNA, 18 nt, Homo sapiens
guucaugaaagauucaau

SEQ ID NO: 37693 - RNA, 18 nt, Homo sapiens
auauuuuuuucugaaauu

SEQ ID NO: 37694 - RNA, 22 nt, Homo sapiens
auauuuuuuucugaaauuuccu

SEQ ID NO: 37695 - RNA, 14 nt, Homo sapiens
aaaacguauugcau

SEQ ID NO: 37696 - RNA, 17 nt, Homo sapiens
aaccagagccugagugu

SEQ ID NO: 37697 - RNA, 17 nt, Homo sapiens
gaacaggauauucucac

SEQ ID NO: 37698 - RNA, 15 nt, Homo sapiens
agauacugaaauaaa

SEQ ID NO: 37699 - RNA, 21 nt, Homo sapiens
ugugcggccuggucuaccugu

SEQ ID NO: 37700 - RNA, 22 nt, Homo sapiens
ucauuguucuugugaacccaaa

SEQ ID NO: 37701 - RNA, 22 nt, Homo sapiens
uaaaccgaacugauguaaguaa

SEQ ID NO: 37702 - RNA, 20 nt, Homo sapiens
uuacccccugggagccccaa

SEQ ID NO: 37703 - RNA, 13 nt, Homo sapiens
aagacaaaaagcu

SEQ ID NO: 37704 - RNA, 19 nt, Homo sapiens
auuuucaugcuguucauga

SEQ ID NO: 37705 - RNA, 13 nt, Homo sapiens
ugcccuuccccuu

SEQ ID NO: 37706 - RNA, 17 nt, Homo sapiens
uuguagaagucacauuc

SEQ ID NO: 37707 - RNA, 19 nt, Homo sapiens
cucugaaggguaauuauau

SEQ ID NO: 37708 - RNA, 16 nt, Homo sapiens
uuccgcauccuagucu

SEQ ID NO: 37709 - RNA, 13 nt, Homo sapiens
auguguaagacaa

SEQ ID NO: 37710 - RNA, 17 nt, Homo sapiens
guucaugaaagauucaa

SEQ ID NO: 37711 - RNA, 15 nt, Homo sapiens
gacgcugcugccgug

SEQ ID NO: 37712 - RNA, 16 nt, Homo sapiens
agucucuaucauuaaa

SEQ ID NO: 37713 - RNA, 16 nt, Homo sapiens
caaugcauucugaggu

SEQ ID NO: 37714 - RNA, 14 nt, Homo sapiens
augauucaaauguc

SEQ ID NO: 37715 - RNA, 19 nt, Homo sapiens
gccugcucgcccacuuccu

SEQ ID NO: 37716 - RNA, 14 nt, Homo sapiens
ucccacacugucca

SEQ ID NO: 37717 - RNA, 22 nt, Homo sapiens
cauccuagucucuaucauuaaa

SEQ ID NO: 37718 - RNA, 15 nt, Homo sapiens
uaaaguucuagugac

SEQ ID NO: 37719 - RNA, 17 nt, Homo sapiens
ccauuuuugaaaccaaa

SEQ ID NO: 37720 - RNA, 21 nt, Homo sapiens
uccaaagggcauggguuuuau

SEQ ID NO: 37721 - RNA, 17 nt, Homo sapiens
aaacgucuuaaauauuc

SEQ ID NO: 37722 - RNA, 15 nt, Homo sapiens
ucaaugccccugaau

SEQ ID NO: 37723 - RNA, 19 nt, Homo sapiens
uacaaugcauucugaggua

SEQ ID NO: 37724 - RNA, 20 nt, Homo sapiens
uacagaaaaguugaauuuua

SEQ ID NO: 37725 - RNA, 23 nt, Homo sapiens
gcccuuccccuucccacacuguc

SEQ ID NO: 37726 - RNA, 23 nt, Homo sapiens
cuaguuguaauuuuuuuguggga

SEQ ID NO: 37727 - RNA, 17 nt, Homo sapiens
gcccuuccccuucccac

SEQ ID NO: 37728 - RNA, 12 nt, Homo sapiens
augcauucugag

SEQ ID NO: 37729 - RNA, 18 nt, Homo sapiens
accauuuuugaaaccaaa

SEQ ID NO: 37730 - RNA, 16 nt, Homo sapiens
uuaaaguucuagugac

SEQ ID NO: 37731 - RNA, 20 nt, Homo sapiens
ccgcagggugaacugcagcg

SEQ ID NO: 37732 - RNA, 19 nt, Homo sapiens
cuuugugcagauucuuuac

SEQ ID NO: 37733 - RNA, 17 nt, Homo sapiens
uccccagagcuacaggc

SEQ ID NO: 37734 - RNA, 19 nt, Homo sapiens
acaaaauggaauacucuua

SEQ ID NO: 37735 - RNA, 20 nt, Homo sapiens
ugcauauuuuauuauaguca

SEQ ID NO: 37736 - RNA, 12 nt, Homo sapiens
ccgcuacuucca

SEQ ID NO: 37737 - RNA, 15 nt, Homo sapiens
gccccaauucgaucc

SEQ ID NO: 37738 - RNA, 13 nt, Homo sapiens
uagucucuaucau

SEQ ID NO: 37739 - RNA, 15 nt, Homo sapiens
aguugaauuuuacau

SEQ ID NO: 37740 - RNA, 21 nt, Homo sapiens
ccuggcaaagaugaucaguau

SEQ ID NO: 37741 - RNA, 18 nt, Homo sapiens
cugcagcgaguacuuccc

SEQ ID NO: 37742 - RNA, 15 nt, Homo sapiens
cggccugcucgccca

SEQ ID NO: 37743 - RNA, 13 nt, Homo sapiens
uccgcauccuagu

SEQ ID NO: 37744 - RNA, 12 nt, Homo sapiens
aaaaaaacguau

SEQ ID NO: 37745 - RNA, 18 nt, Homo sapiens
accucuaaauucuuucau

SEQ ID NO: 37746 - RNA, 16 nt, Homo sapiens
gaguuccuucugcucc

SEQ ID NO: 37747 - RNA, 21 nt, Homo sapiens
aagagccggagccuccagcug

SEQ ID NO: 37748 - RNA, 18 nt, Homo sapiens
gcccacuuccucccggcc

SEQ ID NO: 37749 - RNA, 20 nt, Homo sapiens
ugcgcucggccugcucgccc

SEQ ID NO: 37750 - RNA, 22 nt, Homo sapiens
auuuuuuugugggaaauccaca

SEQ ID NO: 37751 - RNA, 18 nt, Homo sapiens
uuaagagagucuauuuac

SEQ ID NO: 37752 - RNA, 16 nt, Homo sapiens
guaaagcuuugugcag

SEQ ID NO: 37753 - RNA, 16 nt, Homo sapiens
uaaaguaugugcauau

SEQ ID NO: 37754 - RNA, 9 nt, Homo sapiens
acacugucc

SEQ ID NO: 37755 - RNA, 18 nt, Homo sapiens
uauccuccaugaauauca

SEQ ID NO: 37756 - RNA, 11 nt, Homo sapiens
gcauccuaguc

SEQ ID NO: 37757 - RNA, 19 nt, Homo sapiens
gcauccuagucucuaucau

SEQ ID NO: 37758 - RNA, 12 nt, Homo sapiens
uguucuugugaa

SEQ ID NO: 37759 - RNA, 17 nt, Homo sapiens
cgugggccugagaccaa

SEQ ID NO: 37760 - RNA, 18 nt, Homo sapiens
auucuuuacccccuggga

SEQ ID NO: 37761 - RNA, 12 nt, Homo sapiens
ucccacacuguc

SEQ ID NO: 37762 - RNA, 17 nt, Homo sapiens
cauaaauuuaguauuuu

SEQ ID NO: 37763 - RNA, 16 nt, Homo sapiens
auuucuaggacugaau

SEQ ID NO: 37764 - RNA, 14 nt, Homo sapiens
cuuccucccauuca

SEQ ID NO: 37765 - RNA, 23 nt, Homo sapiens
aaaaugucauuguucuugugaac

SEQ ID NO: 37766 - RNA, 13 nt, Homo sapiens
cacagugaucaag

SEQ ID NO: 37767 - RNA, 20 nt, Homo sapiens
ggcggguccgggucgcagga

SEQ ID NO: 37768 - RNA, 15 nt, Homo sapiens
auuucuaggacugaa

SEQ ID NO: 37769 - RNA, 16 nt, Homo sapiens
uucugagguaaccuca

SEQ ID NO: 37770 - RNA, 15 nt, Homo sapiens
acaaaaagcuacuua

SEQ ID NO: 37771 - RNA, 24 nt, Homo sapiens
aauacauaaaguaugugcauauuu

SEQ ID NO: 37772 - RNA, 11 nt, Homo sapiens
uccuugcugca

SEQ ID NO: 37773 - RNA, 12 nt, Homo sapiens
ccuugcugcacc

SEQ ID NO: 37774 - RNA, 19 nt, Homo sapiens
acuaauguguaagacaaaa

SEQ ID NO: 37775 - RNA, 20 nt, Homo sapiens
uuucucugauacagaaaagu

SEQ ID NO: 37776 - RNA, 23 nt, Homo sapiens
cugccucucucauccacuuucca

SEQ ID NO: 37777 - RNA, 14 nt, Homo sapiens
ggagccuccagcug

SEQ ID NO: 37778 - RNA, 19 nt, Homo sapiens
uauuuaauagguuuggaca

SEQ ID NO: 37779 - RNA, 15 nt, Homo sapiens
aucuauauuuuacau

SEQ ID NO: 37780 - RNA, 21 nt, Homo sapiens
ucgauccccugucacgugugg

SEQ ID NO: 37781 - RNA, 15 nt, Homo sapiens
aauuuaaauagcuuu

SEQ ID NO: 37782 - RNA, 17 nt, Homo sapiens
ccuucccacacugucca

SEQ ID NO: 37783 - RNA, 15 nt, Homo sapiens
uucccacacugucca

SEQ ID NO: 37784 - RNA, 15 nt, Homo sapiens
caagucagucauuca

SEQ ID NO: 37785 - RNA, 16 nt, Homo sapiens
ugaacaggauauucuc

SEQ ID NO: 37786 - RNA, 23 nt, Homo sapiens
aagauucaaugccccugaauuua

SEQ ID NO: 37787 - RNA, 15 nt, Homo sapiens
gaauacauaaaguau

SEQ ID NO: 37788 - RNA, 15 nt, Homo sapiens
cauauuuucaugcug

SEQ ID NO: 37789 - RNA, 19 nt, Homo sapiens
ccugaauuuaaauagcuuu

SEQ ID NO: 37790 - RNA, 17 nt, Homo sapiens
caggaccaucccggccg

SEQ ID NO: 37791 - RNA, 19 nt, Homo sapiens
cggcgggagggcgcggggc

SEQ ID NO: 37792 - RNA, 19 nt, Homo sapiens
aacccaaagugugacucau

SEQ ID NO: 37793 - RNA, 19 nt, Homo sapiens
guaaguaaacggucucuca

SEQ ID NO: 37794 - RNA, 13 nt, Homo sapiens
gccccaauucgau

SEQ ID NO: 37795 - RNA, 21 nt, Homo sapiens
uguaaguaaacggucucucac

SEQ ID NO: 37796 - RNA, 13 nt, Homo sapiens
cauccacuuucca

SEQ ID NO: 37797 - RNA, 15 nt, Homo sapiens
cccuucccacacugu

SEQ ID NO: 37798 - RNA, 16 nt, Homo sapiens
cuagaauuugauaugu

SEQ ID NO: 37799 - RNA, 13 nt, Homo sapiens
gaccaucccggcc

SEQ ID NO: 37800 - RNA, 16 nt, Homo sapiens
cccagagcuacaggcc

SEQ ID NO: 37801 - RNA, 16 nt, Homo sapiens
ccauuuuugaaaccaa

SEQ ID NO: 37802 - RNA, 24 nt, Homo sapiens
acauuccugaacaggauauucuca

SEQ ID NO: 37803 - RNA, 15 nt, Homo sapiens
ucauuaaaguucuag

SEQ ID NO: 37804 - RNA, 19 nt, Homo sapiens
ucugguccuaagucccugc

SEQ ID NO: 37805 - RNA, 19 nt, Homo sapiens
aggaauacauaaaguaugu

SEQ ID NO: 37806 - RNA, 15 nt, Homo sapiens
cucgcccacuuccuc

SEQ ID NO: 37807 - RNA, 20 nt, Homo sapiens
uuaauuuauugaggcuuuaa

SEQ ID NO: 37808 - RNA, 17 nt, Homo sapiens
ucauuaaaguucuagug

SEQ ID NO: 37809 - RNA, 19 nt, Homo sapiens
guccccagagcuacaggcc

SEQ ID NO: 37810 - RNA, 13 nt, Homo sapiens
ggggaggggcgcu

SEQ ID NO: 37811 - RNA, 23 nt, Homo sapiens
uccuggcaaagaugaucaguaug

SEQ ID NO: 37812 - RNA, 15 nt, Homo sapiens
aaaaacguauugcau

SEQ ID NO: 37813 - RNA, 20 nt, Homo sapiens
aacugcagcgaguacuuccc

SEQ ID NO: 37814 - RNA, 14 nt, Homo sapiens
ccccaucugguccu

SEQ ID NO: 37815 - RNA, 23 nt, Homo sapiens
uacuucccgcuguuccucgccac

SEQ ID NO: 37816 - RNA, 19 nt, Homo sapiens
aauuucuaggacugaauua

SEQ ID NO: 37817 - RNA, 20 nt, Homo sapiens
gucauucagauaugauucaa

SEQ ID NO: 37818 - RNA, 14 nt, Homo sapiens
uggaauacucuuau

SEQ ID NO: 37819 - RNA, 14 nt, Homo sapiens
uuuuacauggcugg

SEQ ID NO: 37820 - RNA, 16 nt, Homo sapiens
ggagcuagaauuugau

SEQ ID NO: 37821 - RNA, 13 nt, Homo sapiens
aguaugugcauau

SEQ ID NO: 37822 - RNA, 17 nt, Homo sapiens
cuuccgcauccuagucu

SEQ ID NO: 37823 - RNA, 13 nt, Homo sapiens
uuuauuauauaua

SEQ ID NO: 37824 - RNA, 21 nt, Homo sapiens
cuucccacacuguccauucuu

SEQ ID NO: 37825 - RNA, 16 nt, Homo sapiens
cucaggcuggcaccgc

SEQ ID NO: 37826 - RNA, 14 nt, Homo sapiens
uucaaauguauuac

SEQ ID NO: 37827 - RNA, 21 nt, Homo sapiens
ucccacacuguccauucuucc

SEQ ID NO: 37828 - RNA, 15 nt, Homo sapiens
aaaauggaauacucu

SEQ ID NO: 37829 - RNA, 11 nt, Homo sapiens
agccggagccu

SEQ ID NO: 37830 - RNA, 19 nt, Homo sapiens
uuucccuucuuacaaugca

SEQ ID NO: 37831 - RNA, 23 nt, Homo sapiens
uccccugucacgugugggcaaug

SEQ ID NO: 37832 - RNA, 18 nt, Homo sapiens
ggaaacaagucagucauu

SEQ ID NO: 37833 - RNA, 19 nt, Homo sapiens
gaaacaagucagucauuca

SEQ ID NO: 37834 - RNA, 16 nt, Homo sapiens
aucuucuuucaugaag

SEQ ID NO: 37835 - RNA, 23 nt, Homo sapiens
agguccuggcaaagaugaucagu

SEQ ID NO: 37836 - RNA, 19 nt, Homo sapiens
cccuucuuacaaugcauuc

SEQ ID NO: 37837 - RNA, 22 nt, Homo sapiens
ucuuguaaagguccuggcaaag

SEQ ID NO: 37838 - RNA, 12 nt, Homo sapiens
caucuucuuuca

SEQ ID NO: 37839 - RNA, 16 nt, Homo sapiens
ggcugcugguggcgcu

SEQ ID NO: 37840 - RNA, 14 nt, Homo sapiens
cgauccccugucac

SEQ ID NO: 37841 - RNA, 19 nt, Homo sapiens
gcuggagcugccucucuca

SEQ ID NO: 37842 - RNA, 21 nt, Homo sapiens
gcuccucggacggcuccggac

SEQ ID NO: 37843 - RNA, 23 nt, Homo sapiens
agaagagccggagccuccagcug

SEQ ID NO: 37844 - RNA, 17 nt, Homo sapiens
gcaaagaugaucaguau

SEQ ID NO: 37845 - RNA, 18 nt, Homo sapiens
uuccccuucccacacugu

SEQ ID NO: 37846 - RNA, 17 nt, Homo sapiens
uuucagugcacuaaugu

SEQ ID NO: 37847 - RNA, 17 nt, Homo sapiens
cagucauucagauauga

SEQ ID NO: 37848 - RNA, 12 nt, Homo sapiens
uuaucaguccaa

SEQ ID NO: 37849 - RNA, 14 nt, Homo sapiens
cuucccacacuguc

SEQ ID NO: 37850 - RNA, 20 nt, Homo sapiens
acaaaauggaauacucuuau

SEQ ID NO: 37851 - RNA, 15 nt, Homo sapiens
ggaagguauuuaaua

SEQ ID NO: 37852 - RNA, 12 nt, Homo sapiens
aaagaagagccg

SEQ ID NO: 37853 - RNA, 17 nt, Homo sapiens
guaaagcuuugugcaga

SEQ ID NO: 37854 - RNA, 21 nt, Homo sapiens
ugaagcacagugaucaaguua

SEQ ID NO: 37855 - RNA, 22 nt, Homo sapiens
aauacauaaaguaugugcauau

SEQ ID NO: 37856 - RNA, 14 nt, Homo sapiens
agcugccucucuca

SEQ ID NO: 37857 - RNA, 16 nt, Homo sapiens
auuaaaguucuaguga

SEQ ID NO: 37858 - RNA, 19 nt, Homo sapiens
ggcuuuaaaacuuauccuc

SEQ ID NO: 37859 - RNA, 14 nt, Homo sapiens
ucauccacuuucca

SEQ ID NO: 37860 - RNA, 19 nt, Homo sapiens
cgcucaucccacccgccca

SEQ ID NO: 37861 - RNA, 14 nt, Homo sapiens
cucugaaggguaau

SEQ ID NO: 37862 - RNA, 13 nt, Homo sapiens
uccgcuacuucca

SEQ ID NO: 37863 - RNA, 22 nt, Homo sapiens
uguaagacaaaaagcuacuuau

SEQ ID NO: 37864 - RNA, 17 nt, Homo sapiens
cgccuccgcuacuucca

SEQ ID NO: 37865 - RNA, 15 nt, Homo sapiens
auaaaguaugugcau

SEQ ID NO: 37866 - RNA, 19 nt, Homo sapiens
aauaucuccgucaacucau

SEQ ID NO: 37867 - RNA, 14 nt, Homo sapiens
aaguaugugcauau

SEQ ID NO: 37868 - RNA, 23 nt, Homo sapiens
auuuaaauagcuuuuuucucuga

SEQ ID NO: 37869 - RNA, 19 nt, Homo sapiens
caaagaugaucaguaugaa

SEQ ID NO: 37870 - RNA, 16 nt, Homo sapiens
ccgcauccuagucucu

SEQ ID NO: 37871 - RNA, 13 nt, Homo sapiens
ugaagauacugaa

SEQ ID NO: 37872 - RNA, 16 nt, Homo sapiens
uggagcuagaauuuga

SEQ ID NO: 37873 - RNA, 19 nt, Homo sapiens
uacauaaaguaugugcaua

SEQ ID NO: 37874 - RNA, 11 nt, Homo sapiens
caaagugugac

SEQ ID NO: 37875 - RNA, 19 nt, Homo sapiens
uggcaaagaugaucaguau

SEQ ID NO: 37876 - RNA, 16 nt, Homo sapiens
caagucagucauucag

SEQ ID NO: 37877 - RNA, 22 nt, Homo sapiens
aaaugucauuguucuugugaac

SEQ ID NO: 37878 - RNA, 15 nt, Homo sapiens
uaaagcuuugugcag

SEQ ID NO: 37879 - RNA, 16 nt, Homo sapiens
aauuucuaggacugaa

SEQ ID NO: 37880 - RNA, 17 nt, Homo sapiens
uaaagguccuggcaaag

SEQ ID NO: 37881 - RNA, 16 nt, Homo sapiens
uccauucuuccuccca

SEQ ID NO: 37882 - RNA, 18 nt, Homo sapiens
cugucacgugugggcaau

SEQ ID NO: 37883 - RNA, 20 nt, Homo sapiens
cuguaaagcuuugugcagau

SEQ ID NO: 37884 - RNA, 17 nt, Homo sapiens
cuaauguguaagacaaa

SEQ ID NO: 37885 - RNA, 16 nt, Homo sapiens
cauuuuugaaaccaaa

SEQ ID NO: 37886 - RNA, 17 nt, Homo sapiens
ugcccuuccccuuccca

SEQ ID NO: 37887 - RNA, 11 nt, Homo sapiens
cgcaggaccau

SEQ ID NO: 37888 - RNA, 22 nt, Homo sapiens
ucuaucauuaaaguucuaguga

SEQ ID NO: 37889 - RNA, 16 nt, Homo sapiens
aguaugaaaaugucau

SEQ ID NO: 37890 - RNA, 12 nt, Homo sapiens
cugaaauuuccu

SEQ ID NO: 37891 - RNA, 13 nt, Homo sapiens
agccuccagcugc

SEQ ID NO: 37892 - RNA, 14 nt, Homo sapiens
cuagucucuaucau

SEQ ID NO: 37893 - RNA, 18 nt, Homo sapiens
ugccucucucauccacuu

SEQ ID NO: 37894 - RNA, 21 nt, Homo sapiens
cauuguucuugugaacccaaa

SEQ ID NO: 37895 - RNA, 17 nt, Homo sapiens
agucagucauucagaua

SEQ ID NO: 37896 - RNA, 18 nt, Homo sapiens
uccaauaaagaguuccuu

SEQ ID NO: 37897 - RNA, 19 nt, Homo sapiens
accauuuuugaaaccaaac

SEQ ID NO: 37898 - RNA, 16 nt, Homo sapiens
gggugaacugcagcga

SEQ ID NO: 37899 - RNA, 22 nt, Homo sapiens
auccuagucucuaucauuaaag

SEQ ID NO: 37900 - RNA, 23 nt, Homo sapiens
aaugccccugaauuuaaauagcu

SEQ ID NO: 37901 - RNA, 15 nt, Homo sapiens
cuuuaaaacuuaucc

SEQ ID NO: 37902 - RNA, 21 nt, Homo sapiens
aaccagagccugaguguugcc

SEQ ID NO: 37903 - RNA, 16 nt, Homo sapiens
uaaagcuuugugcaga

SEQ ID NO: 37904 - RNA, 17 nt, Homo sapiens
aaguaaacggucucuca

SEQ ID NO: 37905 - RNA, 16 nt, Homo sapiens
uguagcauccuggaau

SEQ ID NO: 37906 - RNA, 20 nt, Homo sapiens
agccggagccuccagcugcc

SEQ ID NO: 37907 - RNA, 12 nt, Homo sapiens
accucauuauca

SEQ ID NO: 37908 - RNA, 17 nt, Homo sapiens
ucauuguucuugugaac

SEQ ID NO: 37909 - RNA, 14 nt, Homo sapiens
cuguccauucuucc

SEQ ID NO: 37910 - RNA, 13 nt, Homo sapiens
ggcuggagcugcc

SEQ ID NO: 37911 - RNA, 22 nt, Homo sapiens
ugccucucucauccacuuucca

SEQ ID NO: 37912 - RNA, 16 nt, Homo sapiens
uuucuaggacugaauu

SEQ ID NO: 37913 - RNA, 13 nt, Homo sapiens
cgcgcuccgcgca

SEQ ID NO: 37914 - RNA, 21 nt, Homo sapiens
auucuuccucccauucaggau

SEQ ID NO: 37915 - RNA, 15 nt, Homo sapiens
agccuccagcugccc

SEQ ID NO: 37916 - RNA, 16 nt, Homo sapiens
aauacucuuauaucua

SEQ ID NO: 37917 - RNA, 13 nt, Homo sapiens
uaucaguccaaag

SEQ ID NO: 37918 - RNA, 20 nt, Homo sapiens
agguuuggacaaaauggaau

SEQ ID NO: 37919 - RNA, 22 nt, Homo sapiens
agucucuaucauuaaaguucua

SEQ ID NO: 37920 - RNA, 14 nt, Homo sapiens
agcugccccgggga

SEQ ID NO: 37921 - RNA, 23 nt, Homo sapiens
uugcauuuaauuuauugaggcuu

SEQ ID NO: 37922 - RNA, 19 nt, Homo sapiens
uguuugaagcacagugauc

SEQ ID NO: 37923 - RNA, 18 nt, Homo sapiens
uagucucuaucauuaaag

SEQ ID NO: 37924 - RNA, 20 nt, Homo sapiens
cauuguucuugugaacccaa

SEQ ID NO: 37925 - RNA, 19 nt, Homo sapiens
auugaggcuuuaaaacuua

SEQ ID NO: 37926 - RNA, 22 nt, Homo sapiens
guaauuauauaguuacccaaau

SEQ ID NO: 37927 - RNA, 11 nt, Homo sapiens
acacuguccau

SEQ ID NO: 37928 - RNA, 18 nt, Homo sapiens
aagagccggagccuccag

SEQ ID NO: 37929 - RNA, 18 nt, Homo sapiens
cauuggaaacaagucagu

SEQ ID NO: 37930 - RNA, 21 nt, Homo sapiens
uguuguuuuaggaauacauaa

SEQ ID NO: 37931 - RNA, 15 nt, Homo sapiens
cuuauccuccaugaa

SEQ ID NO: 37932 - RNA, 15 nt, Homo sapiens
ugaauaucaguuauu

SEQ ID NO: 37933 - RNA, 15 nt, Homo sapiens
auguguaagacaaaa

SEQ ID NO: 37934 - RNA, 23 nt, Homo sapiens
aacccaaagugugacucauuaaa

SEQ ID NO: 37935 - RNA, 15 nt, Homo sapiens
ucauccacuuuccaa

SEQ ID NO: 37936 - RNA, 17 nt, Homo sapiens
aacaagucagucauuca

SEQ ID NO: 37937 - RNA, 18 nt, Homo sapiens
ucuaucauuaaaguucua

SEQ ID NO: 37938 - RNA, 22 nt, Homo sapiens
uuaagagagucuauuuacggaa

SEQ ID NO: 37939 - RNA, 19 nt, Homo sapiens
augucauuguucuugugaa

SEQ ID NO: 37940 - RNA, 15 nt, Homo sapiens
auuugauaugugaac

SEQ ID NO: 37941 - RNA, 13 nt, Homo sapiens
aauuauauaguua

SEQ ID NO: 37942 - RNA, 19 nt, Homo sapiens
aaauguuguuuuaggaaua

SEQ ID NO: 37943 - RNA, 12 nt, Homo sapiens
ggaaacaaguca

SEQ ID NO: 37944 - RNA, 22 nt, Homo sapiens
uaguuguaauuuuuuuguggga

SEQ ID NO: 37945 - RNA, 18 nt, Homo sapiens
ccaauaaagaguuccuuc

SEQ ID NO: 37946 - RNA, 13 nt, Homo sapiens
gagccuccagcug

SEQ ID NO: 37947 - RNA, 15 nt, Homo sapiens
cucauccacuuucca

SEQ ID NO: 37948 - RNA, 13 nt, Homo sapiens
uuccucgccacgc

SEQ ID NO: 37949 - RNA, 14 nt, Homo sapiens
uaaaguucuaguga

SEQ ID NO: 37950 - RNA, 14 nt, Homo sapiens
uggcgcuggcugcg

SEQ ID NO: 37951 - RNA, 24 nt, Homo sapiens
ggcuuuaaaacuuauccuccauga

SEQ ID NO: 37952 - RNA, 17 nt, Homo sapiens
uauagucacuaguugua

SEQ ID NO: 37953 - RNA, 13 nt, Homo sapiens
uggaaucuuguaa

SEQ ID NO: 37954 - RNA, 11 nt, Homo sapiens
acaaugcauuc

SEQ ID NO: 37955 - RNA, 15 nt, Homo sapiens
ccuccgcuacuucca

SEQ ID NO: 37956 - RNA, 18 nt, Homo sapiens
ucuaggacugaauuauga

SEQ ID NO: 37957 - RNA, 13 nt, Homo sapiens
cggaacucaaaua

SEQ ID NO: 37958 - RNA, 17 nt, Homo sapiens
uuugugggaaauccaca

SEQ ID NO: 37959 - RNA, 13 nt, Homo sapiens
gaaagauucaaug

SEQ ID NO: 37960 - RNA, 19 nt, Homo sapiens
acagcuccaagaauuucua

SEQ ID NO: 37961 - RNA, 17 nt, Homo sapiens
agucauucagauaugau

SEQ ID NO: 37962 - RNA, 13 nt, Homo sapiens
aaaguucuaguga

SEQ ID NO: 37963 - RNA, 15 nt, Homo sapiens
uacauaaaguaugug

SEQ ID NO: 37964 - RNA, 15 nt, Homo sapiens
guaaacggucucuca

SEQ ID NO: 37965 - RNA, 22 nt, Homo sapiens
uccuccaugaauaucaguuauu

SEQ ID NO: 37966 - RNA, 18 nt, Homo sapiens
agagccggagccuccagc

SEQ ID NO: 37967 - RNA, 22 nt, Homo sapiens
uggacaaaauggaauacucuua

SEQ ID NO: 37968 - RNA, 20 nt, Homo sapiens
cucgcuuccgcauccuaguc

SEQ ID NO: 37969 - RNA, 21 nt, Homo sapiens
acuguaaagcuuugugcagau

SEQ ID NO: 37970 - RNA, 23 nt, Homo sapiens
gggcgcucgcuuccgcauccuag

SEQ ID NO: 37971 - RNA, 16 nt, Homo sapiens
ucuuccucccuggaau

SEQ ID NO: 37972 - RNA, 22 nt, Homo sapiens
uaaaaaaaaaacguauugcauu

SEQ ID NO: 37973 - RNA, 14 nt, Homo sapiens
cuccgcuacuucca

SEQ ID NO: 37974 - RNA, 21 nt, Homo sapiens
agagccugaguguugccuaau

SEQ ID NO: 37975 - RNA, 18 nt, Homo sapiens
agcuagaauuugauaugu

SEQ ID NO: 37976 - RNA, 18 nt, Homo sapiens
agucacuaguuguaauuu

SEQ ID NO: 37977 - RNA, 21 nt, Homo sapiens
gagccgguccuugcugcaccu

SEQ ID NO: 37978 - RNA, 17 nt, Homo sapiens
gguccuugcugcaccug

SEQ ID NO: 37979 - RNA, 16 nt, Homo sapiens
auccacacugagcuga

SEQ ID NO: 37980 - RNA, 14 nt, Homo sapiens
auuuuugaaaccaa

SEQ ID NO: 37981 - RNA, 16 nt, Homo sapiens
cgugugggcaauguuc

SEQ ID NO: 37982 - RNA, 15 nt, Homo sapiens
cagcugccccgggga

SEQ ID NO: 37983 - RNA, 14 nt, Homo sapiens
aaagguccuggcaa

SEQ ID NO: 37984 - RNA, 22 nt, Homo sapiens
gaagagguuuuaaagcuuccau

SEQ ID NO: 37985 - RNA, 12 nt, Homo sapiens
uucccacacugu

SEQ ID NO: 37986 - RNA, 11 nt, Homo sapiens
auucaaaugua

SEQ ID NO: 37987 - RNA, 16 nt, Homo sapiens
ccggagccuccagcug

SEQ ID NO: 37988 - RNA, 21 nt, Homo sapiens
cgccuccgcuacuuccagggc

SEQ ID NO: 37989 - RNA, 22 nt, Homo sapiens
gagaccaaggcccccgggccga

SEQ ID NO: 37990 - RNA, 21 nt, Homo sapiens
acauggcuggagcuagaauuu

SEQ ID NO: 37991 - RNA, 19 nt, Homo sapiens
cccucuccucucuuccucc

SEQ ID NO: 37992 - RNA, 15 nt, Homo sapiens
gcucgcccacuuccu

SEQ ID NO: 37993 - RNA, 23 nt, Homo sapiens
uuaaauagcuuuuuucucugaua

SEQ ID NO: 37994 - RNA, 16 nt, Homo sapiens
gccuccgcuacuucca

SEQ ID NO: 37995 - RNA, 16 nt, Homo sapiens
uagaagucacauuccu

SEQ ID NO: 37996 - RNA, 15 nt, Homo sapiens
cuugugaacccaaag

SEQ ID NO: 37997 - RNA, 20 nt, Homo sapiens
uguuguuuuaggaauacaua

SEQ ID NO: 37998 - RNA, 20 nt, Homo sapiens
cuuauuguagcauccuggaa

SEQ ID NO: 37999 - RNA, 14 nt, Homo sapiens
aaaguucuagugac

SEQ ID NO: 38000 - RNA, 15 nt, Homo sapiens
cggagccuccagcug

SEQ ID NO: 38001 - RNA, 14 nt, Homo sapiens
gcuccaagaauuuc

SEQ ID NO: 38002 - RNA, 15 nt, Homo sapiens
cuccaagaauuucua

SEQ ID NO: 38003 - RNA, 16 nt, Homo sapiens
ugugaacccaaagugu

SEQ ID NO: 38004 - RNA, 17 nt, Homo sapiens
cauccuagucucuauca

SEQ ID NO: 38005 - RNA, 15 nt, Homo sapiens
cuccgcuacuuccag

SEQ ID NO: 38006 - RNA, 20 nt, Homo sapiens
gcgcgccuccgcuacuucca

SEQ ID NO: 38007 - RNA, 21 nt, Homo sapiens
ggcuggagcugccucucucau

SEQ ID NO: 38008 - RNA, 13 nt, Homo sapiens
aggacugaauuau

SEQ ID NO: 38009 - RNA, 17 nt, Homo sapiens
ugcauuuaauuuauuga

SEQ ID NO: 38010 - RNA, 19 nt, Homo sapiens
gcuuuaaaacuuauccucc

SEQ ID NO: 38011 - RNA, 16 nt, Homo sapiens
ggcuggagcugccucu

SEQ ID NO: 38012 - RNA, 19 nt, Homo sapiens
uaaccucuaaauucuuuca

SEQ ID NO: 38013 - RNA, 14 nt, Homo sapiens
uauuuucaugcugu

SEQ ID NO: 38014 - RNA, 14 nt, Homo sapiens
gugugacucauuaa

SEQ ID NO: 38015 - RNA, 16 nt, Homo sapiens
acaagucagucauuca

SEQ ID NO: 38016 - RNA, 17 nt, Homo sapiens
uguguaagacaaaaagc

SEQ ID NO: 38017 - RNA, 15 nt, Homo sapiens
cggcuggagcugccu

SEQ ID NO: 38018 - RNA, 22 nt, Homo sapiens
agagucuauuuacggaacucaa

SEQ ID NO: 38019 - RNA, 15 nt, Homo sapiens
uaugaaaaugucauu

SEQ ID NO: 38020 - RNA, 14 nt, Homo sapiens
agccccaauucgau

SEQ ID NO: 38021 - RNA, 17 nt, Homo sapiens
cccaaagugugacucau

SEQ ID NO: 38022 - RNA, 22 nt, Homo sapiens
uucaauaaaacuuuuccaauga

SEQ ID NO: 38023 - RNA, 17 nt, Homo sapiens
uuccucccuggaaucuu

SEQ ID NO: 38024 - RNA, 17 nt, Homo sapiens
uggaaguaaauguuguu

SEQ ID NO: 38025 - RNA, 16 nt, Homo sapiens
uggcgcuggcugcgcu

SEQ ID NO: 38026 - RNA, 21 nt, Homo sapiens
ucuugugaacccaaaguguga

SEQ ID NO: 38027 - RNA, 20 nt, Homo sapiens
uccgggucgcaggaccaucc

SEQ ID NO: 38028 - RNA, 21 nt, Homo sapiens
uccgggucgcaggaccauccc

SEQ ID NO: 38029 - RNA, 13 nt, Homo sapiens
uccgcuacuucca

SEQ ID NO: 38030 - RNA, 17 nt, Homo sapiens
uccccugucacgugugg

SEQ ID NO: 38031 - RNA, 13 nt, Homo sapiens
uccucggacggcu

SEQ ID NO: 38032 - RNA, 18 nt, Homo sapiens
uccuccaugaauaucagu

SEQ ID NO: 38033 - RNA, 20 nt, Homo sapiens
ugcuauugggguuggggggg

SEQ ID NO: 38034 - RNA, 22 nt, Homo sapiens
ugaguguugccuaauuuguuuu

SEQ ID NO: 38035 - RNA, 20 nt, Homo sapiens
ugagcggaccuucccagcua

SEQ ID NO: 38036 - RNA, 16 nt, Homo sapiens
ugaaagucccagauca

SEQ ID NO: 38037 - RNA, 12 nt, Homo sapiens
uccagcugcccc

SEQ ID NO: 38038 - RNA, 17 nt, Homo sapiens
ucacuaguuguaauuuu

SEQ ID NO: 38039 - RNA, 18 nt, Homo sapiens
guuguggggaugaacuuu

SEQ ID NO: 38040 - RNA, 14 nt, Homo sapiens
uaugaaaaugucau

SEQ ID NO: 38041 - RNA, 13 nt, Homo sapiens
uacgcgcgcuccg

SEQ ID NO: 38042 - RNA, 14 nt, Homo sapiens
uacgcgcgcuccgc

SEQ ID NO: 38043 - RNA, 12 nt, Homo sapiens
uacgcgcgcucc

SEQ ID NO: 38044 - RNA, 23 nt, Homo sapiens
guugcuaucaauccaagaacuua

SEQ ID NO: 38045 - RNA, 15 nt, Homo sapiens
gucucuaucauuaaa

SEQ ID NO: 38046 - RNA, 21 nt, Homo sapiens
guauugcauuuaauuuauuga

SEQ ID NO: 38047 - RNA, 17 nt, Homo sapiens
gcugcgcgccgcgcucc

SEQ ID NO: 38048 - RNA, 19 nt, Homo sapiens
gcugcgcgccgcgcuccuc

SEQ ID NO: 38049 - RNA, 14 nt, Homo sapiens
ggagccuccagcug

SEQ ID NO: 38050 - RNA, 19 nt, Homo sapiens
gcauggguuuuauuauaua

SEQ ID NO: 38051 - RNA, 14 nt, Homo sapiens
gcaggaggcaucca

SEQ ID NO: 38052 - RNA, 21 nt, Homo sapiens
gccuuuguugcuaucaaucca

SEQ ID NO: 38053 - RNA, 17 nt, Homo sapiens
gcgaguacuucccgcug

SEQ ID NO: 38054 - RNA, 16 nt, Homo sapiens
gagccuccagcugccc

SEQ ID NO: 38055 - RNA, 17 nt, Homo sapiens
gaacuuuuuguuuuguu

SEQ ID NO: 38056 - RNA, 18 nt, Homo sapiens
gaacuuuuuguuuuguuu

SEQ ID NO: 38057 - RNA, 15 nt, Homo sapiens
auuaaaguucuagug

SEQ ID NO: 38058 - RNA, 17 nt, Homo sapiens
auuaaaguucuagugac

SEQ ID NO: 38059 - RNA, 18 nt, Homo sapiens
auucugagguaaccucau

SEQ ID NO: 38060 - RNA, 12 nt, Homo sapiens
caagaacuuauu

SEQ ID NO: 38061 - RNA, 18 nt, Homo sapiens
caaccucucccaacuaua

SEQ ID NO: 38062 - RNA, 17 nt, Homo sapiens
auaucaguuauuuuuaa

SEQ ID NO: 38063 - RNA, 18 nt, Homo sapiens
auaucaguuauuuuuaaa

SEQ ID NO: 38064 - RNA, 14 nt, Homo sapiens
auaaaacuuuucca

SEQ ID NO: 38065 - RNA, 18 nt, Homo sapiens
aguucuucaaagauaggg

SEQ ID NO: 38066 - RNA, 22 nt, Homo sapiens
aucccggccggcgcgcucaucc

SEQ ID NO: 38067 - RNA, 15 nt, Homo sapiens
aucaguaugaaaaug

SEQ ID NO: 38068 - RNA, 11 nt, Homo sapiens
aggaccauccc

SEQ ID NO: 38069 - RNA, 13 nt, Homo sapiens
aggaggggcuucu

SEQ ID NO: 38070 - RNA, 22 nt, Homo sapiens
agcuaggggggucagccagccc

SEQ ID NO: 38071 - RNA, 12 nt, Homo sapiens
aggggcgcucgc

SEQ ID NO: 38072 - RNA, 16 nt, Homo sapiens
agucauucugccugcc

SEQ ID NO: 38073 - RNA, 17 nt, Homo sapiens
agucauucugccugccc

SEQ ID NO: 38074 - RNA, 20 nt, Homo sapiens
agucccagaucaagccugcc

SEQ ID NO: 38075 - RNA, 21 nt, Homo sapiens
agucccagaucaagccugccu

SEQ ID NO: 38076 - RNA, 22 nt, Homo sapiens
agucccagaucaagccugccuc

SEQ ID NO: 38077 - RNA, 19 nt, Homo sapiens
accucucccaacuauaaaa

SEQ ID NO: 38078 - RNA, 18 nt, Homo sapiens
agccgggaaagaagagcc

SEQ ID NO: 38079 - RNA, 23 nt, Homo sapiens
agcccucuucugacacuaaaaca

SEQ ID NO: 38080 - RNA, 16 nt, Homo sapiens
agccagcccucuucug

SEQ ID NO: 38081 - RNA, 23 nt, Homo sapiens
agaacuuauuuguacauuuuuuu

SEQ ID NO: 38082 - RNA, 18 nt, Homo sapiens
acuuauuuguacauuuuu

SEQ ID NO: 38083 - RNA, 15 nt, Homo sapiens
uugagcuaggggggu

SEQ ID NO: 38084 - RNA, 13 nt, Homo sapiens
acauuuuuuuuuu

SEQ ID NO: 38085 - RNA, 22 nt, Homo sapiens
uguaaagcuuugugcagauucu

SEQ ID NO: 38086 - RNA, 16 nt, Homo sapiens
uguuuuaggaauacau

SEQ ID NO: 38087 - RNA, 19 nt, Homo sapiens
uggaaguaaauguuguuuu

SEQ ID NO: 38088 - RNA, 22 nt, Homo sapiens
cuagucucuaucauuaaaguuc

SEQ ID NO: 38089 - RNA, 22 nt, Homo sapiens
cgcuuccgcauccuagucucua

SEQ ID NO: 38090 - RNA, 17 nt, Homo sapiens
cuaaaacaccucagcug

SEQ ID NO: 38091 - RNA, 15 nt, Homo sapiens
cgggaaagaagagcc

SEQ ID NO: 38092 - RNA, 19 nt, Homo sapiens
cgcucggccugcucgccca

SEQ ID NO: 38093 - RNA, 17 nt, Homo sapiens
cgcuguuccucgccacg

SEQ ID NO: 38094 - RNA, 15 nt, Homo sapiens
cuuccgcauccuagu

SEQ ID NO: 38095 - RNA, 22 nt, Homo sapiens
cuuauccuccaugaauaucagu

SEQ ID NO: 38096 - RNA, 15 nt, Homo sapiens
cuuacaaugcauucu

SEQ ID NO: 38097 - RNA, 12 nt, Homo sapiens
cucgcuuccgca

SEQ ID NO: 38098 - RNA, 10 nt, Homo sapiens
ccucucccaa

SEQ ID NO: 38099 - RNA, 15 nt, Homo sapiens
ccgugugccugagcg

SEQ ID NO: 38100 - RNA, 15 nt, Homo sapiens
cauuaaaguucuagu

SEQ ID NO: 38101 - RNA, 23 nt, Homo sapiens
caggauggcaggaggcauccaaa

SEQ ID NO: 38102 - RNA, 22 nt, Homo sapiens
cacuccacuuggacaugggccc

SEQ ID NO: 38103 - RNA, 23 nt, Homo sapiens
cacuccacuuggacaugggcccc

SEQ ID NO: 38104 - RNA, 17 nt, Homo sapiens
uaaacuguaaagcuuug

SEQ ID NO: 38105 - RNA, 16 nt, Homo sapiens
guucuugugaacccaa

SEQ ID NO: 38106 - RNA, 20 nt, Homo sapiens
uacgcgagcgcgcgcgcccu

SEQ ID NO: 38107 - RNA, 10 nt, Homo sapiens
uaguucuuca

SEQ ID NO: 38108 - RNA, 11 nt, Homo sapiens
uaguucuucaa

SEQ ID NO: 38109 - RNA, 16 nt, Homo sapiens
ucacuaguuguaauuu

SEQ ID NO: 38110 - RNA, 20 nt, Homo sapiens
ucagcugccuccccagcucu

SEQ ID NO: 38111 - RNA, 21 nt, Homo sapiens
ucagcugccuccccagcucua

SEQ ID NO: 38112 - RNA, 22 nt, Homo sapiens
ucauuaaaguucuagugaccga

SEQ ID NO: 38113 - RNA, 16 nt, Homo sapiens
uccauggggugggggu

SEQ ID NO: 38114 - RNA, 17 nt, Homo sapiens
uccuccaugaauaucag

SEQ ID NO: 38115 - RNA, 18 nt, Homo sapiens
ugaaggggcggcggcccu

SEQ ID NO: 38116 - RNA, 20 nt, Homo sapiens
ucuugugaacccaaagugug

SEQ ID NO: 38117 - RNA, 22 nt, Homo sapiens
ucucuaucauuaaaguucuagu

SEQ ID NO: 38118 - RNA, 18 nt, Homo sapiens
guaugaaaaugucauugu

SEQ ID NO: 38119 - RNA, 14 nt, Homo sapiens
gucauuguucuugu

SEQ ID NO: 38120 - RNA, 11 nt, Homo sapiens
gucagccagcc

SEQ ID NO: 38121 - RNA, 20 nt, Homo sapiens
guacgcgagcgcgcgcgccc

SEQ ID NO: 38122 - RNA, 15 nt, Homo sapiens
ggagccuccagcugc

SEQ ID NO: 38123 - RNA, 18 nt, Homo sapiens
gcugcgcgccgcgcuccu

SEQ ID NO: 38124 - RNA, 11 nt, Homo sapiens
gcuuccgcauc

SEQ ID NO: 38125 - RNA, 16 nt, Homo sapiens
cuaaaacaccucagcu

SEQ ID NO: 38126 - RNA, 18 nt, Homo sapiens
acaccucagcugccuccc

SEQ ID NO: 38127 - RNA, 19 nt, Homo sapiens
acaccucagcugccucccc

SEQ ID NO: 38128 - RNA, 23 nt, Homo sapiens
gaacuuauuuguacauuuuuuuu

SEQ ID NO: 38129 - RNA, 14 nt, Homo sapiens
gacgcugcugccgu

SEQ ID NO: 38130 - RNA, 22 nt, Homo sapiens
gagcucccaggaggggcuucug

SEQ ID NO: 38131 - RNA, 13 nt, Homo sapiens
aaacaccucagcu

SEQ ID NO: 38132 - RNA, 18 nt, Homo sapiens
aaacuaggugcugcagcc

SEQ ID NO: 38133 - RNA, 14 nt, Homo sapiens
aaauugagcuaggg

SEQ ID NO: 38134 - RNA, 16 nt, Homo sapiens
aaaguucuagugaccg

SEQ ID NO: 38135 - RNA, 14 nt, Homo sapiens
aaacaccucagcug

SEQ ID NO: 38136 - RNA, 15 nt, Homo sapiens
agccuccagcugccc

SEQ ID NO: 38137 - RNA, 17 nt, Homo sapiens
agccuccagcugccccg

SEQ ID NO: 38138 - RNA, 21 nt, Homo sapiens
aggaggcauccaaaggcuccu

SEQ ID NO: 38139 - RNA, 18 nt, Homo sapiens
accucucccaacuauaaa

SEQ ID NO: 38140 - RNA, 15 nt, Homo sapiens
acggcuccggacgcu

SEQ ID NO: 38141 - RNA, 17 nt, Homo sapiens
acuuauuuguacauuuu

SEQ ID NO: 38142 - RNA, 22 nt, Homo sapiens
acucauuaaauggaaguaaaug

SEQ ID NO: 38143 - RNA, 19 nt, Homo sapiens
acugcagcgaguacuuccc

SEQ ID NO: 38144 - RNA, 17 nt, Homo sapiens
aagagccggagccucca

SEQ ID NO: 38145 - RNA, 23 nt, Homo sapiens
aacuuauuuguacauuuuuuuuu

SEQ ID NO: 38146 - RNA, 20 nt, Homo sapiens
aacuuuuccaaugacauuuu

SEQ ID NO: 38147 - RNA, 23 nt, Homo sapiens
aacuuuuuguuuuguuucuuccu

SEQ ID NO: 38148 - RNA, 22 nt, Homo sapiens
aagagccggagccuccagcugc

SEQ ID NO: 38149 - RNA, 15 nt, Homo sapiens
aucaguuauuuuuaa

SEQ ID NO: 38150 - RNA, 16 nt, Homo sapiens
aucaguuauuuuuaaa

SEQ ID NO: 38151 - RNA, 22 nt, Homo sapiens
auccuagucucuaucauuaaag

SEQ ID NO: 38152 - RNA, 23 nt, Homo sapiens
aucccggccggcgcgcucauccc

SEQ ID NO: 38153 - RNA, 13 nt, Homo sapiens
augaccuggccgc

SEQ ID NO: 38154 - RNA, 23 nt, Homo sapiens
auagccagguaccuucucaccug

SEQ ID NO: 38155 - RNA, 18 nt, Homo sapiens
auauauuuuuuuuuuuaa

SEQ ID NO: 38156 - RNA, 19 nt, Homo sapiens
auauauuuuuuuuuuuaaa

SEQ ID NO: 38157 - RNA, 20 nt, Homo sapiens
auauauuuuuuuuuuuaaaa

SEQ ID NO: 38158 - RNA, 23 nt, Homo sapiens
aguaugaaaaugucauuguucuu

SEQ ID NO: 38159 - RNA, 14 nt, Homo sapiens
aggggcgcucgcuu

SEQ ID NO: 38160 - RNA, 23 nt, Homo sapiens
caccgcagggugaacugcagcga

SEQ ID NO: 38161 - RNA, 17 nt, Homo sapiens
auucugagguaaccuca

SEQ ID NO: 38162 - RNA, 14 nt, Homo sapiens
auuaaaguucuagu

SEQ ID NO: 38163 - RNA, 16 nt, Homo sapiens
cauauuuuauuauagu

SEQ ID NO: 38164 - RNA, 17 nt, Homo sapiens
caggcuggcaccgcugu

SEQ ID NO: 38165 - RNA, 22 nt, Homo sapiens
caggcggguccgggucgcagga

SEQ ID NO: 38166 - RNA, 22 nt, Homo sapiens
caggauggcaggaggcauccaa

SEQ ID NO: 38167 - RNA, 15 nt, Homo sapiens
ccagcucuaucccaa

SEQ ID NO: 38168 - RNA, 22 nt, Homo sapiens
ccaaaccagagccugaguguug

SEQ ID NO: 38169 - RNA, 23 nt, Homo sapiens
ccagaucaagccugccucaauca

SEQ ID NO: 38170 - RNA, 19 nt, Homo sapiens
ccgcauccuagucucuauc

SEQ ID NO: 38171 - RNA, 17 nt, Homo sapiens
ccggcgcgcucauccca

SEQ ID NO: 38172 - RNA, 18 nt, Homo sapiens
ccggcgcgcucaucccac

SEQ ID NO: 38173 - RNA, 22 nt, Homo sapiens
ccuccaugaauaucaguuauuu

SEQ ID NO: 38174 - RNA, 23 nt, Homo sapiens
ccuccaugaauaucaguuauuuu

SEQ ID NO: 38175 - RNA, 17 nt, Homo sapiens
cgaguacuucccgcugu

SEQ ID NO: 38176 - RNA, 18 nt, Homo sapiens
cuauaaaacuaggugcug

SEQ ID NO: 38177 - RNA, 15 nt, Homo sapiens
agccgggaaagaaga

SEQ ID NO: 38178 - RNA, 21 nt, Homo sapiens
ccugagcggaccuucccagcu

SEQ ID NO: 38179 - RNA, 18 nt, Homo sapiens
cagcuagaauucacucca

SEQ ID NO: 38180 - RNA, 15 nt, Homo sapiens
gccccaauucgaucc

SEQ ID NO: 38181 - RNA, 13 nt, Homo sapiens
ccggaaacuccac

SEQ ID NO: 38182 - RNA, 18 nt, Homo sapiens
cugcagcgaguacuuccc

SEQ ID NO: 38183 - RNA, 23 nt, Homo sapiens
aagccugccucaaucaguauuca

SEQ ID NO: 38184 - RNA, 22 nt, Homo sapiens
aauguuguuuuaggaauacaua

SEQ ID NO: 38185 - RNA, 21 nt, Homo sapiens
cauuguucuugugaacccaaa

SEQ ID NO: 38186 - RNA, 16 nt, Homo sapiens
ccucucccaacuauaa

SEQ ID NO: 38187 - RNA, 14 nt, Homo sapiens
ucacuccacuugga

SEQ ID NO: 38188 - RNA, 13 nt, Homo sapiens
cgcgcuccgcgca

SEQ ID NO: 38189 - RNA, 13 nt, Homo sapiens
uccugugggaccu

SEQ ID NO: 38190 - RNA, 20 nt, Homo sapiens
guaccuucucaccugugaga

SEQ ID NO: 38191 - RNA, 14 nt, Homo sapiens
agcccucuucugac

SEQ ID NO: 38192 - RNA, 15 nt, Homo sapiens
cggagccuccagcug

SEQ ID NO: 38193 - RNA, 18 nt, Homo sapiens
ccacauccugugggaccu

SEQ ID NO: 38194 - RNA, 19 nt, Homo sapiens
ggcuuuaaaacuuauccuc

SEQ ID NO: 38195 - RNA, 16 nt, Homo sapiens
ucaaucaguauucaua

SEQ ID NO: 38196 - RNA, 17 nt, Homo sapiens
uggcaggaggcauccaa

SEQ ID NO: 38197 - RNA, 21 nt, Homo sapiens
agagccugaguguugccuaau

SEQ ID NO: 38198 - RNA, 19 nt, Homo sapiens
auugaggcuuuaaaacuua

SEQ ID NO: 38199 - RNA, 12 nt, Homo sapiens
augcauucugag

SEQ ID NO: 38200 - RNA, 20 nt, Homo sapiens
agcucuaucccaaccucucc

SEQ ID NO: 38201 - RNA, 20 nt, Homo sapiens
cugagcccggaaacuccaca

SEQ ID NO: 38202 - RNA, 21 nt, Homo sapiens
acuuggacaugggccccagau

SEQ ID NO: 38203 - RNA, 18 nt, Homo sapiens
gcccacuuccucccggcc

SEQ ID NO: 38204 - RNA, 14 nt, Homo sapiens
cuccgcuacuucca

SEQ ID NO: 38205 - RNA, 16 nt, Homo sapiens
auuaaaguucuaguga

SEQ ID NO: 38206 - RNA, 15 nt, Homo sapiens
gacgcugcugccgug

SEQ ID NO: 38207 - RNA, 21 nt, Homo sapiens
caacuauaaaacuaggugcug

SEQ ID NO: 38208 - RNA, 21 nt, Homo sapiens
ugugcggccuggucuaccugu

SEQ ID NO: 38209 - RNA, 23 nt, Homo sapiens
gggcgcucgcuuccgcauccuag

SEQ ID NO: 38210 - RNA, 16 nt, Homo sapiens
accaggcacccccaga

SEQ ID NO: 38211 - RNA, 22 nt, Homo sapiens
uaguuguaauuuuuuuguggga

SEQ ID NO: 38212 - RNA, 20 nt, Homo sapiens
ugcauauuuuauuauaguca

SEQ ID NO: 38213 - RNA, 18 nt, Homo sapiens
aagagccggagccuccag

SEQ ID NO: 38214 - RNA, 20 nt, Homo sapiens
agccggagccuccagcugcc

SEQ ID NO: 38215 - RNA, 17 nt, Homo sapiens
agcccggaaacuccaca

SEQ ID NO: 38216 - RNA, 22 nt, Homo sapiens
cuaauuuguuuucccuucuuac

SEQ ID NO: 38217 - RNA, 21 nt, Homo sapiens
ugaaagucccagaucaagccu

SEQ ID NO: 38218 - RNA, 22 nt, Homo sapiens
cauccuagucucuaucauuaaa

SEQ ID NO: 38219 - RNA, 14 nt, Homo sapiens
aaguaugugcauau

SEQ ID NO: 38220 - RNA, 21 nt, Homo sapiens
aagagccggagccuccagcug

SEQ ID NO: 38221 - RNA, 15 nt, Homo sapiens
cugagacacaugggu

SEQ ID NO: 38222 - RNA, 17 nt, Homo sapiens
aaccagagccugagugu

SEQ ID NO: 38223 - RNA, 12 nt, Homo sapiens
aaagaagagccg

SEQ ID NO: 38224 - RNA, 16 nt, Homo sapiens
aagaacuuauuuguac

SEQ ID NO: 38225 - RNA, 13 nt, Homo sapiens
gagccuccagcug

SEQ ID NO: 38226 - RNA, 13 nt, Homo sapiens
gagacacaugggu

SEQ ID NO: 38227 - RNA, 21 nt, Homo sapiens
agaucaagccugccucaauca

SEQ ID NO: 38228 - RNA, 17 nt, Homo sapiens
uucacuccacuuggaca

SEQ ID NO: 38229 - RNA, 17 nt, Homo sapiens
gacacuaaaacaccuca

SEQ ID NO: 38230 - RNA, 23 nt, Homo sapiens
gaccuucccagcuagaauucacu

SEQ ID NO: 38231 - RNA, 14 nt, Homo sapiens
cugccugcccugaa

SEQ ID NO: 38232 - RNA, 17 nt, Homo sapiens
ugcagccccugggacca

SEQ ID NO: 38233 - RNA, 17 nt, Homo sapiens
cacacugagcugagggg

SEQ ID NO: 38234 - RNA, 16 nt, Homo sapiens
aacuauaaaacuaggu

SEQ ID NO: 38235 - RNA, 16 nt, Homo sapiens
cucaggcuggcaccgc

SEQ ID NO: 38236 - RNA, 18 nt, Homo sapiens
accuucucaccugugaga

SEQ ID NO: 38237 - RNA, 16 nt, Homo sapiens
ccggagccuccagcug

SEQ ID NO: 38238 - RNA, 11 nt, Homo sapiens
gcauccuaguc

SEQ ID NO: 38239 - RNA, 16 nt, Homo sapiens
gccuccgcuacuucca

SEQ ID NO: 38240 - RNA, 22 nt, Homo sapiens
aaagucccagaucaagccugcc

SEQ ID NO: 38241 - RNA, 15 nt, Homo sapiens
cuagaauucacucca

SEQ ID NO: 38242 - RNA, 23 nt, Homo sapiens
uccccugucacgugugggcaaug

SEQ ID NO: 38243 - RNA, 19 nt, Homo sapiens
uuucccuucuuacaaugca

SEQ ID NO: 38244 - RNA, 22 nt, Homo sapiens
uaaaaaaaaaacguauugcauu

SEQ ID NO: 38245 - RNA, 17 nt, Homo sapiens
gaauacauaaaguaugu

SEQ ID NO: 38246 - RNA, 17 nt, Homo sapiens
gaccugggccauaguca

SEQ ID NO: 38247 - RNA, 19 nt, Homo sapiens
cggcgggagggcgcggggc

SEQ ID NO: 38248 - RNA, 19 nt, Homo sapiens
acucuggucaagaagcauc

SEQ ID NO: 38249 - RNA, 19 nt, Homo sapiens
agguaccagccuuggauac

SEQ ID NO: 38250 - RNA, 23 nt, Homo sapiens
aaaaugucauuguucuugugaac

SEQ ID NO: 38251 - RNA, 22 nt, Homo sapiens
auccuagucucuaucauuaaag

SEQ ID NO: 38252 - RNA, 15 nt, Homo sapiens
ugugggaaauccaca

SEQ ID NO: 38253 - RNA, 22 nt, Homo sapiens
uccuccaugaauaucaguuauu

SEQ ID NO: 38254 - RNA, 14 nt, Homo sapiens
uaaaguucuaguga

SEQ ID NO: 38255 - RNA, 17 nt, Homo sapiens
uaaagcuuugugcagau

SEQ ID NO: 38256 - RNA, 16 nt, Homo sapiens
ugugaacccaaagugu

SEQ ID NO: 38257 - RNA, 13 nt, Homo sapiens
cauuaucagucca

SEQ ID NO: 38258 - RNA, 14 nt, Homo sapiens
cuagucucuaucau

SEQ ID NO: 38259 - RNA, 15 nt, Homo sapiens
gaauacauaaaguau

SEQ ID NO: 38260 - RNA, 20 nt, Homo sapiens
ggccugcucgcccacuuccu

SEQ ID NO: 38261 - RNA, 21 nt, Homo sapiens
uuuucaauaaaacuuuuccaa

SEQ ID NO: 38262 - RNA, 16 nt, Homo sapiens
uuauagccagguaccu

SEQ ID NO: 38263 - RNA, 23 nt, Homo sapiens
ucccagcuagaauucacuccacu

SEQ ID NO: 38264 - RNA, 17 nt, Homo sapiens
cagauaccaugaugcug

SEQ ID NO: 38265 - RNA, 15 nt, Homo sapiens
cagacucuggucaag

SEQ ID NO: 38266 - RNA, 19 nt, Homo sapiens
ugggccccagauaccauga

SEQ ID NO: 38267 - RNA, 16 nt, Homo sapiens
guaaagcuuugugcag

SEQ ID NO: 38268 - RNA, 21 nt, Homo sapiens
ccaugaugcugagcccggaaa

SEQ ID NO: 38269 - RNA, 16 nt, Homo sapiens
aaacaccucagcugcc

SEQ ID NO: 38270 - RNA, 18 nt, Homo sapiens
aggcacccccagaaugac

SEQ ID NO: 38271 - RNA, 15 nt, Homo sapiens
ucuaucccaaccucu

SEQ ID NO: 38272 - RNA, 20 nt, Homo sapiens
uuaauuuauugaggcuuuaa

SEQ ID NO: 38273 - RNA, 20 nt, Homo sapiens
ccugagacacaugggugcua

SEQ ID NO: 38274 - RNA, 16 nt, Homo sapiens
ccauuuuugaaaccaa

SEQ ID NO: 38275 - RNA, 15 nt, Homo sapiens
cuuccagggcuacgc

SEQ ID NO: 38276 - RNA, 17 nt, Homo sapiens
cagccuuggauacucca

(The sequence listing continues in the following parts.)

The invention claimed is:

1. An isolated nucleic acid selected from the group consisting of:
   (a) SEQ ID NO: 55663;
   (b) a DNA encoding the nucleic acid of (a), wherein the DNA is identical in length to (a); and
   (c) the complement of (a) or (b), wherein the complement is identical in length to the nucleic acid of (a) or (b).

2. A vector comprising a human insert, wherein the human insert consists of the nucleic acid of claim 1, and wherein the vector comprises no insert other than the nucleic acid of claim 1.

3. An oligonucleotide probe of 16-120 nucleotides in length, wherein the probe comprises the nucleic acid of claim 1.

4. An isolated nucleic acid selected from the group consisting of:
   (a) SEQ ID NO: 1485;
   (b) a DNA encoding the nucleic acid of (a), wherein the DNA is identical in length to (a); and
   (c) the complement of (a) or (b), wherein the complement is identical in length to the nucleic acid of (a) or (b).

5. A vector comprising a human insert, wherein the insert consists of the nucleic acid of claim 4, and wherein the vector comprises no other insert but the nucleic acid of claim 4.

6. An oligonucleotide probe of 16-120 nucleotides in length, wherein the probe comprises the nucleic acid of claim 4.

* * * * *